United States Patent 7,868,149 (PLANT GENOME SEQUENCE AND USES THEREOF) - sequence listing, part 91

SEQ ID NO: 47555 - DNA, 31874 bp, Oryza sativa
  unsure (1)..(31874): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaatggaataccgcttgccgcgaagacaattggtgcaatgctgaattcttgcttaggtggtaagtattggaccagaatactggaaacaagaactttcgatatagaaaacaacgacgttgacctgattacaaaaggttacagtggcctcatgacaactctgagattgagttacaagcacctacctgaaaacttgcagttttgcggcattttcccattaagttgcagtggcctgaccagacttgaaccaattttttcatgagtgatcacctttcggatcattgaattgtgagaaaggaacacttggtcggcggttcaaaggcggcaaagggtgaatatgagaaccttccggttggaaggcggcaaagtgtaatcacaacaatagcacaagcatacacaagtaagagtatgactctatgatgatgatgagccgttgaggagctgtccaatatcatggattagctgtgccctcaagttgtccacgctgtccatggtaacacctcgggccacaactccaagccaatgcgactctgatcctccagcagcgtggtttcgccaccaaccacagatcacctcagcacatttaatcatgtaaagggcacattcggttccattgttttgcttaggtgtcggagctttagtgcatttcgtctcaggaggtaggtaaggaagcagtgatgccgcaagacggcgtgcagctctcaaattagcatcaccaggactgctgtcatggtgggctaagcatggtctgcctccaaggttgcggtcaaacactaggaggctccagtgtgtaccttcacccaacagatggggatcctgactgttcactggaaaaaaggactagttttcgagaggggagtcctagactctgtagctgggttgacacaacagtagcatctgagtttcctagtagatgtgacattgcaggattcacaagcaacacatcttcgctgtcaattctatctgataacctgttgaaagcatggaccacaactgggtcagtgaaaaactcctgagagcaaagagagcgtaggtcatctatcgtcactcctgccgctgattcactgcttgttgggagagcctggggtgatagattttctgtgttgctgcttatcagagaactgctagcggggagagcctgcagtgtttcatctactgaacagccgccaatctgagaaccaacacttgtgggaagagcttgtggtgcttcattaattgtatcaccgtctatctgagcttgtgctgataaattttggtcaggcagcttaggatgattctccacaagttgattggtacaatcaagatcagtagcatctgaggagtttcctagcagatgtggcattgcaggattcacaagcaagacatattcgctgtcaattctatctgataacctgttcactgggtcagtgataaactcctgagagcaaaaagagtgtagatcatctatcgtcactcctgccgctgattcactgcttgttgggagagcctggagtgatagaccttctgtgttgttgcttatcggagaactgctagtggggagagcctgcggtgcttcatctactgaacagctgacaatctgagaactaatgtttgtgggaagagcttgtggtgattcatttattgtatcactgtctatctgagcttgtgctgataaatttcggtcaggcagcataggatgatgcttcacaagatgattggtacaatcaagatcaaaacgtcttgctttatgcattttcaacccaagctcctcctcgaggtatgaaaccagctcatcatagtatttctcctggtcctgtcatatgtaaatgaaataagttgacagttgaattgataagccaaatactatctgcctaataatatgcaaaggaatcgatacttacatcactcaaactccatcttaagaaaatttctggagcaactggaggacctccaagtttgcctccagatagacccttcttttttgtcaactgttgctgacctctcctgtgcactgcactgcgtggcgtgggctgtggctctcgaggcagtggaatatcctcctccccatcaccgccaagatctacatacaggacaccagctcaggtctcgtggtgggggtggtaatgcagtatgtttgaaaattccctccaaataagcatcgacatgaagataaaatgtgcttttcagaagatcatcaaaagtaagcaattctcttatgccacaatcgtggggattgtatctttgattgctaagagacctcataacctgttggctgattgaactccaattgacgattagcctcttgacccattcaaaaccatcacctaaccgtgaccccgtaccatgctccatggcatggcatatcctttttatgcaccattttgaattttgattccaaaaacattacgaccatcatgcccaatgaaatcttgaacccaattgggactcttctgttgctaggctgataagaggaaagataacgaaaacattttttgaacagttgcagattcagccatgtattttctgtcccatgtggggatatttccttatgatttccattgaacggaagcttatgacattgtgacgaattcatataactcccaagattatcatcagaccgcatctcataaatgcctctgttgttgaagaacccaacaagccagccagttctagcatcaatcactagtacaacgtattctgcttcatacctaaggacataatagaatgtcccgtggactggtgttgtatatagcatcattcggctatatgttaccctgaaagcagaattccacaggagccagaatctgtagtgcccctggcaatgtatgaagttctcaacaaattcatgttctgttccatcaagatatagagttactgtgttctgccaaaggaggatgaaggtaaaatagaaagatcagttcagttgcattcacaggttgaaaatgggtagatcaattcgttagcagaccgtaaattacaggagatagaaaaaaagtgatcgacgatcataccctcggtgtgagagctggtgttttctttttgcgcctgcccattatcaacactaagatacttcctccaacagcaacaaggtcagcaaattatcctctgcagccacagggaaggcgtagtaaaatcaaaataataattaagaactaaactacatcctaagaatcaaaacaaatcgtgctatggtaagaatcaaaattaactgtgctccctccagccgcagcagaaaccagccccaaacaataaaaagaaattgattttttttacaagaaacaagcccattgtggtgttctctccagccgcagcagattttttttttgttttggaatgcgcaaaagaattaagcatcaatcagccgcagcagcaatgcaccggcagcagcagaacaatttccaggagaccgacaagaaaaactggaaacaaaaccaaataatcgaaacaaaccgagtttcaaaataaaaggaatccccggccattctatgcaggataacatacaagaatggacctcgaacatctgctcctcctcaaacaaggcacaagcaagaagaagtatgggagccctagttacgacttggtgacacatttggctaatgcgaaatgagaaaatttttaaaggccatcccccgaatacccaccaaatcgaccaaacggtagctgccatcctagaggatattaacgatagagagttcacctttaagccgccttaattttcttccctttagctttgttcgccactctgttggtttttttcctagttgtttgtatttgctgctactatcctatgtgatgtaaaactcttctctatccttctaatatagccggcaattctcttgccgtttactgttaaaaaaagaaacaaaccgagttttctgattccagtgattcctcaagatcaccggcagaacaatatctcccgcgacgaggaccatacagaatagaaaggacaatgcagaagagaaaatgctgcagagaggagtccgaccccaacaaaatcaataactgatacaaagaaaaacaaaatcaaaacaagtcctaattttttcatcagaatcagctagttcagagatttcttgagctaacagttggattattctctatcaacaacacgatcttgcgacacaatgtccccaagaacttgcggcacaacgcccccaggcgatccagagcaaaacaagaagaagaaatgggagatcaaccccaagaactatagaactaaaggtgcagaacggcccgaactgatgcagcagaaaggagaagaccaaccccaagaacagagcaaaacatccaagaaacaagaattgtcgatgttctttcgaggctcaccggcggaatagtatcctccagaaactagatggcgggtgcgggcaggataggctgattcttccaaagtactggacaccgtgatcgtcgatgagtcgagctccctcggcttggttccgctgccgcgctgagcgggaacccgaagcttgaagacgattgttttttttttcctttcctttttttttccttgggaaaaatggttgtcttgggattgggcgcatctggtgcccctcttcttgataactgggccgggctaaacgagcatgttgggctcgctcagccgatccacacacccacaccctctctgtcccccaccgcgtcggccgccgccgccgccgccaccaccgccgccgccgtcgccgtcgatgcttgttcatccccaggcgccgccatcttcatcgacaggtggaacatccgccgctctgaccccgaacgatagcagcttgaacttgaagtgatagcggcgcatgccgccgagtggcggctggcgagaggacgcatggtcgagcgcgcccgtggggacgtcgtagccggcggcgaccaccgtgtgctgcctggcgtggagcggccacgaacgcgacgccgccccgtcgatgtaggtgaggtgggtgggggttggggggcaggtcgcgctccgccacccaagcgcgctttggtcgagctcgtcggtggcggcggagatggcgtcggggccatcgccccactccatgttcaccgccgcactatccaatcatccgtgccgcgggagatgatctcccggacgatgtcgcgcgcgtgagccttgccctccgagtccacggcgcggtccagccatgctcgcctcatgctcgatcgggtgcccagccgcttcaaactccgccgacatccctgcacgtcgagccacccccaggcgccgatgttgtccaccgcgctggtcacctcgaacgcctcgtcaagcgagcggccagccaccgccaatccggccatgatgcgcagtgagacgcgagagcggattgggattgggggaagggaggtggagaggctctaaccctcatcgagcgaaggtgcgggtggcggcgtgaaagcggagcgggcgagaccgatcgaggcgaggcaacggttcacgcgcgcggtggccgtgcagagcagcaccggcgcggcggcgcattggccgaggtggcggcggctggtggggaaaattgggatttcgcgtcgtggtcctcaaaattggatttcacccgaatgcaactgtacaggaggattcaataaaatatcactcttaattaaaggctaccttacataaaagttacgggccagtttaaattgctaccctaccaaaatttgctctggtagaatagcaaactaaacacctctattaaaacactacctatgctataaatttagctttgcccatgaacttgtctcttatggacatattttggcttcaatccaaataaacattttcaactttaccctaccaaaattttagtagtaccaaaacttgctcaaaatttggcactaccaaaaatctggtaaggcatgaatcctaacatgccctgcatctattacttttaccatcaatatcaaagagaatttaatttatcttgtgtgtaacaaatatcaaagagtatatacactcatggaaccaatgagtatccttctttcattcatcactcaacggtccagattgtctcggtgaaatctcaacgattgagatcgctcccacctcccacctccctcgattgcgcgctcctcttcgccccctctctatcgctctcacgcgccgccgcccctccccaaccccgactcacgcggcgccaccgccctcgactgtcgctgctccgccgtcttcgcatccgtcgtcaccgccaccgatccccgcgccaccgctgtagccgccgccctcgactgccgccgctccgccgtcatcgcatccgtcgtcccaccgccaccgattcacgtcgccgccgacgccttcctcgcctggtcgctgccgagaccttcctcacccccgcgattcccaaccctaaccgccgtcactgccaccgctagcccccgtcgaccgtcgcaccgtgccgcgccgcaccgtctcgcccttccaccaagcccccggactccaacgtcgccgctccacgccgccactccagccccgatccacgccgccgcagccgcatcaccgtttgtttccgccatgggggcgtgattccgcgcgacggctggaggaggcgaggtcgggcctgccctccatcgatggcggactccgcgtgacggctggaggaggcgaggtcgggcctgccctccatcgacgctccacgccgccgcagcccgcagccccgtcggcgccgttgctgcgtcgcttcatcgccgtcccgacctcgaaggagaaccggcttcgagtccctcgcgccgccactgatccagggctcctcaaccctgcaagccgtcgatcccgcctgtgaacaaggtaagagtgcttctcgatcccgttcctgtacatgaggaggcgacgcacagcgcgtgggagggcaggcggaggcgaggagaggcatggctgccgtctgccgggctcccgggcgcagcctcacagagctgcggcatccacgccggacggcgccgcggcgtggcggggcgcagccgcgcaggcgtgcagcacaggcgccaagcagggcaggggcagggcggatggcgcagcagcaccaagcagcaagcaaggcaagcagaagcagtagcagccatcaggccatcacgcccaatctcccatcagcagaaaatggacagaaagagaaaagggaaggcactggcatcacaaagaggttgtactttttttttatttgacaatttcagaacattgcaatttcaaagtgtacaaatttattactgaaattgcaattaaatattttatttttaggatgcttgtacattttgtttcactcattgctttttatcttatcaaactaatcaatctttgctatttgtttttcagattctacatatgtatctatcctcattagttcatatatgtgatgtacggctgaaagcttgaatcagtgaatcttgaggtatttttgagtacctacttttatatttacacttatttgcaaatggatgatgaattgtgaacttgtgattaagtgcttgtactatgacttgctgatataatgttacattgtacaatattgtgcattgaattttttttcttaattcttgttctgtgttaactctcgcgtgtggtagtttattggccacacctaaattttttttctgtcctccgccactgttcatagagatgcataatggctttaggaatcccctttgttgactaaatccccattgttcattattaaacattgttcactgtgcatggatatctgtgatgcaaaactctaatccaaagcctattttgcatttcaactaaatttcacgtgttaatctcattcgtgtggtaggatttttttttggggtttcattgttgtcattggatgagatacttcacatcttgttaacatttatcgtcaatctttcattgtaaaattgtggggaagaaatggcctatctcagataattctattgtgtcaatttttctatgtgattgcttatatctagcaaactgacttaacctttcatttcaaatgatttaatctataggacgaaaattcagattgccgaagaaaaattcaggctgacaggacaccatgtcaactgctattgtttgctgcacaatcaacgaaatttttggctgattctactaaatttctgtttggtataggtaatttcttccataatgattaccccttacaaatagtgcaaatgtatacttcgtgggtcaatcttcgcactgttgtagaatctgatgtttaaaattgcctgcatccggtttacaaatcaagaaaaaaaattgccctgattactgtgccaaccatattttctttgagggattgaccaatctttttcttggaaaagcttaaccctgttccaaacgtaatactgcaaaattttgctcaatttcacatgcacaccacagtgtagtcatgcattaatgattttgatttcacggtgtgacatgcacatcacattgtggacaagtacattgacagaccagcattttgatttcacatatattcttccctgttaaagcccggtcatcctaatcgatctgggatctaagaattagatggtatatgcagtacctttagtttttcttgcaattgactctaaattcttatgacgttcagttcatataaataactatatcctacagaatagatgaacctatttttctttctctagggcaaataactgaagagtgttggtatttgagttaaccactttttacgaacctaacctgctgcagttccacaaccatggatttaaatagattgttcatgtagttcctattttttcttgtatcctacgttcacagatcatttattaaattttccttgtatcctacgtttacagtgttgcatgaatcaggaaaaatctgattgaaggatctaatatttgaggactcctgctctgctgttgactacttcactccagttattcaaggtatcaaagttactctaaaacagtattaaacattatgttttgcattgttgaaaataaacaaatgttcactgtgcattattaaaaagtatgttttgcattgtgtctttgctttaatttgaataaagaaatgttcaccatgtaccgagctggactgaaattacttgaatggatcatcaccacccttgtctgaagtaaacagtacctacaacagataatgctaattgcgaatcattcttggcaattgactgcatttgtaattgattgttaattaattttaggcgcactatactgcaaatcatgtcagctttcctgagcatttgtaatgatcaatgattaaaacaaattattattattatttatcttcgtagcagcaagcttgagatattattggcaaatcatatccaaatctctgtcaattacgctttcatgcagcagatcagagtaaaggttagcaaatcatatccaaatctctgtcagatgctattttggcaatatttccatgtattacatgcccatacatgtcaactcacaagacatacaaggcaatattgttatgtctttccatagatatcatgatagcaacaatggtaacattatcctccttagcctatatatatgtgggtgaaggagtgtgatccaaaaaaaaattactgatcctccttagccggctgcatacgactgctcaacttcaactcatcatcttggtatcgttctccaagctatctcttatgtgttggaaattattatatactttagtttgcacctattgatctcctatttcttatgtattgtaataaggcatggcatccatggatgatgtggatttttcaccacatcaagccacacctaaggagtcaatgaactccaaggatgatgcgaaggtgcagccttcgtcagggcaaacaccaaacaaggggaattattacatggggcacgcgaatgccatcatgatgatgtttcaatacatacgtgatggttgccggcgtgttgagagttccatggaagactagaagtgcaagaaggtagaaaaaggacacggtgagaaaaggaaggtgggagaagggtatgatcctcgctggtcttctcccatcgagataacaatgaagatctgcaatgacgacgtctccgatgaagcaaccgagaaggaaacatgatttagtattgtcactactgtgttttggctttagaataaaataacatttcttgtgaattacacaagaaaattcagtaaacaatgtcgttcaggcctattcagtactgcttgtgaaatgcacaaccaaattcgatgaaactttgttgttatgatgcctattcagtattgcttgtgattgagttgatttctgggacctatacaaatgtgctctacctcctgttgaactactatgtatttgtttggcacggttggatgcatagcaatgttcctttatatttgttttccatgtctttttatataaggagacatcacacaccaattgtggtttagatctcacataaataaattaggtcggccaattttctgacgttgtgtagcactattgatttctgtaactcttttgctttagatcaaacacatgtaattcttttgctttagatcgaacacattttatttgcttcagggctccattaatttaaagagctgaccaatcacatgaatattgatttatgaacatgaaagcgtataaaaaaaaagcaaatataattaacataagaaaccagtatcgctaatttgctattatgttgcctattcagtcatgataaaggagtaaaggactgctagatgtcaaacttatgtgtatggtccaaatcctgtaatggcccattaacaactaaaatacccattataaatacttatatgcaatactcaacctaagtgcctttgatctgtcacgtttatcatatatcttaaggcacagatatatgcattatcatatatctttaatatcatattattatgcattatgacatggggcacaaatatattggtatatcctattctaatattttacttgcaatatatttgatgtatgatataaattgaattaaagctcaaatgcacagttaatataataatattttttgctaaacatgaaaattttaaaaattattaaagacaaatagagttgcaccgtagcgtttagcacgggtatattactagttaaaataactcatcgagttatgatcaagcatttaatttacctcttcatttaaatcttaaattcataaagactacaaataaaaataacttatttgaaaaaactcaaatatgaaataaatctaactcttgtggatggagggaatatttcgaataaaattgccgctgactctccttttcaagcttatctcctaactccggcttgctcattggtgatgagctgatgatgggctcgagtgtgggaaggtagcaaccttcacctcctttgttgcctcggttttgtcgctctggcgcaacccccatggccgatgtctacctagcaccatggccgttgcacaccgcatagaaaagtcacatcatctttatctttttgtcctcgtagcttgaccagtccatggccgttggcaagcccaaggactttccataacggccgctgcatccgcaagctcctttgcgtccccctcccacctccaccataaaagtcttggacgccacgcggtagctcatccatacctagggcatgggggatgcttatgttcgagtgtcccgaggagtgcgtggaagctgctgggatggtgggtgccatcgtgcagctcacgaaggcactgaggtcgttatcaccattgctattggctacctcattgccaccgagaggagaagggggcaccaaagagtggtgtgtagctcacgtgacgcggctagagaggagctccgccacctcatggttgtggtgcagcttgatgtgagcgggctcttcagctcggcgccatggcatttagtggtagttgataagggcatccatcaccggagcgagaaagaagagatggcctatagagaacccatgttgttgaaagtgttattttatcgaatcctttttgcacagtggtatttaggcgaaacctatttttgagggtggcataatcccaaatttctcatgcataggggaacagaagtttgcctatgagaatattgactactgtgatgtccctccattgtgatatcttaaaattacttgtaattttatattgtttggcatgatattcagcttaaaatcacttgagacttctttggttccataaaaatattgaatgggatttagtatgaaactaatctcctcaattctctccgacctgtctcctgtaatgaacattgtttatgcttttttagtaaaaaggctggcgcagagcctttgatttataaaattctctccaatctctccctaagcctattggcccataaggatattgaaagggacttgatgtggatttaatccccccacaatcctctccggtcctttttcttgggaattgaaaatatttttgacgagtatttattaaactggtgatccttgtataaatattactgattgaaccagcaaccgtagttttattttaaattgttgatttaattcgtgtgccatgtccattttccagatatggtgagttaaagattttcctttttaagtatatagtgatttagtggcatggaatggggattggggaagaaaatgtctttgctcagaaaggtccgcacttccacaagattaactccttcatgctagcatgatatgttttatgctagcatgatgtgttgatgtttttttggttagcatgatgttattgaacaaaactgtatgagttcattaacttctcatgcctctttctagcttgtagacattgacgattaatgagaaacgtccaggggtcttccggctagctccataaggtggtgggctagatgatctgggttcgaagcctcacctcttctaattatttgatattaggttcttccctaatattcgcgtttttgacattggcgattaatttgcaacgttgaaaagcatgagtgaacgcgtgctacttatctctgatgtggcgtactttaaaagagacagcgttggagctagggaagaagcggagggggagatgccggggatggaagaggagtatggcggaggaggaaggagtggaagatgcagatattttcaacaactgactaccaactaattgtttcctactatcttaagcttcctaaatgggtctcaataacatatgtttcttttaccaaattgattaacaaagtaaaggggaaaaaacaccaataggctactgtgacatcaaatctgaccaaacaacatgcacatctatattggcgaaataatgttggatccgttgaatagaacctgcatgagtggtagccttgaaggcacaatagcgatggatttgattggatccattttcgccggcggccgctaccacaggcgtaatcttgaaatcaagaatcaacacagtgcgcagctgcacagcaaccacgaagtttctgagttttgatggattaacaatggtgccatcgaagagcttgatttcctcaggtatttgactgacaaagcaagagatggataagtgtatgccgccatgaattagcttcggaatcttaatttgtatggtgctttccttcccattgcgaagaagggctaagctgatatccacggcgccatggatgccatggatccgccgactatacaccccatgaaatggtgtaaggtcgctgaaggcggccaccccgtcgatgagctgcaagtcgtccttttcgtcctctcctttcttgatcttgaggtcgtactcgatcacagcaggattttccagcgagatgcctcgcttaggacctgacaatcttataagcgagttgggatcagagtagtggccaggcaagacgaaaggatcatcccggccgcggttgaagatgtagttgcgcagggggtcaaagagatcccgggcagccatgaagccatagatctggaccggggcgtcggcggcggcgttggacagagctgctatcttgatggagaagatttgcatcatgcggcagccatggtggacgatgcaagccgtccagcatggctggcaatggtcggtccgagccgacagcctcatcggcagcaggctagtctcgcgggtgtcgtcgaggcagtagaggctgtggaacgggtgggagtcggggtcgtagatggatccgtcgctgtgcttgacgccgatgagctcggaggcttccatcatgtcgtcgtcttcgtcgatgtcgtacaagaattcctcctcttcctcatcatactcccaattgttctcctcctcctcctgctgctggtcatacttcttccccgttttgattggagcgagggaacaaggaataaccaacgcgttcttctcttcgttctcatgtgatgacgactccggcggctggcaatcgccggcgccgcctcccttgtccatggatcgatcgatcgatcgactgaatcaccctccggctgggacgctgggtgcgtggtttgtttgggggtcatgggattagcttgttgctgccttttatctgatctgatgggaaacaaaccgtgtccgattccgaccggtgaaccgtctccgagtctagcgactccgtcgtccctttcccggttttaccgtcgtcacgtcctgtgccctggtgtttggagtggcggctgcgtcacggatcatccgactggtaaaaaaagaggaaagtcagggctgccttaatccgcaaagctgccgagggaccgacccgtggaatttgctatatatttgtcgcgtgattttttttctacgtattttgtcgttttttcgaccgtatgatctgcgccgcgatttgtgctgatttcaaaggttgctaaatgcaactgggccaccatttccttccggcccaattatccttcctccctcctggcccgacatttcctcctctttctttcctcaccccagcccagcccatctctacaagccgcctccatccttccccttagcaaggccggcccatcctcccatcctctctccggccagccaaagcaccaccaccttccttttttctccccggaataagtccactttcgatcacccacgcgagtttgaatcacgtcctttgaaccgtaataatagaaatcataaccacatctttcataactaagaaaaaaaatctttcataactaggttaaataaggtcctgagacagtacaagtgattgttttgattgatgtggcatcctagtcgacaaatagaaaatcaaaaaaaaatgtgaagcccatatgtaaagtggactccacctctccctacttatcccctctcttccccaacaactcgtcggcgacgagaggagaggcgaccagcgagcccgtttgcgtgaggtggcagttgcggttagaggttggcgatgccactggtgtgtagctcaagctcgccgtccacgggaaggtggcggtggtggtgggcaaccggagaggatggggccgcagctgtttgcaagtgaccaagtcatcgttccgcccatttcaacactactgtcaaatttaaagttagcatatctctggactatagaatagagtaaacacaaattttgtttctggtcctgctgattcaacaatatcattccatatttccatttaaactttgcagccaaaataaaacctcaactactactatttaccctctcaacctccacactaaagttgttctaccagcagcgcgcacactttattctctcctctttatgtcagcattgacgaagcactgtctgtcatagtggcatatcttaagctgtggtacttgctatctttcttccctgatgtttgttcagttgagcagcatgtgcatgcttcacttcagcatcagtttgacatctctgaaaaggcctcacacctgccggattcctatgacaaaaaaaaaaaaaaggatcaacaatggctgaaggataatctgctccaggcttcatctttcacgcaaaaaataactatttttcaatcaagtttttatttttttaaaaaaatgttttcccattcatcaacatcagttcgtttcattgccgtttattaacttcagtgctggagtgattttatagtctttaagggtaccatatttccaccgtacatttgatatctcacggtactaagagatatatatatcatatttgcactaaatgttttggtatctcttggtaccttttaataactgtaaaatttctctcagcactgtacgtaggtttgcatgtatgttttgatttggcctgtttcagattgtagtttgtacgaatttgatgagaaacagtttcgaattactacaaatctgatgaaatcgccgcgaaccgtacagaaacttaagtaaagtattagtggtacctgatgaaatctgcaagaacaagaacatccctgtcagagggagtaagacaggagtgtactggagtacagtgtactcaacatcatatttaaagcaaacactgtaaaaacattgcctgctccaaaatccaaatcagtgtcttcacagtacagaagtgcctgacaaagctgacagattcttgtgttctgcatgtgtagattcgatcaggaatgccataatggcatggatcgcgtttctttatcatcagatcatcacttctactctaaacaacagtacgattggtcctgctcctacacatcaccagctagtagatcacaaaactgaaataaaaacagcttgaatttgcatcagttaatgttcgataggttgtaaaatgcaataagatgtccttccattctgcgcatttctcaaaaaacagataattttctcagcttacagcattagtttttctttaaaagaacattaccggccgtatatatttttttcaacaaaccaaattaaacccatcatctctttgaaattgccaatttttttggcatgatcgaattaaatcccccccccccccccccccaaaaaaaacaactaaagcaatgaaattgatgaaaaccataaacttcagatgctacgaaaccattttgcctaatccaatatgaatgtggtgcgatttggagcaatagacatcatcgttgttcatgaaatgtaccgtagacaataacatgatataacctagaaaatgaggagatcctttcttgcttccaaaactctctttcctatttgcaaattatcacatcattgatctcacaccaatacaagtagattatctagttcatcagttctaatcccaatctgccggccagaaaaagctgaggatcctatgccacgtacagacagcagaggtaaaacaagcaacccaatcaagaagctggacaaagctgtttgccacaaagctcagctttggcctcttgtaatcatgtacgcaagtacggaggttaagaaaaaaaattctttgtgctaatcatgctgttataaactcgttccgtcacaagctagcacacctatatgagataaacatcccgtgtgaaagtatatcctgcgccaaaattccttaccacattccggtgtttcaagtgtataatcattaccttccaatttcccaattatacttacaagacacgcacatatattacacatgctaaaaagacataatccaaccacaaatattctgatgtatgatctcaccacattactacgaaagcattatcatccggagtattatgtttggtatcgaaggtatcaaatctggtacttatgatgatatcgtgcaatggtataccattcgtactcgctctagtaagtctgagaaaagaagatcgagttccttcacaaaaatagagttgagacattaggcgtgctgtttcagtttattatccctgcatctgcgtatttggatacatgaataaattgcattcagaattagaccgtgaaacgaccgacccggcgagattatcttcttggttaactttggtacgtaatgagagaaacatggattgtacgacttttaatgcgtaggtatggtgtgagatgatgatttgctgccgtagtgaagtttactcccataatctccaccacgtgtacgcccttgactggaccgacctgaagagagtttatctaatttactgacaaatttggtttaagcaagcaatcacaaatgaatcacaccgtgctgttctaagatgtttatgtcctcaacgtcgtcaagtcatatatagtaatagctaaatgctgtggatagatataaattaatgtgtactccctccgtccaataaaaaacgaatctagaatgatgtgacatatttcagtactatccagattcgtactaatagaatgagtcatatctagtattatgttggttttttatgagaccgagagagtacttgatgtttagaacattaagggcttgtttagttggtaaaagaatttgcccttacatgtcacatcggatataaggacagacatttaaagtattaaacgtggtctaataacaaaacaaattacagattccaccaggaaactgcgagatgaatttattaagactaattaatctgtcattagcaaatgtttaatgtagcaccacattatcaaatcatggcgcaattagacttaaaagatttgtctcgcaatttcctggcgaactgtgtaattggttttttttctacatttaataatccatacatgtgtctaaacatttaatgtgacagtgtaaaaaaattgtttggaaactaaataggtcctgattgtgaggttttcacaacaatgtgtccatgtggatgctttttgtatgatgaccttgtattttagagatgaagtaagataggaccaatatgtacaaggactagtttaaaataattgaactaatagctggtataaaaatatccaatagagttagttaaagtgatagattatttattatcaccattattgtctgaagtatagatacaaccgttggatgcatcatcacgaaaacatttttccccttctccatacaactccaattgttccttcaaatcattaatgatttatatctattttcttttattggtcatccaatacatttatctagatgctgccaatgcaacctggcttgcataggtcccttttaatgcaacaggagactccacactaatactgttcctaattcctgcatctgtttttacaaaagatgatcgagcagctctgaagaagatttgttaatagttcatggatcacaaagcaaggcatctcaggcatctggtgccatgcatgcatttcatctgggctatgtggttgaagccctgcacaagtatgcatgttcagatgtttcagtttctgtacatgttcaggcagaaagctagccagtcccaagttatattcagacattcagtgcccagttcagttgctgttgcccaaactccattgtagcagtgtgcaggtttacatggagcttggcaggcagaccacatgcatccatgcatggatcaggaactcatggtgcagtgcatataaacatggagacaaaagcagcaatcaggtcgagaagagaagataagccttcgcttctctgttggatcatacatgatgtggacatagattttcatcctttcgaagggttctcttacatatcacttaaatatttttttaaaaaaaataaaaaaactaagatatacacgtacaatttaactattacaagttgtaacaaaaataacaaatttcaggtatttgttactctctccgtcctaaaatataagaacctagaactggatggaacatttcctagtactactatccagattcgtagtactagcaaatatcccatccagtcctaggttcttatattttgggacggaatgagtatttgagaaaaatacaaaaaagatattgacaaaacaccaaaatctaaaaaaaataccatcgataagtgtgattctataaaacatcattgtacaaatgactttgtcttaaaaatatcatcgtatcctatagcacttaaggatggttaataatgtaaccctaacgaagatgtcatttttaagtcaaagccacttgtccgatgacatttttttttgcaactcgcacttgtcaatgtcattttttaagaattggacgtttgttaatgatattttttggattttctcttgttgtttttatcacaggtcgaaatctatagagcgatatatctcatattgatttattttaatttttttaaaaaaataatgactatttaagtgatatgaactagtgtctctttatggatggaaacatttttccctgcgtgatacaccagttctacgctcagtgctactaggaggctagcagccacttgctgctgctagagcccaaagaacagtactgtcagttcagatcagttgcaacttgcaaggtctccatcttagtggagtactttagttattcgatcctataaaggtactccctccgtaccctaatataagaggtttttgtgattttacttgcacttgcactttaactattcatcttattttaaaaaattagaattattatttattttatttgtgacttactttattatccaaaatattttaaacgcaattttttgttttttatatttgcataaattttttgaataagatgagtggtccaagtaaaatatcaaaatcgattatattaggggacggaggaagtaattacaaagtctaaaggaatgaaatctccagctagataataaaaaaagtgtgttcttttgttttaagcaggtttggtctgaggtgacaaagactgtctgttagaagtttgcaatgcccatacttttacaaaccccttcatgattagcgattttaatccacaagtctgaataaattccagcatgtctgatgtagctcatagaagcatttcagcttgtcttaatttttttctgtcctcatttttttaatcaaatgactatttcattgtacagtcgtaaagccatttcaaccacagtaatctgctggtaatttttttaatgtcatataaatttcataggtagtgatattactgctgatttcccaccattcaactttcttaaattaatgcctaatatatcatgattatttttgctggcattggtctctttaagcatgtgggatgtatatttgtgggtgtgagtgtggtgagcgtgcgtgtgtcttatcaataatgtaattttaaatttttttatataaactattttataattttttaagtaaatttcatgaaacctcacatgttatgatttaagttgcacaaaatcacaacggctctggtacatggcatataaccatagatattacggtcataagatttcaccaataaaaatagttaacttacctacaatatttaaatgatggattaaaagaattcatatatttcggaacttgtatgcatgtatggtagatcaaagaaaatttagttaatggtgtatataaaactaaatgtcatagtaccagcattacgtgcaagtgtgcaacatgccaaaactccaatagttttatgcaaattggatcataacatcgtggttacgtgaaatttactactatctctgtcttaaaatataacaacttaatactcggatgttatatatcttagcaatgtaaatcttgacatgagacatatatccataataagtagcagtacatattgtgggatagggcgagtagtttttttaaaaaaaaaaacgaaacggtttaaaaactaatccatagttagcaagtggttaagtgagcaaccgtttccatcaaagacggggcaaaagtgagcggggaagacgacacctccgcagctcggcgcacaaagcctgcaggaaacccatcacctgtaaccaatccttccatcttctctgccttctccttcgcttcaccacctcgccaaaaccgccttcccttcccttctcttcccttccaacctctcgttgcggtttgcgctagaaaaaaaagagaggagagatttcaagaaaccgtgggggagaaagaagcaggcaagaagtagcagcagcagcgagtgaggctaatctggtcagtttcagaacagattctttgttcggtctctatccattgcaagaacaggttttgttttttcttttccctttttttgggatcagagtctctccatttctgatgctgctgctgctgctgatgatgatgatgatgcaaggcttgtggcaacttgtttggtgaaagaacaacgagagggatactgggatagggatcaaaggcaaaggtttttgtttttaccccgtggtaattgttcgttcggtttgtgatgggatagttgctgggactgtgaatcattttgccccttcttatcatacagacaggcgcgtgatttgaccagcttgtcgtctctgctctgcctctatccatccatccattcatacatccaaccttgggggttcttgattctttttctcatttcttggggaggcttaattgttgctatcgccctccgcttcaggtgtccatttgaattcttcgtcgtttctttcgtatttaattgccatttgctgatttgcctctttatttcggtgggttttatggtaataaaggtgtggttcctttatcatcaaatttgaggtgttctgggttttctttggttcttttttggagcactggatttgtgtgctcttgtaaatcaaatagagtttgtggtttggttcgtattttacacaatcgagttgtgtttttattttagtttgtatcgaaatatttgcatacttgtttctagttccttcaggcttcagttctcttcattattataaaaaaaaatttggtcctttcgtccataatttttttcacaattccatttttgaatgtatgagcttgaattatgtgacttttcagtttgagcttgggattgtcaccttttcatggacgggaccaacaaccatggagcactgatggacgattggatgcttccctcacccagtccaagaacactcatgtcgagtttcttgaacgaagaattcagctccggtcccttttcagacattttctgtgataatggcagtaacaaacatcaggatggacttgggaagagcaaagctttcatcgattcaagccgggaagaaactgctcagctagcaaaaaagtttgaatcaaacctttttggtgccaaccagaaatcaagctcaaatggctgtctgtcagagaggatggctgcaaggacaggttttggtgtcctgaaaattgatacatctcgtgtcggttattctacaccgattcggtctccggtgacgatcccgcccggtgtgagtccaagggaacttcttgagtcgccggtttttcttccgaacgccattgtaagtgacttcctcacctcaatcagtatttgctctgtgtaatgttcagttactctactcatgtggtttatatggaggatatatttgtcagtaaatggtgaaatctaaaccaagatacctattataaaaaatattctaacgcaagatacagcatctttaatttctcttatgtctctgcagcttcgtataattagtggaattttggagaagaaagtgactatatatgttgatgactgattaatcttaatgtcatggttttgatttatgcaggcacaaccttctcctaccactggcaaactgccatttttgatgcatagtaatgttaaaccatcgatccctaaaaaaactgaagatgaaacacgccatgatcgtgtattcttctttcaacccattttgggatctaagccaccaacttgtccagttgcagagaaggtagttttctcaaacaatgttgttctattccctatttactgcaaatctgtaatcactgctcgcctgctcggcgcagtttgttttactgttccagcaaatctgacgagcaaaatcaaattatcagtgttttttatgcattggtctgatgatatttatacttttcagggtttcagtgttaatcatcaaaaccagccttcagtgacggataatcaccaggagctcagtcttcagtctagctcaactgcagccaaggatttcacttcagcaactattgttaaacctaagacatctgattccatgttagacaatgatgatcacccttcccctgcaaatgatcaagaagagaatgcaacaaacaaaaatgaagagtattcttcagacctgatcattacccctgctgaggatggatataactggaggaaatatggacagaagcaagttaagaacagtgagcatcccagaagctactacaaatgcactttcacgaattgcgctgtcaagaaggtggagcgttctcaagatggccaaataacagagatagtctacaaaggttctcacaatcaccctttgccgccttccaaccgccgaccaaatgttcctttctcacacttcaatgatctgagagatgatcactctgagaaatttggttccaagtctggtcaggccacagcaacttcatgggagaatgccgcaaatggacacctccaagatgtcggtagtgaagttctgacaaaactgtctgcttctcttacgacaacagaacatgctgaaaaatctgttatggacaaacaagaagctgtggatatctcatcgacgctctccaatgaagaggatgatagggtaacgcatcgtgccccgctttctctgggctttgatgcgaacgatgactatgttgaacacaagagaaggttggctagccttagtcactaatcactcaatgaaccaatcttcactttgagtagctgattgttttccttcaattttattcatttcagaaagatggatgtttatgccgctactagcactagcaccaacgccatcgacataggagctgtggcgtcaagagctatccgggagcctcgcgttgttgttcagaccacaagtgaggttgacatccttgatgatggttaccgttggcgcaagtatgggcagaaagttgtcaaaggaaacccaaatccaaggtcaattctaatgccatttttctcttttggaacaaattctttgcagttcctctaatccttcactacaaaagtaaatgtttagcttcacaatatgacactgtcatcgaaggaacatttctctgtccatatgtgtgcatccatagttggtacaaagaccggaaattactcgcattatctaaaaaactccattttgtatttgcaggagctactacaagtgcactcatccgggttgctcggtgcgcaagcatgtggagcgatcatcgcatgatctgaaatccgtcatcacgacgtatgaaggaaagcacaaccatgaagttccagctgccaggaacagtggccacccaagctcaggctcagccgctgcaccacaggctaccaatggtcttcttcaccggagacctgaaccggcacaaggtggtggtggtggtagccttgctcagtttggctatggctcagctggtcacagaccagcagagcagtttggtgcagcagcagctggtttctcctttggaatgctgcctcgtagcattgcaactccggcgccgtctccggcgatcgccgtgccggcgatgcaggggtacccagggcttgtgctgccgagaggtgagatgaaggtgaacttgctgccacagtctgggaatgctggtgcagcagctagccagcagctgatgggcaggttgccaaagcagcatcctcagatgtaaaaatggcaggaacatgagacaaatggtgtttgctgcttatgtatatgaaacatttttggtgcttttgttaggagaatggagtgttattgtagctcaatttactttcgggggaaaaaaaagcagatagttcaggcaattgtaggtagtagaggttctagaaaagataaatggctttggctgagttctaaataacttcctcctttttcattagcatgtttactggattgctaaactatatattttctgtaaaaaagattatatagtatttttaaaatttataatacatactttaattatgcgctaatgatcccccttgttttccaaggcgtctacagctacagccgaactcagcctcagccttaataagatcagaacttctgcgttgacatcttaggctgactggttttacaatcaacaaattcaatcttgaattctgggagcaaaaaactgcagcaaaaaaaaaggtattttataactttacaggagtaactggtccgcagatttgcattatccagtaattgacgtgcagcagaagatcggacagaaacaataaacagtcaccatttgcaatgcttttttgcgggacagaccaaagtgtacccagtatactgtcatgtcagaacttcgaaacagtcaacgctaacaaaagcgaatcacaccatcaccgcttatatattttctctgcacaaaaatgtgcatatgtggcaactccaagaaactttacatttgacgaggatattttttgagtgaggaggttttaagttaaccctaatcatgttgaaatgtcactttataaatttggtatttctcttcactaaaacgtacaaccaaaacttcagcacttctttttgctcagtggccattaacagctgactgctggaaattctctctttgataaatggctttccaccgctcaagctcttccctgcgaaataatataaacaccagaagttagaaatgggaggagaaattgacccctttctttgggaggagggccagttgcagacaattgcttatactgttgtacaatatcaggttctctaatgcactgttatatagtcgactgcgttagtgctatattatcttatgatgtatgatacaaaagataattgccaatcttgtaggatacaattgtttagctgattattgtgtttctaatgaagcaattaatatatgatcacttatacaaggctactttgtttaagtaattatttttgtagaccactgtctacacctgaacagaatgtacagatgggacaagtgcactgacattgagtatgggagccaaaggagacaaaaaagatcaattaatctgcttgggcatgtttttagattgtttagatctgggaaatatgtgcatagatacagatcattgtttatgtctaagctctactgaaattagctagtcccgatcacttatttgagtttgaccttaaggaacttgatcccaacacagttattaaagaaatcattaagtatcggaaagaacaaaagttgtgtatatatagtccacatcgtataatggataagctaagtcttgtgtaccgaggtggtaaattcaagtgccattgggcagttggggccaattgagttatctagtttccccaaggcaattagctgttccaattattggttcacatccaaaaagaagcagccactgcaattcaataaatgaaagaaaaaaatacaagaaggattaccttaagcaccaccctattgaatcataatgaagaaggccaaggaccttacgtcttccatcattcctacggccagccctccgttttaccactggaagttgcttgatacctttcacttccatgagcaccttagcagtgctcagatctgtatctggaaagcaggtcactagtcctctttcattgccgtggtactgaaaccctctagtgaggcatgatgaaacaagagaagaatttgcctgaaacaattaaagcatgtaagtatgtgcatcgctaatttcgatattactataagggcctgtttggataggggtgttcaaatttaaatactttggttataagtttaactgcacgtctgcatcctataaaattccagatccaaagcatcccttaaaacggcaattgctaaattaaattataggctttaaaggtgtgagattttgcatacatccaaagtagatgaatttgccccattccgtggagtatcttcacttaattcagattcaaatcctttacggcgaatgtcaccaatcgtaacaattccttcaagaaaatcttcactgtctactacaagaacacaattttgctgcttatcatgcataagccttgttgcctccttgatagtcactgtaggtgtaaccttaataaattgctttgacattgcttgtgatacctggaacactcgttgttagaaagctgaatgaccacaaaaatatatcaaatttactaaggatgaacttgacaaaataataaagagaatgtagaaaagaggcatggaacctttaaatcatcaagaagcatatcctcattgttaataccatagcggtagggatcatcgtctagaattgcaagttcaacgtcatctctgtctggtcgtctccggtctgtctcattcctatctgtaggaggtaatagtgaagaataaccatgccgaggagatgtagcctcaaacgcctctttgttgccagacattacaacagatggcacccatattgctaaaccaacagctccctgtaaattaaaaataagggtgagcttatgtcacaaggagtgtgcaaactttcatgcttagaagcaaaatagcaaatatatgggatgagacatcaccatcagaggcagtaaaattctgtaatcttttgttagttcgaatagtagtagtactgaagtcaatggaactgagcagactgatgctagtgtggcagccattcccacctgaattaagcagacagtcagtatacttcgtttctatcaaactttaggctaccttcctagctcaaaaaaggaaacttactagtgcataagcttgagggtgtgcaacagcagtgttacccgggatggcagagtttattagttctgctgctgagcctccaaatacagcaccaacagcagcaccaatcatcaagcttggagcataaaggccaccaacaagaccagaacccttgcagagtgcagttgctacaacttttgcagcagccaactgagctaagagccagattccaggggctgaggcactttttccagtatgtaaaatttcatcaacattggtgaagccccagtacagtattccagggtaccttagagctattaaacctgctccaagaccccctaacgcagggcatactacagcagggaggctgaatttcttccttatcaagtcaaaagtctttgtgaaccaaaccaccaactgtctgaatgccacactcactaccccacaaagcatgcctaggataaggtagagtggtaactctgcagaatataacattagtgatttagttggttgcatatttaccagttagacatatcaacatgaaaacagtaatagatacacagttcggcgttcacgtcacagatataccagaacttcaaactattcaattgtgaatggcaagaaaacaagatcggaacaataagaagctgctaaaactaacgtgttgatggtaagggaaccaaccacaaaacttcaaaaccatgagcatatacaagtgtataaatgcgtgatgcatatataaaatagattataaaggcaggatatcacgagtcctctgctatagtagtaagaacaaaaaaaaatctactcaagttcaatacctaactaagcaaaatccaccttcagtaataccaggtttgatcagaataagataaaataccagcagcagattttagttcatacgtcgggacaataaaagctgccttctcccctagcaaaacattggacacagttgatgatataactgatgccaatataatcatagcagtggtaaatggcggtgaattctctgctcgaagtggcctcagtactgtttcaatagcaaaaaaacatccagcaaccgcagcattaaaacctaaagacaaagcaacacaagtgtcaggagagaataaagaaaaaagcattggcctgaagatactggatgttaaagagatgaaattgcaaagatacgtggtacaacaaagatctatagtattgtatttgtagttccagttgcttgcagaattagtttatcttccttttcttgttaacttgtactaacatcttataatgctaaaaggcagtgggaaacgattccaatctgttgcaattcccagatgaatgtaaaaaaatcaaacagatgatgattatttaaaattacctgaagcaatcccagcagctgatccggcagcaacaagagcaattctccgttccctattgttctccatcatttcagcacatccatatgcacaagatttaccaatatcaacgcttggcccttctggccccaatgaacatcccgtccctagagtaattgcagcttgtattgctttgattgtaggaaaaatcgcagccatgaaatcaacaccttccctttgagatgataatgattgttttatctgctcaaatatctccagtaatccgtgcatcataccaacaacaactccaccagtcactggaattaacaatatcctatgccatgtatcagcaagtctctggaggcgaagccaagcagctccctctgtgggtgtgcctgcccatgcccattcatgtatgatatgcacctgaaaagaatagttagccactattgaaccagcagattggtatatgagaaaagtacaaacaggaaacttttggtttagaaatgatcatctaaacttgattggatagctcccgcttaacagatctaagttatttcaaggaaagagccttttctagtaactttaagaaatgggggttcgattaattgcagttcagtcaaagtaaaataggcacatactgtattaacccggtaggacttttctgagtttctatctgatcaattcagatctatgaagtattcagagaacacaaacaatgcaccaaaattgccagcaagtagacataatctagtaaacctcagcagattataataccacgcaagattcgttttcacctaaacccatgccataagaggaagactttaactagcaaagacctcatgtttgtatcaactatccccgtggcatcaaatttcacatgaagaaaatacattatcatctccacgaaacaccctaaacggcaggataaagtaaatgtacagtccatattctcacacgagaaaatggacatttagccacgttcaaaacatggcttcgctagaatgccatcccgaaaacgcgtttcgctaaaatgccaatatgaaacgcgtgctcactgccactttgccattttagcccttttgtgcattttcgaaatcatttttgctcctccaccgggcgatgagacaaaattgcccttcatgtcctccgtcgccgctgttgaggaagaggagctcgtcctcgctggccaatctccatgtccaccacaagcagctcaccgtcttcctcccagacggcgaggtggccggcgagtcttccgacatcttcctctccctcgacctcgccacctccgccgactacctcgccgcggtcgacgacggtctccgacgaggtcgcttcactgcggttgacgacggcggctagggtttcgaggcggccccatgttctcgccggtgacggaggcgaaggggcggcccatggccttgccagtgacgaaggcgaagggggatgcggtggagaggcagcagcagctgctggtgagcctcgccggcaacagaggcggagggggacgcggtggaaaggcagcagcagttgctggcgagcctcgccggcgatggaggcggagggggacgcggtggagaggcagcagcagttgctggtgagatggagcgcaagcctccgccgccgcgaggcctccttgacgacctcgcctccgcctccgcctccgccttgttggtgctgtccggcggcggcggccaggggcagccgccggtggttccatcactccgcgcacccgcacacccaaatgccctcgtcggcagtggcggtgggctcatccagcggcgttgccggccatcccgccctcgtcgacggcggctacggaaggggaaggatggtggatggaagggcattttcgtctcattacccactgaagaagcgaaaatgatttcgaaaatacacaaaagggccaaaatggcaaagtggcggtgagcacacgctttatattggtattttagcgaaacacgttttcaagattgcattctagcgaaaccctgttttgaacgtggctaaatgtccattttctcattctca

SEQ ID NO: 47556 - DNA, 26420 bp, Oryza sativa
tttccccacgcagatctctcacttacccgcgggttgaacgcagcgacgcagatgccggtggcgaggccgaggaggcagccgacgagcagcagcgcccactcgggcggcgcgccgtccccgagctcgtcgctgtcctcggacccgggctccccgccgccgccgccctgggggacgccgccgcgccctccgctgcgtggcggtggtgccgcccccggctggacagccggcggtccaggctccgcagcagctcgcgcacgcggctcctcctcggcgtcgacggcgagtccgggtccgccgacgacggcagcgcccccgcccccgaccgcagcggctccaggtcgctcgcctgcgccatcatgccccgccgcgtgcgagcgagggggatctagaaccgaggcgatcgcatcggagtaggggaaggggaggatctcgcggcggatctcgccggtggcctcgatctcgtcggcggttgggggtggcgatggcgagaggtgaggtaggagaaggggaaggcacgttcgcgcgtggcggtttttgcagattagccctcgagagagtttgtagttgcaattggtgggtgggaggtttggttgggccgggttgcacttgggcctagtggacacctgccaggtccattcactatggttggcttaggttggcataaaaccacttgaacatgttctttttttttcaaaccattaatcacttgaagtttgatattcacctcacaagctattttgtcgcaaatacccactaccctacttagttttttttttcaaaactcaccctagtatgcacatgcttaaatccaatcaacatttcgtaaattgtgagttatcaatgtggtcgctaccaaattaaatacttctacaagtatagtctcgatgtatttttggagattccacgagtagaattgccaatgaaaatttaaatgtcgcactgagtttctctatataaaaagaaaatcaatgaaacatgaaaagtaagtctaatacaagtacttggataagatgactaaggtagtttagcctatgggtggctctacattagtgaaaataagatgaggttaagcatgtgccaatggggtggtctttgcaataaaactaaataggggtgggcatttgcaacaaacttacctatgtggtggaatgtaaaacttcagacaacttatgggtgttttttttatggctttggaaattggattgcagagggaaaatatcgatattgtgcttggattagcttcctataaaatttttttaaatgaaatttagtttttacgaataattttgtgcttgtttacttaccttcttagcaatcatgaaaataaacctatgcactaaagtggcgaagaaatcataaaatcgaatttcaaattttaaatcaacgatggtatttgtttcctgtgtcatgacgaaacagtttggatgttttgcaatattttctgttttacctgtcccacattattgcttggagtatttgcttagcacgtcataatttcagtggagaatccacataaacattggtggtcattgttgcgataaaaaggcgtaatatttcactatttcagcatgtcgtcctgtcactattcactagacgcattaagctagaaaggagctttttttttctttctgtggttgcaaaccaagcgtgaagcaaaaactgaagtattttgaccaagaaaaagatgtttcactgctttcagtgatcagtcaaagcattgctttcccaggaaaaaggatgaattgttcggtgaaatgtcactgaaaaagatccctggggtgctcatcagacgttaccatttttcctgacaatcttgcctcaaaagatgaatcaggaagcaaggttgttcatttgatgtaattgtagccatacatacaaggaaaatctactcaaacatggaatttatggacttatatttcaggcccagattagaccatgaatgcaggattatgtacatatctttcatccaacagatgagattagtcttcactcacctggacaggttactggacactgttctatgctgaatcttgaaagcttgaaaatattagtatatactgctgcatcaagcgtatgactgataataagtatactcatatggagaatcctgacaaacaaaaaacatttaccaatcatgcagattagattagtcaataggtgcaggttctcagaaagcatgaacagcttgagaacatcttctgcttatcagctagagacaatgcttcgtctaaatgaactgattcagtgaacattcttcaccaaagttactatcttgatgaaataaagccatttccctttctgaaagttgaatccagaaaactcaacagtaaagagattaaaagttttatgaaatagtaactgaactgtactgtacatagcgactcaagttacattcatatggcaccgtgaagcttttggctatcatatgaccatcactaacaaaacttgttggcgtcacagattcagaaatgccgagacatgaaaacttctgatcaccctctataagacagtaacaaaggaatacacatcagtacattgcagcaactcacaagggtttcagatatgatctcaaatcttactcctgtatctgaccagctttgccaatgtctcttgagcagccagtgtatgggcatgaccatggccaagcataacagtccggatgctaatgcaagtcctgcacaattcttcgccggtgtcaaacagcccacctcggagcaacagcttcgccctcgtctcgagcagtgtcgctttgagcagcgtcacttcctgccagacaaactcatcgacacggtgattcggttgcagcttcttcctccagcaaagcgacccacggttcaggtcctggatccgcgatgcgtaagacttctccacctcctcaaggacattggtgcacaccttgagcagttctaaagccgagccgcaccgtgagaatgtcatgaaggagtcaattgccaagggaagtgccgtcttccttatgaaatgcaccatgtcgactgccttgagctgaacagaaggtggttcagacttgaaaccaaacacaaggaatgcactagcccataagtggtccgagtacactgaggggttaccagccctcattacgccgttcactgctgcagttgttggtgccaaacctcccctaatcttgccaaagagctgtgttattgggtggaactggatccagcagccaggatgacgagttgcctttcttgccagcccaagcttgacaagtaagagtgctgactccacctcagcttttcgaccatgtggagctagaaagcaatgtgtgccgcatagaaatgcagtcttcagggattcacccaacaggtgcatactgcctttcattggtagcttgctcgctgttgcagctaatagcgtagacgacacaggagcaggagctaaccaagaaccagcgataatcatctttgaggtaaggcttcctccttttgctcggtccatcaatgcaaaacaaaagaccaggacctttattaggaaagaattgttacgacagaagccatcgtcattggcaccaagtgggaacaaactctcattcagtgatattctctcgacagcctcaaacagagtggaaggtgtaatcatgagctcagacagcagtgaaccaacgatccacaggccaaagctcaaccgacctaaccgctcgtcaagcttcctaagaacttccatttcctcaggcggatagtcattcttctgcttcccctttatcaatatcatggcatcattgtatgagagctgtggcagttgcatcggttcaaggttaatcacacgtggtaaacgtgtggtcacaatgacatgtgtcgctccagtgttcctagggatgaagtcatggagatccttaccttcccaccaatccctctcactctcaaggttatcaatgacaagcaagtacggcacgtcgcggaacagctcccgcttcaccctctgaaaagcatcaaactcctgctcctcaaagctcctgatcctacctctctccttctcagcctctgcactgatgtccaatcccaaattcatggataaattgagtatgttttgcctcaaataccgagcttcacctccaatccacaggaccatcttgtaccgctgtgaataccggtaagcaaattccaatgccagttcagtcttgccaattcctgaagaaccagtgatgcagagcacactggcactgccatatcctttgctgttgcaccgaaaccttgacctcctgtgctttgatctctgcttctgaagatttctccctttacccgatgataactctataactggatcaatccaggcctccaatgtcggctccttgcacttgcgcatctccaaactgatatacctggcattcgatgtcctcactgtgtcactctcctcatcagcaaacccatcagacacaccactcgatctgtcattcgcagcggaacccctcgggcaatcaacctcttggatatccaccgtggaaccgaagaacattccttcaatttcacttagctccttctcccttccaacgaaatgccggttccgcggaaaaggcattccttcaggcccttcactctccttctcagcaatgctcttcctgccaagcttggaccgcagcaaggtgaccgtcttggacacgcagcttctccaattggtctcattcgcctcaagcttaaactcatggcaccgcatcaatccttcgaacgcttccttcccctccttatcctccaatttgccgtcgaaaagccccgcgatctccggtggctcggtgtcgaacagtatgggcaccaggttcttcttctgagcaaagaacctgatctcctcgaggctgaacggattgaggaaacttgacatggtgacgactatgacgccgaatgcgacggagcagatgatccggtcggcgatctcatggctctgcgtgtcggagtacttggcccggtcggcgacgaaggaggcgatgccctgcagctcgagctccgacttgagccacttgcagaaccggccgaggctgccattgccgtggtagccgatgtacacgtcgcagctccggagcttggcgttcgacgacggcgacgccacggagccgcgggtgaaggacacccgcggcacggggaacgagaacgacacgcgcggctgcacgccgccgccgcagtcggagaccttggtggccgggtcgatgccgccggagtcgtagcgctcggacggcggcgtccgcgacgcgctcggcgcatcggtgtcctccgagttggagtaggacgccggcggcgacggcgccgccgcttcctgcggtggcggcggcgccgcagcgggagtcgggggctcgaggactcgaggcgagatgtacggcgactgcagcgccgacacgaacgcggaggacggcggcgacggcgagtagaggtgcggggtgatggagatggccggcgagatggggtttgaccggtcggagctgctgctgaatccgccattggtgcggatggtgagcgacttggtggcggcaatggggatatccttgggcacatcaagaaagctcccagcctccttctcttcctccatggctaccaccaaatcacaaaccttggcaagcaatctccaatgcactgcatgatcttgtgctcctcatgttcctatcaaaagatttgggggagaaagggaaacaaaacaacagatttttgtcacaaaatcgatgaaagagagcaaatggagacatggagtaatcacatctgattaaaaaaaaacaaagaacacaaagaactgttctaataacctgcagattctctgattgattctcaacttgattccatttgcatccaaaaaaatgtgtaaagaaagaagtttcaagagagaaaaaaaaacttactggtaaggtatccttcaggaatccaatgccacagaaaaaccactgataatatcaattgttttctgcagaaatgcagaaccacttgctgatgaggggctttagcttcaagaaccaagaaaaaaaatggcaaggagagactggagccggatttggaatttaaaaaagaggccagcttttcccactcaagccattgaatgggacgggtataactataactatcccacctcctgtgatctttgtcctaggaggaggaaatgaagggtggaggccccttcatgacaagcaaagtacaggttcagtttaagggccctcttcctcccttcatatgaccaccacaaaccctaaaaataaataaatgtgtgagtgtggcatcaaaaggagcaagtgaatgtggagctactactagtgctagtgctagtggcacacaactgcaaggtgaagtgatgaagaagaccagcaccatttccaatggtgagatgcaagccaaggccaaaaaccaacccaccaaaacagtacagctcaactgcagcagcaatgccaaagcaggtggaaaaaaataaactatataaaacacttttattaggaaaatttttatatatgtgttcttacctgtttaaaggttatagctgaaaaaataaactataatagaaaaccttaaaattaactctaaatgtaagtttaaaatttaaattttgatcgtggctgataagacaacgtgaagacaataagagtttttcttcatgtccatttgagtccaatattccgtttaagtctcatcttaagatgtacctcctttgtccaaaatgatttaaattctaaagataaatctagacaatttaaatctttttggacgggagaagtatgcacattatactttgtgcacatcctgataggagtgttgttgcatgccactacaattgatgcatgctccctatattaggagtattcaccatgtaggagtagattcagcaaagcaaagggtgattcacatctgaaacagtgctttcaaagtgggggtttggtgataaaataggctagtaagaccttgttttatgtgcattggagggtgatgaccacacactgtgtaactattttacagtgccccaagcttaggtagcaacttaaataatggtggcaatgcattagcctttgggtaaaaaccctaagcaccagtgggacagcatcactgcatgcaatgtgcagggattagggataggaagaggatgatagggaaggagatcttgatcttgcagaagaggacatggaatagtgctactgtgctagtgagagagaggggcagccatggcatggcctcaccttgttttggcctagaaatctggacccaagggagagaaaccaaagaccagtccaactgctgctgcagtaagctctgcacttgccatcaaatgctactatcgctccacacagttcagcagttcatccccacaaacacaaaagccttgttggtttgtctaataagctaaagtaaatattaaaatttgatttttggaacttaatattaaaattgattttaatatattttaaacatagtttctttcagtattaactttcaaattactaagaacaaatatataaaagttttatttataaattaatgtttatactctaataagtcgttttggtttattaggtaataggagtaaccgatgaggcttaggccctgtttagttcctaaaaacatatgcatggagcattaaaatatagattaaaaaactaattgcaccattagggaggaaatcacgagacgaatcttttgagcctaattagtccatgattagccataaatgctatagtaacccacatatactaatgatagattaattaggcccaaaagattcatctcacggtttatagacgagttatgaaattagttttttcattcgtatccgaaaataattttcgatatccagtcaaacgtttgatatgacatctaaaatttttttatttcaccgactaaacaaaccctaaactctctctctagcacatgttgcatagcagacgtggcagagcggcaggtgatggggttgagacatttatgatttgattctatcctgccctttcctgttgaccaaatgggtgataccctaaaggtcatggatccggtcctaaaggttttctctttctttcggtggcacagtagattgttgcaattagcgggaatgtttttagtcatttgaaactttggggaaaacattttgagcttttcgtttttcaaatttcctagtactagtagtaccatgtagtagtaccatgggacggaggaagtgctacatatctgctatatgctattcgtcccaaaaaccagcgtagtaccggatataagatattccagtactaccaatttaaacatacatatgtccagattcatcgtactataatatgttacatctagttttagattcgttttttatgagacggtggagtatacctcttatttgtctctccacagacatcgttaattcctttttctttttttttcgaggacatcattaactctaactagctgttagtgtgtcccaatcctccatgtcagctattatccatagcattaaatatattgtcacataaataaaaatataatgtagtaagagagttaataaagagagataaaaaaataaaaaaaatcatttctcgtgcaagaaaccatctctacaccagaaccaaaaatgaaaacatgagaataggtggataaaatgagagagtagggagatgattggatgaaaatttaatttgaagaaaccattcattgtatatatagttctatgtatagtgtctgtatgactagcaaatatgaagactattttgataatttctgggttaggaatggccttagtttgcagtggtacaaaacgagtacaaaacactttggttctatcatccacgtaaaggcactggacccatcaattatccaccaaatatcaaaaaccaattatcttatataccaattgttaattacaaattaacaaccaaaacacactaatgtccaattttcacatgcttggctttataaattagtaagaatgcaagatgtaattagcaataagaataataattaagattgatttaacgaatgatgccatacgtcggccccgaacgaccactagtgtccaactaacatcagaaccattcttgagcatgatgatttaaatgaagactgtaatttaaacttttgctagtcttatgctatacctccgtttcaatatataagacggatcttatcttttggatattacgtttcgtcattcattttattttaaaaaatatgtaattgttgtttattttgttgtggcttattttattattaaaggcattttaagtataatttatatttatatatttacactatttttttaataagacgaatgataaaacgttaggttcaaaagccaataacatcttttttttaacaacggagtaattacattagcgacttcgatataattaaatccatcgttcgcctctttattcctcaaataatgtaccattcatgctgccatgcacaaacactcaaatctgtacgtatagaccacaggtttttgaattttggtgtactttgtttcttcttgaaacatacggaaggatcgttaatccatcttttgatcagtaaacagtacaaacggtacagccaaccaagcacagccaggaaattaaactgcctgttaactggatgaattcatggagatgtttctgtacgtcttgcagtataaatgatcattcaattctaaagtgttttgaaattataggccctgtttggaagattagcccagggctaattttaagagctaatgtttagtcatgaattggtaggctaaacattagtctaaggtggcatgtttggatccatgggctaattcaagactaaaatgtggagagagagagagagtagaaagagaggagagagaaggagagagggctacctttttatggtacctgtgcaaaattagtcccattagcaccccttggaggggctaatgttttgaggggggctaattcactgtagccaaaaattagtatacatgtttggattcttgagggctaattcatgacttaaaagtgggggctaatgtttagcccatgaaaccaaacagggccatagttagcaggagcactttttaagctcttgggaaagaaaaacaacggctcacaactcaccagctccaatgatagctgagatggcatgcactttatcccaaaacacggtgattagttgggtgctcctctttaatatttttcatgtgaacagtgcgtccggccgttccaagtttccaactggttaattatattaaatttcggccagatcatatcaagcaagagcatttttctaggataatatatatgcaaaatgaaattctgctagcctcttctgcatcaagcaagagttgaaaggataaaactgcattttttttcatcggtaaagtgaacaatatgtcgatgaataccaagcttatatgcgcctgattgttgaaacgaagcatttgctacatgcttcgaaaaatatattctctaaaaaaatgtcctaatgcattgcttagaccacttgttttaaattatttattaagtttatttatcaaaatatttaatttatttttctgggtcgataaaaataacatccaaaatcttattaagaaagaggtgaaaatttaattcatccatataattaaatagatatttcaccgcaaaaatcaattcacgccgtgtttagttacaaagtttttcttcaaacttccaacttttccatcacatcaaaactttcctacacacacaaacttccaacttttccgtcagatcgttccaatttcaaccaaacttttaattttgatgtgaactaaacacagcctcaataatccatttcaaaacagagcctctgaaccaaaaaaaaaacatccatttcaaaacagagcctctgaaccaaaaaccagatataccataattgcagttttcagatgtcacggctggttagctgttgctagaagagtatgggagcacacacacaccaggtgtatgggcccatgccgtcattaggagaaggtatatggaatctgctacatggaccaattatatgttcagtccaagagagtaggcactggctagttggtatataattttgaggatcagaatccagacatgatggccatagaaatcaggatctgggtctcctgctttcaatgtgtgatccaattggccctccctgcacaagttgaagagagtgtcaattctaattggagctgtgggaattgattcataattgcaaaggaaaagagctcctgattagcagagttattataaagactctcatatggctggcttaacatacatatttagacatatataacttgaaagtatgtagtacggagtagtacctgtatctaattaaaatgtagaaagtgtgtaaacttgtgtatggtgatgctaatttgtgcaaaacaaatagtactggtatgtggtatcacaggttcaggagctactctagatttacctcaaaactgtttagatttaccattcttcaactgacaatgcattctgaagtttaacaaactaaaaagccattggatttactcctgtgaaacataccagatggcagctagcggaagcattacaaaatttcagcaaatataatctgcttccatgttccccatcacactggagaaagagcacctcttgtgtccaatggaaggtccaatcaatccaatccatccatcatgccatttgagaaacacactcaggtgacaccctgatccaacactagtctaccacctactccatggaatgcctctcctaatccaacactggtctatccatataaaaacacccctaccaccaacaacaaaagccaactcaagcaaaaatgaagtagaggtagtagtactagcataggaactactaaaggcaagttcagctcttgccttttgctttgcatgagtaacctgaaagcctgaaactttgtttcaggtccagtcacttggattggttccaactccccatctatcaacccatcactttctttatgcacactatgaccactgatctgcatttagcacagtcttaactcctcctaacatcaactatctcaggttaacaacaaaaagtatttaacatagtactaccatggacatttcgggtgcaaagagcagtgtaaggtgatgatgatgatgatgatgatgcagagaacaggctgtgcggtattgcagaattaccaactgacaacagctttgcttcagcattgcaaccaactgagagcagcatcgcagaattaccggggatcatggcgtctgaatgtgcggtgcctcgcctgaatcatgctgtagaaagagagcaagagagagcagtgatgtcctggaccgtagcatcatcatcatcagtacccattgccatcccatgtcgtgtggtttgtttttcgtttctttgtcgggtgatagtttgtaaagttgctgtcacaatgtcactcttcttcaatcttaatacaaaagatgcacaatacttctgtgcattctcaaaaaaatcccatgtcgtgtactcgtgtggtttggcatcgcgctgcttctgaaactgttgcagatgtggataatggatgtggagcccaatcaattggcaaagagctgattatgtgttaaatggcttagtaacgaattattattattattattattattattattattattatgtataaaatatttatatatgtgtccttggcaacttacaaattaatactgaaaaaactacaggcctatttagattgacgacgttttcaatcatacaattatttggtaaaattgataattatgtggctacgtttagtttgttaggcaatgtgtatagaattttgacaacattattaagccaatcctaccaaaattttgacaatgctatcaatttatcaaaattttggcatcatcaaattttgataatgctcattttggtaccaatccgaacagatcctacattgaaaataatttagcttgaaaattaatttttgaaatttaaattttgacagtcgtaggacaaacaataaggctacactggacgggtttcatttccatcttctcgcccctcgcatcgaactgccgttttctcaattatacggaagacgcgcacatgccaccacgcatgcacaaaagcatgtaccgcgattttgatgggagcgctagccatggattccaatttcatacccacacaaacagtttttttttcagctgagatccaaagaggataattgtactgtactactctctatttgcatccgtagaccgtagtagtctttcaaactcaaaagttcccacatgaaagtggggtttatgatgggaggtgcatcaggcaagatgatcggtgcatcgggctggagatttgaagtcctcttgtactgtttgtactcttgtatgcacggatcggtgtacactgctcgcggattcaattcttgcgcgggcggcgcggggggggggggggggggggggcatttgtacagcattcgcctctcgttccattgattgctcttcttcctagccattgttgggctgcagccttatgggcctgacctgactgatgcaacaatctcagtatatgggctgaaagttatactgaaagttcaagaaagatgttgtgacctaatcctcacaaaaaacagatccaatactaaggataaatttgtattgtatgacttcagaatcatccctggaattatgtttattttaagataaagggagtatctatcgcttatatagcaactggaattcatctcaaaatcaatatgaaaggaagaaaatagaaaattactagaaaacagcaagtgaaaaaaaaggcacttttagaattccagcctctcctctaattaaacacgcatcaagctctaatatagtagtactagagtttaaaattttggtttggccctttctatcgcggggtactaatagaactgtaattttggaatattttggtccaacataatttggattcaaacaaaatttggtctagcaatttcaggtcaaatagtttaaccacgggagcagggcgggctgaaattccattccggaattttgaaccctgagtagtacaattgatgctatactgaccttttcagaaaatggaatgagcatccctactgcaactagtacattcgtatagatatataaactcaaatcattcaaacgatccatgcattactagcacagcacattcaaacaatcatttgcagtaattgagaagtggattaggaagcatcttgaacaactaaatttgcctcggaatgcgctaaagagaggctgctctatttgaggaggctgttgtctcggatgttaatttacttctggttgtccatacatccgtggccagcaaaatggctctgtaatttaggatattgcttaggcaatggattgcaaaattataatctccgagtgttgcctgcttttgtcatctcctgcttagaacctcgagctgcttgtcacggcatttcgtgaaccgtgggatttgtcgtcgttttgacgagcaaatcaaaaacttggtgcaatcttttgtgattagttcactgcacagcagcagcagaagaattcctagcctatcgattaggcctgttctgaaattgtgatggatggaattcagaaattctgaacgtattgtgagagaagtacagggtacaaacgttataaaagtctaaaaactgctacgccaaattgacttgtgcgagcacacctttaaaatacatttaccttctaattaaaaaggctgtccagtattgaactgggacgataacttattcttctcataccaaaaccaaaactcctatcaatactgaaaatttcttgtgtgttttttaaatttttgctttattctttctatgtctctgagttttgacttattccatagatatccacgagtctgtgtttttcctctatatgcatttggtggacagttagacttttttttaaaaaaaaatgaccatattatccctcgccagtacataagctctagcttcttattagagataccattattaagtttatttaaaaacttcaattataacaattgaagggggcaattgtttgatccaaaaattgaaaactaaaattttaaatgaattgcaataagatttgattaaatttcaatggaggggaaattacacggagaaccaatttcttttgattttgtcctcttcctatatataccaaaatttgattatttttttacctactttagccaggtttgatgaaattacccatagaaatttcgtcaggtttggttgaaattcatttcaaattttgatttccaaatttagagtcaaataattctcccattctaccttttagaaccagatcgtattcaacttcagaattatatttttttaagctaacacttaatgtgcaagcgaggggcaacaaagttaatctataaatataaatatatatttttttgtagggatataaatataaatatatgatgaccaattcactcacaactaatagaaaatacataaagaggataaaaaaaactcaggagtatataaagaataagatagaactaaggcatagaagggtagagttttttcttcctcaatatagagaagatgacaaagaaagaactccaaaatggactgcaatatatttttttgaacgattatagactgcaaattacgggtcctaattaatcaacatcacatcacttcacttaccaacatacgtgggaacttgaccgggacttgttgccgacggaggccgtaaagctgaccaccaacgacgacgcgagatcgctggccgtccgatgagcatcggacggcggagatgaagcccgtcgacacggcggagtgagcctcccgccacacggtcgacttttcccgtcttgcccgttctctcgcggcgctgcctgccttctctttttttccaccgatgactcagcagcctatggagtatggacccgtacactgcaaaatacccatggtttgggcataaacaccggtaatgccactgccaatagcacacagaaaactggagctttaccaatacttgtgccgtctcttttggaacaaatgattttttttatggaatttctgagaaatccgattctacagaaaattttcctacgtgattgtttgaatcataggaatagctataataaatatcctataaactttctttgaattgactcgaaacatagaaattttgggaaaaattctaacatgggctttaatctcttagaaaaatcctgtcttatatattccttatgattcatgtgtttttcctatgctctatccaaacgattattcctaccgtttttatgtgttttcttaccggttaccaaggttcacaactttggtaaggaattaaaagctgctcacaagcagtatcttcaggtttttttttaaaaaaaacgttgataaattgacaaaaaccaatgaaacctttataaagcttgtcaaaatttaaatctcagtatttttataatggtttgtttatattttcgaccctatctgaaaagatcagatttgatgaaatccaaaccgattttcaacgggattgtaagtctgctactactgcaaagctttcagtttcaggttttgtgtcaaacatcgcaactttggagtagacatacgtattatgtgcacgattttttccagcatggaacccaaaaccgacacatttatgaggctcacaagtcacaatctaggacgaagagagccttctaatagaaggtgtagaaagccatagaattttatggcaaagatgcaattaaccaccaaaaccgaggactactggatgttcaaacaggggttggtgtggtgtgcatctcacagtcagtcagtcccaaattcttgatctatcttaaattaaaaaccatttgttgactctataaccacgatctctcttctgcttggaattctctatcctatttttcatctcatattctaaccattgattatgccatgattggatcttggcacagtgctctgcatgtgttcttgtgttaatcagctgcccctaatcccctaggagaccaatctactgctgcttagctcctgatacaaatttgcacattgcccggtgaaaattcagcaactgagcaagccaacaagagcctgggtttctgaactctgactagcagtttcatcaggtaccaaaaaaaaaaaaactcatcttattccctagttgagatcatcagtttgtttctgaacatttttttttttacattttgcggcgttgatcagattggtttgagcttgggagagatcgatggggtgcgtgtcgtccaagatcctgagcaaatcagggagcttccaggagaaggtggtgagccatggattcaaggggagcaacctgatcgaggagatcatcctgtccacccccaagaagagcaacggcgatcagttcttggccctcctccgcacgtccacctcgtcggcgtcggcggcggcgagcagggccaaggacgccgccgatcagagcaccacggcggcggcggtggccgccgaggagtttgtcaagatcgagacgatcaacgtgtccgagctgctcgccgggctggaggaggaagaggaggaagaagaacgcgacgacggcgagaggtgttcggctcaggcgtgcgtgctcgatggcgcggtggcgacgccggcgagggcgacgagctttcgcaccgtggaggagttcgacgcgctggtgacgcggagcggctcgtcggaggtggcggaggcagcctcctccgccgatcaagacgcgacgggcgccaaaccgtcggagcaagaggaggccgccaccgccgccgccgggaacaagaggcgggcgagggcgaggcagctcggcgagctgaaggtgccactgccaccggcgttcgacttctccaagtccggcagcctgcgcgactggctcctccagggcggacagatattctccccgggctcctacgtcacccccaagttcgggacgacctcaccggcgccttcgccgccgccgccgcaagaacgtggaggagtactccacaacgccggcgagccgcagccgcagcacaccgtgtttgatcccgagctggtcgcgcagttcgagcaagccatggagcggctgtccgaggacgaggagcgcgtcttggagaagatcctggaagccatgggagcggcggcggaggaggaggaggaggaggaagcgacggcgacggcgacggcgaggctggagatgccaagccatcggccggtgatggtggtgcaggagtaggcgacggttttggtaggtttttgcagccgcgcgtgtgtgatgtgatctgtaattttaaaccctgtgcttgcaaaatgtaaatatgaatgtgttcagtgatgatttctgtcgtgtctcggcaaattccaattcagttcaaattcagtctgccaagaggacgatgacgaacacatcaaatgcgaaaacgctaatccgcgaccagatttatattagggaaccatcgatgcatgtagcagaatctgaggaagatcttgggccaaagaagcatctggatgcgaatgggtttatagttgagggacacaaagtgcacctcttccctctccattgggtgatttagctgcagaaagtttacttgaggtccctcaaaaaataggggtcagaatcacttcccacaaccgcaaaacagatatatagtaccctcaacttctaaaactagtgtaaggctgtgtttcaaagtgagtgttgggaacccatctcccatacacgaaaaacggagtggtccattagtacgtgattaattaagtattagcttttttttcaaaaatagatcaatatgattttttaaacaacttatatatataaactttttacaaaaaatgcaccgtttagtagtttgaaaagcgtgcatacggaaaaagagagggaggtgttggaaacttgctcttgcaaaaacaccctaagttgagtccctcagtggtttttggatagcggttttggctgacaagacgcttacgttgtgtgttgacctagtcttgtcttatgtgatgccaaattgatgcttacaattaaaaaattagtggagccaacgtgtcaagggttgtcttcttcatccaccctctcccacgacttcacctctcctggccaatggcatggaggccgagatccatggcggcagcattgccttgtaaagttcctgtgtcgtcacgtgttgccacagcctaccaagctcccgccacaaccatgttgaggtctcccgtcaccaaaccgctccccccctctctctgtccgcttgatccgaagcacctcgtctggctcctgacggctctttcctctagtcgtcttcctctttccaaggccgagcttagcctccgtgccaccgtaggatgtaggtgatgctggcaggaagcgagtgcgtggagagagaggcaaggaagccgacagcggtgaagcacgagaagacggatgggtaggaggctgcaacaaagctccctagggcctaggctgtggggtgggccctgtgctccgtacttgttagactgcagttacccctaaatctcaccatcctcccaccttcggcctctggacctcacctcatgcatcttggcggccctcatcctaaaggaggatggtggttggcggtatttttgatcaagtgatgaaacaattatatataagtgacaaaacaatatcaaaattatttaagagagaaatcagatgtcccatctgttgttagggttgaaagtgattcggataattttcgtccgaccggacattttttcggattcggatagtttcggtcggatatatccaaaaattttcaaattcggatttttttttcggatatgaaaacgactatgatataggtgatatctgtcggaatctgatatccgtaggatattatccggtattttccatcggatatccgactcacacataagactgccatagaggaggtaaatcacacaaaagctagcccaacccaaagaggaggtaaaacagacttcttgacaaaaataaatttcgaattgaattttatgatattaaatgaactcatatgaaaaagttataaaaaacaaagttgtagaactcaataagatctaccaattttattttggtcatttcttcatccgagtttcattgaactatataaaatttgatttttaaaatataagaaattcaaataattcttcgggtagtaaatgatttcaaatggaaaaaaactatcaaaaacaaagttgtataatttatcaagatctacaacttttattctggtcatttttctatatgactttgtttgaacggtttaaatttgaatttgaaaatataacaacttcaaacaacattttcaaatactaaatgatttgaactaaaaaattcatcaacaacaaagttgtagaactcatctagatctataacttttattttggttatttcttcatccgacaaagtgatattaacattgttcataaaatttacatatctctcatttggttttataaattataaaagagatatgtaaattttgtgaacattgttactatcactttgtcggatgaagaaatgaccaaaataaaatttgtatgtcttgatgagttctacaacttttatgtgcattttttcaactgaaattatttactgtttcaaaatatcatttgaagttttgaaattgaaatttttaattgataaaacaaagtcacgagaaaatatggccaaaataatagcagtaaaaacacaataacatgatagagcatgattttagaaacatttaagaaaaagaatcatccaatttggagttcatatgagtgagataaactagtttcaaatttttaaattttattttcacatacgactccttaagacgcccgtgtagaaaaatttgatttttccatataggctcttaagtggtccgcatgcaaaaatgagctcattttggcatcttaagtaggggtgggtattcggtcagaccgaaaattcggtattggtcttcggtcttttttgaaagttcggtcatctaaagcgcaagaccttttggtcttgaaaaatgttgaagaccgatcaattcggtctcggtctcggttagactgaaatttcagaaatatttagaagaatcgcacaaatcctcaatgaatttcagatccaaaaatatcatacacataaagaaaattcataaaaatcccacatcggctttcttcactgtcatatactcatcccagatcagatttggcgccgctcgtcgccgtcggggtagaggaggcaccatctgatatgcccccggggtggagccatagaggaccgcagcttaggcttggcagttgggggcttgaggcctcctgcctcggggctccggcagcatgggcgcaagaagaggaggtcgtcctgatgtgacttgtgaggaggaggaggaggcaacgtggaggagaagatgctgggatggtgcagaggtgccagcgatggaacatgatgccgatgtgcgagagaaacagaaaggagcgattgggtgaaaaaaagaagaaagaagcgctctctcctgggtgggtggggagagcgtggcggctaggtggatgaggagaaggcagtagagagagctagggttttacttgtgttgggcttgctttcttgggctgatattgtgctttcaatgaaattcggtcaattcggttaacagagggtgatgactgaaatgaccgaataaaattcggtcatctagcacataagactgaagtactgaccaaatttatcgatttcggtctcggttatttcggttcggtctttttttgcccacacctagtcttaaggagtcgtatgcgaaaatgccgacgcggcaagttgtggtccatttgcaaaagtcatagggtcttgtacacaaaaaaccgtttgtgtagttgaggggtttttatattccgattaatatttgtcaccgtatttgtattggataatattcgatttcgttttcatatcgatttttgatttcgaaaaaaaattatgaaaataaatatgatagagctagtttccgatcgtattcgatccattgtcatccctatctgttgtctcgtccaaacaagcatcttacgttttctgcgtggttttggcttctgcccacagtttaccacagcagcagctattcagcccgtagaaaattcagatagccaaattggccttgttgctgtcttgtggattgtggcttctgttgaagtcttactccattttttccatctactatatccgataaatctcctgccgttttaccgtttcaaaaaaaaaaaagtcttactccattttttatcagttcgatattttccttagataatggtatcagttggatatacaatggttggtagaatagcgaggagaaaatgacatcacaacatctgtagagctagaaagaaaatccattacaattagtcaaatcagtcaagttgcggacatctgctattttctttatcccaaaatattataactagtttaaactcatattatatgagtgtatcaagataatattagtaaaagataacttttaaaattaaacatcacatactactcatactacaccttaattttattatagctcaaactagttcggaccaataattcacctagcccaagaagatagccaactccttttatctctctacttaagacttgttatatttgacatgggtggaatattatagactagaactgctatgcttcccacaaccagtctaattgcgaaagtcttcggattagatcgtctgaggtggatttttacttttcaagagcaaatagcctcatttgttgcaaattttaaatatatttgacattaaaacgggcgtatcacctatcactttatattgggtttataaaacctggcagttttcatgaaaaccagactttttgaccggctcaagaacataggccgctcagttttccaggtcaagttaaaaaaaatcaaactgcatttaaattgtttggcaaaatttgatcggattaggtttcaaaaaaaatgatcggattttgtcaagagtcaacggttttcaaaaagtttttgcaaaaacggagaaaaccactaactcatggtttttggctctagaatggttcggtgaacatacaaataatctacgatcacagctcacaggataatgttaattatttaagttcgatctacaagtgaggaactaaaatatccagttcagctccagatgtgactgcacttttcgtagttcggttaatcttctctcttctttttacacgtttggatccaagctcttctttcacgtacgtgcaggtgtagccacagatgacaccagggccacaatccattttttctacttctgttattactagatttttctgtaattatttgcatagtacatgtgtcatgtgtggtgtgtcctccgtagtactttatcgtgctcgttttgtcagtgaacagtgatactgtattctgattggagtaccatattcttttacgcccacgcgctccacgcggtaggagtgcggtcagtctcgcaaaattattgtactccctcccagcggcggacgcgtccttaaacacaaaatttatttcgagagacatctctatgtaaggcttaaacgagcaatgacaaaaaaaaaaacataagggaagtactactacacgtcacaggcatataagtatttttttgctattagtcgatgcaggtctctttcttttcttcttataaaatttactcttaaattatttatttgatctacaatctgattacatcattgtgtttgttgcaattaaatctttataacaagatcttagatgactatattatgatgataaaacatttatgttatgaattactttttattatatatgtaagttacttttatcatattatcggtgaaatgggaaccaggttacccatttacctggcaaaacaattataagtaaaataaatggcgtgcttaaactgatattgctaggggcccaccttggtaggtctcgggctcacctttacctgtttaagggataaggctgtagcctaaggtctgcttcggacccgatcttgtcctggatcccgagctcaccttaatcattataagtcctacattactaagtaagaagagcgtaaagacatacaagatttacatcttaagagaaatagactaaagactgccgcaaacctagccttacactaggtctcgggctcaccttagctcatctgggttacacattgctccgtgaaaaggagcgtagactaagatctaccccaggcccggccttgctccgggccccaggctcaccctagttattggtcacactttctaaaaggggtggagggtggagacatatgaagttattctgacaggattgtgagtcgaggtctgcctcggtccagcctcgccctagctaggacccgggccaaccatggtctttgtatggttcacattcttctacaaagaagagcattgaaacatataaaatagatacattgtctactcatcaaagacatcttcaagaagctcgccttagaatagatgaactatcatcatggaaagcgcgagggcacgacctcaggaccggttggggagatggacacgttccacgagctattgtgaagcggtcctctccgccataaatgaaataggtttatggagagcaccagctagtctagagctaaaaggacatggacaagacacatgcgctgatttattagtgctagtggcaccttggatgcgtgtcgaacatgccccatgccacctgatttagctaaacgggcataagtgaaaccgtggcgttgtttcaggcagcccaggttccgccaggcccaccactcgccacgtgctgggctagctggcgcgacccagctgtctcggacagaagcccggggtaatgcaagttttaagtcttagtggtctcttgaagactgtgttagggaaccagccagcaacgacaagacagctgataagacaagacaaagagtagatttgtaataacgtgaacccctctttgaactataaaaggaagtggacaagctacggatgaagggttggactctttagatcgatacgcttcgctttgtagcccaaaaaggccatctttgtactcaactgatctagggaagccaacgaaaccaacacaggagttaagtagtacacctctgggtggcctgaacctatataattcctgtgtcttttgcttggcgagagctcggcccccacaaatctgatctcactttgatctctttctcatgccctgcaccacaaaccccctggtcgaatattcacacttggggaggggtatccactccccgctgtccgaggaatcgctccctcgacacatatttagaaattacttttagatttgattaaattacttctcatatattcatgatgctctgagttgattacttttattaatgtttttagtcaatttcataatttgtgctgattaaatttaatttctagctagacccatatttttatccctacaatgaattacttctaatgtcgtaacaactttcttttattttgtgctaagttactgttatgatttatgtaaattactttcaggcttcattaaatttactttcataaatgtatacctaattactttcggactaatctgttgggtgttcacaccttgttatacctaattttaatggctcatgactactataaagggcaagggggtcttgaggtgtggggcgatacgggtcgtagctgggtcggtcgatccaccatgcctaataggtagattgtaacaccctgaaaaatttgaccgacaaaaaaaatcaaaactctaaaagtacggattttcaaaaactttttaaattaattgcatcatgccgatcttattcgcctattttatttggaattgatttcgaagttcattaatcgtaaagaatagttaattaggaataaaccctaaaaacaaattggtaaaataaatataattaggtgtggatagaaataagtaaaatattatcgcgaccatatttggatcaattgaatttaaatgcgatgcagtaagaattaaccctaattaaaattcaaataaattatataaataaaatatgagtaatattaatctagagtaaatccattggttggaatgacacaaatattgagtaaacttcatttatacaaaatttaggatttatagaatcaaatttaaataataaataggctaaaatcgggttaaataataaaagacactgttcattgcactctaggtgctcgacgtggtcccttaacccagcccctcctttcccccctctctctgtcgccaccgtcaccacgcgccgccgcccgacgcgccgccgcccgtcgcgcctggccgcctcgcgccccgagccgccgcacgccgtcgccatcgtcgcctgccgccgcgccgccgtcgccatcgccgccggtcgccgtcgccatcccatcgccactgccgcgccgcgccgtcgccatcgtcgcctcgtgccgcgcgcccaccgcctcgcgcccagcgccccgtacccgtcgcgccgtcgccaccgccgctgtcgctgtcgccgtcgccatcgcgtcccgcctcgcgccgcgcgtgcgtcccatcaccgccttgcgccgcgcgccaccactgccgcgccgtcgccgtcccgtcgccgcgcgcgcgttccatcgccgcctctcgccccgtgccgccgcgccgccggcgcgtcacccgcccctctctcccc

SEQ ID NO: 47557 - DNA, 5989 bp, Oryza sativa
tcccctctcctcaatccatctccccctcctgtgcttcttcaccttctccacgcgccgccgtcgtcgtgccgccgcgtcgccgcttcgagccgccgcgccgccgccctcgtgctgtcgtgccgccgcattcgtgccgccgcgccgccgccgttgtttaatgtgaacgctggtattaaaatttgatcggtctatgctaggtcttaggcttgtgaaaagaattacaaaacttgctttacgcaaaagaaccatagccatcctttgaattcccctgtcatgtgcattattgctgtggtggcttgctgagtacggttggtactcacccttgcaatatacaaatttaatcagaggtcggagatgaagcttcggaggatccctacgcttactactaggagggtgatgaagacgatggcgcccagtaggtcttagttacggtcgttgcctgtggcaatggcgtgccgctgccttaactccgctgccttaccttcttctgtttttggaatgtattccggaccgctcggtccgatgatttaagactatgcctgcgggcttatgatgtaatgattcgtactagacactcgtgtatgtgcacttgatatttcagctaagaattcgtgtgtaccagactacttgatccagggaaatggtactgtttacacgattgattcctgttataaaaatgggggtccacagagctggtatcagagccatacgactgtaggaaagaccaaaaggcgccccaccccttttctaagctggccaagggagaaattcccatttagtaatactttcaaaaataaaaacactatgtttacaaaactcggaacgattttcatcttactcttagctattttcttcacaaaacaagttttactcttagctgactttgggtttttcttaaaattagatggcagatcaggattcacccgccacctgggagatgggcgtaccccgctcagagggatacgtcattgagctacaccggctgatgaggcgtctgcgataccccagatttccgatctaccgagtgagacaatgtggatctgtttgggaggctcgggtcgaggttcacacgctagttccttcggagttagactacagcttcccgacacgccaccgtcgcgacttgccggagaccgcgatgcaggatgcagcacgggaggccttcctccgacttagctctatccaccgagctgagttggcgagtactgagtttgctcaccacccgtttcgagaggagagcaactccgtctgcacagttcaggacacaccttgctgctacaacccgatagtgacccgactgtcacgatgggctgaggtagtagacgacttttacgaggaggctctgttagagatcgacgaccagcagaggcgtgtgggagagttagagaccgaggtgactgacctcacagcgcagcagcttcagttggaggaggagcaccaggcttggggcagtgagatagactcactgaaggcacagctccaggtccacggcgaccagttccagcagttatctgactagtacaacgatcgccgcgggatgatggatactcttgaggagcagctgagagagagttaggagcacgtcagccagctggaggagcagcttcgagcagccacgatcagcaccacaagagcttctacttccacagtagtagggcgtgactgctacttcttcctcaccccgccgtacccaccagcgttccacgctcttctgggagaggctagtacgctagctaccgagtcagcaccttacctagtggacccgacagtgacatagccacctgccccggagattgtccacactccactgatccccgcaccttctccgcagccgggttccagtttggagactccgatccaggtcgactccgagacagaggggaccgacaccgagccagagaccgagccagacatcactgacccttcagaggatgagactcttgttcctcgcatcaccttcctcggaggacctcgcaccctcagcactgcccgcaagagcacacgacctccgggcaagaagcccaagccagatccagaggccactacttccgagccgtggggactcaggtttgcccgtgccagcgaccaccctctacctgccccgggatcctgcgaatggctggatgactagactggaggacttttgcagcttcgatctcgcttcagatggtttttggatagtatgcgagacaccccccttacctagattgacgagtagcttgatggttagttcgatgtatcttttggatgaaccttatttgtactgcgtatgtgtgcagtcgattgcatcatgatttatgtaccatttgtggaactctgtgatgttatttatgatattattgctgttgtgttataaatgagtttattccaccatgcttgcaaaacaaagttcacaccaaaacaactcccttaatgggataaaaccataagaactagttagaaaattaggatacttacttaaccggcctacacagatggcaagccgacgttgggcgtcaaccagcaatgaagaaactcagacacctgacctaactaccctgtccggagttatggccactcaaacccaacttctgcaagccattgcaaataaccaaggcaaccgtggcagatcgagctttggagaatttatgaggaccaagccacccacattcgccacagcggaggaacctatggatgcttaagattggttaagggtcattgagaagaagctaactcttgttcgagtacgggaggccgataaagtgatctttgaggcaaaccaattggaaggaccagccggagactggtgggacacatacaaagaagcccgagaagaagatgctggagaaccaaactgggaggaatttaccacagccttccgtgacaacttcgtgcctgccgcggtgatgcggatgaagaagaatgagttcaggagactacggcaagggaataccacagtacaagagtacctgaaccgtttcactcagctggcgcgctacgcgactggagatcttgccgacgaggaggaaaagatcgacaaattcattgaaggcttgaatgacgagttgcgcgggcccatgattggacaagaccacgatagtttccagagtttaatcaataaggtcgttaggctggaaaacgaccggaaggtcgtggagcacaatcgcaaaaggaggcttgccatgaaccgcccgcctcagcccgtaccctagcgtcataaagggacaacctcctcagtatggagaccaacagtggtgacaaccaatcgtcctaccgcatccagcaatttccacaggctgattaccatccagaaccgagctcctgcaccgaatcaagccgccactggatcagtaagactaggaagttgtttcaactgtggagagtatgggcattttgctaataaatgtcctcatccaaacaagacacccatttgcaccggagctaatgcaacggctattcacgggactgctacccctgctgctggacgaggtctattcgggactccgcagactaacaggaccactaccggatttggacgcgggcaagtgaaccatgttcgagctgaagaggcccaggaagaccaaggcgtactgatgggtatgttttctatcaactccactccagttaaagttctcttcgattcaggagcatcgcattcatttatatctttgaaagtaagtcaacaacacaatttgaccagagttaaattaagacaaccaatgttagtacattcacctgggggtgagatagcagtggatacagcttgcattgatgtacccatccgccttagggatgtggtatttccctccaatcttatggtgctgatgccccaaactcttgatgtcatattgggtatggattggttaacaaagcataggggagtaatcgactgtagacgtagagaagttaccctgaccacaccctggggatcggatatgagagcaaccatggatcaagatcctagactaaccgaacgtgccggaggcatatttaccatgctaccccaaaaaggaattcccgtagtgcagcgatttcctgatgtgttcccagaagatttacctggaatgccaccagatcgtgacatagagttccttattgacctgatacccggaactgcccccatatccaagagaccatatcggatgccggtcaatgagttggaggaacttaaaaagcaaattagagagttgcaagaaaagggatttgtacgccccagttcgtcaccttggggagccccagtgctattcgtcaagaagaaagatggtagcatgaggatgtgtgtagactaccgttcactgaacgaagtaactatcaaaaacaagtatccactaccacggattgatgatctttttgatcaactcaaaggagccaaggtgttctctaagattgaccttcgatcaggataccatcaattgaagattaggaccggggatatacctaagaccgcgttctcaacgcgttatggattgtatgaattacacagtgttgtcgtttggattaaccaacgccccgggcatattttatgaatcttatgaataaagtgttcatggattacctggacaaatttgtggtagtattcatcgatgatattttaatctactccagagatgaggaagaacatgcggaacacttgcgattggtactcgagaaacttcggaagcataaattatatgcaaagtttagtaaatgtgagttctggttaaaagaagtcgctttttaaggccacgtaatctcagccggtggagtagcagtggatcctgctaaagtggaggccgttacggaatggaaagcacccaaatctgtgactgaaattcggagttttctaggcttggccggatactaccgaaggtttactgaaggattatctaagatagcccgaccaatgagacaactactcaagaaggaaaagaagtttgtatggtcagaacagtgtcaggaaagctttgagcagctcaaagaaaagctgacctcggcacctattctagttcttcccgacatcaggaaagactttgttatatattgtgatgcgtcaaggcaaggactaggaggagtactgatgcaggacggaaaggttgttgcctatgcgtcgcgaaaactgcgaccacacgaggaaaattaccctacccatgacctagaactcgcagctgtggttcatgcgctaaagatttggagacattatctaattggaaaccattgcgatatctacactgaccacaagagtctgaagtatattttcacccagtcagatctcaacttgaggcaaaggcgatggttggaattaatcaaggattatgacttggaggttcactatcacctcggcaaggcaaacgtggtggccgacgctttgagtcggaagagccattgcaatcatctgaggacggaaggaatggctcctgagcttaaggaggaaatagcccaactaaacctacatatagtacctcatggacagataaacaccttggacattcaacctcttttgagaacccaaatagaagaggcctagaaggacaacgaggaaatccgagaggtgaaggaacgtctagctgcaggatttgcaaaggaattttcaaccgacgagaaggatgtcctatggtataaaaagaggatttatgtacccgaacagggtggactgaggggattaattttaaaggaagctcacgaatcagcatattcattgcaccccggaagtacgaagatgtaccaagatctgaaggacggttactggtggcccaacatgaagagagatgtggcagaatacgtagcactctgtgacgtgtgccagaaggtgaaggctgagtaccagagaccggcaggtttgctgcaaccccttaggattcccgagtggaaatgggatgagataggtatggattttattgttggattgcccatgtaacgccccgattttcgttcgggtttaaaaatcaattaataatacattttctagaaattaaataaaagttaaatcaatttatccaagtgaaatgttgggagaattaaaattttcccttaa

SEQ ID NO: 47558 - DNA, 10748 bp, Oryza sativa
  unsure (1)..(10748): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatatagtaacctagtgtcaccaaaagtcatatataaagtggtatagtcatattgttcctaaggttaggagtgagggatatggatatatgtggggtcaaggtgaatgcaaacaataggagtttgtccaacaagtttaacaaaattttaatttattagtgtacaatcgacatgcaagatttgcaaacattttcaataacctccaaaacataggttcaaagtgatcaaagagagggaggtgggacttgccttgaatcaggaaaatatcagcacctaaatcacttcttcaccgattaagcaatcatctatacaaagtacacgttatgcaattaaacaccgaaatatgcgaaaaatccaaaatgctctaaaatggatgatttgtgcacagcgaataggtactggtctaaaatgaatttaggtgaaagaatttctattttatctcatttcatttgagaattatgaattttagaagtttcatcggtatagcgtaggatttacttaggtactattgtgaaatgctgttataaggtgattcttattaagtttatgtttgctggggtgaagatatgtgttttctaagactaacacatttggtttcataatttttagagttaatatgaattctttatgtattttacaaattataacgtgttataggtgtatagtgttctataggttcatggctttagaggtttaggtctagaacttgcctcatctagctagtgatgtataaaatgagtattttagttaactaatctaaccttagttcataggcttatggtctttattatcatggttcatattttataaactaggggagctctagtccatgttagcaatttattatatcaacctagaaattattacataagctaagtgccttaagttttggtggatgggaatggaactatgcattcactggtctaacaagttttatttgggtttcattatagctagagtgtatttctatgtacatttatatatatacatattgctcaatcgatactatgtgattagctcctatcctataaatttaaagtttagagctataacctgtacagaaggttccatattttattttactatgttgaagcccactgtttgctggttctatagatatttggttcacttcatttagactaaagatgaattttctacaaattttacattttaaggttgctctatgatggttattacttacataagtaagtatataattttattttataacttggaagtatatgttttggtgattatacagaacttgggtttattcaaaaaggatctaagatgagttttatataaacttctaaagttcatcttatgccaaactagttattttaaagataatagttttagaggcatttgatgtaaagtgtttatatgttttattttaatttatttttagagaacatgttggtggatctgtagaaactaagtttgctctaaaatgagttgaaatgaattttgtatgcattttataaatttgtgcgtgctttatgtgtgatttaacttggataaattttagaggctaaatttgtactgtgagtgcaagtttttattccataacatcaaatttcccaatttggtgagttcacagaaatttgaatcatcttaaaatgagctatatttaattttatatggattttacaagttttagttactgttcttttataattccagattttgtttccaaggggtccactgtcagtgagagatcaatatacaaaaagatccctgaggtttctaagaatcaacccgcagacctaggctcatatgtcagtgaattgaaaagttgcacattaaaccttatagttgtttaaattctcgaaacaaggtccctgacttcttttctcacgcagagaggcagaacagccatggctgagctcgatctcaagcttgccagcggcaaacggtggctcgtttgagggtgcgaccaaaagacaaaatgaagatcatgctattgcgattccattcctcttcttttcttggtcagtggacatcggagtaacgccggcggcgagtccgagcggcggctgtgcttaggctgctactgcatgttgagttggtgctcaattctaagtgaatgaaatgcatgaatgcaatcctatgggctcaagggtgctcaccgaaccttgaacgaggcgccggaaagtctggacagcggcagcggagaagaagatggtccggcgacggtgtagagctccgggaagacggcaacggctcgatccactcatcgaattgacatgcatgtgttttcatggggttagtgaggtcccagggatggtgtatacgcgaagaatcggacaatggctcaccggaggaggcggaatcgacaatggcgacggcgaccggaggtggagaagacggtggacgatctccacactcgtagcaccattcttcaagattcttgaggggaaatggagaggaggttgaggtgaagctggtggcgtggtggctcgctccggcttgatctagattgatggcaacggcgacgatgtcgctgcggcggtgcgcagagcgcgctccagagctccggtgtgcacggcagcgttcccgccgattggctgcaccagagaggatgaaatcaaaaggagaaatattcggcatggtgaggagagtatggaacgcaagagaagaggaaacaaccgcggctcatcaacgattgcggccattgtcttcttcgtggccggcgatggagaaccagtggagaagagcagcgaggatgctctccctcggatggatcggcactggaatggtgggtgaagagtggcgacgcgtctgggagaggcagaaatggagctcggcgtttttagggcgtcgacacgtcgtggccacgcgtcgcgcggcgtccagagccggtcggcgctcgatctctccctctcagtgtttctcggtcggctagggaagttgcacagaggaagggcaagccggagggactgacaagggggcccaggtcgaagtaaactaggtggaagagagatgtgtaggcagagacatgggtgagcttggtttttggacgaatttccggaattattttctcctctaattttgtagcttcaatacttaatgtgttgatcagattaactagtgttgattttactggaggtaggtgtatgtacctagtttccattttctttggttgcactcaaaaattatggatagattactcacagaaattagaggaatatgggttctttggaaactagttcgaatttttaggagacctaaatagagaagataaattctggaaaatttatttttattcattataaatgacctagtatttgaataaattattttacttatacacttttatgcagttaaatgcacttttagacaaagtatggttttagccgattaagaactacagttaatctagtttttattagtttgactgatttatttgaggtaccaaatttagttattaaatcataccaaaattacagtgagttgcatgtgttgattagagcctacatgaattttcccatggttttatcttgcacgaattattttagataattcgcaagacttatgtcttatatatgtttccctttcctaaatgcatgtaaatgtttataaaagttatatttggactctcattaacctgaggtgatgttgatatgttagaattacaatttacattacacaggtcataagctccttacctattatgcacaagtttactttagtattaaattaagagaatgcttatagagatgattaagatagaatataccctatatgatataatttatttggtcacttccatgttcatgactagtcttcagatggatgaccaaaatagttttgtggggcttgacattggccttgttgatatattttaaggtgtatggtttctattttaacttcctctagctagcactaggccctaatggtttagttgtttatctagatcttagttaatattcatgagacctattatgaaatgcaaatcgaaaatccaaatgcaatccaaatccaaatgcatatgaaggactcaagtcaaacatgtctatgagagtatgcatgcttacacataaatttatatttttgtcctaggttagagatgcaaaggttttaatttgttttaaaattttatcatgcaagagttagatcaacttcacctaggtttaaaatggaaatttttggtttacaaaattgaagaactttcctttcactagttttgatagaaattccttaatcctagaattcgggtatgttacaccaacatgctacctgatcggcatttttggcaacagccatgctatgcctcgcaccatccatccatcccaaaagagaagacacaaagacaatatcaaaatccgatagcaatagagctgaaaggcattgtcgctgccaaggaacccggcttgcttgtactccctatcacctatatagtccatggcaagctctctccatcctccattgtcaacgtcatcatctccatcctcttccttctccaaagaaaacaaagggcgtgccaccgaagtggaagaagtagagggcaagaagatgggggattgagcccagagcgacggcgatgtgggggaggtcgacataaatggtggttgcacggacattcaccagcatgagggggaagggggacagacgagcatgaggggaacaagggagagagagatatagacttggggggagggggggatgagctttacgaaggtccagaggataaggcaatgtgtgtgtggtggcctgatactctgatctgttgaatggatttcgtcattaatttatcccgttaggacaggacaccgttgcgtagattttctgttttttaatgtgcttgatttttttgcttcctaagcttttcttttgcagactgagttgatcgttgagccagagaagttcacacctcagagctgtttaaagcttcagacgattaacaaggaggaaaaactcgcaaaacaagatctggtatgtttctttttttttctctatattgttccttcttttcatgaattggtaggtttttgttgcattagctcacactaaaatgtcttagactatacatatttattgttttagtacatatgcacagagaatctctgacattagttcatttttttctatctcctagctcttcttcccaattgtttgggacgggcactaggtgttgttatgcatgaatattcttcatgaccagatcaattatttcgacccaaaatgcaatgactcaaaatggttccagtactctcagaacctggtaactatgtcagcacgttccattttattatgttcaattgtttcagcacaacatacatttgtatctcgcaactcattaactaatgttcctgcatttgtcaaagcatagtaactatgcatgttccatcttgttttctacaactttttcaacacaacatatattcttgttcgcaatccatgagctaatgtttcaacattttccttatgtaatgtagctgattaacttctccaaggttgcgcttgatgccaaaattgcaataaaagatataacaaagtttcagaaccactccaccacagtacccactacagtccaatgcgtaaattgcttttaaattacttgtttcaccttttttttcattatactgtttttcctatctcatcaccttgtgccatcacttatttttttctcctaggtttgattgtggctttttctgcatgagatacatgaacaattgggatggaacaaagatggactattttgatgacagtacgtcagtaccatgaacatctacaggaagatcatgacttacctgttagccaattcacatttggcgacaaccgacttcagacaactccctccaaagcagttagggattagtctggcctcccacctcctcaatttatccgataactttcgcataacttttgtctagtctttttgtttgatgatattttggttatcctatacatatgcaaggaatatttgtgttggccaaagcaagaaacaagggattatctatgatcactaaatacatgtgaagctagcttgatgcatgggccatgcaaatgtgtggatgtatcagtctggccaaccatatgactcatgtactcaactatatatgtgtgctaaatatatacatatgcatgaaccagccaacaagagagtggagttgcatatatatatatatatatatgtgcgattcatgtgcttgcgcttgtggtcgtttacttagcaaatacgtatacgtataatagatgatctttcatggacttaaagaagcagcaagctgggactagctctgggctgcatatgggctggtgccagtagttgcgctgctcgtgtgtatgtgcagccggatattcacgccaacgggagtgagctactgctgtggggataacgtcggatgactcattcttatctggatgattcaaatgaaggcaatccacagcaattgaacccagaggcatcgaatcgatctgacgcgcggtcgtagcggcgccagagaatgcgcgtctacccgttaggccaccctatgcctataaaacccatcgaaagcaagccaggccaaggggagaaacacacatccatccattgacgagcaacccttcatccgcattcattcatagcaatattcacacacattcctcacacattcaacgacacagccatcgagcaattcactcaccatcaacacacacatatgcagagatcgatatcaaaagcagctcttctattcctcatctgatcgatttgcacaagcggcgcagacgcagcctcatcggagtagccaggcgggaccagctcgacgggaggagacctcaccgacaacaagaggcagcatcagatcatgggcatcaacaacctctgtaccatgggtaatgatcctgtggctttcttattgatttttctttttcagttcatgcatgcatgagatggcgatggtgatgagatgctggagcactgctagttggcgcccgcacgccgtcgtcgagtttgccaagtctcatggaagtgtcatttgtgggaccaggaggcaagccgccgtttttctacgtcgtcatgaccggccgaatgacctcgtcgcgctacctcgccggagcatgttgtcacggcatcgtgaatgtcgtcgagtcgtgcccgactgaggaggtctcgtcggagtcgtcggaaacgtcgccaagtctcccgcgtctacatcaaccaaacacatcattgggcgatggagattgtcgcactgccctcggagccatggtgctgccctcgtcggagtcgccgtgccaatcatctgatcgacatcatccagtcgagtcgctggtgatgacactactcgttgctgtgatctcatcgccgacgtccgccggccatcttcggtggtgttaccatcttcctcacactcgtcgttgagccgcgtgacgagaatgccaatcgaagcgccgctagctgctcggtgcccgcatcgtcacgctggggttgctaagccgttcgtgatgctgtgaagccatcccttcatcacaccggagcaccatcgcttggtgcccgcacaccgtcgtcaagttcatctgcgatgctttcacctcgtcaagccagagtcatcgtgccgtccgtccgtgtctccttttatctatagtaacatgatgagatgccatctgtctacaacgcttccacttcgtcatggcgagatcgatgctgtccgtccatgatgcactctctcttcatcacgccaagatgagatgttgtccgtccgtgattctctccctcttcatcgagatcaatatgccgccgcttgtttgtgtattggagcgtcgctcgtctatatcaacatgaagaaagaatagtgccgtctgtgatgccaatgtaccgttcgtgttagatctacaccaaccaatgtcctcggctattccgccgatgaggcatttacttcttccaaggtcgccgttactatcggcacactcatagagccccttttgcaggctcgtcatcatatcaaccggatcaatagtagattcatcatccgaaggaggtgccaaagccacgtttgttcggttattgtctgcaccaacttcttcatcaacatcttcgttacaagtccctgttgtataagggacatgacgagtcaggaggtgcttagccatggatatccggctgccatctacaccaactgtcatcgtcaactctttgttactttgatcccatcaagtcaggaggtgcccagccatggatattcggctgttgtgtacaccaactgacttgaccaactcctcttccctttaacaccatcctgatgtcgttgctgatccaagcgacacgagatctatgcatgttgaagatcaatccatctactccaccacgttgctcaagactgatgaggcggagcgacgagggtgggcggagcctatatgaaggctacatcaccaacaccggcgcacggaccgatgaggccgcggatgcgttgccggcgcctagatatatatccacaatcttcaccaacattcatcgtgcatggagaacgtgaagcgaagacgacgagacgaccacatgcagcttaatcggaggtgctctgtaggcctaaacctgtggcagtaattaactaggagtctttcgagaccccaggaattagaagaccacttatccaagtttagatttgtccaacgacaggctatggagcgcacatacatatatacatatatattacattgggaatttgtatttatgatccttgagattaataaagcacatgttccctatgttttctgtttattttgtgtccttagttacactggcacgctctcgcatatcgttaccgtttgttatttttttttgtcctaaacacttttttgtgggaaagaacccaaattatgtgtgctcattttactttgaatggcattttttggaatgtacttatttattatggatggtagttggaaaagttgtgcacataaagagttttgagacttatccaatctgtccattctcctttgcacataaagagttttgagacttaaccaatctatccgcttcactgacatcgttagtcaaacacggaggtacaacagcaaagcacggtgccagccgcacgcaacaactgcctccatgacagtcaccacattctcaaccaggagcaaaccgttatttctctgccaatcactatttgtcaaggcatgcggtgttagtgtatctgtataagtggatgtatttaatacaaagattgattctctagttaattctgcatgtcaaaagataggagtcaatgcttaagacacctatacaatgttatggcaaggttttagattatgataaatcactgtcggagtaccctttacactgaacttaattattgagattcgttatcgagaaagagccggacagtgaatattatctatttaaaactgatgttaatttcctttatttatatatgtctataacattgtgttttgctgcatgccaatgacaatcgatcaaaaatgcaatgttagtgatggattattgtactgtactattccattacatccagatatttaagatgttggaatcattgcaccccatgatgcggtttttcttggatttcatcttctacaatattcaaaaggtgttgatgcatgttactagactgcatcgtgaagagttgagctttaatacaacttttattggccagaacaagatttttcttcatggccctacagtgtcatttgatgcaagcccatgtgctagggattatacaagtctttacactatatttcctgtaaggtttgggccaatgtatttactgcatttcgaatatctccttgaattcttaaggacatgtccttatggggtgaactctagagattaagcaatagttgtgtttgttacatatcatcctagtattgaatcatatgttgacaggatgaaacaactgatgattttacacaatttgctaaatgaacaccctagacatcatacggctaatgtagttgctctggaaggatatacttgtagatccaaggagttgtccagaactcaataacgttaccaaccgaacagggttccgtcaacatggttgaattccttgcatattgatgatgcaagaggttgtctgcattttgctaataactttttgaagcatgcaaaaaatatggttcatataattcttactacattattctttcactggtactgtgtttttctctaaatagtttcaagaagaacaaaacgaggtagcattttctctacacatggcaaactttttatcaacgatattacaaaggcttgctcgacttgctcaacgcaaccaaaacaagccatatatcattgacttgtaagtggatctcaagtcttttccaatcgagttcaatctcaaatctctcaatcaagttcaaaagatggagtgtgattatttctgtaggctttcaaactgaatgacggacgtaaggacgggaaattaggtgcaactatgctaacttgatcagaaattgacttatcagaatatcattatattcttcttaccatcattgcattcttctcttgatctgtaggaaacaatctggaggtatttcagttggaaagttgtgaatgaatgttcttgtatctgttgttgctagttgttctggcctcatggagatatgtatggtatcaatctggggacatcctctctatttctttgtccttgttgagacgatgaccaatgttgt

SEQ ID NO: 47559 - DNA, 11981 bp, Oryza sativa
  unsure (1)..(11981): unsure at all n locations
agcgtgataccatcccgccataaagcaacacataccaacctgcaacatcggtcattcgtctcaacaaggacaaagaaacatagagaatgtccccagattgacaccatacatgcctccatgaggctagagcaactagaaaccacatatacaaggacgttcattcacaacttttcaactgaaacacctccagatttcttcctacagttcaagagaagaatgcgaggatggtatgaggaatatattgatagtttgaaaagtcaatttctgatcaagttagcatagctgtacctaatttcctattcttacatctgtcattcggtttaaaagcctacataaataatctcacttcaccttttgaacttcactgagaaatatttgagattgaaattgactgggaaatattttgaatccacttacaagtcaatgatatatagcatgtgttagttccgtggagcaagtcaagcaagcctttgtaatatcattggcaagtagtttgtcatgtgtagacagaatattgtcttgatttgttcttctaggaactgtttaggggaaaacacaattttagacttaaatatattttcaccagtgaaagaataatgaagtaagtactatacgaaccatgtttcttgcatgttttaaaaaagttattagcaaaatgcagacaaccccttagatttcaatgtatatcctcccaacgcaactacattagccgtatgatgtctagagtgtgtatgtagcacattatctaaaattattagttgtttcattctgtcaacatatgattcaacactaggatggtatgtaacaaaggcaactatttactaatctctagagttcatcccaaggacacatccttaaaaatttgaaagagatgctcgaaatgcaatgggtacaccggtccaaaccttgtagagaatataatgtaaatacctgtataatccctacatacagacctgcattaaatgacactgtagagacgtttactacagtaaatgcatcatgatgaaaaataatgttttggctagtaaaagccccattatagcacaacccttcacgatgtagtccagcaacatgcatcaacagcttctgaatattgtaggaggcaaaatataagaaagaccacgtcttggggtacaatgattccaacatcttaacgatctagatgtaatggaacagtatggtacaataatctgtcattaacattgatttttttttatcgaatgtcattcacctacagcaaaacacaatgttacaacgttatagacacgtataaataaagaaaattaacatcagttttaaatagataatactcactgtccgactctttctcggtaacgtatttcaatagttgagtttcgatgtaaagtatactccgacaatgatttatcatagtcaacagtgcataggtgtcttgagttttgactcctatcttttgacaagcaaaattgactagagaatcaacctttgtattatatttatatccacttgcacagatacactaacaccgcatgccttgacaaatagtgattgtagcccctgtaaaaaaatggcaaaagagcataaacaccagtatataacaacaaagaacgaatgagagattgaataaatcttgttaatacgatgaagtgcatcaataaaaaaaaagtggcgtacacattactctaagttgtttacatgttataatcatgtacagagattagtttcaatattgttaaaaattgaaaatctaagataattatgtatatacacattactaagatgaagtgcagcagtgcattcaaagaagtggagcacacattactctaagatgtttatagattataatcatgtatacatattagtttcatcatttctctctagattaaaaattaaaaatccaagataattgtggttagcttcagaaagaaaggaattacgtcatactgctttgtaactaaaccgtcagcccaaaaagtagacaaatttatgcatgacttgagaattagaggggatcttttttacctagacttgagcaagtaagaagatggcgcaggcacattttgcttcacatggacttccttcacctcctcctgcgtgttcctgtagttaagacaacccaaaggacagaatccgcaaaagagcataaagagtagcaaatagcaacaaagaacgaatgcaagcatgattccctcccaatgcgaagggctgcaccatcttcacccaaaattttgttagtaagacaaaaccctctataattgccaatgcattaagaaagaaaaagaaaagaagtagcagcatgtttgcattacacatgggaatagcatagtccattctcggtcgcatccaaaggcagatggcgagggaggtatattcgaacaagaaaggaagaagataggtatattatgggagggagcccttagtagatctaaggagacacacacagcagaaccaacaaacaccacggatgacgtgtacaagaaaaggtaccttcttcttgcatagcgtagagttgccggagaactccatccatacgagagctaacattgctacagccttactagctggcatacaacttggcgcgtgcgcttccgtccccctctccatcgccagctgagatttattctcacacccctacagtgttttcaggtgcttaaagtgacatgctcgcttgggggaaacgggagtagaagcacagctgcattccacactgccaccttaatctttaaagttgtcatgatttttataataaaggaattgtacccttgttaagttgcactagatgaatctgagagttcaaattagtttatttcatccctgaatgttcctttctccttttttttgtggatggctacttgcaatgctatacttatatttgacgcttccgcaatgcttatgttttagaggagttgctgtcaaaatttctccttattcattaaatgtatttctatttagtagcatcccggtgtctttgtagtttctggggtgttacacatcacctcctacgtgttcctctgcggtcaagacaaagacaacccaaagaaaagaatcgacaaaagatcaaacaacggtagatagcaagcaagaatgaatgcgagattgatcacatcctgcaagtaaggcgaagtgcaacaatgcatcaaaaaacaagttgcatgtctgcacacttcaatcggagcccattctcggatgcgaagcgcatcctaaggcctggcggcgatgcacgcaatcactgtcttttggcgcaatttcattttcaaatcagacatagatttgctcttttttattctatgtgtgtggggtcaaattttcatttgattcttttttattttgtgtgaagtcctagacgacaacatcacctatgcacctgatttttcttttccagatttccaaattactttctagatgtgtattgtaacacttgagcggtgctctaggagggagcagtatccgtgatacattcttgtatgatggattgagtacgtgatacgtttgaggtttaggttgtgatggggaaatatgaagtgagaattctaacatagagtagatataagggtgcacacacggcagaacgaagaaacaccacggatgacagcgtaaaagaagaggtaccttcttcttgcacagagtagagtcgcccgagaacacatccatgcgggagtcggtgtcactgcagccttagcagctagcgggctcgtcaagtcaaagcagccactgctcaacgtcgagcttgcctttgcagccatcgccgccgcatccatgcagcccttggtagcttggtccacgtcgttgcggcaacaagcgcatgcgcttctgtccccctaaagcacatgtctaccgcaacaacaacatctttgtcaatgatgacacaaatgatgctcgcgttcagtggatcaagaacaccaattcgcagtgtgttccacagacctcctcatcccttcacctcgcagattcgaccaagcaccacctgatgctctagcgtccagctgctgccatcgtcgttaagggcaaatgagctgagcacgaaaggatccttctaaaacaactcgatgtagcgcaacctaccctcgctgaccaccaggcgccggtgcataccctgctcttgtattatatttgtgctgggctctaggcacacactgttcctcgggagctcaaaaaaaacgagctccagccggtcgttgaacgggtcggtggagacgatgtaccatgtcagatcgagccaccacagctatccaacgaactccaccgcctcgatgtacatgtttatctgccatgggagcgggagcggggatggtttgcaagaggaaccgccgcatgttgaaggctccactgttactgtcctcgcagagcacggtgacgacatagctgtcaggcggcccgtggccggcatcggagcaggtgaagaggctagtgttgcggcacccggggaacatggtgctccgcttggtgccttcgatgtccgggaggcggaacagctcgccggtgagcgggttgcagacggattgcatgtattctggttctgggtcaccgaggtggcttccgcgagtggcgccggtggcggcgacatgcttggagaggccgctttcccaagtagcacgggctatgaggtcggagacgacagaggccgggacgcgggcatccatgtagatgaggtggaggccattgccgcttgtgcgtagaccttgccgcttacgaaccccatggtgtcgcttgttggtggcctagctcacaagatcacgcactcacttattgtttacacactatagaaagagtctaacagatgaacataagaactctcacgcacaagcgctagatgtacgcacaagcaatattttgtggcgctgcgcaccagcgcgcagctaatgcactgtctattctccacaaacaatataactaaacggaatgcttacatgcttaattagccacacaataataaaacaataacttagccacgattggccgcacgacgcggccgagcattctcgtggctaagtacccactcactaacttatcgacatgcaagccacaattgcttgcatgcagatcaccactaacatatgcatgcatgctagctgatccacacttcacgccataactctcacttcacttgacttggccactcctccaaggcaacttgcactagctgcatgtaatcacttgcatgcagatcatagctatcactgatccaactaactcgcacatacacctatcaacttattctttctgacacacacatgattgagtacagctcgactacatgcactcacacgacaagaacacttaatcaacaagattaaacccaacaatcacctcctaatctagtttttattatcacctcctcgttcgtcatcacaccaatgttggctcatcatccgcgtcaactgtggcaagaaaagccatgtccttcttcggcttaggacactcatcagcgaaatgcccatactcttgacaattgtagcaatgaacttttgccttgtcgaatttgccgtggtacttcctcttgtcaccaccactgctgctgccggaaccacctccactcctcctctctttagcaaccttggcctcccactcagcacgcatcagtcgtggctcggcatatgcggcgaacagctgctgctccccctctttgtcacgacgcagcccctgtgaagagtcctcgaatgcccgcaggtgcccaattgtctttgtcaccatcatctctgacacatccccccattgctcaatggtgcttatgagggattaggacttctcgggaacagaatgtaggagcttctccacgacggtggtctcctccactttcacgccaagagagtgaatctcgttcatgatcgtggtaacctttaaagcaaaatcattaattttctcagaattacccattttcataccatcaagctcgctcttaagggtttgtactcaggccttcttgatactctcttcacccatgttcatcaacttgagggcgtctcacgctgccttcgccgtctccttctcaaatatggtcatcaccacggcctccggcatagcttgtacaatggcggtgagagccatttggtccatcttctcatcggccgtgttgccctccacagcagcccacacgccttgtgcgcgcatgaaaattttcattttcactgcccaaacgccgtagttgttctcctcgagcatggggtaacatagcgtcaacctgttgacgaccaaatttggtaagatatgaaccaggttcgacattggaatcgaagcggattcggtagaaagatagattcgaagaacaaagcatgcatcggctgcgaaggcatcggctggagtcttgtcacagcctgattttccgtttcaagatttataaattatttaataaattattaatagaatttatattagatgttgattaatttacaagtgaagttaaatgtaggaaataaaatttcctaaacataaagcatggctggatttaatttttattaaattctccatgattaactatactctctgaaattttctcggatttttcagagctcaattcctaattttaataatacaaagaacaattcagtaattagttaatcaataaattaatcattaaatggtctggttttaatattgttaaatactttgagtgtccaagtatgttgaagatttttcttggaattatttgagcattggaagtatttttaacaattcaaagatcatctcatgggttaatttatttggaaaagtaataataatcctcttcctagtcttgggcccttttcagcccattccctccttctctctcccttcctctcagcccgcagaaaagtctgtttttcttccctctcgctacagtgttgtcttcaacccctggacagagccgactgtctccagcccgtgcacagtttccgccgatctcctcccaccaaatccgacctccctgttgctcctttttccaaattagttgtgggaatggaatcctcacaatctcctcttcattttccccgagaaatccccaaaagtttctatggaaatcctttccaatttcgcggatcaatctttcctttttccggcgaagatcctaaactttcgcccgagtttttcccgtcgatgtgggcttgatcccgagctcccgtgcctatataaaggaccccctagtcgtcctctacctatccccttaagtcccgtccgccgccgtcgccggaaacgctctccccgcgctcgccttctctctccacctccggccgccgctccagccgccgtgcgccgtcgcctaggccgtcgccctcctgcgccaccacctccatcggctccgcaaggtcgatctctaccccgtccaccggttcccctccgccaagtctcgctggaagtcgctgtcaccgtgaaggccgagttcgccgcctcggtttgatctccggccgagcctcctcgctgttgcggtcgtcgccggttcacccagaggccgtcgtcggcatcgcagcgccaagccgaagcccgtacacccctctgttgccgccgctcgtcaccagaaagccgtcgctgttgttgacccgtacctcgccgtcgtcccgatctcgtcgccagccatcttcttcgccgttcatcgctgtgtaagtgttggtaagcatcgccgttgcctcctcttcctcccggtgcctagaggtggccaaacgggccgggccaaaacgggcggcccgaggcacggcggaacctgtagccggcacggcccggcacggcctgctacagtaacgggccgtgccggcacggcacgagtagccgtgccgtgcttgggccgccggccgagcccgcgggccggcacggcacggcacggctactgtagtaagtccgcatctcatccttccgcaagtccgtatctcatccctcccaactgacggcccagcccgctagccgcctccgcaagtccgttgagcacccctcctagctgatggcccagcctgccagccacctccgcaagtccgcatcacatccctccgcgccatttcggttcctgggccaaccgtgccccgtccacggcccatttttcattcacgggcccgtactgacacggcgggccacacgcatgccgtgccggcacgggcacggcccggccatccacgggccgtgcttgggccggcggctcggcacgtgggtcgggacggcacggcccgtttcatgagccgtgcctaacgggccgtgccgaaacgggccgtgccggacccgtgcccgtgccgtgccgggccgggccgcccgtttggccacctctaccggttattgtgccgtggttcgcgggcaaccgccgctcctatgtcgttcaccggtatagtttatccctagggtcttaatcccatctaatcgaatcttgtttggccctagcgtcgtcatcgtcttcgtgtgttgtcgccggaccgtcatcgtcgaccctttctctccgatcgctttggttcagtgagacttctatccattctctcttttcagtggcatattatgtttttttatatatgttatctactaaatatgattcaatctatttccggaggttgttttaatattttatctcagttataaatcatttgtaaatggtttaattaatttagaatagtcttttctttaataggtttaattggaattaaatcttgtaaaattcgtaactaattcatatgaagtcggaatgaggccgttcaagtctcataattcatctaaaatcatgatctacatgtttgtttactttacatgtactgtttatttggtttttattagtctttttcctcattttacatgttagcttgtcgtttccgtcgtttcgaagattcgtgagtgcgtcagaagtattcaagaagattaattgaagaccctttattgcaaggcaagtcacacagatcccaaacacaattcctttgagcatgttaatcatatatttaaattctctatttattttaactgtgcatttattttcgaatgtcactgggtggtgtgaacctattcctttgttatggccaatttgcattgattaccctatttcttgattaccttgggttataatttgactaattggatttatatattggttcaactagatatattagatataattgcttagccatgcttagaaacattagcacactattgggataactaatgtttcactgttacttaatgatgtacatggtaaaggtagctcacgatggtcaatcgtgattggttaattaattaatttgacaactaaaacttgataatggtgggttgtgagcacatggttttgatggtcgtgctcattgcaattaaggaccggttcacgagattcagttgtgaaacattaaccgtgccaaccacaagccagagtgggcaacggctggacactttgtatagcaaggctcattgtggtgtgccagactgagaagtggcggagataagcccacgggggtcgctggggagtccatgccttgttttataagggggtaattatgatccaggaacggtgcactgctttgagttgagttatgcgaggggtcttgtcacaatcactcgccatggtgacgtgtccgcgcggcacggtgacatgacggtgggttgtgtcttgtgggtacagtggtacacctctggccagagtaaaactattcgaatagccgtgcccgtggttatgggcgggtctaacaatgtctttcgtgattagtctcacacttctcaccataataaatgatgctataactggtaataatttgattagctcttggtttagaatggtacattcctggtttggagatagatctgtacagccgggtatggttgttcaggatggttgggcctgtgtagcatgggtgtgctgttcagtgttgattaaaacttttaaatnnnnnnnnnnnnnnnnnnnnnnnnnnnnnnnnatattatgccatcctttggtatccttgtgcacttgcatatttgttgtgtggcttgttgagtatgtcatatgctcaccttgcaataatcaatcaaacctcagttgaaaacaagttgcgaaggagaagacgtttggcttataccctagttgagctgcccgtgggagtggagctagagcttcgctagatcgttttttcgctgcagttttcttttcttttgtaagtatgtaacgttgtattattgatgattttgtatattaaattgttagtttgtgtacctcggctgattcttggacgaggattgaatgcacaaataagtttggatcggacagaggacagtcgatacagccgatagaggtgatgcagccgattccgatgatgacggtttcaaagatgtttctataatcgatcaaggtgcatcacaaggattgccatgatggagataaagctctcggataggcaattgtatctattaattaggatatttcatgtaatttctttagagatatgtttgggcaaaagtgtcggagcccaaaactaacaacttggatccgactagaattaatgtatcaatccctggatcagtaaatattgatacatacaatataactggttctttgttgcgaacgttaaagttttacaatactaagtgttttacaataataggtactcacctaactaattaatacacagcggaagtttctatacattatgactagggaggtataacctttagggattctctaagttatccgggtcatcgtagtaatagtcataagggtcctcctcttgacccaaatctgaaaaaggggttataagagcaaggatgagtatttacaatactcagcaagttatcatgggaatatgttatgcattgacatatagtagggttctttgcaaaaagtagtactagacaatctagaagagttatagcaagaatttataaaacatatagactttagatttctaaccagggtaccatatgagtcccggtactcaattccatgagtacggctattcggatagtttcaaagatattctactgcagcagatgtacgctttacccgcagtccacgacttgctgataatcatcagctttagtcatggcccagtattaagtcattaacaattgtggcacctgttccatgaacttatatcctcatatgctctgaacgtattgttaatagcagcaagaggagttctggcgttcccgagatatttaaggggaactgatcgtatgacaccatgtcatctcgatcagggtttagaaatataccatatagtttatactcgagtatcacaaaccatttacctgtacatggtaatggttaaagttgcccttcgcggctatagttgcctcctgcgcgaggacttaaaaataagaaccactatacagaggtgccatattgctaattaacataataacaaggtctgtccccattctagaaactgcggtcgtactcgttcgttcgacataagtacctggtaaaacttatatcgattgagacagtactagccacccggaaatcaaccaaatcttacgtactgtcccaatctaagtataaggtattttaaccagattgtaagcaaagtaagcaatactaaattatatgggtttctatgattgatttatgcatagaaaatagaatattgaatagaaggctataaataaataatttataaaatataggcttaaatgatcaacaggtatatggtaacttgccttgctcgatgtcttgagattgattgatattatctattgagtcaaaagaatcctcaagacctagggttagacatatataaaattcaaatttaaaaggaaatcaaataaaatccaaaaatatgaaaaatggagaaaataaaataaaatgcaaaaatagcaaaaaggggctcaaaagatagagaatgattttagtagaatattggtccaagtttcactggaattggatctatattttaaaagatatgggcttctaaagtttgaaaatcaaataaatgtgaaatggcactatgtgcgggtcccacctgtcagtctctctctctcctcttcttctacctccggccattccccaaatcggaccggcggtgctagggtttgggattacggcggcgatggagggggaaagtggttgtggccgaagaggggagggagctagggttctc

SEQ ID NO: 47560 - DNA, 6231 bp, Oryza sativa
catggttgaaacggaagaactcaccgagatcggttgaaatggcggattacggccggaaaaacttctcggcggcgaagaacagagcagcacgggggcagcggtgctcggcttggcgcggcgaggtaaaactcgacgcagagcttcggttagggcttagtatactagaacatggtaggatataggtgttctaaggggtaattagggcggaggatggatggaggggtgtgaagtcgatcgcgcacaaggtgttcgaccgacgggcgatggtgattgatagaatggattggggaagcagagcttcggggttggggggttatggttgttgatgatcgatgatggacaaggaagggattggggtcctatttatagggctaggaggagcggatgagctcgggcaccgtcatcgccatggatgagctcgggatttggatatggctagggcggcagaggctgtgagagggcgggcaagatcaatttgagtggcgggaggccacgtttgaatacttaccggcgaaggattggcttgaccgcgtgcgaattcggctggcgacgtgttggcgccaatccgggcgcaacgcgcggcggcagcgaaggtgaaaacggccgactcgggggtgaatggtttgaattgtgagaggggataccaccgtctatcttcaatccaaccgtgcggcaagaattggtgcgattcaccccggatagaatcaaaatcggactcggcggcggctttggtcgggcgcgcacggcgtcgagctgcaatttcttgcggcggtcgtcgtcccggctttgtcgtcgtcaagattggtgcggcggtggtggtctgagggcatcgaacggctagcggtgcgccaaggcgattgggcacgcgcgatcgatcccgagaccgacgcgcggtggctcggcgcgcggcaaagtcagatgcccgggcggcgcgcgtgaaggggaggaagaagcaaagaaatccacggtttttgagtggggtatggtcccctaggatcaaatatagactttgcaaaggattgggtaggaattaggctgtgttagatgggctagacattttgccgaacaccttgagggcaatgaacagtaaaatccaggaattttgaatattttccctaaaaagatttgaatttaaactatgattttggaaggttttcactaaggtttgaagtgaagcatatccttactaatattagggtaagctaagaaaataatctctagtttgaaatttgagagaatttgctcaaatttactaaggtttggaataaagggaataattagagtaaattagtagggttctaaagaagtattacgtgaaccaatcaaatagatttttaaaacacactaatttaatcaaaagccagcatgatgcaatcaaattttagtttaaaatttgagattgttacaaaaaagtctgccgcaaagacttatggtatcttagagtttgttagagataagtatcgtgtctggcaaggacatatcttgtatctcaggtataaataggacccgaacccatgtaattaattaacaatcattcaatacaatctcgatgcatcgccaccctttttactttcgtttatttcgacgagttcttgctttcgggttgagctgcatcggtttcaatcttctactagaggtaaaacttgttatggcggcttgtgttctcgtggttaatgcttccatctttacggcactttaaccctgtttatgtaattcattgagttatcatatacacgacacaatctatattagttgcgctatataacttattatcggctggttcttatttttaggaagcaattggtagagttatgttttgttattaatctagattgtatcgtgtatctaccatctcttgtaggttttcatcatcctgcctagatctcatacttgtctttatgcttaatgctgcatcggttgagttcgatctattaagtagtatttataattataatatctggcttattttatgatcattgagagatatagtatcggggtttcagccgatcttacctgatttagctttatgtcccatatgcttaattgatatgctaaatctgccctttatattaatatcttgttgcaataaagtgtattagacttctatcatgatatgttctatctgttttaatatcttaatatagagtggtatcggagtactagccgatacatgctagatctatctgatcggctatgctataagcgcttataatctttatgttaatgtatacttcgatctaagtgatttatactgtctcggcatgacgaccgatctatcccaatcactttgtttaaatatacatcgacagaaggattatatagcgttaatatctacagtcgatcgagtagatttagtcttatcttgcttatttataactgccgatcgattcacatatgacatcggcttgaaaataaatgatacgtcatcggcgactggccgatcagctatcatttatggatttaaccgcgatttttcttgtctttgtttcttgttgattgcaggatcaaatcaactggcacgctcatgaacctaaaagcaagattttggacctgcactgaagttaagcagatcttctaggccagtgtgtgtttttcgcgtcaacacaacccaacctccttcacttgttgcacaacgagctcatggccacctagggcactaccgctgccgctaccgctgcagtgacagattggcggcggcgtgtacactccatcgctggacatgacagcaataacccacctccaatctgataccactgttggtggcccagctcacaagagcacgcactcacttagttgtttacacattgaagaaagaggctaacagatgaacataagaactctcacgcacaagctctagatgcacgcataagtaatattttgtggcgtaatgcattgtctattctccacacacaacacaatgcttacatgcttaattagccacacactaattaagcaatggctcagccacgattggccgcacgaccgaccgagcaatctcgtggctagctacccactcactaacttatctagtattgccattttccggctcaaattgcgtcgcctagctcgtgacctgagaagatggagccgcttccaggtcggggacatcaaactccagcttgcagtagcgttcgaagtaatcttccaactggaagtagctcaggaatcaaggctgctctctgccgaagaacaacatctgttgtcaggcctcaaaacaaaagtcttaggccttgcggtgctcaataaattgaggctaagacagtgcttgagattaacttggcttaaagaaggtgatgttaattccaaattcttccacattaaagcaaacacaagaagaaggaaaaactacattcattcgcttcaaaccccgtcaggagtggctgtttcggcacaaaataaggaagaagaactttttagatttttcaaggaaagattggggaccaatttccaaagaactttaagcctaaattggtctctattacaattaccttcgttggaccttaatgagctagacgaagatattacggaggaagaattaaaatccataattttcgatttgccccctgaaaaggcgcctggtcccgatggcttcattggggcatttttcaaaaccgcttggcccacggtgaaagatgatctcctcgcagcaattttatcctttatgcatctcaacacttctcaacttgcagaactgaactctgcctttatttgccttatccctaaaaaagatgatgctacaggcgctgatcacttccgtcccattagcctcatgcatagcttcgccaagattatcaccaaaattctggcaaatagacttgctcctcggctaaatgaaatgatctcacaaaatcaaagtgcttttgttcgtaaaagggcgattcatgacaattttctgtacgtccaaaacatggtgcagatgcttcatagatcaaaaaaacagagtctattcattaagatagacatagcaaaggcgttcgacactgtgaattggccatatctcctgaaggtccttcgtcatttcggctttgggcatcgttggttaagttggatttctaatctgatttccacctcctcgtcccaagtgctcctaaatggttccctagggatgagaattaatcatgctaggggactccgtcagggagatcccctgtccccgatgctgtttattttagctatggagccttttcaccggatcattaaagcagcggagagtgccaatgtgttagccccgattggcgtgagaagtggcagattcagatgttctctctacgcggatgatgtcgcggtttttgctctcccaaatcccgatgacctgaatgctctttctcgcatcgtttcgtgtgttgcacaaatttctggtttacattctaacatcaacaaaactgagattttccccatcagttgtaatggaatcgacatgcaacagcttcttgccggctggccagggcagatcaagaatttcccttgccgctacctaggtctccagctccacttcaggaaattaaggaaaattgatttccttcctcttatagacaagatcggggccagactaccagcttggaaaggtcgcttctttacctctgcaggtcatcaaaccctagttaactcggttttgagtgctatgccgatgcatcatcttacagtccttcatgcgccaaaatgggtcttcaaaagaatcgaccgtttcaaaagatcttttctatggaagggcgaagaccctgatcattcaaatccaagtgatagtctagtcaattggcaaactgtttgcaaaccgaaaagcttaggagggttaggcctaccggatctggacaggttctctagagcactctgactccgctggctctggttcaagtggaaagaatttgataaaccctgggtaggcatgaatgtgccttgcgatgagatggacacaatactctttcaagcggcaacgacaataatgattggtgacggagcaaaaactagcttctggcatgataattggatccaaaaccattgtttaaaagatattgtgcctagttgttttagcatggcaaagagaaagcaaagaacaattcagatggaaatgcgagataatagatggctcactttcttcagacaattcacttccgtgaaacaaattcatgatttggtacagcttggtggattactccaattggtttcactttcccaggatcctgacgacatcacctggaattggaccgagtctggcgtctacacaacaaagagtgcttaccttttccagttcgaaggctcatttgccaccaatgagtttgattctctatggaaatccccgactgaaccaaaaataaaattctttggttggctagttctccatcaaaaaactttgactgcccaaaatctgctccgtaggcattggccttgcaattggatatgttgcctttgtggttgtgtcttcgaagatacaaatcatttgttcagtgactgtgtgtttgtcagacaagtgtggaccctaatttgtcaattccaaaacttgtcttcggtcggaataaatcctgtcttggatgtgtcaacatggtagtctggaaccaaatttgcaggctctaagaaggatgtgcagctggtcaggggaactcttctaactatctggtggcatatttggttggaaagaaatagaagaattttccaaaagtcttcctgttcagagattgaagtagcttattttatcaagcaagctattgatatgcgctgcttggcctttaaacccccatgaattttttagcttttcctgcagttgtaattctctttccattccttggcttgtaacctctgaacctctgtgctactttgtatttttttctcttctaatgttaaattccggcagatctcctgccgtcgttctcctccaaaaaaaaaaaacaattgcttgcatgcagatcaccactaacacatgcatgcatgctagctgatccacacttcacgccatgactctcacttcacttgacttggccgctcctccaaggcaacgtgcactagctgcatgtaatcacttgcatgcaagtcatagctatcaccgatcgaactaattcacacatatatttatcaacttactctctctcacatacacatgactgagtacagctctactacatgcactcacacgacaagaacacataatcaacaagattaaacccaacaatcacctcctaatcttgttgtttttatttgagcccctcctcgttggtcatcacaacaaagttggctcatcat

SEQ ID NO: 47561 - DNA, 37941 bp, Oryza sativa
ttcgtctctaaaccacacaataccagatataatgcgtccctcaacttccaaaatcggtgcaaataaggtttcccaagtcggtttggacggcgggacgtggttcctgcatggcacttaaagtcaaaaaaaaactatatgatccacatgttaataggacccacgtcatcacccccatttctttcccctcttctctcccttcctcctctccgtcgtcgacgcaccccctctcttcgccctcttctatccctccctcggctgtgagcctaggatcgcggggaggagcagaggcggccgggcgaaggaggcgggagtggggaaggccacgcagagctaggcgcaatgggagctcgaccatggccgtgcaaagcgacacaggagcggaggaggttggacggcaatgaaacggtgagtaaagaggaaaccgagtggggcaaggcgaagaggaggaggcccacaacggcgaggtgatggtggtccagcccgggtagatccctccgcggacgtgagaagaagaagtggagttcactggtgaggtcgccgttgggctttgggctcggccttccccatgctcccctacatcacccatcccctccccgctcaccagcagcccagtcagagtcgtcgcgcttggcgacttcctcctatgtctatcttaggaagcagcccgcccacagcgggaggcctgctacgcccatgctatagtcgtccgctgcagcgtttgggccgggcatggagctcattggtgacttcctctgtgtgttgctctgccaccggccgacctcagctccatcattcctgtctctgccgcgacgtcgcctaccactacatgggagagagtgtaaagaaagatagggagggagagaaagagggtgccaggtgggacctgtatttttttttcacgcaatgacatgcaaagcaccatgtagacgccacatgcaacaaagaccaagttaaagcaccacataggataaagagaaaattccctatatacccctgaaaatttactcaatcccttcaatacccctgaatttgacattatcccttatatacccctgagttttcattttgatctcctctatacccatctccgttagttgaccattagttgaccgttaaatattttaaaatgactatattacccatattatacatatgtgtggtacctacccaataaattttcatatgaaaaataaacttatacaaaatacaagcaatataatcatttaatgcccaacttaaaaaataaaacttattattttttattttttaaaaattatgattaaatccatacattagtttcaccagaaaattaagagcaaaaactaaatgttatttaggtttaaatttttgggaagatatacgaaattcatcaaatttgatctgaaatttatttaaaaattttaaatttgttttctaatttgtgataaactaattatatcccctttgttttttcacaacgaatcttttttcactaaatatttgttgaaaagtaattttcaaatcttatgcagaacttttttttacaataaatctttttttattttaatgaaataatgttttattttcaaaaattcataacaaatatttagtaatttattccttattggttttcacaactcaaataatttacacataaaacatttctagcttttaacaatataacaaggacaataaaagtaatttctacaataactaacggtcaaactaatggtcaactaacggaatgggtatataagggatccaaataaaaactcaggggtatataagagatcaaacaaatttcaggggcgtagaagggattgggtgaaattacatgggcatatagggaattggccctaggataaaatcattgttccaaactgcccaggaacctgatttgttctggttttgatagttggcctatgttatgtcgcaagttttgttgctaagggatggtaataaaattcgacctatagttgagggacataaaatggaccttattgtcttacagatttcttgttacaatgggccttgaggtttaggggaaatagcccatcgacggtgggccacatagctagaattttggcgggaaaactagtgactgggtggcaactggtcgtccaaaaatatctcaatacggtctgacatgtggacccccaaaagaagaaaagctctgagcacagatgggtgcaccaagtccacgtacaccgagtgtcacgggttcacgacccccgctgcagaagaccgggcgctccgtggaacgagtccacgcccgcccagctccttccttctgcgctacggctgtcagagctctactacctccgtgaacctggctcaccgtgaaccagcaacccataccacctcctcggcttctcctctccggcttctcgcttccctttcccacagttcgcttcgccggcctcctccgccgcgcagaatgcgtctcccgctccgccgcgcgctctcccccgcggcagttcggcgcgccttctccacggccgccgcctcgcgccctcagtgggcgatgatccgccaggcgccgccggtcagatctccgtcgccgcacgcgtccctcctgctcgccgagcccccgcgcgactcctacctcctcgtgccggaccacctcatcgaccggcgtccgggccccgaccccagcagcgacatccgggggatcctaggcggcacggtccacgccacgagcggcgacggcggcctcctcctcgtcgtctacatggactcccacgccccggcccccatcatctccaagatcgtcaccggcgcctttcctgctcggcctcgggtcagcgatctcgccggcctcgacttgagcgacccagacttcatccgtttcgtctgcaaccccatcaccggcgagctgttccgcctcccggacatcgacggcaccaagaagaccatgttccgcggctgcgacaacgccggcctcctcacccgctccgcagccggagccgggcacggctcgcctgacagctacgccgtcgccgtgctcggcgaggaccgcaacggcgggaccttcaacatgcggcggttcctctcgcgaaccgggaagtgggagaagctagtgggcttaccatccccgctcccgctcacgcggcggatggacatgtacaccgaggcggtggcgttcgccggacggctatggtgggccgacctgacttggggcgtcgtctccgccgacccgttcagcgactggccggagctccacttcgtcgagctcccgaggaacagtgtgtggccagtgcccagcacagatcttgtacaagagcaggctatgcaccggcgtctgggaatcagcgaggggaggctgcgctacgtcgaggtgtcccaggaggatcctttcgtggtcagctcatttgcccttgacgacgacggcagcggctggacgctggagcacgaggtggcgcttggtcgaatctgccaggtgaagggaggaggcccgagggacaccgcgcggattgccgtcattgacccactgaacgcaagcgtcatgtatctgatcgttggcaaacatgttcttggtgttgatatggacatggggaaggtgatgggttgttcactggcagatgaaactgaaggccctccatatgctatcacctctgtccttaaaccatgtgtgctcccaccatggctttcatcaagcaaaatccctgctgcaggtaatcatgatcttccacatattcatgtcttgtttaagatgatatgtggttagggatagtagaattgttagatctgtagtacttattttccatgttctcttatattaaattatgtggttagttaggggcttgtgcttaggagtttgttttgttctatatatggctcatctcgtatgactgtttagaaacctcgaactcaaaaagggtggactaattgtagctgtctgtaatgtacatattataatatagcattttggtagtcttggcaaatgattgtgctaagccactaaccgatagcctatgaatattagcagtgtagtcatgaataacgtctttgaatatttcctcaaaaactaaaatttcagaatagaatattggtattagtaagcaaatccacatttctgttttaagtacatttgttataagaatgacatgctcttggtgtctaataaacctcaatagatgcaataatgtacaaaaatgtgagcttctacttttctttttctggcataatttttcatgtcctttcaattgaaggaactttttcacgcgacaatggtgacgccaaaagcaagactttatcagacatattggttcgtgcagacagcgacaagaggtgaagaaaattatttacttgtgtactctcctttggtacttatataattcaccatctatttccttatcaaacagttaagaaaccatgttagcaaatactagttaagaagtgctaattttctgttgaccatgataaccttgtttacagtgaaattggcacttctgttttaagcaaatgaacgatattatctgcgatcatgtaatataacgtcagaatttagatggggaagcacctttggtatggtggtggagttgtggattgcacccacccggttcaaattctggtgttgtacgtttgcatcctttgttgatgtagaggccagactttatttctattttctaaaaaataaaaactttagtgtcttgaccttgcttcagttgtacatatttgtagttgccagatggtagttcttactcaatacaaagtttgctttcgtccagtaaatcttattttgtagtaaaacctaaacaaatcttattcagatttctagttgtcttgttattgtctatattgcttagtatacccttcttgataagtgattatatcacaataaagaaactgtatatagaaaatcaacatttagtgtgttttaagaggaaaaaaaaaggaaacgggcatataatacaatgtcatcattcctgtttacttgctataattaatcaagaaaatttgcttcttcctccgctcatttttcttcatatgatcaattagatgtcatctatcatctctgaaatttaacagttgaaaatgtccttggtggactaggaagcgctatttcattttcagataggatatattaggatgtcaatgctgctgcaatcttgaactctcgttttgggggaaatgttggctgaagactgatgttatgatcttcacaatggtatcacacagaattgtgcttcacttaattgcttctgttacgctcattttttagtaggataacacagttctgttggcaagcgaccatagtcaggactcaagaacatagatgaagagcatcatcattttttgagtcatgacagaatagtttataagatggatttgtttagttgataatagttgagcaactgttgcctcttctgcagtcttaagggtagaggtagactacatcactacactaaaaattatcacaatcatgttctactcttgagtcttgaccttgcatcagtgtgcagattatagctttttttctgaacagcattgcatgacttacttgtatactccaaattaggctaatacaggtaccaaattaccaagtataaaagccttaaaagtgtttggtcttgtcatcattatgatttattttcatcaaatagatcattatgattattgtctcacataatattatggacaactaattaagagctttctatttgtgacacatgatcttgttctgatatttttcctgggatcaataaatttatagaaagtaataagcatatcatattcattgctttaaataaaatacaaagaggttataggggactatggaggtatttctgctggcttgtgtgtatacagtatactgaacaagcagacattattaagtgcacactagcactgtataagagctttcccagcattgttgtcatcatgctgagcaattgtcattctttagtcctaaaatatcatgaactatcagactaaaatgaagcttgctatttcataacaaggatcatggtgtaaccttctgccgaatcaagggatgaatatcaaacaatagatatgtactgtaatactctgctgaatcaggacaccaataaaacataaaacactactccctccgtactcataaaggaagtcatttaggacaatgtttaagtcaaaccttgggaatataaatcgtaaataactctcaagttgttgagtttgaaaatgtaaaaattatatgaatagatttgtcttgaaaaatactttcataaaagtatacatatatcacttttttcaataaatatttttatagaaacaaaagtcaaagttgtgttttggagaccgtgtcactgtcctaaacgacttcctttatgagtatggagggagtatctttcaatttttgtgagtaaaacggactacatggattgtcgtagtttcctgttttcttgcgtttatattgaacactgtaaattgtatttttgtataccagtagttctcttcatataattattgacatgcatcctaatgttttctatttgatccaggttatgtaaagacgaactgacaggtgttttaatagaaagctaatgaatggtagcttggagaagtctcgttttgggtaacttggagaattatttgagtgtgttggccctctcagtttacctgctgtcttattttgtgagaaaccgttactgtttcatgttttctttttttggtggacggtttgtgtggagattatggatatcccatatctacacggcgatgatatttggactgaatataggataccgaatatagatagaatatcttatttgtatctcgggtttgtttctcaacttgtacatcaaggaaataccttgagacttagtcggttacgactgtattttatctgtatctgcatattccgttagggatatagattatcttttgtaacacggactccttcctatatataaggggggtccggtgcctctaggggcatgtgttgattctctccaaatcatacaatcaataagatactcggcggattcatccccggacaggagtaggttattacttcttgaataagaaggcctgaacctgtataaatcttttgtctccaaacccattcacttctccagcttgatagccacccccttttattattgccgaaatctagtttcgacagttggcgcgccaggtaggggtccgtcaagcttttcgccgatcagtgcaatgggttccgtctccggcatcgacgacctcgtcttcccacccgggcagacgtttcggttcggcagcctcgacttcgtcaccaacaacttcggcaagatctctctccttgactcggagtcagaccagtcgggagagaaccggatttcagtcccgtttggactcccaaacgcggctgaaagttacttcaagaccatctcaatcgagttggcttcaaaccactcgggcgagatcgcatcttctccaatgtcaccagatcaagatgatgaggcttacccaccgatcctgatgaagctccccaacgatttggcggccgtctccatcacgacagcgtctccatcccgtaggcctaggcggaagtcggcttcaacaccgatttcgcctagcttcagggaagtcggcgtcatcctccaaccactcggcacggtttcgacggatcagctggatggctactacagctctcccaccgtcgactcgcgtcccaccgacatcgtagagtacgacgagtttagctctcgctacaacgacgcggatctcgacgacttcgacggaagcctagatgacaactacacccctctctacttcggcgtcttcatggccgataacgagacggaggagcaacgccaagcccgggaaaccgaagcacgtcgcgagactgagcgtcgccgactggaggaggagcgtcaagcacaagaacaagaacggctacggcgtgagcagcaggagcgtgagcgaaccgcgaaggaggctgagggccgacggcagcgagccttggaagcaggccgccgagcgcgtgatttcatcggccaacaagatgttgaagggacaccggttttccgcacccctcaacagaacgcggttgccgcgatcaccctcctcaacaccctcctcaaggaaaacgagctcaatcaatctgatcacgtcgtcaacatcttgaaccagacaaagaccatgattgcggcttcggtcccagttaactccgaaagcgtccgcacgccgactggcagccgactcccccacttccgatctcatgactaccgtcgtccaagtctcagcatcactggcgcaggatccaatcgcaggagcaggggtcacgacgagcggtccgttcactcgcctcccgaccatcatagggagcgccgagtggaacggcctcgctcaccacctcgtcgccgccccgtcgatcttcgcgacacaatcatacagcgccaagcagctcgaggccatcatcattcgccggaccgccacgacgacgaccttgatggagtagcagccttcaccgacgacctgcgtcgagtggattggccagccggcttcaagccgactggaatagagaagtacgacggcaccaccaacccagaatcatggcttaccgtctacggtctcgcgatccgcgcagcaggaggagatagcaaggccatggcgaactatttaccagtagctttagcggattccacccgatcttggctccatggattgccccgtggtacgattggatcttgggccgaattacgcgaccacttcatcgccaacttccaaggcaccttcgagcgtcccggcacacaattcgacctctacaacgttgttcagaagtccggagaatcccttcgagattacatccggcgattttctgaacaacgtaacaagatctccgacatcaccgacgacgttatcatcgccgcattcaccaaagggattcgccacgaagaattggtcggcaagttcgggcgtaaacctcccaggacagtcaaacttatgtttgaaaaagccaacgagtacgccaaagccgaagacgccgtcaccgcatcaaagcagtcgggtcccagttggaagccaaaaaaggatacgccggctacgggaggaggtggaagtaacaatcataaggaccgcaagcgtaagcctgaggaacttgttgcaaccgccattcactcttctcgacagcgttcgcgcgtcaacacgttcgacaagatcatgaactcccaatgcccgcaccatcctaactccaaccacgtggccaaagactgtttcgtctacaagcaattcgcggagcaatacaccaagactacacggaagaactccgacgaagaacaaagcacgtcgaggaagaaggacgacggcgacaccccggtaggatttcaagaccaccgcaaggagctcaaccatatcttcggcggccccctggcttatgagtctaaaaggaagcaaaagttgaccgaacgggagatcaatgctgttcagcctgacacgccccaatatcttcgatggtcagagattgcaatcaagtttgaccgctcggatcatcctgaccgagtggtccacccggggcggtaccccctggtactagacccagtggtccgtaatgtcaagcttcgcagaaccctcatcgacggtggcagtgcactcaatatcctcttcgccaagaccttggatgatatgcagattcctcgctccgagctaaaaccaagcaatgcgccttttcacggagtaattccaggattatccgcaactccactcggccagatcaccctcccggtcacttttggcactcgggaaaacttccgcacagagaatatcagctttgaagtcgccgatttcgagacagcataccatgccatactcggacgcccggcgttagccaagttcatggccgtcccgcactacacttacatgatgatgaagatgcctggtccccgaggagtcctatccctacggagcaacatcaagcaagccgtcacatgcgacaaggagagttgcgacatggcccaaacccgcgagatagcgtctgcccgggaggatatccgactggctgcagccacggcgagcgaaggagaagtgcccgctaccaagacttcaaaaagtggagaaagcgaagccaagactaagaagattcccctagatccttctaatcctactaaaactgctgtaataggcgccgagttagattgtaaataggaaagcgcgctcatcacctttcttcagaacaataaagatatctttgcgtggaaaccatctgatatgcccggtattcctagagaggtgattgagcactccttgcatgtcaaagaagatgccaagcctatcaaacaacgactccgccgattcgcacaagacaggaaggacgcgatcaaggaggaattaaccaagctgttagcggcaggcttcatcaaagaagtccatcatcccgactggctggcaaacccggttctagttcggaagaaaacggggcaatggcgcatgtgtgttgattatactgacctcaacaagtcttgccctaaagatccttttgggttgcctcgcattgaccaggtaatcgactcgaccgccggctgtgagcttctcagttttttggattgctactcggggtatcatcagatccgactgaaggaatccgactgcttgaagacctcattcatcacgccctttggagcatactgctatgtcaccatgccgttcggactaaaaaacgcaggagcaacttatcaacgtatgatccagagatgcttctcaacgcagatcggccgcaacgttgaagcctatgtggatgatgtagtcgtcaagaccaaacaaaaggatgatttaatctcggatctagaagaaaccttcgcgagcatccgcgctttcaggatgaaattaaaccctgaaaagtgcaccttcggagtaccgtcagggaagctgcttggttttatggtgtcttataggggtatccaagccaacccggagaaagttactgctatcctcaacatgaaaccgccaagtacccagaaagatgttcagaagctgactggatgcatggcggcgctcagccgatttgtttcaagacttggcgagcgggggatgcccttctttaagctactgaagaaaacagatgatttccaatggggacccgaagcacagaaggccttcgaagattttaagaaactcctcaccgagccaccggtcttagcctcaccacacccgcaggagccgttgttgctgtatgtatcagccacctcccaggttgtgagcacagtcttggtcgttgagcgtgaggaagaaggccatgtccagaaagtccagcgaccgatttactttgtcagcgaggtcctagccgactccaaaacgaggtacccttaggttcagaagctattatatggtgttctaattactaccaggaagctatctcactactttcaaggtcactcggtaacggtggtcacatcatttccactcggtaatatactgcacaaccgcgaagcaaacggacggattgctaagtgggctttggagttgatgtctttggacatatcattcaagccccgaatttcaatcaagtcccaagcgttagctgattttgtcgccgaatggaccgagtgccaggaggatacccctgcggagaagatggagcactggaccatgcatttcgacggatcaaaaagactttcgggcactggagcaggagtggttctaatttccccaactggagaaagattaagctatgtgctttggatacatttttcggcgtctcacaacgttgctgagtatgaggcgctccttcatggactgcgaattgcgatctccctagggataaagcgtctaatagttcgaggcgattcacagctggtcgtcaaccaagttatgaaagagtggtcctgccttgacgacaacatgatggcatatcgacaagaggtacgcagattggaagacaagttcgatggactcgagctcagtcacgttcttcgacacaataatgaagccgccgacagacttaccaactttggatccaagcgcgaggtggcgccctccgatgttttcgtcgaacacctttatacgccgacagtacctcacaaagatactactcaagttgcgggcactcatgacgtagctatggttgaagtcgactggcgagagcccctcatacgattcttgacttctcaagaactcccccaagacaaagatgaagccgagcggatttcaagacgaagcaaactttatgttatgcatgaagctgagctgtacaagaaaagcccttcagggattctgcaacgctgcgtatctttagaggaagggagacaattgctgaaagacatacattctgggatatgcggaaaccatgctgccgcacgcaccattgtcggcaaagcttaccggcagggttttttttggcctacagcagtgtccgacgccgacaaaattgtgcgcacgtgcgaaggttgccagttttttgccagacaaattcatctaccagctcaagagttgcagaccatcccactgtcttggccgtttgcggtttgggggctcgacatggttggcccgtttaaaaaggcagtcggcggttacacgcacctctttgtggccattgacaaattctccaagtggattgaagctaaaccggttgtcacaatcacagcagataacgctcgagacttcctaatcaacattgtgcatagatttggagtgcccaatcggatcatcactgataatggcagacaattcactggcggagtttttaaagacttttgtgaagactttggaattaagatttgctatgcctcagtggcacatcccatgagcaatggacaggtggagcgagccaatggcatgatacttcaagggattaaagcgcgagtttttgaccggctaaaaccctatgccggcaaatgggtggaacagctaccatcagtactttggtctttgcgtactacacccagtcgggccacaggccagtcaccttttttccttgtctatggggcagaagcaatgttgccgagtgaagtcgaattcgagtctttgcgctttcgtaatttccgcgaagaacgctacgaggaggaccgagtggatgacttgcaccgactggaagaagtccgcgaagcagctttgattcagtcggctcgatacttacaagggttgcgacgttatcataatcgcaatgttcgatcccgtgcctttctagtcggcgacctcgttttgaggaaaattcaaactacacgagatcggcacaagttatctcctctatgggaagggccatttatcatctctgcagtcacccggccaggttcctatcgactcaagcgcgaagacggtacactcgtcgacaactcttggaacatcgaacatcttcgtcgtttctacgcttaagcttatcactgtacttccctatcttgactgtcaacatcaagttttcttcttgaagttgtcagtcgggggctatcatcataataacggagtgtgattttttatcaattcaatttgcttccttggtctatcattgccttgtttgatttttttctacttagtttgcgaggactgaaagtttttaatagcttctttgggttttaggctcaacaaagcttgataaaagcttttaagaaatcaaagacttggctagaattatcaagcacagcataaatacaccagtattgtacaagttatgcctccatttgctacatttatgctcagtcagaatcagtcctttcatcatcagagttattactactcggctgaaggtcggtgttgcggaattgatctacgacgtcacttgcaatcttgtcagccgcattttgagcattgctgataagatcaagagcagcctctacgcttgtcccgtctgcaaagccatcaatggcgtcaatttcaatcctcgggtacaaggatttggtcatcaccaatgccgtgctagctcccatacttccagctttcttgatattcttgaaatatacatcggagcaactctcagcttgtcgaagatttcggttgcgtcgagtacactcggaccactgttattgaggaacatagcttggacgagtggtatagcgacattagcgacttcatctcttgctccttcaagcctcttgatcttaccaaccaggacgtcaaattgagcttgagatttgattttgcggtctacaaaacacatttatgataaaaatctactgcattaaaaagagagaagttcagattgtcagctggcagtaccttcaacctccttcaaggccgagtccctttgcgcagccagttctaccttgtctctttccagggcttcaatttgtttctccatttgagccatcctggcggcttgcgctgtttgaaatccaaatggttgaggatacagttacgacagcgtaaattaatgggacagatctagagattaccttttgatgaaccactcagctcgaagtttgaatcctggagctgagcaattcggtcccttaattccttctctgtctttttggcaagctccttggcctcatgtagctggtccctaactgcttcaagagttcccaaatgaggaaccagcttttctaaagttgcggtcttggcctcattgcgaagatggattctctgcatgatggttcatggtttagttttgctgaagagaaaacaaagtcatcaaaggcagtcacccggaagatttacattcacaatgcgagtggcttctccaagtgccttcttcagctggcacacttcctcatcttctttttgacgatttatgacgatgccggcagcttgtgagttctcgtcccaccatttgagcaagataggaggacgagagtcatcagccgcctttatgcgaggaatttcttcttcgtcatcgcctggtggtcctgatgtatttccaagatattagacgaataagctgaagttatttaaatcggcatcacttgagaagatgagttacttgaggatgttcctagctgagcgtggggtgatccttgttctttatctggagacccaatcatcgagtcgttaccagcctctggtccttgagaagttgtcgtctgcgcttcaacttcgggagtttcttgatctggacctacatccgactggtttccagtcgggggctcttgggttgttgtagtttcagttgccgccgactggttttcagtcggaggatggtcactcggattggccttatcacctgaagtatgggcgccagtcggctggctttcggcagtcggctcagaatccttggatgaacttggttctgtcacagtcggatcaggatcttttccagttggatctatgtcggatggtttcctgcaaagtgttctttcaatattcagtattatttccatgagagaagcatgtcgaagtgaaatggtaccaagaggtttatacctagaagttgttctgatctttggccttggacgactagccagttttttcctgggagtggtatgctttgggagtttattgggcgagcctttgtccccagatttgttgccgtcgtcgccttcgtcgtcattaagcaccagctttctcttgcgagaacctgtctgcccagtcggattggaggtttgaggttgcggatctgatctgattgtcggccctctacctccctgaacggtgtgctggcgaggagaccggcgctgagtgattggggggttagacttcatcaatacatattcctgagtgagatgcctccacggttagttaactcaacatgaagacaagattatgttttggtcatgggttgaagatttcagatacgtacctgcggaggcggattgaatgcgttatatggcacaactggcagctgatgtgagtagctgacgacaatggcatttgagaagtttttatacattctctccttcatgattttaaaatccagagaatctgattcttcatgattaggatcatgcttaccgtcaaactcgaatgccgtacgggatctttctttaattggtgccaatcggcatttgatgaagtgccgagtaatctgctctccttgtaagccttgttctttgagttttagcatgcgatccatcagctccaaggcttgggctgcttcatccccaatcggaagagagttccaggtatcttggtacaccggaggaagacaagagtactcgggaagagcaggctcaggattctgaatataaaaccagtttgcgtgccaccctttgtttgaggtcttgaagggcatagagaagtacttctggctcagagtccccctcagctgaaatccggcccctccgactacacatggcttactcttgtttggttggggcttgagaaagaagattcggcgaaacagagcgaagtggggcttaattcccaagaaggcttcacaaacatggatgaaattggcgatgtgaactatggaatttgggtttaggtgatgcaagctgattccatagaagcttaatatcccgcggaaaaattttgaggtcggaagagcgaagccgccatagaagaaatgggagaagaccacagtctcgtgtgtatcgggggtcggaaaagcctcaccgcacgctggccgccacccgatgatttccttggcagggagaacgccgtgcgccaccatctccttcaggttctcctccgtcacgtcggatggcgcccattggccttcaaagctttccttctcttccgccattgattttttttcgaatgcgctgatttgattcgagggatggctagggagaggtgaaggattgaggcggtggatcacgggaaggattttgatgaacttttcgaaggtggattcgagtggaatggtgaaccctagtttgccggcgtagctctgtactgtagcagggagtggggaaaatggcgagagttccggcgggggagatgaagtgtcgcttggatctcgggatttcttgttaagggtatcggaggtacgaatgggtttaggcctgaacagtacctcagcccagtacttttaacagcgtggcccattgtgctccttagggacttaggcattttttgctttggcaatttatgcgcacaatagtgttgcccaatgctgataaaatcctttttacgcggtcatataattctttggaattattacaatgcaaattaaaaggtgcccgacagaaaggtgttatgctgtttttgtaagcttttttaggctacaaaagctgtctgggttaacttggaatgacttgtttttaccatagtcatttcctcggtatgttatatgcctgttttcattatggtaaatagtcatagcctaggctattagacttattcattaccataatttttataatatttggtgggtaatctttagagttttctattcggatgcctgtcaagtgtgttcattcgtgaaccttttagagtgttaaccactcggattccttttaattatggctaaaaagcagtcggctaagaatgcctctttaggcgccgtgtatgcttttgtcatatgatgcacgattgtgctattattttgttctcaactatatgtttagtttgttaactaatcacatagttgggaggtacacctaattaggtgcatctattcgatgcaccatattctttatcttttcgccctttacagtcttcgtcttcgctactcggcaggccttggcatgaaaagtttgaagcattcggattattatctttgagaaggctatgatggttgactgcaaaggtctcgggggctactgtggagattatggatatcccatatctacacggcgatgatatttggactgaatataggataccgaatatagatagaatatcttatttgtatctcgggtttgtttctcaacttgtacatcaaggaaataccttgagacttagtcggttacgactgtattttatctgtatctgcatattccgttagggatatagattatcttctgtaacacggactccttcctatatataaggggggtccgggtgcctctaggggcatgtgttgattctctccaaatcatacaatcaataagatactcggcggattcatccccggacaggagtagggtattacttcttgaataagaaggcctgaacctgtataaatcttttgtctccaaacccattcacttctccagcttgatagccacccccttttattattgccgaaatctagtttcgacagtttgctttcaagcaaattgagaacattgctttaaactgtgaaagtgatccagttcagtcagcattaaactgccatcacttaagattatatatgttgtgttagttgtataccattaccatgcatcttatttaggcatcttctctgcatactcattctcttaagatacctgcgatcacattgtctcaggtagcaaacaattcagtatcagcttcctttttatcttggcactaaggtgacgatctattgttactggcaagatatgaaaagtcccttttatttggagcagatggctagaaattccttcgaatgcgcaagtgtgcaaacaccagtgctttgcttgttggtggtgtttatcttgtctggtttggaaaggaaaatttgaggcaacatatctatctatcaatctacagagggaagggggacaggaaggggaaggggaagatggaaggggagggatgctagctgaattgttcggtccttcaatgtgatatttgaactccatatgtaatagctttctacttactactctactttacttactaatttagtcggatatacggtaccaaatatagatagaatatcttcatgaggactcgggttagattctaaacttgtatgtcaaggaaatacccgggatcctagtcggttacgattgtattttatctataatcccatattctgttaggatatggactgtattttgtaaagcggacttcttcccctatataaggaggggtccgtgtgcctctcggggcgtgatcttttttccggtttatacaatcaataatacactcggcggaatcatccccggacaggagtagggtattacttcttgaataagaaggcctgaacctgtataaaattccttgtctccaaacctatccgctttcctagctagatagccaccccctttcattattgccgaaatcttgtttcgacagttggcgcgccaggtaggggtagcgtcaagtttttgccgactaagtgcgatgggttccgtctccggcatggacgacttcgccttccctcccgggcaggcgttccggttcggtagcctcaacttcatcaccaacgacttcggcaagatctctctccttgactcggatttgaaccagtcagggagagaccaggtccccgcgccgtttggtattccgaactcagccgaggcctactccaatatcatctctcccgagtcggcttcaaaccacccggacgagatccaatctactcctctgcgaccagatcaagacgacgggtcctatccctcaatcctgatgagactacccgatgatttggccgctgtcttcacagccaagacatcttcggccccgatccaatctagatccagagaggttggcgttatactccaacctcttgggacagtctcgacggaagagttggacggctaccttagctcccctggcgtcagttcccgaccaaccgagatcctcgactgcgacgacttcggctaccactacgactacggcgacttcgacgacagctatgaggataacaacacgcctctctttttcggcgtattcatggctgacaacgaaacggaggaacagtgccgagcccgagaagcggaggaagagcgcacgcgacaagacaccgaacgtcgccgactggaggaagaacgacaacgacaagagcgagaacgactacagcgtgagcaacaagatcgcgagcgagttgcaaaggaggctgaagatcgacggcagcgcgccttggaatccgggcgacgagcgagggatctcatcgggcaacaagacatcgatggaacagcggtttttcgcaccccccagcagaacgcggttgcagcaatcactctcctcgacaccctcctcaaagaagacgcactcaatcaagctgatcatgttgtcaacatcttgaaccagacgaagaccatgatcgctgcctcggttccagccaactccgcaagtgcccgcaccccgactggtagccgagtccctcatcttcgatctcaagactatcaccagccaagcctcagcattgccggcgccggatctagtcgcaggagcaggggacatgatgaacgatctgttcgttcgcctcctgaacgacatagggagcgccgagttgaacgaccacactccccacatcgaaggcgccccatcgatcttcgcgacaccatcaaccagcgccgcgcggcaagaggctatcattcaccagatcgctacgacgacgatatggacggagttgctgccttcacaaatgatctgcgttgagtgaattggccagccggctttaagccgactggaatcgagaagtatgacggcaccaccaacccggaatcctgtctcaccgtctacggtcttgcaatccacgcagcaggaggagacagcaaagccatggcgaactatctgcccgtggccttggcggattctgcccggtcctggcttcacgggttaccccgcggcacaatcggatgatgggcagaactacgcgaccacttcatcgccaacttccaagcacttttgaacgccctagcacacactttgatctctataacatcgttcagaagtctggagaatcccttcaagattacatccgacacttctccaagcaacgcaacaagatctccgacatcaccgacgacgtcatcatcgccacctttactaaaggcattcgccacgaggacctagtcggcaagttcggacgcaaacctcccaagacggttaagcagatgtttgaaaaagccaatgagtacgccaaagccgaagatgctattactgcgtccaaacagtcgggcaccacttggaagctaaggaaagacacgccgaccgcaggagggagtggaagtaacaaccacaaggatcgcaagcgtaagcccgaagaacttgtggcaacaacctctccatcttcccgacaacgttctcgcgtcaacaccttcgacaagataatgaactctcaatgtccgcatcatcccaactctaaccacacggccaaagattgcttcgtctacaaacagtttgcggagcaatacgtcaagaacgcacgtaagccctcagacgaagatcaaggcacatcaaagaagaaagatgatgaagacgatgccccgactggttttcaagatcatcgcaaagaactcaatcacatcttcggcggacccctggcttatgaatctaagagaaagcagaagttaacagaacgggagatcaatgtggttcaacctaacacgccccaataccttcagtggtcagagatagcaatcaagttcgaccgctcggatcatcccgaccgagtggtccacccggggcagtaccccctggtactagacccagtggttcgcaatgttaagctccgaagaactctcatcgatggtggcagtgcactcgacatccttttctctaagaccctggacgatatgcagattcctcgaacggaattaaagccgagtaatgcacccttccacggtgtcatcccaggattatccgctacaccactcggccagatcactcttccggttacttttggcactcgggagaattttcgcacagaaaacgtttgtttcgaagttgctgatttagagacagcataccatgctatactcggacgaccggctctagccaaattcatggccgttccatactacacttacatgatgatgaagatgcctggtcctcgaggagtcatatcattacagagcgacatcaagcaagccgtcacatgtgataaagaaagttgcgagatggcccaaacccgcgagattacactcgcccgagaagagatccgactggctgcgaccatggcaagcgaaggagaagtgcctgcaaccaagatgcccaaaagcggagaaagcgatgccaagaccaaaaagattcctttagatccctctgatcctaataagacttctgtaataggcgctgagttagattgtaaataggaaagcgcgctcatcacctttcttcaaaataataaagatatctttgcatggaaaccatccgatatgcctggtattcctagagaggtgattgagcactctttacatgttaaggaagacgccaaacccatcaagcaatgactccgccgttttgcacaggacaggaaggatgcgatcaaggaggaattaaccaagctgttagcagagggcttcattaaagaagtccttcatcccgactggctggctaacccagtcctggttcggaaaaagacggggcaatggcgcatgtgtgtcgattataccgacctcaacaagtcttgtcccaaagatccttttgggttacctcgcattgaccaggtagttgactcaacggccggctgcgagctactcagttttttggattgctacttaggatattatcagatccgactaaaagaatccgactgcttgaagacctcgtttatcacgccctttggggcctactgctacataaccatgccctttggattgaagaacgcaggagcaacctatcaacgcatgattcaaagatgtttctcagctcagatcggccgcaatgttgaagcttatgttgatgatgtagtcgtcaagatcaagcagaaggatgacctgatcacggacttagaagaagcttttgcaagcattcgtgctttcaggatgaaactaaaccctgaaaagtgcatcttcggagtaccgtcagggaagttgctcggatttatggtatctcaaagaggcatacaggccaacccggagaaaatcaacgccatcctcaacatgaaaccgccaagctcccaaaaagacgtccagaagctgactggttgcatggcggcgctcagccggttcgtctcacgactcggcgagcgggggatgccctttttcaagctgctgaagaagactgacaatttccagtggggactcgaagcacaaaaagcctttgaagacttcaagaaacttctcactactccaccagttttggcctcgccacatccacaagagccgctactgttatatgtgtcggcgacctcccaggttgtgagcacggtcctggttgtcgagcgtgaagaggaaggccatattcaaaaagtccaacgaccagtttatttcgttagcgaggttttggccgactctaagacaagatatccttaggttcaaaagttattatatggtgtcttaattaccgtcaggaaattatctcactactttcaaagtcactcggtcacggtggtcacatcgtttccacttggggatatacttcataaccatgaagcaacggatggattgcgaagtgggccttagaattgatgtctttggacaatatctttcaagccacgaacttcgatcaagtcacaagctttagctaatttcctcgccgagtggactgagtgccaagaagacatgccagaggaaaagatggaatattggactatgcattttgatgggtcgaagaggcttacaggcactggagctagggttgttttaatttccccgaccggagaaagattgagctacgtattgtggatacatttttctgcgtcccataacgtggcggaatacgaggcgctgctccatggattaaggattgcaatctctctaggcattcgccgactaatcgtccgtggagactctcagttggttgttaatcaagtcatgaaagagtggtcttgtctagatgataatatgactgcttatcgacaagaggtacgcaagttggaagataaattcgatggactcgagcttacccatgtccttcgacacaataatgaggcagcagacagattggctaattttggttcaaaacgggaagcagccccttctgatgtgttcgttgagcatctttatgaaccaaccgtgcctagaaaagaaacaattgaagccatggatactcaaggtgtaaacatgattgaagccgactggagagaacctctcataagatttttgaccaaacaagaactccctcaagacaaaaatgaagccgagcagatttccaggcgcagcagactctatgtcattcacgagaccgagttgtacaagaaaagtccatcaagaatcctacaacgctgcgtatctttggaagagggaagacagttgctaaaagatattcattcaggcatctgtggtaatcacgcggctgcacgaactattgttggcaagacttatcggcaaggtttcttctggcccacagctgtttccgacgccgacaaaattgtgcgaacatgcgagggttgtcaactctttgcccgacaaactcacctactagctcaggagttgcaaaccatcccgttgtcgtggccgttcgcggtttgggggcttgatatggtcggtccattcaaaaaggcactcggcggttatactcatctctttgtagctgtggataagttttccaattggattgaagccaaaccggtcgttacaatcactgcagacaaagctagagatttcttcatcaacattgtacatcggtttggggtaccgaatcgtatcattactgataacggcactcaatttaccggcggagtatttaaagacttttgtgaagactttggcattaaaatctgttacgcctccgtggcacaccccatgagtaacggacaagtcgagcgtgccaatggcatggtacttcaagggatcaaagcacgagttttcgaccgactgcgtccctatgctagcaagtgggtagatcagctgccgtccatactttggtctttacgcactactcccagtcgggctaccggccagtcgccgttcttcttggtctatggcgcagaagcaatgttgccaagtgaggtagaatttgaatcccttcgatttcgcaacttccgggaggagcgctatgaggaagatcgagtggatgatatcaaccgactggaagaagcccgtgaagtagccctaatccagttagctcgatacttacaagggttgcgccgttatcataatcggaatgttcgatcgcgagcctttttagtcggcgacctggttctgaggagaattcaaactacacaggatcggcataagttatcgcccttgtgggaaggaccgttcataatcgctgaagtcactcggccaggttcttatcgactcaaacgcgaagatggtactcttgtcagcaattcttggaatattgaacaccttcgtcgattttatgcttaggcatttcgtttgtatctttcctctttgactgctaacttcaagcttttccttgaagtttccagtcggggggctattatgataataatggagtgtgatttttatcaattcaatttgcttacttgatttatcattgccctgcttggtctttcgacttagtcaatgaggactgaaggtttttaacagcttttgcgggttttaggctcaatatggcttgacaaaggcttttaagaaatcagaagctaagtatggaacaccaagcatagcataaattcatcagtattgtacaaattatggctccatcttcattaatcatcaaaatcattgttatatcaatcagtatcagttttttcatcatcggaattatcagacccagtcggccgaaggtcgacatcttggaatctctcaaccacgtcagcagcaatcttgtcagcggctttttgcgcatcattgatgaggtcgagggctgcttcttcactcgtcccgtctgcaaacccatcaatggcatcgacatcgattttggagtataaagatttggtcatagctaatgccatgcttgctcccatactcccagcttccctgatattcttgaagtaagtatccggagcgactcttagcttgtcgaagatctcggaagcgtcaagtgtactcggaccggtgttattgaagaacatggcttggatgagtggggtagcggcattagcgactttatccctggccccttcaagcctgttgaccttttcaactaagacatcaaactgtgcctgggacttgatcttgcggtctgcatcaacagattcacattaatgaatcagcatatagaagataatggcttttgaggtattgattattggtaccttcaacctcctttaaagccgagtccctctgtcttgccagttctgccttgtcattttccagagcttgaatctgcttctccagttgagatatcttggcagcttgcactacattgactctggttaatcaagattacaaacataatagcatgagttagttgggcagagtttgtgcgtaccttttgatgagccactcagttcaaaattggattcctggagctcagcaatccgatccctcagatcatgtttattcttcctagcaagttcttttgtctcatgcagttgattcctggtggcttcgagggttccgagatgagggactaacctttctaaggtcactatttagcttcgttcctaagatgaatcctctgcaagacagtttaatcagcgcttgaactaaatggcaaacgagatggttgagatcaggcgccaaaaagcttacatttacaatgcgggttgcctgaccaagcgcctttttcagtagacataactcttcgtcttctttttgcttatttattacgattccttgaggctgcatgttgtcatcccaccacttgaccagaatgggagggcgtgaatccttagctgctcgtatctggaggatctcttcttcatcaccaatcattggccctagtgtatccatgaataaagatgaagcaatcaaataaagtctgttggatcgaaatgatttcagatagcgtgtttacctgtgatgattcccggtcggggacgagtggactcttgtgtcttcacaggagatctggtttctgagtcattgccagcatcctttccgggaggactgtttgtttgagcttcaacctcgggaatcttttggcttggccctgtatccgactggtttccagtcgggggctcctggttaactccgactccagcttcggccgactggcttgcggtcgtgggttcgtcgctgggttctacattgtcgctggcctgcggattatcactcgggtgatcttttgcagtcggcccggtttcttttgaggaatccgcttccatgttagtcgggtcagagtctttctcagaaggatctatgtcagatggtttcctacaagttttaccatcagtgttattttcatgatgggagaataataatacaaggaaggttgctatatgatttgtacgtggaagaccttctgatttttggtacaggacgactggaggttttcttcttcggattagttggcttcggaggtcttccggtcgctcctttatctctgagctttccggtaacatcgccttcgtcgtcacttagaaccagcttcctcttgcgagaatctgactggccgactagatcagaagcacttggttgggttttagaccgaattcttggtcctccgcttccctgaccagtttggcagcgaggtgattggtgctgggcgattggaggatctgacttcatcaatgcgaattcctaagcataaatgtcaagcaacttaacaagagacgaaatcatgtttttaaggaaggttggaacgtttgaatacataccggtggaggaggattgaatgcattgaacggtacgactggcagcaagtgtgaatagttgacaacgatagcatttgagaagatcttatacatcctttccttcatgaccttgaagtcaagagaatctggatcttcacagtttgggtcgtgcttgccgtcaaattcgaaggctgtgcgagatctctctttgattggagctaaccgacacttgataaagtgccgggtgatctgttctccttgaaggccttgttcttttagctttatcatcctctccatcagttccactgcttccgcagcttcatttcccattggcagtgagttccaagtatcccgataaactggaggaagacaggagtactcggggagagcaggctcagggttttgaacataaaaccaatttgcatgccagcctttgtttgaggttttgaagggcatagagaagtatttttggcttaaggttcccctgagttggaagccagcccccccaacaacacatggtttgctcttgtttggctgaggtttgaggaagaagatgcggcggaacaaggcgaaatacggcctaatacctaaaaaggcttcgcaggcatgaatgaaattggcgatgtgaactatggagtttgggttcagatgatgcaggctgattccatagaaattcagaattccccgaaaaaatcatgaggttggaagggagaaaccgccatagaagaaatgagcaaataccacgatttcatgcgtatcgggggtcgggaatgcttcgccgaatgccggtcgccacccgatgatctccttcgccggaagaacgccgtgcgccaccatctccttcagattatcttccgtcacatcggagggcgcccactgactctcgaagctttctctttcttccgccatgaatgtgaactggatagtttaatttggtcctagatacggctggaaggggatggggaatcgaagcggtggacgcggggagaaatttcgtaaagtttttgaggatggattggagcggattgatgaaccctagcttcgtcggcgcggttctgtactgtagcagggagtggggaaatggcgaaagtctcggcggggaagacgaagtgacgcttggtcttcggtgtttttagggtatcgggagtactaatgggcctaggcctgtacagtacttcagcccagtattataatcagcgtggcccgttgtgatccctagggacttaggcgctttttgctttggcaatttgtgctcacaatgatgtggcccaatgttgttaaaatcctttttaatgcggtttgataattctttggaattaacacgatgcaaacaaaaggtgcccgacaggaaggtgttatactatttttgtaagccttattaggctgcaaaagctgtttgggttgatttgagatgactaatttattaagagtcattctcttagcatgttatatgcttaatttggttatggtgagagtcatagcttaggctattagactcgttgattaccatgatttttatcatgtttggtggatcattttaagagtttcttactcggattcctatcaaatatgtctgtttttggaccttttgagtgtttatcactcggcccttttcgtattttttatccttgatatgttcaagttgagaagcagttggctgagtgttttactgagtaccatgcatgcttcgctataaaaccactcggttcttgactacatgtttagtttttcaactaatcacatagtcgggggctacacctaattaggtgcatctactcgatgcaccaagttttattttcgcccttcacagtctttgattttagcactcggtaagctagagcaagttgaattgaagcgctcggattactgttttttgtttcgagaaggctattttgtcaactgcgaaggtctcgggggctactgtggagattatggataccccatatctacatgacagttataatttagtcagatatacggtaccaaatatagatagaatatcttcatgaggactcgggttagattctaaacttgtacgtcaaggaaatacccgggatcctagtcggttacgattgtattttatctataatcccatattccgttaggatatggactgtattttgtaaagcggacttcttcccctatataaggaggggtccgtgtgcctctcggggcgtgatcttttttccggtttatacaatcaataatacacgcggcggaatcatccccggacaggagtagggtattacttcttgaataagaaggcctgaacttgtataaaattccttgtctccaaacccatccgctttcctagcttgatagccaccccctttcattattgccaaaatcttgtttcgacagttaatggccatataatctagacatgtaatttgtggtgttatgttgactatgtcatactgtcaaagctcccttctactccctccgtttcacaatgtaagtcattctagcatttcccacatttatattgatgttaattttttagataatgaaagctttattaatctcagtaaaactctatcaagtgatacaattattctgagagcacctccagcttctgcacccaaagagtgcacacagccaacaagaaagaaacagaagataaactcatcatccaaatagcatggacaaaaagaacttcaggagccctctaaccgtagcctagaacgccacccatgcgccggagtagaaaactccatggccactagctccaattgttgacaagccgcaatgatagtaccccgcaaattgaccttctgaaggatagcccatgagcggagccaatgtgtaatcaaaaagataacctgcaaaggagcagatatgttttttctttcaaaaaccacatcatttctacaaagccaaatagaccaaatagtggtagttgcccataataagaccaaagatctcaaattgcgtggttgtcttcttatccaatgcccaaacatatgagttgtactattaggtaaactaatattcgaagcaaactggattaaagaccaaactacgtgggcaaaacaacaatcaaagaacaaatgattaatagtttcatctttgtggcagaaagaacaagacttgtttcccctccaattccttttaataagattatcttttgttaagactactccacgacgtaagtaccataagaagatcttaatctttaggggggcattgatcttccagattcttttgttaatattgggaacatcggtctgcaccaacgcaagataaggagatttaaccgagaatctgccatcagtggttagattccatttaaactcattttggtcataagataatataatattagcgatgcgtgagagaaggtgattccacgccactaacttagagcgagtaaggtccctgcgccaagaaaagcttagaggactggtttggaaaatttctgaaatagttgcatgtttatgcctaacaacgttatagagacaaggatattgttgtcttaaacaggcattcccaaccatttatcttcccaaaaccgtacttgagagctatctttgatgttgaaggagccaaacctgagaaaatcaggcttggccttcattagactagcccaaaagtgtgagtctcctgctttccactgagcttgagacaaaggctgtgaccccaaatatttgttccttagcatttgttgccatacaccatctgtagtgagtagtttatgcaaccacttgctaaggagagccttgttcttaatttcaagatcttgaattcccaaccccccttggtctttaggacgacatatgatgtcccaccttgctagtctatatttccttttgtgtccatccccttgccaaaagaaccttgatcggaaataatcaatcttcttgatcactcctttaggtatttccaaaaaggacatcatatacattggtaggctggtaagcactgaattgattagtgttagtcgtcctccaagtgataaaagtttgcctttccaacttgccaaccgtttttcaagccgttcaatcacttccttccactccgaattacgaagtctcctatgatgtataggaatgccaaggtaacggaatggaaaagaaccaacctcacattgaaaaaggttagaatattgatcctgagttgtttgggcttcaccaaagcagtaaagctcgctcttatggaaattaatctttaagccagataattcttcgaaaacattcaacaacattttcagattacaagctttctctagatcatgttccataaagagtacagtatcatcagcatattggaggatggacaatccaccatcaatgagatgaggcaccactccaacaagctgtcctgcattatttgctctctggatcataaccgctagcatgtccgctataatattgaataaaatgggagatagcgggtcaccttgtcgaaggcctttctttgtttgaaagaaccgtccatcggagaaaggggcaatgaggtggtcattttcagcctctgtaacttgggggatatcatcaattctatttgcatcaaaagagagagtacttgcatctggtggtccaaagagtttcttataaaactcagtgatataattctttatagcttcattcccctcaatcttaccttcctcttgatcttagactaaaaatacgtttcttccgatgtttgccatttgcaatcagatgataatattttgtattattatctcccaaacgaacatcatcagtctttgcaatcatattgatgttaatgaatctagatagatatatgtctagattcattaacatcaatatgaatgtgggaaatgctagaaggacttacattgtgaaacggaggaagtaacttgcttttgttggatattgatgtgtgctgttgagtatggtgctactttgtgatgcttcacatgttatatgtgatatgttggaaatatcacttgaaatcgtggcaacgatattgctgaaattttgtccatgatattgtgctatgtaatcttttacaaattgtgttcaaattattgatgaatttctatcaaaattttgtccaaaatattgtgttctgtcatcttttacaaattgtgttaaaattattgctaaaattctgtcaaagttgtccaaaatattgtgttccattatattttacaaattttgtcaacacttaggtcccatatgaaatacgcataaattcaacttgaaacatgtccagtgttcgcgacaacgttattgatctcaatagtagggctatatttgtccattcaccacacatttaaacaccgttaccatgagttcacagagtatgggtagtaggttgcttcatttcaaaaaagcaggagcaaaatcacaaactctaaaaagcaggctaaaatcacaattgaactagaaagcaagggcaagaacacaattgcctccaaaggtctatgtggagctcaaggtagggaaataaaaatgaggcattacttatatcacatatattgtaaatcagaaggtggatcaaagaagaaaacaaatcatacaatctggtcaaggtgagggctcaaaggttgaatcttgtgatgtggaaggtacaagatccaattcaacagttgagggcttctcatgggtgtgctcgatttcctggatggtttcgctgctgatgaaggaggtgttctctaggatacgatccaagagttcccttccttctatcgtggttttatgtgcaaaggtacctttggcgtaaatgtgaagatacggagcatattccttgtttagacccaaacaaaaatgttataacaagacatgatcgggtatagatgttggtatttcttaacgacattactagaaatataattcccagcaatggcgcagaaatactcctggtatattatggttagagagtttatccgcaagcgcacggatataccattgcagcatttcacccgagagtattacaagggtatcgtatttaatttatcccgtgggaagatcatgtagagagaacttgactaataatttatatattacttgtgataattatattctaagcaggggttaagataatctaagggtagagtgacacacaagcatcagctactcattctcataatatattatctaagctaagtggaaagaaaagagagagaatctattcctatacttctaatgtacatagtatacatacattcttagttaactgatacactagctaataccctctatccgatgccctcctggtacttcgagaagccacccctgactgccgagttccttacgtcagaccgtcatgaccatacaaccggggctaaatacggaggaataccctccccagggaattaacttaggattatatacaggcgcggaggaatacctgtactgagctgtcaccaacagcggcccacctctcatccgtagcatataaccccaaataatgatatcccgtaatctagacaccacgtctaaactaccagatactactctaatatcatcgtcatgacatagagtaattacataagcaaacattatacccgcaccaaagcatctgccagataagctagccgtacattcagtataacatgaacataatgtaaagtaggcattcatatactcggaaagtatttcaataccataaatgtagatagaagagtattctaataaaagtacaaggcttacaaaagaggagaaaagctattagagccatacccgaactctttcgaagactttcggactcctgatttctactctattccttttccactagctagatactactaaactaaacttgagagaaatgagagagctcttgcttgaggtgtgtgagtgaagtgatgatgagagctccttttatagcctcccaatgacggttgtgacggttggaaaggtcggtaatacccaccaaccgtcattggggagccatctcagctgtccaggagaaccctggatcaaacggcactgcagggggttcggctgaaccatgggctgggccgacctggcccaatttcggcaggcagcttcctcttttgctctcatacacagacttgtgaattttggcctggtttgttgtgtcaattctaagttcttgtcccattcatacacaagtctgattctcgacatcgtccgattgatttatcgtttgagttgatgttgattctcctccactttatgatcattctctgcaaaaggttagtaaacccaatactagtggaatattattattctaacatatttatgcattgcaagcatcactagttctcctctgttttgataaaattgacggtcgaaactgatcgataacgaccgtcaacaatagacaactctaaccaaattgagttaacaatgagaacctaagccaagctgctccaataaattcctcctttctctgctgaaagccaaggatttccatccgtagggagacaatactggatagcgggaagaaaccaagacaaaacctacttttgagttcccccattcgttgttcgtcttcctaacggaaagagcgtaccattgttttacctcctcaatgagagagaagggaaacaacttccactttggagtttcttgtgtcatgcctgagattgtctggcacgagcacaattgctaaaactctcgtagatgacagtagggctttgagctatcgcacccccgagaaggattgttctcgaatggctataaagccaggacagagttcatatccagatgtgagaataagttttgatgaagttgctggctcacaaaactcgcccttcggaaacatttcatatagatagttgctccatgatggaaaagaaaagaaaagaaatataaaaagataagataagaaggcaaactaggtttgaagataatataacaactgttccatagtaacaccgccagaaattcttatattgatatttattactcacagataaatacgcaagcgcacggatactgctgtagcacttaaccatatcgaatctcagggaacaagtgtgtaaaatcaaggaaacaggttcatccagggacaacaatttaatggtaggagggggatagagaggatccagatgggttaataatcttgaattaagttaaggtaaaactctatcacttgcttagggcactggcttttccatggtttgccaaacgaatcaggcctatagctctatgatgtacctgaatgtgaatcattacaaagtatgaacggagctatcaccacgtgttgcgtatctctacaacccatggagcacacaataaacaaaggtaatttttaacctagacacacgcttacgttatcgattacttctctagcccccacacaagaagtttcttctttatctagagtcttactagagcacttaatataaatattaaacgatgaacccataatagtgagaatatatcttacttaaaaaaattaaatacccaaaagaaatcacgaatactcacttaatgtggaatcctgtatacttatacagttgatccccactaactattttgctgtcctctcagttagccacgtcactttttattcttatccgttcgatcaatgtgttcaacgcagcagatagcttcttgagggttttctttcctactcagcgggcccagtccaaattaaccaccttgggccaaccggtgaatgacccctgcccttcccctctcgagttcccactagcgacacgaatcctttacgattttgctagaaatctgatgtcaaattttcttccccatatctgacgttttttgcgccgtccgatctgctcttcaagattcgtgctgatatttatggtattagtcaatgcgcggtctgaacgctgtcaaatttcgttttccgcgccgtgtctgtagccgtagctcctctttatctctcctactttctccggtatcttctccattcttctttcttctctcctcctctctttttgcttttttcttctctttctctccggcgagaggctttttcttctctctcgcgctcgagaaggagaggaatctcattggatttctctcatctgctccagatttgatcggttagttttgtgtcgttcgttgctgcttggtttttttgcatcctccggttgtttttttgagcgattttgtctaggtagttcgattttgattcagtttttgaaccggttgcgcgcgatagggagaggaatctcgtcgaatttctctcatctgatccagatttgatcggttagttttgtgtcgtttgttgttgcttgttttttgtttcatcctccggtcgttttatttgagcgatttcgtctaggtagttctattttgaatcggttgcgcgcgagaggcaggattttgaattatttttgtgttgattttgtggtcttagaatccaaatcctttttggatttatagtcagaatcctgtgtcgccgatgattcctaagttttttatgctgatctaggtgtcgccgatgattcctagttttttttagatctggcctatacttgtttttggttttttagttgtagttttaatttgaaatatgtcgatctgcttcttctgaggttctagacatttatttcctgaattgttttctagatctgattaggttttggttttgattttttccatgttgatgggttttgatctatgatttatggtgatggctattcaactcatgttgatttatcattatagtttttagtttttagattttttcatgtttgatttgtttatttttgtatttccagatccatgagatatcttatatagtgtttgtatttagttctatgctttctccatttctgtataataatgatgatgccaatatttttaaagttaaagctccacatgaattggtttggctagttcaggtatcatgtttatgtgtgtttcgaattacttagtgctaatctaaatgattctgtatgacatggttcactagtaatataattttctttttagtttctgtaccttttgttgttattatctgtgttatgttcattttgtaggtctaggtagatgtccaaatgacatgtatttgggttttggtatgttaattcttttgttcttgcattttttaaaactttcgatgttgattttgattagtttagccagccaaattcactccagtttttgtttaggatcaataaataaacctgattatttctgctacacctgattaaagcagtattgttttggtgagatttctgtgtgcaattggataaagcagtattgttttttggaattgaggtgaaatctgaaaaaacttgataaatttgtactcatgggatggctttatttttcttcattgaattttgattgtgcttgattgctctattaaagaattacatctcaaaattacttcttaagcacatgatatgaaagtcgtaggaagctgacaattgacattgttgtgattttgcatcattttgtattgcaaacttgacctgttcaattgacaaaaatagctgatcaatacttgttaaagttggactctatatgtgatgacaattaattggaactgtatgtatttttcctttacttaggtgacctggaaatgttctaatgtattaatgtcttagttctttaagctcatgttttttttctttgtattgatgagaatgcatctgatcttgatgagaatgttggtttactttcttacagaaaatctgtgtgatgcgatttaacttatggttctatgat

SEQ ID NO: 47562 - DNA, 2807 bp, Oryza sativa
aaatataatgaccaattcatcttttgattttcaaaagcctccagtatggttcttctttatttttttcttatgttttgttttaaaaatttgtaatcttcaatttataacttttttcaaaaaaaatatttgtatttgattcttttttctttgtttaattgcttttaaaggttaagaagaagaaggcccatgctaacacagagtcttcattcacaagattctctgtgaaatatttttctgaagttgtgtcctctttgtctgattatcaaaaatccattatcaagaaatttgagtttgatttcttgctgatgttcaatagtagttatgtgcctatcaagtttgccacttggattgccaataaagttgatgtcaggacatcagagattattgtgaaggaaaaaattattctagtcatagttgaatcagttcatgatattcttgggcttcctttaggtggaataccttttagcaaagattatgaacgtggcaggcaatgcatcctttctatgtttggtcagtctgtattgccttcagttaaattttttggtgatctactgattcagcagaaagatttgtctgaagatcaaataatcacatcttttcttattgtcgccttggcttgtttcttatgccccaactcttctttgactccaagtgtgaagtatttgactattttcgaggatgtttctcgcttgaaatactttgattggtcaaaaatttacctatgattggttgatgacttatataaaaaagtttcagaagaacaccactttcggaggctgcttgttttattgggctgtaagttttatttcacttctttagttttttttgcaatgcatttatattttttttattttaggttttgtatcttgacaatgttgattttggctcaagaaatgttgaccagagttgtcctcgtatttctgtttggaaagatgacatgatatcaacattctctgaattagacaaaattgatgagaacacttttggattaagacctctgaaagatttccaggacacttgctatttcaaggtatgtacttctgtcttgtaatgtattttttttcaatgaagtttgttgattgtttttatatttttttagcgtgattcaactcaatctagatcagtgataattcaagacaaacttgattcagctattggtagtatgcttccagattttctcaagcatgaaatctctgaaatgttgagttctcattgcttcagtcatcatttagttgacagtgaatcatgtgaagatttggttgtttctattttgtcgctgattgctaaagcaagtggaagtgatgctgtacaagatcagaatgaatctgatattttacattctcaagttaacactgaagctggcccaagtaattttcaacctgcaagtccaaaagacatacaatttgatgttcctcctataaattgtagtaagtttagtttgcttactcttatttcattccatttttcttataatttttttcaatattaattttttgtttttttatgattttttatatttataggctcccttcgctctgctcctaatattagaagtttaaggaatgatgaaccatttgataagtctgcattgaagtctattgaaaaggattgcccatcacttgatagaattgctggtatgtttatgaactgttttgtacttttaaactatatttctttttattaaatatgtactcttttttttcatttttataatagctttgtatggttcttctgtgaattgtgatgatggcaacaataatgagtcaatccacatcaacgatataactgtaagttttttttttaattttttttttacaatgttagactgattgaagttttttgttttagggaaatggcatgaattgtgatatatctgatccttccaataaatcaaatgttctattgtcatcaatgaaccgtggagatgtaatccttctttttatctatttttctcattttgatttgttttatttgtaccaacaaaatttttttctatattttattataggtggttattaatggttctggtaatggtattgctcctagttttgctgctagtaatgtactaactacttttcatttaattttctgtttgttcaatttttcattttaatttattatatgtctatgtattatcaggtcaacctgttgctactcctgatgttggttatcttaggaacataaacaatgatatgaatcaatctaatgcaggtgtttttttgcccattatcaattttaaaattaattcctattttttaaaagtttgtatttattagttcttttactttaataattttgctaggatcttctgttgctgcttttagtcttgtgaagaatgtggcaaacaagtttaggtccagattaactcagttaaattcaagagcagctatatttggtgaagataggccttcttttaggttgttagattctgatgatgatgtcagtgattgtgataaggacaacgaattaggtgtcaatgcattgatgcaacatgttctcaggtactacactattttttcctgttttaatttatatgtttaaaatagaattctttttgcattgatgcaacatcaatttttttgtaccacaacattatttttagttttgtagggctttatctattttcattctgttgaggacactccaattgagataattcgtgggtatgaaaatgttggtactaaagaaagaacaaattgtcaaaatcccaacaagaggttatttcaagatttaactgtaagtttaactcttagacattttcttaatgtattgtttaactcattcccattacatacagttcatgatgt

SEQ ID NO: 47563 - DNA, 53986 bp, Oryza sativa
ttgaccttgttacttgattttatttaccctgtctactaacttccgggcatttctacactgttttgacaattctttaatgattatgattagtatatcaagtattattcttactgtttattttaacttttcccatttatatatgttatttgctatcattgttcatttgataaagttttctactgatatgaattttttttaaagacgttcatgtgtaaaacatatcctttaattgcattttactgcatttgtgttacttcaatgcttcatctaattttattttttttaaattatcgttacagaattccccagatatccaatttcttggtgaatcaaaatttgctgactgttgtaagaaactttgttctaaatctgatgaaatttacaattcatccaataatttgtctacaagcacacaagatttcaattccactggtggcaagatacctatacatggccctaggagagttttaattcttgcaagacatgccacatatccatttgtgactgagatacgtcgatttccaataactgatgaagaaatctgttattacattgttttttgtcgtcttgctgatagttccaaatggcagaggtattaatctgatttttatttgtttcctattttttgttacatatgtttatatattttttaaaaaattttgtaattatatttttttcttcagttatgatgctgttgatatagatggtgtgaaggaaaaagtatcttagtttggtcattctctcaagaaaggtggttttgtctccacttttgttatgtcagttttttgtcgagtcttgtttcataatgatcatccctcaagatctaagaagaattactttttcccatctattgttgtaagttatttacttctttttatttttgttaaaatttgaaataaatatattcaatacattttttaaattttgtgatttaaatgtaggaaaaattgccatctaatatgtcttctacaagtgttatggagaaacttgaaaaatcttttgttggagctgggaaagctaggaaattacacttgtgtgatatggtaaggtgttttacttgatttgcttgttggtttttccctgttcatatcaacttttttttttgctcctgtccatgtattgctttgcatagctttctgtttttttattttatgtcccttaaatctaccttttatgctgtaatttgcatattcatgttcatcttcttttagattatactttaatgaattgcatagttaccttgattgatttatggcattttgcaaggaaatatgtgtcttttcgaaatttatgtttgtcaaactttcaagtcaaaaaatatatgaatattattattcatagtgtttatgcctgctgaactttctttatcattgcacatatgaagtttcatgtttattaaacttatagtttgtgatttttgcagcttcattttccagtcaacttcaatcatcattggtttctgtttgttgttgacatcaaggatagaatgcttgtaattttggattcattgcataatgagggtgatgagtattttcgacctattctgtctcagcttgtaagatcatatcatttctacttgtttattatttaattgttgcttaatttttgaggccatatatttctttttttgttattatattccttttttatgtttaatctaattaatttgtaccttgaaaatgtgaattcgtgatgtcgacctgtgactgtatatatgcatgtctgaatttttgatatttcttcaaattattcttttacatgatcatgatctttaatttttttcagttcttggtatgccatggtattagcttgccacttatatatttacttgctgaacatttcttgtgttgatctatgatgcatcatcaaacaatttttttgtttaactttttttttaatttttaaatttggtattcagatagccaatttacaaattgcttgggataaatttgtttgcgtacctatggattttcaaaggttccagattgtttttcctccagtacctcgtcaagatttcaggttataatctttattcttcatttttttattttagttatcttttttttgtttgatatttttaattgttctttttttctgcacatttttttgttcagctgtgattctagaatttatgtgatgaaattcaccgaactttggtcacctaggattatattatccactgtgctttcaaatgaaaacatcaagaatattcgtgtccaatatgccaatcaaatattctttcatccaaagaatagaatgctgcaaactgagattgaagatgttgttctcaattggtttgatcaagtaagttttgcaactaatatttttccctttttatcaaatttatttggtctatgtattattgtcacgcccggaaattcactagtaatttccgaacttatttgtgcatgaaatcctcgtccagaaatcagccgaggtacacaaattgacaatttaatatacagattcatcaaattaactaaaacgataaatacttacttaagagcactaagtcctcaccaagaagaaaactgcagcggaaaataaaatctagcgaagctccggctccactcccacaggtagctcaactggggtataagccaaacgtcttctccttctgaattctttttcttcaactgaggttgattgattattgtaagaatgagcatatgacatactcaacaagccacacagcaaatatgcaagtgcacaaggataccaaaggatggcataatataggctcatttgcaaaagcagcgtttagcaaaatatttaagagaaataaaacagtagagtagttaatcagaaattttaatcaacactgaacagcacacccatgctgcacaggcccgaccatcctgaacaaccatacccggctgtacagatctaatctccaaaccaggagctaagcaaattattaccagttataacatcaataattattgtgagaggtgtgagactaatcacgaaaaacattgctcaacccgcccataaccgcgggcacggctattcgaatagttttactctggccagaggtgtaccactgtacccacaagacacagcctcaacatcatgtctaacatgcgtcgcgatactggaaagtacccgaatagaggctgtgacaataccctctgcacaacacaactcaccacagtgcaccattcctggatcataatcacccccttataaaacaaggcatggactccccagcgacccccgtgggcttatctccgccacttctcagtctggtgctccgcaatgaaccatgctatacaaaaggtaaagccgttgcccacgctggcttgtggttggcacggttaatgtttcacaacagtagctcgcgaaccggtccttaattgtcatgagcacgactctcaaaaccatgtgctcacaacccaccattattaagttttagttggcaagtaattaattaaccaatcacgattgaccatcgtgaactatcattaagccatcattaaataatagtgagtcataagttatcccaatagtgtgctaatgtttctaagcatggctaagcaatcatatctaatatctagctgaaccaatatatatagctcaactagtcaagttataataacccaaggtatcaaggaataaagtaatcaatgcaaacaggccataacaaaggaatagattcacaccacccagtgacattcgaaaataaatgcacagttgaaataaatagagaatttaaatatatgatcaacatgctcaaaggaatgtgtttaggatctgtgtgacttgccttgtaataatcggtcttcaattaatcttcttgaatactccggcgcactcgcgaaccttcgcaacgacggaaacgacaagctaacacgcaaaacgaagaaaaagactaataaaaaccaaataaacaatacatataaagtaaacaaacatgtagattataattttagatgaattatgagacttgaacggcctcattctgatttcatatgaatttattatgaattttacaagatttaattccaattaaacctattaaacggagactattccaaattaattaaatcatttacaaatgatttataacggagataaaagattaaagcaacctctggaaaagattggatcatatttggtagatgacatatattaaaaagaaataatatgccactgaaaagaggagaggatttatattgattttggacagttgagattaaccttgaccgaatcgactaagatcggatggcttggattgatctggcaagcgagcctcacgagataccgactcaacgagtcaactccacgtgacatgagatcacctaaatgatcaaccgaaaccggcgaacagaaccggcggctctgaacggctctaaactaaaggacgactcaacacggacgaatgaacgaagcacggggaacacctcgttcgaacgaacgagcgaacgactcaacaacggctgtggctaaaccagtcggctagacacgattcacggtaaagccctggtacgacaaacgataggccggtaggaacctagggttgcacctacggctacacaactcgactaaaagcagcggctaggtttaagcggcacacagctgcgacacggcggcactaagacaacttgactcggctaggcggcggctaggcggaaacacgcagctagggttagggtgacggcacagccggtagcgaccatgcacggctagagcagcagggctgcgagcaaaaacgcaaccggcacggctgcggctgtggcaaagcggcaaacagcggcagcggtagtgatgcatgatagcagcgcggtgacggactgcggctgcgctaagtctaggcctctagggcaacagcgcggcaaagcggcaagcagctgcagctaagcggctcagccggcacacgcgcagcagcggcacggcaagcagctgcggggcaacgcggcaaggcgcgacgcggtagcgactaagcagcggtggctaagaggctcggtagagcgacggcaaaccgcagccgcacggcgtgcagcagctacgacacagcgacgacgacacacacggagacgatgatgacgctagggccaaacaagattagattagatggaattaagaccctagggataaactacaccggtgaacgacataagagcggcggttgccggcgaaccacgatacaataatgcaaacggagggcaccgggaggtagagaaggtgacggcgattcttaccaacacttacacgatgacaggcagcgacggaagatggccggcgacgagctccgaagggcggcgaggtactgatcaacggtggcgacggcgtttcagcgacgggagacgacaactgaggggtggacgggcttcaccttgctcctgcgaacccaatggagtagacggcgaccgaaggcgacgacggacgacgacgaacagtgcggctggagacatggcgacgacggcggcgctctggttcacgacgacgggcaacctccggtgggatttggcgcaaaacaaccggtggccgaggtagctctcacccttgcgaagccgagggaggcgacggctcaaggcggcactgaccagaggggcggcgcggcgccgctggagatggtggcggcggtggagagagaagacaagcgtggggagagcgattccggcgaccgcggaggacgggacttgaggggataggtagaggacgacgagggggtcctttatataggcacgggagctcgggaaaaagcccacatcgaggggaaaaacttgggaaagtttaggatcctcgccggaaaaaggaaagattgatccgcgaaattggaaaggatttccatagaaacttttggggatttcttagggaaattgtagaggagattgagaggattccattcccgcaactaatttggaaagaggagcaacgaggaggccggatttggaaggaggagcggcacggttgcacaggctcgggacggctcggctctatccaggggttgaagacaacactgtagcgagagggaggataaacagacttctatgcgggctgagaggaagggagataataggagggaatgggctgaaagggcccaagactaggaagaagattttattgcttttccaaaaaaaataaccaatgagatgatctctcaattgttaaaaatacttccaatgctcaaataattccaagaaaaatcttgaatatacttggacactctaagtatttaaaaatattgaaaccagaccatttaatgattaattcattagttaaataattactgaaatgttctttgtattgttaaaattaggaattgagctccgaaaaaatccgagaaaatttcagagagtataattaatcatggagaatttaataaaaattaaattcagccatgatttatatttaggaaattttatttcccacatttaacttcacttgtaaattaaagaacatttaatataaattctattattaatttattaaataatttataaagcctgaaacaaaaatcaggatgtgacaattatttagtttaaaatttcatttttttttcttcctgtaggagaaatttcctcgtactcgtcagcctacttttacttcagcagctcagaaaaagttctgccagtgacattgaattcttaggatcttttgtagcaaattggacagctattagctgtagttaattctgagaagaacataatactttcgagactaaaatgttgagcatggttttctgtaatagaatttttgctacatttgatagctggttctgatccagtaacatagtatattacaattgtctgttacacaattttttcattctcattgtagcaattgtaactaatctttttttcccttgatctatctgttcatctttgcttcatcttcttgtcctcttctcaattgtttttctttcattgtcttgactagctgacctctttcctgaaaattgaaatttcatttttttatatgtcagcctctaatttttttcctgttcttaggtgaatgttttttgtttcttacttttgcttgacgattctccagtttgatcttctccctgtttctttcttgttccaggcttcctttgcttctcaatagtccctgacaatgttaaatccttataagtacatttttggtaacacataatatttttgtacaagtttaatttatttcaaagaaattgttttttcttacttgtcttggctgttttttgctgactttgcataatgtatgtgtcttccatcaatgggcatgtctctattgtatgatttgttcttccacatcgtgtgcaatgcctttttggaatctctttaagcttctctacaattgcttttgttctagctgatttttttgccttttgtatttgctaaattagggtcttcgatatcttcttgttcattcattgtttcttctgtttcttattccccattactctcttttgttgtactgccttgattattttgttgcagattttcaggtgcctgttcaatcaacaagtccaaatttccatccaacctgtccatctgatctagcatatacaggtaagtgtctttactctttgatgcttttgaagccatgtcagccattcttctagagaggacattgaacctaagaactgaactgttttcatcactagctggtttctctattcttgctatgcattttctctcctttttcttccacctttcaattatgtacttttcaggaattttgcttatttttagaaatagcatcactttcaggatatggctttgcacatatgcacacatagttctattgtgctaagtctgttatgatcacatattttctctgtctgaattcctgttttgttaggttttcagctgcatatacttcatatgttttcccatgttctataactgcaatttcttgattcagtgtttcctgcaactcatcttgaaattttttgaaaattctcaagttgtacatctctgaagcttgtagttcaatcttgtagcttgaccatagtgtcttaggcttctttgttctggactgatgatctttgcaaaattctgtatcaaagattgtgtcattgattatctcaaattctttaaggaaactcattacactgtgtgttgggcccacaccccttttgaaccttgcatttgtcacctcacttagtgctgtactgtgaataaatgggcaaaaatctaatttaaagtacaatggtatatagttttcccttgttctccacattgtctgtaggtatttgatgttttgcaaaccatacttttcaatcatttgaggccacaatgtttcaaactcaactcttgtcaagcagttgtgaacaatatcataaaattcattgtagagatctttatttttcttttctgaaaatgtgtttcctgtcctttctctccacttcttcataatatggaacaagcaattcgtgtgttttgtatccggaaatactttttctattgctgatttcattgccaagtcttggtcagttatgattgtctcaggatgttttcctcccatagctgttaggaatgcctcaaaaacccatttgaaagtttccatagtttcatctcctaaaaatgcacacgcaaaaatgcatatgctgccatgacctgtaaccccaacaaaaggagcaaatggtaggttgtacttgttagttttgtacatggtgtcgaaactaacaaattcaccatactcctcatatagttgagtggatctaccatcagtccaaaacatactcttcaccttattattctcatctagcaacaactcgtagtagaatcctgggttttcggcttctttgttaatagatactccatgagcttcatatcactgttttttgtttctgaattgattgatgttgtcacattgctgacatcttttttgttgtatagcagtgctgacaatcccccttggagaaatgacagtatgactatcatgcttcttgtaggtatgttgcactccttgagagttctgatcaacctcttttcttctactgtcatattcttgtgtgactttaggaattttgcttctctgtttgggcttagtgtgtgattgtgttctaggttcagtcttgatattttccaaatattctgtacctcttttattaccatcacacacttgtagtcagttctgtttatcacatttgtattcctcttttattaccatcacacacttgtagtcagttttctatttatcacatttgtattcctcttttattaccatcacacacttgtagtcagttctgtttatcacatttgtattcctttgttctgttgttttcttctttttcttcccatcttcctcatttttcccatatctgtagcactgatatgtataactagtaatctcaccattcattttcttgcttgttgtcttgtaatggtgtgtatttacaattgagaacccaactaggtatgcataaaagttgaagaatccatgagcctccttatctgatctgaactccattccaacttcaggtatgtgccttttgtcaattacttcattgatttcctattcattatccaagaaattgtttatgtcttcctcatttatgtcccctccagttgtgtggcttcttgaactgcttacttcattactagctgttatagtactttgttcacagttattttggactttttgtgcaccttctgtgtcatttctaacttctgttatttcttcattcacttgtccactgtttatctgaaaaaaatatatgaattgattagtatgaaattttagtaaactaatctattttgtaatctcaatgtcaatatatgaatcactcttgtttacctgtccattctcatttcttgaattttgttgtatatcctcttcgtttggatgctcattactctgcattgccattgtcgtcccattcacctgcaaatttcttatttgttatgtttcaattatactatcacatgtttttatgattttattttatgaatgtttgtcaaaagtaacgtacctgtcttttgaaatggttgtttttggattcatacaactcttttatatctctttctgatgatctctgcataatttttttaaattgtttgtcatttgtaagtaataatccggttagtgtatttatttcactgttcaaaatgttacctcactccatgtagtcatgttgttgttattgtatattgcatcaaattcttgatagatgcgttctgttgtagaaatctgttgttgataaaacccatcttgctgatctgtttcttgtggagaaaacctgcttgttgtcaaaatcatagaattctgcaatggcaaaatataaactgttagtaatgacttataaattttgacatttttgttcttcatttatggttgtaagttaagttctcacatcaaatgcgacgggtgtttgaagtagatttgtatatgcctctattccttcctgcacatttcattttagattgcaattagtttttctttcatttttctttttctagtacaattgaaatctgattaaaatatgcttacctcatttgtttgcatggtcactcttggactctgaattatttgttgcatgagattagtgtagctcatctttcctgcctccatctgtaaatttcccttgttttctgttatatcagaagtattggcattatttttataatattgtgaattttgtacttacaagtcttccatcttcattaagcaatgagtactggttgtatagtatttgtgctccatagcttgttgcatttggtgtttctgttcctcctctagcattttgtcctgattgaatattcttttttgtcaatctcctgcaattgatttgatcctgtaattgaataaataaataagcatcataaggttacagtacacaacaactatagttacagttgtaagttttgcaagttttgactgtaagtcatttttttttctgttaaaattttccttctcaataatataacctgatatttgtatgtctcttttgatttcttcaagcccagttttttgaaattttcttctcattgtctcccctgcatttattcccccttcttcactttcacgcttccttgtacctgcaaaaaaaaatacaatcagttacagttatattttataccacttacagtcagttacagttcaagtactgattaattacagtcgtaattttagtacttttgtattgtaatttataatagaatgttagtttttttagatattttcatcctgtcatcattcatttgttggggcatgcctggagaattaaatttgtttgatgtttttgtaagttcggacttttatgtgccccttagtttgattgctgccctagtcattttttatagctgcaagcagtgtttttcaaaataaattttattctattcttcgtagaatttaattgttacctgtatgttgcttgaaattggtgatttctgtatcaacttgtttctgaaagaatttttttctgactacattctccatctggctttaatcctgcattaatatttaaaaagcattacaatataatatctttgtaatttaaaattttgttgaccataaattacttaccagcaatttctttcattacttgaatctgtgcctgtatttttccttgtttattgatgtctttgtctttttgtgtctcattctttaaccctgcaaaaattaaggcaatgtagttacagtagaaacatgtaatgtgttgtccttactgaattctatattccatacaatccctgtatattcttcatcaattatcacatttacagtggtcttacagtacaattgtataccacttacagtgcagttaaagtggaattaggccatagttacatatgtaattttaggtgttatctactgtaatttttggttttgtgaagtttcctctacgagaattggggcgtatttagatatatctgttctagttccatatttattgcactatagttacagtccaatacattcttcatgaactacagttacagttgtaattttagcaagttttgactgtaagttgtagcaagttttgactgtaagttgtagcaagttttgactgtaagttgtttttttcttttaaactttaacttctgaatagtgctatttttaatatgacctgatgtgatgaatctttttgtctagcatagtatagtatttatgtaactattttgtccatgcagccaacctgaactggttcagcaaattttgttcctgcaacattcaaggaatatgcaccaaattagtatacatgttttttaaaatcatcttactagattgttaagtattagatatttatttacataggacatgcaccaaattttcataatctagtgttctttatgcaatcaactctttttgccaaatgatgataaataatttttgaattaagcaaatcaaatttttgcacgtcatcagacaagaaaattattcactatttgtgaaaaagatttattaaacttcttgtctgatgatgtgcaaagttttgaggtgtttttctttaatatttgatggcaaaagtttttatattattagtgttaatataaatgtgtttattaccttaagtaaatcttgattgtttgtttttgagcattacatgtgttcctatcatgtttgatgtaaaatctgtatatgcattactgtttgatggagaatttatgaaattttgaagttaacatattgaagttatcaaattttacaatgcaattgtactaaacttacagtgcacttacatgccgtatatattgtttttacaaatgtaatttaaggtacaaagcactgtaattttccaatttgaccatatgtgaatgtgaatttgatttggtgcggtgttgtttttagtttctgaacttctttttcatttttaatcccttgtgcaatcttagtattggagtattatttgtgtgttgatttcagttgatttgtgcctaaaataggtgttcatgtttttttttgcctggcatgtttgtagatatggattgagtttttttcatatggattgtgccctactccaattgttatgtgactcagttttaccgtggaatatgtcctaattcatgcttttgttctctttaattttagcttgcttcttactcaagggatctcaactatcctgtctattagccatcatgcaggttagttgtctctgacccatatcaccatgctaataactagtgtggttttctttttcttttttttctgaccaattgatatactattagtgatttacagtggtttgtgcacctagctacatggcatgatatactattagtgattcaaaactgagttgatgtgttcagttttagtgattccctcttagcacaatttggaatgggcatactaaggttattttactttttggtaaatttacagtgcatttgtactaaacttacagtgcacttacatgttatatctattgttcttacaaatgtaattttagtgcaaatgcactgtaattttttgcatacgggttggggccatgtatggtgctagcaaaatataactgtaagtagtcttatagtttcagttacagtacaattcattgacagttacagtgcagttacagtggaattggaccatagttccatatgtaattttagttgttatctagtggaagttttgagttgtcaagttaatatcctgcatgagaattggtatctgttcaattgttcaactgtatgagcattagatagatctgttctagttggtcaactgatggcagaagatgtggtgaaagttttagaggtttaaaatcagaaatgcaaaggtgaagggggaaggggtttcagggttgaaatttacctggtatgttttctcttgtttgcttgatcctcttgatctccatttttttggtgatagtctccttgttctctctttttttttccttctcatcgctgtccatggcgcccctgatctgctctgattgatctagaaccttgaaccttgtttgttgcgtgtgttttcctcttttccttttttgatagctttcttggattccaagttgatggttctgttgtaatgggctacgattttcaatgggctatgttgttgattttcttttctatctagggctcatttcttctattgggcttttttttgtcttttatggtttattttgattatgacgtttgggctagattacagcccatttgatttatatttcatttaattttttgttctattttataattgtttttttattatattttttcctgttcattggatgtagatctaatggtttaaaaaaatctgtgtgattttgggtgaaaaatcacccgttagatgtataggtagtcccatcctttatcaaaaatcgtcgttcgcttcaacttccaccgcgtgtcccatggggtattggcctccccaaaatcgtcggtctattgaggaagagtggaggggcatctataatgtatcgtcggtctattgaggaagagtggaggggcatctatatattttaggcggaattcttaagcaaccaccatcatccgaactatatatgataagataaatcgatcaccttgtttgggtttagcctgttataccttcttccaggtaggctgatgattcccgaaatggatatgtaaaaggccactatagaaaaaaaagtacggaagtgatttcttgacaaatttgttgagcggtttatatgtacttgtatgcatatactccctccgatttttaatatatgacgttgttgacatttgaacacatgtttgatcatttgttttattcaaaaattttatgcaaatgtttaatatataaatcatgcttaaactattttaagtgataaaacaacttacaacaaaataaattataataattacataattttttgaataagatcaatagttcaacatgcggcaaaaaaattaaatacattatctattaaaaaacggaggtagtatatcatcattattagctcacaaattgaaaaagtcattgtatgcaagcattcaagttctggtccttcatcctgcaaagatctctgtaagtccatattatgaattaatcgtccatagagggtaaattcccacggcaattaatctttataccttttaagataaagaaaactttattaatctcaaagctctttatttattttactcgaggtatcatcgtacctcgctttatttattgattacatacattacccaacacacaaatctttatagtatacacaatatgtttatttattattacatgactttatttgtggagtactccacaaaagcttttttattgatctcatagtaaggaattaacgggcttcaaatgtcgcgaccagttacgctcgcaggcgacccgtgaagccggtcttctcgtcgtagaacctgtcccagaccatgacgcctccgaagttgggcagcttgctgaagacgtactgcatcaatttcttgaggtcctctggcgagatgtaggcctccctgtccacctcccgcgaggccacgacgccgaccaggacacggctctgcgggtacatcttcgcccacttctggaacgactgtatccaggacgatgccgggcaccggccatcgctgaatttcttgacgtggatgcggtggaagagccccgtcgccagcgcctcatccagccggtggtccgggtactcgcaccgcgtcgtcgccgtcagcatcaccccgaccgtgccgcggtagtccttgttgtgcgcgtagagcagcttggctagcttgttgtagttctccctgccgccctggtcgatgaagaagtcgatgccgttgacgatggcgtcgccgaacgggcgatagacgccgttgcggtggccgccgaggtaggagtaccagaggtggtcattcagctcaacggccgcctgtggggtcgggagggaatactcgccgccttggccgccgatggcgaggaggatgagtatgcccttggattggcagtacttgatgtcggggccgacggcggagaccgggtggccggagatgtcgaccttgtagtacccgggcttgtagccaaaggcgctgaggaaggaaatgatgacggtggtgtagaggccggtatcgcaggcctccctgagggagccctcgtccttgttccgtccccaaaagatcacggtgtcgccggtgttctgggacgtcggcgacgcggcggcgaggccggcgaacagtagtactactgccaaggagagaagtgccgcgtggcgtcggagcgccattgatcgaatcttagctagcttgcctgcctcgagaaatgaaatgatcgagcgagctaggtgtgaaggatagggaggtgcatgcatggatatataaagcgataggtaggatagatggacagtgcgcgcgtcgtcgatcgctggatggacgcgttgtcttatgttgtgtgcgcgcggcgcccgccgcgtgggcatgcagggatatatccgataatccgaagacaattcgcgcttcacgtaccaccagcaccagaaggttgctaagctggtgcgctacagctagcgtgcgttaagtaagaaaccacgcacgcgaaacagcagaattaaccaaggttcgtcggattatcatgctgaagaaaattaacgaagcaggctgcctagctaaaaatgaagatgctgggcaaagtttgaccgtaaattaacgtacgtgttgaatatatatataacagtccagctagcgaccaattactttgttgatacaaatgtttacttctctagcactctggcaacttaaatatacgtcgtgtgttagatgcagcctgttttgatgaatgatacgagaccaacgccgtgaattcaaggttctgctgccacgtatcaatgggcactgtctcgtaaatgtactgagaccacttattttatcgtaatatactggccacaagtttggtgttgtgtacttctgtaactctcataacatgtttaaagtatatacggggtcaaggtctacggtgcctaccctaaaatccttcaccaaacttagactgttccatgggctttttattcaccgctattgttcgtttgggcccattcatcggatcttgttttgagaactccattcatcggctttattattgcgggttctaccttttgcatcatttctcggttttaatgcctttctccgtgcaataatcgggccttattaacctttttttatgaacagatgtatacatctacgtatcattttcttacgtaaatatgtatgtaacatcctaatcaacacttaaattagcaagattatccttgttttattctgtttgtcttggttcgtacgcaccccgacaagtttatatatattaaaatatgtgttttacaagtttatctactagagatacaaatagaacttttcttaagttccccttctaaaatacaacaacaggattatcagtgaaattttcagagcaaagaagtaagtaataattagaattcagttatcggaattaaataaaatatttttgctatcttttcccctcggtcatgggccgcggtccgccttgcctccccacgcgtgctcgcctcctccgctcgctgacccatggccgtggcccagccgagcctatgcccctctctctctcttcagacaccaacaggtggaccacctgtcggatcaatatctctcctccggccggcgaaatcgaagggagcaaccgcacccagtgccctctccacccacttgcccactccttgcccttcctgcaatcgccgccccacttcttgcaagccgcgcccctaaaaatgggcggagattcgattttcaaatctctctgcctctctctctctctccttccccacatcggcgccgttttcgcctcacatgggtcaagtccaaactccctggccctataaaaacaacccccgagatcccctcctccttttccctcatttgatgccctctccggtgccctcttattgccctcacgacgtcgcaccccacgccgctaccttttccaccaactacggccgcctctagctgctactagggtcactgccgctccacgccgtcaccaccaccgtgctcgccaagcttgccctctccccggccgtcgctttgcgccgctgaaacctgcttctcctcggtcgtcggtgagacctccatcttcaccaaactccgaccggcaatgctcgctgccgtggtacctatctgtctaatctctctcctctccttccctagatcatgctatagccccttccgccccttgccactatcgccgtcatcccttcacaccagtcatcatccttcaccggtgaggaatccctcctctctcctcccattttccttcctcttctttgccgcaccatcgccactcgtgcacgcctccgcatcccggcagctgccgccggtggtcacttgcgctgcctcctcccggttgggatggctggccggccaccgcttctccacagacgtccgatctgcttcggagcagatcggggctgttcgttcggccacccacgtggctaccatgtcagcgccacgtgtacgccacgtggtgcgcccgtccctggcccgatggacttggttcaccgtgcgccgcccgacttgcaccactgaccggtggagcccgactatcgtgctggcctccctcccttgagacatcaacccataagctttaatgcacaataattcgttaaggtgttttctattaatcgtaaaaacacagtgactattctaaatttcataactaattcatccgagctccgtttaagtccattcaaattatagtaaattcataagaatgcctagaatccactaaaaatagtgttgtttcatgtttcagtaatcttattgttggtatttcttaacggcattactagaaatataattcccagcaatggcgcagaaatactcctagtatattatggttacagagttcatccgcaagtacatggatataccattgtagcatttcacctgagagtattccaagggtatcgtatttatttaatcccatgggaagatcatggtagagagaacctgactaataatttatatgttacttgtaataatcatagtctaagtaggggttaatataattcaagggtagagtgacacacaagtagggagctactcattctcatactaaaatatctaaactaagtggaaaaaaaagagaaagagaatctattcctatacttctagtatacatagtctacatacatcctagttatctgatgtactagctaataccctctatccgatgtcctcctggtacttcgagaagccacccctgactgccgagttccttacgacagcccgtcatgaccatacaaccgaggctaaatacggaggagtaccctccccaggaaattaacttaggactatatccacgcacggagaaatacccgtactaagttgtcaccatcagcggcccacctctcatccgcagcatataaccccaaataatgataccctgtaatctagacaccacgtctaaactaccagatactactctaatatcatcttcatgacatagagtaattgcataagcaaacattatacccgcaccaaagcatctcccaaataagctagaagtataatcagtataacatgaacataatgtaaagttggcattcatatacttggaaagtattccaataccataaatgtataaagaagagtattctaataatagtacaaagcttacaaaagagaagagaagagctactagagccatacccgaactcttccgaaggcttccggactccgatttctactctattcctattccactagcttgataacactaaactaaacttgagagaatatgagaaagctttgcttgaggtgtgtgtgtggagtgatgatgacagctcctttatagcctcccaatgacggttgtgatggttggaaaggtcggtaatacccaccaaccatcattggggagccatctcagtcgtccaggagaaacctggatcgaacgacgctgcgggggcttcagccgaaccatgggtcaggccaacctggcccaaaattggcaggtggcctcttccgttgctctcctacgcagacttgtaaattttggcccaattaattctaagttcttggcccattcatgcataagtatgagtcacgacatcgttcgattgatttatcatttgatttgatgtcgattctcctccactttatggttattctctacaaaaggttagtgaaccaaatactagtggaatattattattctaacatggatatgcattgcaagcataactagttctcctctattttggtaatattgacggtcgaaactgatcgctaacgaccatctacacttatattctattttacttatatgctttgtttgtcgcgtagattccggcagttccgacgctctggtttactttgaagttgttgcggagttcccagtagcaccggagcaaggcaagtcatgcattacatttgatcatattgtgtatatttcataaatatctcgctttctatttaatattgcgatgttttataatgtcatgtgggatggttcctgttactctgctttatatcgcttaccttgtgccattgttaacctgggaattaatatgattagatggttggttaggaaaatgcttggccatgcttagatcaactagctcactatggggtatcacatagaacttctatcctgttttaatgatgataattatggagatgtaccaccatgttattaattcaactaaaacatatcaaatgggttgtgggcgcatggttttgataaacgcgcccatggcatgtaaggaccggttcacaggaaaccctgtaagaattaccgtgctctccacaagccaatgtgggcaacggctaggcttgtagtatagctctttcctatataactttcctaggtaagggtgggcgtgatggagttgggtcgggccccggttttaaggtttgattggcttatggatataccgcggcacaagagggggctgcctacccctgttttaagggtaggggcgaaacttgcgaaggggttatgcgaagggtcctattacagtccctgtccggtatgtcacggtggcatgccagcacacgaaaatgtattgtggggctatgtcttgtgggtacaattgtgatgccttgcttgtggttgtgggcaaacaaccagattaatattgcttaatggaactggtatagtttaggtggatggttgggcatgtcgcaacgtggtttagcattggatagtgatgattaatattgattagtttacttcaacaatttttactactttcaactactactttaaatacctgctttatgcaaaagaacacctagcctcctttgtaattacttgcatcataccctctcttctggtatgacttgttgagtacagtgggtagtacacaatcttgctctgttcccccacattagagttgaagtgcttcctggatggaggttactcaggggagtaggctttgtcactaccattaaagatgcctatggtgtggagtcgtcgcgctgctagtatcagttatcctatgtttagctagctttatctttccactgcatttgtaatacttttatgatattttgtaagacgtggatctgtatgcaaattttgttgtctgtgtaccttgtccagtgctggacaggggttttaatgcacatttttcttgggaattctggtttgtgaatttctgggcatgacagaggtggaggagcgtggaggtaggagaggtggcggtacgcaacggcagcatggcgtgccttggaggtggtggaaggggggagagtaggagagccaagggggcgaggtgagtgttggtatttcttacgattacagatagaatccgcaagcgcacggatatactgatgtattacttcccctatggagtattccaatggtatcgaattcaagggaacgtgtgtgattaattcttcctccggttcatccaaggacaccaagcaaaaaaaatagggactggcaacctactgttcctagatgatttcctagtgagaaatagtgtctagggaaagcttaattttaatcctaacacaatacttcaggcactggcaacctactgttcctagatatcgctctactatatacccggatatggaggacttaagtgctcttgagggttgtcaccacctctatacctacctcaaacgtactatgggatatgcaacattactggataataattacctaaacaccacgtctaagcaattaatatctattttagtgtttataactcatcaaagcaatcactatagtttagttgattatagtgaacaataatcccatatgctaattaggaactaaccaagaggtaattctcacaagataaatctaaattactcaggaagataatcctatggtattagagtaataaacagaataaaataaacaggagaggattaccgacagctccggaattcctccgacttcttctactctactatcttcctaattctagtatacaaataatacaatagagcctcttgtaattcagctcaagcttggaagtgcgtgtgagagtgaaggagtgaagcttcttaaatagggtaggtatgacggttattgaaaggggaattgtccgaaatgccccgcaaccccatcaggagcacatctggaccgtccttgccaaaccccaggatcaacagtgttgatcaggcccatctggccctcagtttcggcctatggactcctcctattctgccttattcattcctgcgagttttaggctgattcgttgatattttgatgaagtctacagcccaccttttgcatggatatactccttccttactttagtctgattttcctcccaactttggtggtttatgtcctatattggatattcaccaacactcgtggcatatgttagaaataatccctatcactatgttggatgttttattatctgtactttatacagatgttggtggtatatattttgcacttcacagccaccaacagtgagtggaggagcgagaagggaggagaggcggcaagtgaaggagaagcggcgaggccgaggagcgcggaggcgaggcgagggagccagggtttggtgggccatggttgtgggtggtgtgaaattttaatagcgtaattttttttgtggttaattagttaccaccaacaaaaaccaattttcactggagggctcttaggaggcctgccttataaaatagagctatcttttaaggtggcctcctaagagctcgccagcgaaaatcagttatcgctagcagctcatgacatggaatctgccaatacatttttacaagcgtttgtttcattggtccgtcagtaaaaataaaaggggaacaccacaaaaatcgttttagtagttaattcaaagtattttaatttatttccattttccttctttgtatgaattttacaataagtctactaaatttctaattcaatattgaagcttttatgtttttatagaattgcaaatttcatatcaaattaaggaaacattgatgctttccttgttactgtataataatttcctttgatagaatttatatagcaataaatggtgttgtgcaagtcagccttcgccttttatattttagtcctcaaattctgtagatctatatatagatccaaaatttacactaaacacccttaaaatcagaaactattataaaatagcacctttgaccaaatccaaaatcccccacttcacctcaccactggcgactctccttcctcctctcgttgccggtggctcatcacctcctccgacgagatggtgaccacccacagcatcctcctttggttagctctcttcattctcctcccagctgctcactcatccctcgcggctagtgagcttcgggctggtccgacggtgagctcgtaacggacctggcgacgtcagcgtcccactcctctcccctatctggtctcccctcctcgagttagcgagcttctccggtggaaatcgagcgatgcgacagcgggtcgaagcggcaacaaactcagcaccgtgtgcgcgtggatggccatgagctcggggcggatctggcgacatcagcacctcctcctcgccagcatgggaaaggagctcaatgcaaagctggcggcgtcgacagcgatggtgcaggcgacgagctcagggcagatctagcagctcagcatcgatggtgcctcctcctcgccggcgggggagactggagacgggttctgcacctgccgctaccaacgtcgcttcctcgccagtgctggcgttgccctgtcgtcctcatcgatgccggcaagcccctcccctctccggcagtgtcttcctctctctccccccactcttcgagttccactctctgcgcgcttttttctgacaaaactgatgagactctttgtacctggagaggacgcgactatgtgagaaccccatgaaaacatggtccccacctcttctctcctccacgcaagcattcgcctatgtggattgacgaggccaaacgccatgtagttacattgtgaaggccctaacaaaaactataaagaaaaaatatatatttgtcggaattttgtttttatttttatggtgaaaacataacaaattttctagatgagactttgcatatatgtgtaatgcaattttcagatttttttggtaaaatttattatttaatatttatggagcgtgaacaagtttgtgtgtataagacacaatcttttagtatggaaggttttgtgtgttttatgttacggaagtacggaaccaagactgcaagttcttattgagaaaggaagaaaggaggatgcaaaacgtccccacaaatacccccgccgaccggtttcctcctcccctgccaagcaacgccatgtcgctccacagcctcaaagaaaccctccagtcttcctccttttcacagccccaatccgagtcccaaccccgatcacctcctcctctcctcgccaggaggcccccaaaaacgtccctctcgcagcagctcctccgccttgatgcctcctcctcctcttcctccttttccgtctcgccgccaccgccccctcgcacttccccgacctcggatgcggcggcggatgatgcgccgccgctgccagaggaggaggacgaggtcccctgcatccgcccccgcgcttcccttccgccagcggcctccctcgactcccgcgggccctacgaaccgcttgctctctcgccgcccggagagcgccccgtcgtccaggtaaaatctatgctgccgcctccctcttggctactactgttcgatgttccggtccacagttcttggcgagtggcgactggtcaggttctcgcaccgtgataggttctgaccaatgttttgcacctgccatggctttttttttttgggtgattgatagcatgttgaataataggaggagagattacagcataacctgatgattatattgagcctcagggctggggcaggtgtgtatagtacaagagataaggaagacataatacaaatcaatcatatcctaatatccctttaactaccatataacagatgtggcttccctttccctcctaatatcccttccctctgttcactttagtccctccttcaacagaattttactcactttagcctctcttttatttttagttagagcaattttttagttattacaagcacattcactttgctgtgctttcctctgttttgtttggtacaggtaccctcctcgataaattgcaggctacttgtgcatcagagggatggtgtaagattcttatacaatctgtatagaaacaaccatggcggtgtgcttggagatgacatgtgaggtttggaagttattttgttacagtataagtacactgctaaataacttgtactcttgtatgatataatctcctgattgtggctgaactgaaatgaaactatacaatatccaaaacaatacatatctctttctatccatgtgaaaacattgtggttgataggtttgtgggcttaaatcgtcaaattcaatgaaacttggtaatattactcacaaccaggagattatatcatacaagggatttttttcttaaaaagattttgtaagtgacttattactattgctttattaaagtctaaactccgacatgataactagtttttttttaagtttatttaaagttttacaaaactgtgacagggaaattgtagttagtttgaaaagtatcttaaaattatagtctttaaaagataatacatgtattgcatatgtcctgatgttcctaaacttctatgtaataaccatgcacatagtttgcatggtttatattattttgtgaaaaattaataactaaaccattcccactgtatgtagctttaatccgttggcggtttacttcgtggtcttattctgttcttatcatcaatttatatacatagtttgctcatattctgcatgatgggtaagcatgtggatgattgacaggtacttgcaccggcatcacataagcataccctgtaggtctgttgggaaaaaaaatctcagggtcgatagcaagcttgagcattttatttttggggagcttttttctactcacctattattaaatctcaaaccgaaaacataataatgagatttttcaacacaacatttaaatttgatggacttctgagttctgactcccttgtttctcatgtttttttttctgatttaggggtttgggaaagactatccaaacaattgctttcttatcagctgttattggaaaagataatgaccacggtgatcaattagtggaaggaagaaagattgcccctatactcatcctctgccccacatcagtaattcgaaactgggaaaatgaatttgcagagtgggcaagatgttctgttgctgtctatcatggcccaaatcgtgacctggttcttcaaaaggttgaaactcaaagactagagatagttattaccagttttgacacttttaggattcatggcaagattttgtgtggcatctcgtgggaccttgtggttgttgatgaggcacaccggctgaagaatgaaaaatcaaagttatatacagcttgcttggaaattactactcgaaagcggtttggtctcacaggaaccataatgcaaaataaaataatggaattatttaatctgtttgactggattgtacctggttgcttgggggatcgagaacactttcgagtatattatgacgagcctttaaaacatggccagaggttcagtgctcctgagagatttgtacaagttgctgataagcgcaagaagcaccttgtttcagttcttagcaaatttctgttgagaagaacaaaggaagagaccattgggcatctcatgcttggaaaggaggataatattgttttctgcagaatgagtgacgttcaaaagcgcgtttacagaagaatgctgcaacagcctgacgtgcaaatccttataaacaaggatctcccatgtagctgtggaagtcctttgactcaggtggaatgctgcaagagaactgaaccacatggcattatctggtcttatcttcacagagacaatccagagggttgttctctgtgccccttctgtcttgttcttccttgccttgggaagcttcagcaggttatttcatattcttaaaatattttggaaagatttatgtttttttaataattccccactaattttccatagatcagtaaccatctggagctgataaagccaaacctgaaagacgaaattgagaagcagaagaaagatgctgagcttgcagctgctgtctttgacacagatattgaattagttggtggaggtgctaaaagtgaaaacttcatgggtctcagtgatgcagaacattgtggaaagatgcgtgcgttggaaagactattgtcattatggactctgcagggtgacaaaattcttcttttcagctattcagtcaggtgagtggttatccccaatgtgtccaatgcttcagtaagcatgaagattaaagcaagaataacatatctcacaagtcagaaaatttctttgttttaaaccatatttgatgttgaacaaaaagctcttattgatgtaagaccttggaattgattgttactaaatgttcataaaatatcattacttactgtagtgggtataatttctcacaagcccatcatgctccagtttttgctgaagttgtggtttatatacctttgacagtatagagcgttaaatcattgaatagatgtaaacttccttctacttgcctttctttaaatacacttttagggaatgtgattagacaggttacactgaacacaaactaaacctatttatttagacctgaaagtaagttaaaacaaaacttgcttgtatcgaatagcttatttttctcttaagcatctatcttagttcttgttcactgcgtttgcttcttggaacgtttcttgacagtacttgcgatttagatatgctgcttgatgttatatcttctgcatgtgtaatcacttgttcatgcataaattgacaaccaggatgcttgacatactagagaaatttcttatacggaagggttactgcttttctcgctttgatggaacgactcccatgaatgcacgccaattactaattgatgagttcaatagatgcccaagcaaacaggtaacttcctgttgatgtgcatttcagtactcgctgccaaaagaactttttagattagcatcgtcaaatggtgaattgcttttctacaggttttccttatatctacacgggcaggaaatttaggtgtcaacctggtcagtgctaatcgtgtggtgatttttgacccaagttggaaccctgcgcaagacttgcaagcgcaagacaggtcatttcgatttggacagaggcggcatgtcactgtatttcgcctacttggtgctggttcccttgaagagcttatttattctcgacaaatatataagcaacagctttccaatattgcggtctctggaaaaatagaaaaacgttactttgaaggagtgcaggtaatgttgtaaaactaatgcattttgatgaaattggattgattgtttcaattacttgaagggtggtacaattgtggaccatcctaatatgattcccttttcctgttctaaaatcatttccctgaattacctagtcatttaggtccttatattttttccatttcccaaaatacgtgtttctcccgtgcttgtatttggactgattattacaatcataacattcatattttattcagaaaattattgtatttcgaccatttgattatgcagtttaatatactcaccagagaatttagagtttgtaagttgatgcaaactacctggatgatgtattgttaacaaacaagcgtagacattgtgtaatccacatgatactgatattaatatttgttgttaagagtagcaatttagcagaatcaaacacgtgacacatgaactgccttgcactattcctacattgttgcatacatcaccatatgttaatgtacttcctattttggttcctagcttagcagtcataggcataagagaatggttgcactcataatacacatacagcacttaaggtagattcattattttctgttgcagtgtcctatggcacctgaatagtaaaatgatgtgtcactacatgtattaaatctagggcaatgctgccttttttaactagatagttttctcaccttacctcatgactttccaaattctgtgttaacatgaatacttttttttagaataaggcatctatcaattcactagattacatttcgacagttcagaagtcatgaagttatgcgtcactctcttgaagtttcttagtcatttaccagcacatatacctttcacgttttaagaataatcacacttggctttggtgctttgtttatataaattgtataattatatgattttaggatgacaaaaaatttcaaggtgagctctttgggatatgcaatctgtttcgcgacttgtctgataagcttttcaccagtgagatcattgaaatgcatggagaacatgggaagggtaatacagctgaaacaataggaattcgagaaatagttgatacaaatatatttggtacgcaagatcaaatgaaatcctcaatgacagcaatacataacgagaacaagaatttgtaccattgtggtaagttctactgtcagtctgaatatttctaatttaattttcttgattttggaccttaaatgctttatgaaaagtttcaatttcaaaatgaccaataatatactattactattactattatgggaaactgaataatatactagtggctgaatagttaattgttagattaaattttaatttcaaatactgactctaaatattttgcattgttgtgcattcaatttttgtaacattcatatgtttgtatcgatttatttagccctgctgttcatcctattctagtttatgttcactgtctgccctaagttctcttcatacattttgaagaaaagtttatgtcccatatcccatagagctcaaatgacactaacatttgtagattgatatggttttgcaacattatatatctataatcctatgaacagaaaaatatctggtctgtgaaatgcaatatagaataacttacgttctgaataaaatagaggaaattagtaattatatttgtatcaatctcatcttacaagaatattgaaaatcattcccccccccccaccaccaccaactctactttcttaaggaaaaaaagtgtgggggtaaaagggttcacatgaaactatcagttctctaactttaggatgtgtattgacaggggggcctgacctataataagaataaagtttcagttctatgaaaaaaaaaataaaacaatcaattattattgcatatttctgaaatgttcagttaaatttacagcaaacggatagttctgacaaaacagtagcagtttgaaatttagtctaaaataaataaacacttggtcaagtatgcaagtctttgacatcttgatctatgtaggattctgttattagttgctacgtttactgtttccagtaaaaactgatttgtcaattgcaaaaaactcatattgactaagattgaaacccgaaagttgcttgctaagttgtctaccagaatatctcccctctgtctacgtattggtgcattgattttttcttgtaacaaattctgttccctacaaacaggaatagtttatgctcaccgaaatgaagatgttgtaaacacgaggacaaatgaagcaagcaactgtgcagaagataaaactgtcccaaggcacttagaggagctgcaaagtaagaagaatgaaacaatgcatacaattaaggcaaaatcttactcactggtgcagaaaaagaaggaattcagccgaattgcatctttcatgggtatgaacgaccttgagtttagtaagtggttgctgtctgtctcgcctttgcaacgacatgaagtattggaccgctacaggaatgcaaagtaagccatagggagtatggataatgcttccctcatatagatagccctttcctgctccaccgatgttttccttctattctcctgttctgccccatccactctttctctggcttggcacaggctatcagaaggggaggaacatttcatgttcagatcatcttatttccttcttttctttttcttcatttattgcatttgtaaggtaagatcagacccatagtggtttgtcttttgggtttgacataaatcgctgtttctcctgctggttctctggatttgggcgcttgtatctttgttggtcggctgagtaaagcttttagagttaccacggagttctgagtgcatctcaaacagaaagaagctgtgctggttagtggttacaatgtacaaatgatacgagcatagcaggtcatgtatcatgcatgcaaataattcacccgttatccgacttttcccgagacataatattgtagctgatcgccagcggcacaccaaggtctggcgttgtggcaatgttgtaacagagagtgcaggctgttaatacatcccttgattatgcatctagctcacgacctcacgttactcatcagtatttttcacctcaaattttttatgggactattcgccctgcacatggacgcgcttgcaagacaacttgttcataagatgttccttcttggtacaaccttcgttctaaactataacaacttttagccctttaaaatttatcctaaaatataaatttttttaacttatattattttctcaaccaatcataacctttcatcatttaaattcttcgctttctcttttttttaaccaattacaatattcttttaaataatttaaataatttgatctacttttttaataccagtgtttaaacctaaaatctcttatattctacaatgaaggtactacttatatactaataaaaagattgcgaagattctacctgtaccatccatttgatcttataattcgattgaatatccatgctagaacaagtgaaaacaaatacattaatcaaattgattcatgtaatcggcgaatccaagggtatagaatggatgtgactatacagctactggtagctgatttgtctctaaaccagctaccactccatctattagagatactatccacatacttcaaatacaattttctcttaaactactcattcgatctatgatccgattataccgttgtgttcgtaacaattaaatctttataacaagatcccacataattatattttgatgaaaaatgataaattacttttataatatatctaaattacttttagatttcactaaattactttctagacatatgaaagtaaattcaataaaggctaaaagtaatttacatatattatagaaataactcgtaacaaaaagaaaaagaaagtaactttaatgaataccctttttcattggacgtgactacatagctaaaaataaaaggaaaaaaaacaatcgatgattaaacagatttatagagttatttttaaccatacaaaagttacttccaattaacattgaagttacttttaaaaattgttaaacttacgtgtgttgatatatgctgattaaattttatttctagataaagttatgtttttatctctacaacgaatttacttataatgtcgtgacaaagttacttccgttttgttttaagttacttttataatatatgttaattacttttagtctctattgaatttacttttatatatctaagaagtaatttattcaaatctaaaagtaacttatatatatatatgataaaagtaacttacatatataataaaaataatttataaatataaatattttttcatcgtaatataatcatgtaaaatcttgttgtgaagatttaattgtaacgaacacaataatgtaatcggattgtagatcggataagtaatttgagagaaaactttgtttgaagaagaaaataacatacatgtgatgtagtagacttctaaaaaaaaatgcatgcatgtagtaagctacagttgatttctccgcgcgttccgacgttgctggttaaggcaaaaacgagaggcctctccgaatagattttatggtatagaatagttattctattcccccctctctcccaagggccaaacccaccttccctcctttctaagggttcaaaacccacctgccatctcagtcaaaggtcggtcaaagcatccccacgtcggtcaaatcctggtcaaatcacctactaactccccccaccgcccacctcttctcagctcttatctcgcaaaacggtgcaataacacgacagaccactgtgcagtaacactttgtcttacgtacagtaacaatattcaaatttagttaaaatataatcatgacgggtctacttttaataagcacttttttcctagcatcatggtgcaaacaattaaaaaaatcatacatcacgtgagagatattgttcttcaaagcttgacttttttggaatttgactctctacaagtaagtagtactatagcattattattactcgtcactactatctgttgtgcgttattacaatcccatcacgatattactgtaagtctatacctaattaaaaaatacgcaaggcttccactaaaaaatttcatccatattccttttttcctttttctttcttctttcttttccgttttcttccatccgtccatcttcccttttttttttattttctgttttcttccatccgtcttttttgcgccggtttttctttttccctactctaattaattgcaaaaatcgattccccactacttcatcattttccccatgattttctctttcaacgctgttttaattcaacggatttaatctatatttaaaagtcaccgtttttgtcatgggttttgtggattcgctctgatttttataaaaacggaaagaacagatcgattgtataaaagcagtcaaccaattttgtaagatcgagaaagattcgatcggaattgatgggaggaccgtttctggcattgtatggacatgagatgttttcaccattttccggaggttgaagacggtagtcagctatgcgagctgtaactacaactcctcttgtgggttcggtcaaatagaagcaggctatgggttaagttaaagtgaagcaggccaagcaaggggaggtggcaagaaaggaacaagggaataaccttttggtctgaaaacaaagagtaaatgtatagtgagcttttggtccaaaaccaaagagtaaaatgtatagcgatctgaaaatatttttatccgttgcaacacacgggtattttttttctagtatatagaaaagatcataagttttgtaataacaatgcgtcttactgcaatttttgtatagtgttactccataaacatgtggtaacgtgtacctgccatacagtaacacttccacttgtgcagtaacaagtatatttagcatgtgaatctatatttttttattcctggtttactacaatttcaccacgatattattaccaaaggtgtagtaacgttctatatgttctacattaacaaagtgttttagtacatttcttggatagtgttactgcataaacatgcggtaaggtgtaactgtcatgtgataacgtgtatctgccgtgcagtaacacatttatttttgtgcagtaacaagtatatggttagcatctgagacttttaacccaaatatttttgtttcaattcctgatttactgcaattcactacaatattactgtcaaaattgcagtaacgtcatatacatgcagtaacactatattggagtgatgagaccggttttattgagaagagaggggaagaactgtttctttgaggaggagagtgcgtagatgcattttgaagtttaaccctccacatacagtaacactatagcatcatagtggaaactgttttaaaaaacaatacatatcttgtgagatattgtttttcaaatattggtattttaaactttaaccctccacatgcaataatagaatgtgtagtttgtagtagcaagggcatatacatgcagtaacatggttttaccaaatgtataaaattattcaaaacactcctacatcaatcagacctcgctcaaagccacctacagactttacctatagctcacctattcgattttcatattgtaaaaatgacatagtaaaactacaattaccgtgcagtaacatggctacttggaagtggtaacatgtacctatcatatagtaacacttctacttttgtgcagtaacaactatatatggttagcatgtgaggctttaacctatatatttttgttttattttctagtttattcgtagatttcactagtggtagagagatgaaggctggggcaagaagaaaggagagagagggaaaaacactactacgaaaatcatctttcgtggcggccattttagattttccctggcagaaattgcagcggccacaaagcaaaggccagagaaaatatcaatcttcgctagcggttatcagtcgcccgcaaaaattgattttcactggcggctgtgttataccggccgccagtgataattaattttgagacaaaaaacaaccatatgtagctgtcctccagccgccagcaaaaacccctctccctctccagcctccagcatcccaaatccacatccccaaatctcaaatccataacaattcaaatccacatcaaatccaatcatccaaccttaagagaacactacatcaatttctcacttcattctcaacaaacaaacattaatacatgcatgtatgaaacatcaatacaaacataaaatggagaaattcatcaaaatcgctgtcgcccgcctgccatcgccgtcgcggcggccgccgccccctccctccggctagatctgggagagggagagggaagggaggaggagaccctccggtcgtcgtcaccagtcgccgtggttgtcgtcgtcgtcatggcccagcccatcgtcgtggtggtggtggtggtcgccgtcgtcgtcgtggcccggcctgtcgttgtcgtggtatgacggcggcggatccggcctctccgcggcccggcggcggcggataccacctccctgcggctcggcggcggcggatccggcctccccgcccgcacccgagagccatcgccctgccgcgcctgagcgccaccgcccaccgcgcccgagagccgccgccccgccgcgcccgagcgccgtcgctaggtccgcctgtcgtcgctgccgcggcggccgccgccgcctccctctggctagatctgggagagggagagggactgagggaggggatgggaggggaggggagagaggtgaggtttagatgagaaagagatagagaggagagatgaatgcagtgggtgggtgggtgaaattgcttttaaatgcgtgggtgggtgatgctgtgaaggaatcgatctgtgagctgtgcttttcgctggcagatccgttttttcgctggtggatctctttagtagccgctagcgaaaacgcttatttttgatggtggacatttaagaggtccgcctaaaaaaatatagtatttttatggcggacctcttaatatggtcgctggcggccagtgaccccccaccccccgattttctacgctggcgattttttcttgtagccgccatgaaaaatattttccaaacgctatgaaaaatcatttttctagtagtgaaagagacatacacattcaactagagcgagaggtgttactcacatagatggggatgcaagtcatagttaatacatgacttgagagttattctaataagatgtgattataaacaattggacaaaccattgtacatagttgatgctgttactatacgctatgtatttagttactactccctccgtcccaaaatataataacttttagctctcagaatttatccaaaatataactatttctccattaacattctctttccaaccaatcacaaccctccacgtggcacgtgtgcgacttagagaagtcgcgcgtacacgctaattagcaaaaccgagcaacactagcccttggatcaacgggtaatgggcgaaggtgcaaaaaaaacttgatgtaacattaaaaaaatcgttaagataaaggaagttttatttatctcaaagctctttattatttcacccgaggtaccgtacctcgctttatttattgattacatacattacccaacatacaaatctttatagcagacacaatatatgtttattttcattacatgactttatttgtgtagtacacaagtactgcacacaaagcttttattgatccaatattaaggaattaatggtcttcaaatgtcacgaccagtcacacactcacaggtgagccgtgaagccggtcttcttgtcgtagaacctgtcccaaaccatgacgcctccgaagttgggctgcttgttgatgaactgcagcaggttgttgagggcctccggcggcatgtaggcgtccttgtccacgtccggcgaggccacgacgccgatcaggacacggctctgcgggtacgtctttgcccacttctcgaacgactgcctcctggaccatgccgggcaccggccgtcgctgaacatcttgacgtggatgcggtggaagagccccgtcgccagcgcctcgtccagccggtggtccgggtagccgcaccgcgtcgtcgccgtcaccatcacgccgaccgtggcgcggtagtccttgttgtggtcgtagagcatcttggccagctcgttgtagtgctccctcgcgccctggtcgatgaagaagtcgatgccgttcacgttggcgtcgccgaacgggcggtagacgccattgcggcggccgccgaggtaggagtaccagaggtggtcgtgcagatcgacggccgcctgggaggacgggagggagtactcgccgccctggccgccgatggcgaggaggatgagtttacccttggactggcagtacttgatgtcggggccgacggcggagacctggtggccggagatgtcgagcttgtaggtgcccgggatgtagccgaaggcgctgaggaaggagatgatgacggtggtatagcggccggcgtcgcaggcctccctgagggagccctcgtccttgttccggccccagatgatcacggtgtcgccggtgttctgggacgtcgccgacacggcggcgaggccggcggacagtagtactgccaaggagagaagtgccgcgaggcgtcgaagcgccattgttgatatgttggtcgaatcgatcttacgatggagctactgatcgaggtgtgaaggatacgaacgtggatgcatggatatatatagcgatcgatcgcgctcgctggacggacatacgtgtcgtcttatgttgtgtgcgcgcggcgggcgccgtgggcatgcaggcataagtccaaagataacgacgaagctagctaggccttcaccttcacgcttcaccaccagtagctggtgtgttacagctagcgtgcgcaagtaagaaaccacgagtgcgaaacaacagaaattaaccccgtttcgtccctctcagtttatcatgcagaagagataacaaagccggtgcttagcaaaaaggaagatgctgggataaacttaatttgaccgtgaacgtgttgttgaattaatataacagcccagcacgccaccaattactttattgctgtaatgtttacttctctagcgttctggctacttagaaaatgtatgtcatgtcagatgttgcctgttttgatgagcccaaacccggaactgtgatgagggttgggtgaattgaaggttctcttgcccagggtttccaattttggtaaagaccgaaaatatggcaatttcagtggtcacaggaatttcaataatttcagaaaaaatggtgggttttttcacaaaattatttaaaattttaaataaattttagttgaatttaaataaatgttgatcgaattcaaaaaattgtaaaaaaacaaaaaattgcggacgagatatttgcccggggttccgaaatttcaaaccctactgctgaccatgcatgagtgggcactgataataaatatttacttgaaaccccttcttattttatcatgctatatatactatccacataggttgtggtgttgcatggctctcaagactgtttaaactgtacacgtggattgggcctacggtgcctagtgtcaaacctgggtttgaccccaaatcgtatatgtatgccgtgctagttacacgatcaattgctagcacatacattcaaccttgatactagagttcatacatcatcaaagtacagtacataggagtccaaacttaagtaaataaatgatctagactttaacaattacatcatgggtcatccgccgaatacaagacaatataagagagtaaaacacagcgaaaacataatataaaggcaccaaaacccagcaagtgtgtctctgccctcacacaacaactgaccgttaagtcctagtaagcaccaacatcattgtctccaaaacctgttgtatagaagtacccgattgccaggtcctcctcaatctctaaaaaaaaagaagtcacacaagcgtgtgtgagtacaatacgtactccgcaagacttttagtgtatccaatggtaatccgtaataatgcaaggataacaaggaatggttcaccgagttgtccatgaccatggccacgactatccgaatagatttaaactctgcagaatgtgcacaactgcaccgagatgacacgttaaacctgagctaccatacagaaggctcgttccaatatgacgaagccttttcactagctagcagaggagtgccctccaaggcccgaggctcaaacgttgtgcaggtaaaccttgaacacaatatcgtcaaaggcaccgacaagtatggacaataaccataccggcattaatccaatgtcaacaacaatgacctacaactacaacagacgggtctattgcttggaaccaataattctcttagctagggacttcctatgagccacacgtgatttgcgctagtgtctcagatcaatttggacacagttttccaccaagataataaagattttaccctctgttcatttccataattttgcaaacatttttttctcgaaagcccaataatccgattaaaactagcactaccgatataagccagctaagcatattctacacgactatcctcccagcacatgaacccaattctcagtgataacgtaggtgacaatgaatcatgatactcaagtaacaaagacaaggtatatgcagcaattggcaagctacccatgcataatagttttgcaatgaatacaatttatatatttgaaatatatgagcaattgatcaagggggagcttgccttggtcctggacctcctggtattcctttggtaccacctcagcaggatcgacaacatcgttgtcttcacgaataccgaacgaatgcaataaatacaatggcaaaatttaatagtacaggtaatccaaatatttttgcagagtatgaaagtgcgtgatttcaggaaaaagaatcgcttgaatccgagtttgtatgacggagaaacggctaaaggaagtcttctctgccctaaaatcgaagataaatgaaaaacatcgttttcgctcaaccgagctgctgaaacggctggaaacattctaccgacctaacaggtcatctattaaacattttcttggttctaggggcgtttttatggcgcaaaacctacatatgggttaatgtgaacctattgaaaaacttcagtagttgcaaatgtctcggtccaaaaacaacatcttcatacgagcgaactacacaactcgctaaggatgttaacgatgaccggcgtaaacgtgaagtcatggcagcgactctactcacggtttcagcacgttctaacagtagtgaggccaacctagcatggatggggccgatgggatgttcatggttagctcaaacaagtgtgcacctatggtgttcggtaaaatgccaaggttaagtacggcatgcctacctctgtcctctcattctctagtgcacggctggtgaagacgggcacatggaggctcttggggtactacatgcaaggtactggggttctaacttgtgtggtcttactcctttgagcctcggccatgcatgtagctacagtggtggcacttgggcggctggacaaacgacgacatcgctggtcatggcaaggaaaacacatgcataaacaggagctcagcggttgaggctatcggcaaggtgacggcagatggaagaagttgtcctgtggtggaactcagggcgtcggggactaaaaccaagcatgggaatgaacttagcagggtatatagatgctcccatggggaggaattgggttggaacttactgaggtgaaagttcccaaatcaagtgcatggaggcattcggtcagccccaagagaagaagatcgggcagcagcaagttctaccatggaggaggaggaaaatggattaaggtggggggaggaacacatggtaaagctgcttggatgtcgagatactcaccagggacagagtttagcgcttgttaggtcatggcggcaccgggccagcgttggagaacacgatgcactgcatttgtgctcagcgtcaactgagtgcaaaaacggaatcagtgggtgaagggacgcgaggtgacatggctgggatgagatgatactcaccgatggtattggaacggtggaggtgtgcttgccgctaccacacgtggcacctcgcccagcgaaccaagggacaatcacttgggtcctttggcttcctaagaacaagggcgagttcgggagttaggaggacatggtcttggttaaggaggaagccaaggaagggaggggagagagcgggtgcttgcttaggctgtgttcttccctcaactttcccaactcacctccctcgtgttctacgtgcacgcttttgaaatggctaaacggtgcgtttttttgcaaaaggtttttatacgaaagttgctttaaaaaacatattaatatatttttcaaaaaaattaataaatacttaattaatcataagaaaaggcgttgctccgttttgcgtgcgcaggaggtgagttcctaacctcacctcctgatcacagccttactcccttggcctcgagatggcgtgggcaccggcaagcctgcgacagataaatgggatagggcagggtgttgcagaggctggcaaagggcttctcacgaggtcccgaggtaggcggcctttctctcgtccacattcgagtcaaagacgaggcattcttgggacttgggagcaagaaatcatgggcggcaaaggacagattggccgctgccgcctgccgcgcgtgcaatgcgattgggaggcgtggtggagcactatgatggcgtggcagggcgttggggaggagctgtgacgtggcgtggggtctccagggcagtctagtgggtcgtggctaagctgaaactcacggtcatgcgcgagggctagcctggctcacgcttccagcgcggcaaaaaatggctcgtgtttggctgggttgtgggtcccgaattagaggtggggagtggagaccaacataagaagtatgtcccatggagttgcctatcttaccaaataaactagttgaaaccccacgcattgctgcgagattttgtatcaatacttgggagaaatgaaaataccatattaaaagagaaagaatgatatgatggttgatacttacaaatattgagcaaacacttgttagtaaaacttcagccgaaccaatatagtcgaaaaataaaatagggcatgcaacattaggaactgaattgcagcgtcttcgttattctccaaaagaaatagtcatatagttatttaatcctaaaaaaatgttgcatatttacttcgttaagtgttgtgcttgttctgaactcctttttaagtaccgtacataacataatcttgctaccaactgcaatgattacttgattagtgaaaggagcattgacgacttcataaataaaagtatgagcagatagttccagaccatagaggtaacggatattgtgtaattagcagatcatattcaactctgacatgaaaaacatatacaattgtgtttccaacataagaatgtgaaattaccctaaaactctgaaatgtcacttagtctatgtttggacactctcattggctgaacatgtagctgaatatttcccatcagagcttgtatttgaaaaaagaaaaaactaaagaatacatcataattaatgtcatggaggttagatgaaagtagaagaaaagaacttgagaaaagaacaaaatgaagataaagtcctcaagccatacctaaaattgggggaagacatctacaaccaggaatcggccgcaggacgaagaaatcgatttgcagaaacacaaaattgtcatagacctcaagccataccaaaaattggggaaagatgtctatggccaggaatcagccacaggatgaagaaattgatttgcagaaacacaaaaatgtcatctccttctatgagaatcctttgcttcgaaggtaatccaatggtatgacaattttatccgctgctatgtcaatcctcaggttttcccataagtacaggagccaatatcctagatagcactaataagaatgggtcaaacaatataagcttttcatgagaaactaaagcaatagacaatgcattatggaattaccgcaatagctgttctttttctaagttagcagaaacaattcatcaaaaactcccaccttgttcgtgcgagagcaaattcataggctatgctcaataaataaacagaagcaaatacatatagaattggtaaacaaactgaaataaaatcgttgaaccataaactttagttacgtgaagtatactaaactttcatacttcgattctagccatctggctctagcctttgttgataaattggaggagctcagagacttgaccttggctgagtggaattttagactctttatgaaaagtaaggttcttttgctccttaagtttaaacaagtctattggcaaaaaaggtgcactataaggtgggcaaagtttggtggtgaaaatacaaaattctttcatgctgcggcaactgaaagatatcgcagaaatttaattatgcagctaaagtctgatgatggaagggtgctttctgatcatgcagaaaaggcagaaattatttttcaaacctttcagcaaaggatgggagtttcttcttctccagtcatgcacttcagtttggcagatctcatttctgctgctcctgatcttcagtcattgtctcttggctttacaaccatggaaattgatgaagttgtcaacaaaatgccaattgatagatctccaaggcctgatggattcaatggttgcttcattaaggcctgttggcctataattaaacaggacttctataatctttgtgctcaattttgtgagggttctctggtgcttgagagtattaatagatcctttataactctagtccctaagaagtcttctccagaaaaggtaaatgacttcaggccaatttctttacagagtgtggctctaaaacttcttactaaggtgctggctgataggctacaatctgtcatcattgaattgatccaccaaaaccaatatggtttcattaaggctagaaatattcaggactgtttggcttggtcttttgaatatctgcatcagtgccagcattctaagagggaaatagttcttttaaaattggattttgagaaagcttttgatactattgaacattcggttatattggacatcatgaggcagaaaggctttgatcctaaatggataagctggatttctcatattttttcttcagcctcttcttcagttatcctaaatggtgttcttggcaaatccttctattgcaaaaggggtgtaagacagggtgatccactttcacccttattatttgttcttggagctgacttgttacaatctatagtcaataaagcttgttctcagggagttcttacaatgccaatcccaacacctggtaatgaatttctgattgtccagtatgcagatgatactcttatttttttgactgcttcccaaaaagagcttttctgtctcaaggcaattttgaacacttttgcctcttcaactggccttaagattaactatagtaagtcatgcatgattcctctgaatgtagatttggaaaaggttgatcatctctcaaaattgtttggttgctctattggtaagtaaccttttacttatctgggtcttcctcttggaaccacaagaccaagagttattgattttgctcctctaattgatagagtagcgagaagactctcagcaaccactgctttgttatctcatggggacaaattgaccattgtgaatgaagttctttcctcccttcccacttactacatgtgctctctttcactttcaaagacagtcatagaaagtattgatagagctaggagacattgcccgtggaggggatctggtattaattctagtaagaagtctttggttctctgggaaagagtttgtcagccgaaagatagaggtggtttgggtgtaatagaccttagattgcaaaataatgcccttctcttgaagaatctgcataagttctataatagatatcctgttccctaggtcagtttgatttggaatacttactacactgcagaacctcctcatgctgttactcctaaaggatctttttggtggagggatgttttgcaatttgtggaaatttttagaggcatctcggcctgtactgtgcaagatggaaaatcttgtttgttttgggaagatttgtggaacaataaagtcagggcattggtttatcccagaatatattcttttgccaggaattcaaatctctcagttctgatgttctctacttctgatctaccttagctctttgccttgccactttcagagcaagcttttcaagaatatttagcaatgtcagctgcagataccttggagcatcttaatgataagtgatcgctggacatatgtttggggcaacggtattttttcttcacagaaaatttatgccatgaatttttctcatgtccatgtgcctgtttatattaaatggatttggaagagtagttgtactatgaaagtcaaggtgtttggttggctcctcttgattgatcggttaaatacttatgacatgttagacagaaggcattgctcccctcaaaatgcttccttgctctgtgtactttgttcaacaggatcaagggaaacaactctccacttatttttccagtgtccttttagtactcaatgttgggcgcaatttggtgtggtttggaatctttctttaagctttggtgaaatgttggtcacggccagaaattcatataactctacccattttgttgagaaggtgctttatgctgcttggaacatttggaagcagaggaatagtttaatttttgaaaacattgttccctctgttccctcttggagagttctctttaggaatgatctctcccttttagttcatagagtcaaaaattctgagagagatacattgttatagtggttaaatttgttgtaattttttcccccttattaatataaaatcttaacggtgggggcttcccctaccgtggttctttcaaagaaaaaatcaacgaatatggttcacggattggatgagttcagaggatggtggaaggtatttgtggtctgttatgaatgctgaagggatgttaagaggctcataaagggatgctatgagacttgtgaaagctccttgtggcttaattaattgtgttagttttcctgtaatttctcaagtagaaatagaaaggagaggaaatggattggggcaaggtgatgagatggcaatatgtgccatcaataatcaatcctatgttgagaaaataaatcgatgatgtggcttcttctaagcacaactaatggtcttaactttctagaaagaagggatagtattaggtcaacaggtcaacgataagagacaatgagtggaggagagaaaggtctccagttgggtgaacagtgccctaaattttccaatttcgactgagggtttgaatggttagatgggtaaacttgcttcaatccaaacataacttggaggcaaggctagtagtaaggtatggaatatttaggaatttatccagaatttttggacaatattgaaaactcagagtcggttatggcagtgggaaccatttagagcaatcgtacaaacattattttgctcagctgggattttttatgcacgaaataattcatgcagtgcagtgcacatgaaaaacatttttacgaaccaaagaacaaaagtggattgttacaaaacctacaccctcataccatggcggaccggccaccaagatgatgcccatgtaacatagacatcgtcagagtgcgagtatggtcctagccgcttcacttttgcccacatgaccaaatagaggggaaacccgaccaaacccaactatataataaacttgtggcatccgcatatctctgtgatataaccatatatcacattccatcatcctcatggctcgagaacgctaggtgagtcctcatgggttcacggcttgagaacgctggggtcataacgtcaatgccgagacatgccactgagccccacgtccagcctcctccttttagcctaccatcgtgccagcgtgaaccccaacttaccctagttctattccaagcagacccaagaggagaccacttctaggtcaccgcgaacacactactacaaaaataatttttccgtgcggtcaaaaaggattttcgcgtgagatatggaacacctgcacgcgaaaatcgggttttcgcgtgcgggtgctttatgtggcccgcacggaaaaacaaaaataaaaaaaatcaaaaaaaagaaaaccctaaatgaaaccctaaatctggcggcgccgctcctggccgccgtctcctcctcgtcgtcgtcggcggggccggctgccgccgtagctcgtcgttgtcatagctgtcgccgccactcgtctcgtcgtcgtcgtcgacgtcgcgcaggagaaggcgggagaggggcaccgccactggatctaggcggtagagaggcgccgcgccacagggagagcatggggacgaccgtcgtccgcctccgctccatccaccttcacaattatatttgttactttttgttacaacttatagaagttaaattttaacttgcatattcgtagagtgatatatttcatattaatctatcttgtcaatttatttcaattttttatggctttttatataatatgcataaaacgatgggatatcctttcaagggatgaatactctttccgaggtaagaaaccacatcatccacgaaatccggaaaatatacaaattggaattacaaattacaatcaccaccagttagtaattcactgtacgtgagatctgcacatactgacctcactttatttgtacattgttcaacatattacacatttaacatatcatattcatcttggtaatatatgtttagcttaataaggaattagaacacgtcaccgttgatgtagccggtcttcttgtcccagtacctgttccagaccatgatgcctccgtagttggggagcttgttgatgaactgcagcacatcgaagtagagatccttgtgcgacatgtaggcgtccctgtccgcctccggcgaagccacaatgctgacgtagatccggctgtccgggtacgccgccgcccacttctccagcgactctctccggccccaggtgcaccgcccgtcgttgaacagcttcacgtggatgcggctgaagagccccgtcgccagcgccgcctgctgccgctggtccgggaacacgcaccgcgccgtcgccgtcagcatcacgccgccattgctgtggccgtggagcagcctggccagctcgtcgtagtgctccgtcgcgccctggtcgatgaagaagtcgatgccgttgacgacggcgtcgccgaatgggcgggcgacgccgctgcggccgccgccgaggaaggcgttccagaggtagtcgtccaggtcggcggcggcctgggaggacgggaggtagtactcgccgccctgcccgccgatggcgaggaggactgtcttgcccttggactggcagtacttgatgtcgccgccgacggggacgacggggtggccggagaggtcgagcttgtagctgccgcggccgaacgcgctgaggaaggagatgatgacggtgttgtagaggccggtgtcgcaggcctcacggagggagccctcggccttgttccggccccagaacaccacggtgtcgccgatgctgctgctctgctgcgccgtcgccggagcggcggcgaggcaggaggagagcagcagcagcacggccaggggtgcaagagcagccaggcatcgcggcgccattgatcgatcttacgcttaattggctttgcaaacctctcgagattacacgacggagctagccgcgatggatgattgatgcgaggtgtattgcatggatatatatagggagatgggtattatggtatgtgcacgcgcgtcggcgcggacgtattgtgttgtgttgggtgcgcgccgtcggcggcgtggcgtgcaggcatggatgcgtcaatgcgtggcgatacatccaacgacaacgacgaattaccttttcaccttcaccgtacaactggccgtgctatacgtacagcgccattagcatgcacgcgatgctagctatatgctggagacctggagtacgacagtacgtacgggtagctagaacgcgttagcaagcacgcgattgcacgtgcgtcaagtaagaaaccacgagcgcgaaacaatggaattaaccaattaactgttcgtcggattatcacgctgaagtcctgaagataacgatgctggtatgtttagaaagagaaagatatacttgacacaaactttgtcaaactactttgtttgttacgatttttactttactttacttctctagcatatattccggccggctaccttgaaaataaatataccaagtcgtgttcggcgtcgtctgttttgaagagactggaagtaacaagggctagcggggtacggtgaattcaattaatggttctgcgagcaaccgttcaccaattagttcttgtatctttaaaaaaggttctttgtctcctcaataattatagggccggggatccaaaaatcaggcattgttttatcactttagagaaatataatattgcatcacgttcttaaatgtttaaacttacttttattttttttaaaacaatgtaacattaaaaatatattgactacagtatcaattactagtacatgatacattgagaaacatagaaaaattaataaagttaaaattttgaatatgcaacacaatcaaattaaaattaaattcttcttacacgtgaaactttgaatttcaatggcattagaaatatgtataatagtgtgacatcttgttataaaaatttaattgttcaatcaagattgtgattaatagatttatattgctaatgatcataatcacaaacttcgcgaatattgataagctttaattaatatctcagtgcatcggcctacattcaggatcaacatatataattgtcgaaagacacattgaaatggaagctctcgaacctatttcgaagtaagtttaggatgaggtttctgatccggttggtgtttcgacatatcaactcaggtttgcctacctctctagttgcagagagaggagaggggcttctatctttttaggtctctgaaaagctagttgacatgagatccaatcaaggaggtagtactttaatttgcctgagttcctctagatccaactaatcggtattacagtactcccgcgggttgttcaccatgcgttccatagcatttacctatttgcctttgtgtttttgcgcctctagaagcttcatcgttttttcacagtcaaagttcaagaaataaggtttctgatcagcaaaaagaatactttcaatcttatactatctcggtttggtttgatctatcaagatttacatatactactagcataatgcttgtgcattgcaacggattataaataacatttattgacataaactaaatcctaaaccatatatcacaattgggcataaatgatgaaggaaatataataatcgaaataacaatatgaaactacaaataactttggccagaatgataattcaatatcagtaaaattatataactaaatcctgttttttcttttagctataaataattcaacacagagaaaaattataagttaaaacaatttttaatatattaaatagtgctaaaactaatactgtaaatgtgaaaacaattgaaattagctagaatttttttaaaaaaacttattttagcccatagatgaaaatccgatgcaataattctgaactggtaccgtttcttcgtcatatatttgaaatttatagttatgttcatttatatggtctatattatgtgtgtggtccaggagcatggttgggctggaccaggaaggaatagtacccaactggctctgcttatcgtcttccctagctgaaggcaagaaacaaaagagggaagatgggtgtcggtgctttggcgaccaaacggcggtgaataagatggtaggatatgtcatacgatatgactcgcccatagatggtggaggtgggcaaccaaaaaaaaacagagcagtagaaacgcagcaggcaacgacgtgatcctgatagagagagaaacaatggcaacgagttctggtggtgaacatgaccggatgagtgcgtcaaaacacgttccttacgagggggttccattttccttgaacgcgcaggaagaacaaaagatggaaaaacaatactaacactgttcattatcttccctagctgaaacaagaaacaaacgaggagggaagatgggcgccaatgctcctatgactaaatggtggtgaggaaggtggttggacgtgtcccacaatgtgactcgtccatagatggtggcacttggtaatgaaaaaaaccagaacaatgggaacgtggccaacaatgacgtggtcctggtagagagagaaatggcaacaacgagctctaatggttaacaccaccgggtgagtgcatcaaaatgtgtttccaaacgaggaggttctgttttccttgaacgtgcgggaggagggagcgtagtggagaagaggggcgctaggaggaggggtgccaagaaggagaggggctgcagggggaggtcacgagggagagatttggggcgcctagagggagggatcacaagggagagttgtggggcgctggaaaagagccggaggggcgcgggaaagagggaggagtcgtgcgaggaggaaggagtgcggccatgcgggatggggaggtggatggacgaaaaatagtcggaagccttacgtattttataattattaggtatagatatagatatattacatctaaactccgaccaatgtctctttaatccttcatattcatatctatcggttatatatccgatcgatccaaaattccatcggtatcggttggacacagaatactatatcacccctgtggtcgattggccccgtgatctaatcttctcgtttttaccttgttagttgcaagatcaaactaactagcatgttcctaacccgattttgataggacctatactagagtgaagcaaatatcttaggccttcgtgtgtgcgacaaattttgcgtcaatgaatctcagagcatattcaacggtacgtatatgggtgtattatgcaaccgcttgcacaaaacttgctattagcagaatgcattatgcagtcatgaacttggctttaggactgcataattgcatttattatgaagtaaaactagtgttattccggttattctgcttatgtgctgatgcttcgatgatccttcggtgattttacctagttttctgatgattgttttaaaatttacatcaatattgttattctgcttgtgtgctgagtcccatatgattatttggttttttccccagttttctggtgctttgttttaaaaattgcaacaaattcggtcaagatttgtccgatatttctgaaattcgtccatttcagttgtgccgaaatttttatgcaattgaatcccagaacttgtagaaaagttcaatctttaggagacagggagtagaggttagggagtatgtattggttgggcgatcagaatcgaaccagaatccaatgccgatcttccaaaatattgggttctatagttactactattttggattccgatcgtaattcccagtccgtctggctatatggctattggcttgtagtagtacctaccgactacgatgatccgatccggtatttgatcaatctcctcctccctcacactgtatctatataaataaattgctagggttggggaattactaccgagaagcaaagtgcgtgcattccatcaagacgcccaaagacgcaacgcagtaaggaaaagaaaagaaaacaaagagaaatcatgtcggcggcggcggcgagattgagagcggtgtttggttcaatggcggcggcgcgtcctctcgtccgccgtcggctttcttgtcgcccttttacctcctcattagcgcctcccaactaccaccaacaagactgctagtatgagcaaaccaactaccaccaacaagactgctagtatgagcaaaccacatgccatcgccaccaccagaccaacaacaacaacgccgcacgcggctgaaaaccaatctgacatgacttgtcgtcaacaagctggggattcctcctc

SEQ ID NO: 47564 - DNA, 2401 bp, Oryza sativa
  unsure (1)..(2401): unsure at all n locations
gggtaataccaacccctatataagggacatggccggttccattgtaactaaccaatctataatcaatcaatcgaatcgtttttcatattgcttttagttttctcttagtctgtccatctttgtcggtttgcgccgtaaaccgtccgccgccgctgcgagagtgcgacacctctttgtaggtttgtcctgaaaaccttccgttttgcccacgagacgggtagctatctagaaatcggctctgctagccggtttagttatcaaaacccatctaggtttagctttttgctagatcgagatagttggcgactctaggatcaccgtaaggcataaggtgctatgatcgtgcttgtcaacttgtcacaaaagttgacaacacgatttttggtgactccactggggagatccgttcagcgtcaactcaacttcgacttcgccatgacgaagcagtcgtcatcaaaggtagaggtggagcctatcaatgtgataccaattacattggatgacttcgaggaggaagatcgcaagtccatagaggagtacattaaggagatcacataggaggcgttgatgagggcgtgcactaggactcgtcaaggcgtgatcatcaaacccgggccacgtcctaagctcactcccgatttggtaagcaatgaagaggtaacacaatctatccaacaacaagttgtatctacaaaagattcatccatgattatttttaaaaataagttagatgcaactattaaaggtcgatttgataagtttttaagaactaaattcggccctctcatggccgattttatgttaaaagataaagcctctaccagtgctagccaagttcctatagatcaaacaagtagtggaaccgatggagcggcgcagacagccggtccgatcgggcctgatggccagtcagaccgcgacttcgccgtcggtccgaccagccaaacggccggtcagaccgggtattatcacggcggtcagaccgggactcaggccggtctgaccgcgcctctggacgttggtcagaccgggccctggactggtcagaccggcgcaattattccgattcaggggatatatccaatgactaatgctagttatttgtatcatcttagaacatttgatcctcctatatctactgctgcaactaatccccaagttcccccacatgttcctaatgcttataatgatgttgctaatgggtatcctcccgatactaggtaaggccaatataatcatattgcgccgcaaacacatcctattaggccaccaaatccaccaccaaatcaacataggcctaataatgtggaggaaataattagtgggattattagggataaattcgggattgaagctaggaatcgtgctaaggtttaccaaaagccgtatcctgactattatgataatgtgccattccctcgtggttatagagttcccgaatttgccaagtttagtggtgaagatattaggaccacatgagagcatgtaggtcaatttttagcgcaatgtggtgaggctaatagtgatacttttaaattgcgcttattttctttgtctttgtccggtaccgcttttacatggtttacttctttaccggcaaattatattcatacttggactcaattagaacaaagatttcatgattatttctatactggagaaactgagcttaggttatgtgatttgacatcggttaagcaaaaatataatgagcctgtcattgattatattaagagatttagggatgttagaaaccgatgttatagcttgaatataactgatagagatttggctggtcttgcttttaatggtttaatttctcatcttagagaaagattagatgaccaacaatttcttgatgttagtcaacttatgcaaaaggctctggctcaggaaagccgggttaaggataataaaaaaattgttagaccatataagaaaaagcctaatattaatttgattgattaccctgaggctagtgatagttaagatgagggtaatcatgatatgtatattgctgagtggtcatggactaactaaaataagccttttgtttgttctaatctaatgccaactcctcgtaaagatcggcaaagtgagattaaatatagttttgatgtggccaagtgtgataagattttttattattttttataagacaaacaaattagattacctaaagaccatatcataccatctcaagaagaattgaaacgtcgagcttattgtaaatggcatgattcccactctcattctactaatgattgcaatgtgtttcgacgacaggttcaatcagccataaatgaaggacgattgaagttcaccgatggttccaagatgnnnnnnnnnnnnnnnnnnnnnnnnnnnnnnnnnnnnnnnnnnnnnnnnnnnnnnnnnnnnn

SEQ ID NO: 47565 - DNA, 977 bp, Oryza sativa
tttgtgttgattaatgatgattgcttgattggggttcgctgctacagtaaatcgggttttgctagaggatttggaagaacataggacgagtgtgattcttgatcactccactttgttgttgattatagttcttgtctgaatttcttgtcatataagttctgcaggaattttgttctatccagtcacttcttaattcagttcttgtttacctccttactatccatgaattctcatacccagttagaatttatatatgttgtttctgaatttatatatgcaaacattgtgctttgcagtttcttgatagcataacacgaggccaatcgatacgccatgttttctatgctcctgaaaattgcaatcagaaacaagcgtcatttgtatcagtagtaacatgcttattgtcatcttagcagatgcaattgacaaacctgaaggatcttttgtgatgttcctgacattaaaatgctaaggataggcttttctgttactcttctgactacatagcattccctgataagaactcttgttgaattttcacagagcaaggaagtgaagaacaaggaaagaaagatatggaagccttaaccaaagtcatggacaaggtcaaggaagtgaagagtaacccagaagtggtggagaagctggacaaggtcaaggaagacatcagcagccttgctcatgctttacatctgggaaaacatggtaaatctttcttttgagatgtcttatttcctaggataggataatcatatttctgacaactatatggttgcatgataagtaggcatttcattatttacgcgtattcccgaaaaaggaagcacatctcattgtcacaaatagaactatagaagcacttgcattgtgtatagtccgaacatccaaaacctgaatattaacttttcttacatcttttcccataattttacacatgatcaaaagataaggaacatgaatctgaggagaaggcaaag

SEQ ID NO: 47566 - DNA, 760 bp, Oryza sativa
tgtatatatatatatatatatgtatgtgtatatatatatacactagaaaaaatatccatacgttataacgggtaaatgttattttgtgtttgttattgttatacggtttagctagggtaaaattcactgtgggaatttaattgtatatttttttcagaaaatcataagctgtaattaggagtccgtattttatctgaagttagcatgcgagtgttctcaaaagatttcttatacgactcattttatacttccaataggaaacaaacttaaaatccaactcaaacacggttctgtatttccaaaagcaaacgaacttaaaaacctactcaaatacggatgacgtactaaaattctggcaaaaacatcttcaatttttataatagtagagatatatcaagcacataacaattatgttgtccatgcaaaccatatcgtagaagctagctagaaatactagtgtagaacatcgtgggggtgacagcgccactatgattacttgatgtgggaacttgtacgttgtaatatgccgggggttccttagggacgtccagggcctccgtgttgctcagcatcgcgacgatcttgtctatgttcggccgatgctcggggttggcctgcacgcagagaagggccatctggacgtacctgattaacacagcgtcctcaatgttttctcctgctgatattaacgagcggtccacaaggtccttgtatctttgcgcatcccacagttgccatgcctgccaggggctgcaggaat

SEQ ID NO: 47567 - DNA, 825 bp, Oryza sativa
attcctgcagcccttaaaaccgatcaaacacggatgacggaccacagaaacatcttgacacatcaatacattaaaaccgactaaaacacggataaacggaccgcggaaacatcttcaatttttataatagtagagatataacacgtggggcttgtgagtttatctcctattaggattcaaaattggttttaacctatgacaaaaccaacttaattatctctttctttattttcttcttagaatcggactgtgggccaatcctgttctaacttaccaaacttagctgatataaatcaaccaatattttccagggagagctacaaatcggacgtccgatgttataaaaaaggacggtcaaatgtttcagttaaccgtttgtgcaacgttaagttatacatggtgaaacagaaaattcagcctaaaaaacatatagaaattttgtaaaacataataaaaatacatggtgaaacatattactatcacgtatgaaacattaagtttttattgtttgaaacatatgattttctttcatcagaatataataatgtgatatcttgttgtaaatatttaattataacgaattcaacagtgtgatcggatggttcattggataagtagtttaaaagaaaaaagattcttaagaccactaaatacttacatgcatgcatactgtggggagaaaaccaatagaatggcagtagagagagtaggggcatgagcatcttgtaatttttcggcctttgggaaacattgagttatacgtggtgaaatagtaaattcagttattaaaacatttaattttttttataaaacgggctgcaggaa

SEQ ID NO: 47568 - DNA, 13030 bp, Oryza sativa
tttctacaaaggagatagttgatgtgctcaagaaaatgcttgtggataaggcccagggccagatggtttcaatggatgtttttataaatcttgttgggagattattgcacaagatttctacagactttgtgctgacttttggggtggctctgttgatcttgctgccatcaactattcttacatcaccctggttccaaagatgtctgcgcctcaaactcctaatgattataggcctatctctttgatgaacttttcggtgaaaattctttgcaaaattttcgctgataggttgcaggtgttgatgttaagattggtgcattagaaccagtatggtttcataaaaggcaaatcgatctaggactgtttagcttgggcctttgaatacattcatcaatgtaagcattcaaaaagggaaatagtgctgttgaagcttgattttgaaaaggcctttgacacagttgagtatgaggaaatcctcaatgtgatggctgcaatgggtttcccatcccaatggaatgcctggatgaaagtgatcttctccttagcttcttcggctgttcttcttaatggtgttcctggcaagtttttaaatgcaaacgtggagtcaggcagggggttcccttatctcccctcttgcttgctttgggagcagatctgttgcaatccataatcaacaaggcacatcaaagggggatcttgtccatgcctatcccgatccctggtgatgataacttccccgtgattcagtatgcagatgacaccctcatctttatgcaggcctcggcccctcaacttcatgctcttaaagccttgttgaactcttttgctctctcttcaggcttgaaggttaattattccaagtcttgcatgattccattgaaactcacagaggataaagctcagatgtttgcttaaacttttggatgttctattggaactctgccatttacttacttggggctgcctcttggaaccaccaagccaaaagttatagactttgctccacttacagatagaattgagagaagactgacgctagttcagcttttctatcttatggtgatagactcacattggtgaattcggtcctctcattgctcccaacttattacatgtgttctctgtcattgccagtctcggtcattgattccatagatagagctagacgtcattgtctttggaggggaaatgaccttaattcatccaagaaatctcttgctgcttggtccaaagtttgtaggccaaaagacaaaggtggtctagaagttattgacctcaaagttcaaaaatagggctcttcttatgaagcatctgcataaattttataacagagcaaacattccttgggtcaacttgatctggttatcttattatggcaatgtgataccccaggttgctagaagctgtggctccttttggtgaaaaaaatggatataaaggatggttcaaagtgaaattttggtaataaaacatagcccaaagtggaatgaactcttttttttaaatagatctatagtttagaggcacatcaacttctcaaccacaccctagctagagtacacaatttggaatttacattgtgtaaccttgaatatattttatcatattatataatataattatgcaaaattaaatgtctgcttttaaagatcaatgcttttgatattttttatcggctttcgatcgatatcgacacgtttatgtccgtataatccgtttccgggtttccgatattttcaatatttttttgaaaggatcgatattttcaatattgtttccatctccaactttaccattttccaaaaaaaatatagttatggagatggttaagacgtttcacgaccgttttcacccctattctaaaaaggcaaattttggtataggacactgcttatatgtggttttagccttagcacactgcctaaactcacttttagggggaaacactccataaatgtgataatttgccagtggataccgcgccgattaaaataataatttccggttaaagaggagagagaaatcgtgtgaaatgtcaaaaatgccccttgggctcacatttcagctctatctcctatatctcttctcctcttcctgcccgcatgtcgcttcccgccggccgccggccatgcccgcacagacggcggcggaggcagcggcaagcagcagcagcaccccggccctccggcggcctaccagctacagtgcacggtggagcagctgcagccgctccttctccccgctgcctcgccacccccaccccctgcccctgcacttcctcccgccgtcggtcgacgcgagcgagccgtagctcccgcaccgcatccccaacgtctacgccgagccactcattgccaccgccgtagccgccgccgcccttctctcatcccaatcaccgaatcacaacaccgctgcggggcggtggctggcgcagcatgcaggccggcgaggcgatggctcgcagatccggcggcgcggagcggggcggtggcggatgacgacgacgatggtgacgagttcgaggaggaggaggacgcgtgaagctcatgcgcagcttctgccctcgccgcccgtgcaccgcttctcccccgccgttcggccccaaccgcaccgtcgcatccatggcagatgctgggtggcacaagattgtggcaacaacggtccctcctgccgtgcgatcacccgccgccggcgctctactccgcctgccacacgctcggccgacatcgccgctccgcctgcttcagccgccagctccgctccgccacagccgacgccctgctccactctgccggccgccatccttgccatctcctccgccgcgacgagctcaagccccggcgaccgacaccgccccatgcgcctcagagagagaacatatatagagagagagaggagaagagagacaggagatagagctgacatatgtgtccaagggcatttttgatatttcacgcgatttctctctcatcttcaaccagaaattattattttaattgacgcggtgtccactggcaaattaccacgtttatagagtgttttcccccaaaagtgagtttgggcagtgtcgtaggactaaaaccatacataagcagtattctgtagcaaaaattgccttctaaaaaatatcaaataaaataagttgttaactatagtaatcaagatctatcatttttttaattttgtagttgccaaaaaaaaaccaaaaagtattctgaattttaataagcatctatacactctgcgcacccaagttgcaagccaaactatttttttcatgaaatacgcacgcatgtgccgtgtataagatttgaacttgagacttcttagtctacacacatcatcactatcaactactatcagatacttgtgatgaggctcctctaacgtaccatagagggacatacgtttctgatgtgtgggtccatgaggttggtcccaccggttagggactcatatccctcggattttaagtcagaggagctgtgttttaaatacttattgtttagaattaagatgctattattttaacttcatatctcaaaatcttattgtgcttatttagtcacctaaataatcttgagtaaagaagtcatcaattacaaagttgatgtagctagccagagtttttgaacatgtaaaacaaggattcagaatatatatatctccttgcgaacccagccgcggccgcacggccgcacagagaggttattcgattacgcaaacatatcgatcttatcctcaaagatgatcttcccaagtcaaacgactcgatctcatgaaaacaaccagcaagactcgacccataatttttacatatatactccgtattactgtaattaacttgctgcatgccccctgcatgagaagccgataatatttttgtaaaagccatagggcaccgatcgatcagccgaggggcatgaaatttcttgcgcgaatcgtttactctagttattttaggtcctcgaccgagaacaaacgcgttgtcttgtaacatagaagaaattgacattggcacgccacttctcaaaacttgcatgcatgctactgtgcctatatatatggcccagcaaagcgaaagcaataccattaaaccaaaacactagctagcaacagcatagcactactgatgcatatataatagctaatcaaacactagtccgaagacgtagtatattctctccactgccaaatgcaacccctcctcctcctcttcctctctccggtggtcgtcctctcgtcgtcggcatggacggcccgtggtgaagatgaggcggtggcagtggcctcgccggaggtgaacccgctatactacaactgcagcctgtccggtggccgctacggtcaaaacaccacgtacgaggacaacctcaaggcgctggccgcgcggctcgtcggtgtggccagggtctccaacttcgcctcgcacaccgtcggcagcgcgccggacgcggcgtacggcatcgcgctctgccgcggcgactacaccggcgacgagtgcgccaacggcctccgcaaggcgttcgagaatgccgtcgagaaccgcctcttctgcgacaggttcagggacgccacgatctactacgaccagtacatgctccggttctccggcgaggacttccgggccaacctaacgaacgcgccggcgtgggtcgcgtggaacatgaacaacgtgaccggcgccggtggcgccgccaagttcggcggccgcgtcatggagctgatcaacaagaccgctgactacgcggcgtggcactcctccctgcagcgcgggtactgttgaatttataagcatataataatttaatttattccataaataaatcatgatattgtagatgtaaactagtataaatccatcattagatctacatatgtatactaggcagtaaagcatcaacagatcaaatatgcgtaatatattgaacacgtatcgagggtaccggaagactagttgctcagcaggaattactcacggttgcaggcgttgacgacggcgcgtagcacgtgagcaaagaggaagatgagtcgtcgtgaacgaacagggagtattcgtgcgaagcgcttcccaaaaaacttattgccgccttctccttgtgcaggatgtcgaaggtagagggtctcggcgcgcagcacgcgagtgaaaagaaagacgagtcgtcgtgaacgaataaggagcagttgcgtgaagcgcttcccaaaaaccttatttccgccttctcccagcggaggacatcgaagctctcccgatcgccgatgcacgccagtaagcgggatggagtagactacgagcgacagcgcgacacataggatgaggacgtcgaagctctcccgattgccggtgcacgccagcgagctggatggagtagactacaagaaacggcgcagtgcagaggaggaggcaaaccgccttctcccaatcgacggcgtagtacagaggaggcaaaccgccttctcccggtgcaggacgttattaagctggatggagtagactacgagcgacgacacagtatagaggaggaggccaaccgccttctcccggtgtaggacgttattatagagaggcctgctctcccgatcgccggtgcatgccggcgagctggatggagtagactacgagcgacgacgtagtacagaggaggaggcaaactgccttgagtgacgatgcagaggaggaggcaaaccgtcttctcccggtgcaggacgttattatagagaggagacctgctctcccgatcgccggtgcacgccggcgagctggatggagtagactacgagcgacggcgcagtacagaggaggaggcaaaccaccttctcccggtgcagcacgttattatagagatatcaggacagtgcagcacgttattatagagatatcaggacgccaaccggactccacgacggcgcagaggcaaaccgccttctcccggtgcaggacgttattatagagaggagacctgctctcctgatcgccggtacacactggcgagctggatggagtagactacgagcgacgacgcagtacagaggaggaggcaaaccaccttctcccgctgcagcatgttattatagagatatcaggacgccaaccgaactccacgacggcgcagaggaggaggcaaactgccttctcccggtgcagcacgttgttatagagatatcaggacgcctgagggatggcgcagaggagggtgcagtattatagagatatcaggacaccaaccgggcaatggtttcacgtcgtgcgcgcgccgccatgccatgccaggtgagcgagcgtgcgtgttccccctcttctctccacctcacacgcttcaagtgagtaggagggcatcatccccctttaaggaggtccccctctgctagaataagcaaatgtggtaactcccccatgcatgacatctaataaaggtggccttttgtgatttttcaaagatttaatttttgagtaggctaaaggccatctattaattcctacaggtacgcgacgggggaggccggttttggggagctggacgtgggtgaaaccagcgtcggcatggtggagcagcagtgcagcagtagccccgtcatgtacgcgctggtgcagtgcacgcctgacctcttgccggccgactgccggagctgcctggccggcatcgcctcgcagatgcccaggtggttcagtagcaacaccagttaccgcctcggcgggaggattctcggtgtccggtgcaacctgaggtacgaggtcgatcgcttcttcctagaaagcaacgagaccatcaagattcatatgccaaaaccgaaaggtactactacgcgcgtacgcgcgcccgccctttctatgcttgtctaatggcctctttttttttaaaaaaaaaactgccacaagtttttttttaatctaacttatagtataattgtaatataatttcactgtacctataatataatataatataacttgcatataagtattaaaataatatatttaactttatatctaacttatatagagattacaatgtggttacagtacaataacaacattttaattacaatgtaactatagtgtaattacattgtagttacactacaactataatatatatatatagttacatttgaaagtttttttaccaaaaatacttgcgacaattttttagcaattcttttttttaaacgcagtacaaacacataagctcgatcataacacgcgcataatcactcctataaacacacccatatgcaataacggagccaaaaaattctcaaatgtagggctcaatctatccatttattctatactaaaagtccattaaatttactacaaacactcataaatcactatgtgacgctcttacaaacggtcctacgccgccacgagacgctctaataaattagagaaaaccttataaatttcgagaaaaaaaaagaaaacccttgatttttatttaaatgaatgaacccattattttaaagcattagattacatttattaaaaaaatgcatcccacctaacctctccggaataaaaaaaaatcccatgtgatagtatgtataaatacgtaactacttactactcacggaaaaaacaacaaaaaaaatacgtgattacgattgaaaaaaagaagtattagtcctttcacctaattgctacgagagaaacatattcatacgcacttcaacaaaaaaaaaaactgaaaaagaatctcacgtgtacatataaatatgtactactattcacctaattgagaaaaaaacaaaaaaaaaatctcccgtgcacgtaaatagtacacaccgtcctaccctcctcaaatctttatacgtacaagaaaacatccaccgtataaaagtataaacttatctaaattagttgtatataggaaaagtattacaactacatttatattaactatcttataattatactgtctttctctcttttttaataattaatagtggtaactatactaatttatgaaccttggcactcctctttcccgtagaaaatttatagatatattaattatattttgattaaacaaatatcacatgaaaccaaattgtatcctcttcatgttattctcatccaaatagtcttataagtagtaaaaaaaaagtaaatttgacaacataggttattctatcattcgttaccccacaaacatttataactaatataactaatacaagagaaatatcacaacatgtattagctcatatgtgtctgaaggattagtgctcgagcaaatacttttttcacgtggttctcgccactaagtctgcagtattagattttttaagtggtagattgtaattaatacaagtaatgtgataatgtgattgaataaagtgccaaatttcccttaaaatcatatcaactgctatgttttgatttagaaaatactagtatgtttagtatcttattctagccctttaatttatatgttgtccaaatagctataaacaagttgtagattatgcaatcatacatatatttcctcagagatatacatgactgagttataataattgaatagtaatagtccatgctaacaaatatttcgaaacgaggttgtatttgacgacatatatcattccatcacatatatttccccacaaaatccatgaacatagctaagttagatctatagcatacagaagaaatatcaatacccacatcgactcatttgttcctgagagattgttggttgagcgaatattgttccacatagttctcggtaccatctaggctgattgattatttaggcaaattattggggatgactcccggtcgggcgcccgatcgggaaggggtaaaatcgggcgctgacgtcagcgttcgatttacgtgcaaaattattttaaactgatttatctcttaaattatttatccaaatcatgatctgattgcaccattaaattcgttgcaattaaatcttcaaaacaagaccacacatggatatattctgacaaaaattttttttagcttattattgacttatttttaaatgttgcatgatgttccaccagatatatcggaattgtttcactaagtagataaaaaatgtttcactcgtttaaatcgggtgttgtttcaccttatataaaaacaatgtttcagcaaatagcgaaagaatgtttcagttcactgcaacattagatctatacatatacatagtgaaacattgtgagtacactagatgaaacatttttcggtagaagaaaaaataaaccaaattcctttaatagaggtttccaaaatatgtaggtttttttgttgcaatggaatgtttcgttcatagcaacattagatctatatatagtgaaacattgtgagtacaataggtgaaacattttgggtggaacaaaaaatgaaccaaattctcttaatagagagtttccaaaatatgtgggttttttgttgtaaaagagtattttaattcactgcaacattagatctataaatagtgaaacattataaatacactaggtgaaacatcttttatagaaaaaaggggagcagaagtgggtaggcccaagtaagcacgtgggggagggggcgcggggggagcgcccgatccggctccccctgcgccgggcgaccggcaaagagcatttccgaaattattgggcaatatggttgaataaatttaagtaccgtccgtacacttttaactcttttactcttttaattagacttttctttatttgggccgttggggtctattaggctcatccacgctaatgaattaatggcttattttcattccgttaatgatcaagtagtttaaaccaatatgaggccttcatccaggtgaccctatgtccccttcttcgttgacaaaccttatggtattatattcatcctttgagttcttcaatttgtgatctacatataaaaactacaatttgtaagagctaaaagggtgaaaacacgtctcaaaaaaatgtttcaatgtacatggatgaatataacatactatataaatatataaatgtaggatcgaaacacaagaactaagccaaccagaggagggtgaatggtaggtatacccaaaaaccgaaaacttttagcggaaataaaagttaccctcaaattcgacggatcgtggtctaaccgaagttgtcctgtcagtctgatcgcctggttgccatcggtttgaccgagattagatctccggtctgaccgccgagatcagctgccgctcgctgtcgccgccgccagtctgaccgcccgtatgccgccggtctgaccgccagtgagtcgtcggttagaccgctgaaacccggtgaaacacaaatcgaagaactcttaaagtagatgacaactttattgattctctctgtgtttacaaagtgcaacaacagcactccttacaaaatctcgactaaactcgaaaccctaactaaactagcaactcaattgctcttaaaagcgataccaggaagcctcacgctccccctctatttatacatgaggtaggcagcctaaagccacgaaccaaactcatactagaagtcctaatccccataggaaaccctctagtacaagaaacaaactttatataaccaatcataccaaatttggactccttccaaattcgactccacatcccatacgcacacaatacctccatcgtatgccatatggaatcttcaccaaccacgtgcatcaactctagcctaagtatcccgcatgatatctgaccaccacggacatcgtcttaccaccaagccgattcccggtccatcaccgcaaatactctctcgaggcatcgagtcacctacacatgaaacaaacaaagaaaccatattccgagaccaagctatccccaacttgactcattgttagcaaacaacagtattacatacgtatagtatccatctagaagccataaccatgaaacaatcacggatatccaaagaaacaacccgaaaccgaaaccgacacagtgtcggccggtcagaccgcgggccggcctgtctgaccgctcaacacaagccggtctgaccagcaaccgcggcctggtctgaccggtcccgacaaaacaacaaaccctgttcaaattatatccaaaatcactttgacagtattctccaaatatcaaaaccaataatcacagatgccaattgttcatcacagaataagaaccaaaacacacattgatcttacaataaattacttcccccattttatattataggtcattttgactattattctagtcaaatttctttagatttgaacaaatttatagaaaaattaatagaaaaacatttacaacaaataatatatttgttttgtagtgaaaatattactatatttattttataaaactgggaaaacttgactgggaaaaaagttaaaattgcttgtaatataaaatagagagggtgattaatttgcacctacatgctataattctatcacattgcttgcatttgcaggttcattgagcgcagggaagatcgtcggaatcgtccttggagtagtagccttcgttattctaattttctccttgattatacttgcattgctcaaaagactaagagaaggtgtgattaagttgttgcgatggccttaattataataccgatctaattcttaagcaggttctgattttttacgtttaattaatatttccctgtgatttcgacctgtacatgtagtaattcaagagtcagaacggcaaaagaaactagcaaaacttgagactgagatcatagacgagattggaccgctcttttcacgctatactttacaacagataaaagaagctacacgtgatttctcaaatgaaatcggaaaaggaggttttggccatgtttacaaggtaatttgattagatgtaacgacatgtcttatctataaacatccaattgacctattatatactcccttttctgaatcttttgcagtaaatagctagcactgatccctccattcgacaatatgttcttttttacccgaatccactcaacaatatttgacattgggtggcattaagtttatttagtactcccagcatcaaatattgtcataatatcataaacttaccatattttatatacttactgtatataacttgtgaacaaagttgtataatttgaaggtgtgaaaagaattatgttaaattaatgttatatatttatatgacagcagggagtacaaattatcatgtggtcaaatgctaaactgtccggatatagtctcatctatactcttcttaggctgtgtttagtttctgaaattggggagaagtttgtggaaagttggtagtttgaaaaaaaaagttgagaatttatgtgtgtaggaaagttttggatatgatgtgatgtgatggaaagttgggagttaggggaaagtttggtgtgaactaaacacacccttaaaataaggcaatggtggtggcctcaccaagtatagtatttttttatttaccatctacccatcatgctttctactagctacccatgtacttttatgttataaaataacacatctacatatatatgattctatcatatttcacctgtacaatataacatctataggtacaaaattgtccaaaaaacctcactattaatttgttttaatccgtagtaaagcacgggcatttggctagcatgggtaaatagaatacgcttacgacgcagatgactagtaactgtgctaatcgcaaggatctgattattattgtttagacttaaatttggactgatgtactaaatttatgtgttttgccatcatatatttttagggtaaactaccaagcggaactgatgtagcagtaaaaagactcgcggtatcttcatctggccaaggttttgaccaatttatgaacgagattaaacttatggcaactcttcaacacaggaacctagttaggcttctaggtttctgcatccaaaacgaagaaaacatactcatctatgagtacatggagaacggaagcttggatgatgtgttttctggtatatatatcccaagttcccaacccttatattacgaaaagaaaaatccttataagatcatgtg

SEQ ID NO: 47569 - DNA, 1650 bp, Oryza sativa
ttagcgctctcgagaactttttcaggttaagcaccccagccctctataagctattggtatacaagttcttgttcagttgactttacatttttcgctcatgatgttatcagctcttgtccagaggaaccgtttgtttgccaagcacttcttttgagagaattgtttgagcccgaaatgctttgtttgagagagtttatcgttgggttataggacaattacccactatcaattgtttatacacactacctcttttgagtatttttcttgtttccaaaaacaaaattggtgctatgtatgcagttttttatgagctaaaagattcccttcgaatcatgtatatatcacatctggtatgatgagacatatatatatatatatagtagaaggatataatttctataggaccataatgggacatcacttataacatgttaagaaaccacagactacgtactaatggaccgctccgttttccatgcacatgagatgggttcccaacccatagaaacaaacacagccgaaatttgtgtggaacctagcttttttcagaaaaaaaatgaacgcacgagatatagtgcaaagtttcataattaatataacaaaaaaaacaagattacaactttgggatattagaactgggaagaaaaaaacaaagcaaacgcatcaccgtcgtacattgacacctcctcacataacccagcagaaggcgctagtgccaagccgtccaccggtatacctatagaaggttcgaagatgcccctcctctcccccctcctccccagacactgactccacgcaaaagatcatcgacgagttttcagttatcctctcgtagaagggctaaggagagcgagagggcgagagagaaggagatccactcgtccctcgcgccaatctgatgatgacaaccaagaaccaccggtgaccaaaccgagagaaggcgataaaggcagggacaagacctcaaggcaaggttatgacactttaggtgctactgtcgcccgtccatctagactaggttttcacctagatagtcctaccagggagacgaagggtggccgctcaataatgccccaagaggggcgagggggagggggttgttatggtgtcttatgacatcgtcgttgctgactcaagaaaacccaagctaggctttcaccaacagcgccctctcaacctgtcattgccactctaaagttcagccacccaaacaactctaccaactcgcagctccactgccgaccaccctagacccgcctttgtcaggtcttttgtgccgccaacgctgcctcccgtagcccatgccaccgtcacccacaccggccaccatctcagtcagcaacctcctcctttcatatcaacctcaccagcacccatcacttgccgttgccgccatgccgtgaactccttgctatccgcgattgctgtcctttcactaccattgctccgctactccagccaaatccggcacgggggcaccgaatccagttgcaggggaggtggggttgaatatttggccacaacggcgctggttccaccgccgtgcaccgcgtgtccatcaccagcagctcccgccgcatcacctccacgggtgcacctcgccgacttgttcgtcgcgtcgtctctaccggtcgccttgctacctcgatt

SEQ ID NO: 47570 - DNA, 6438 bp, Oryza sativa
agttttagacttggtacggatgctcgtatttaaggccaatttattgtgtttctcaaaaggaaaataatttagtctcgttggtacgcacgatagaaaaaacacacaagaacagaaaaaacgcaagaatgaaagtagtatgtgttttttttttcaattctacagggatcataaacatagagaagttgaagagcagcctttgattgaaaccaagataaaaaaaaattgaacaaacaaagttcccaaagagatatgatctcttgcttcttttttacatggaattggaccataggaatacaatcacatgaatatttcctaccttttcttaagaaccaaaggagcatataggaaaaacaatccttagaaaattaaatctcaaaaaatactttgccaatcctccatttcaaagggcccttgaagtttttcctctacaaagaaagtcaacaaagatatatttgggagcctatttggtcacagtcatcaatagtaggcttcaggacttttgaaaacgataaattctagtactgaacagcatcttacgcacgcagatacctggaattggggcgcaggattggaatttcagaaatatcatgcaatcatgctctaatgatcaaatgcaactagaacaagttaatacttgaaaatcctcatgatattcaagtatatcttgatatcccccctttggaaaagtcaaatacagctcaacatcatctcctcgctgcagtgtttctattcaagaagtaaaagggtcaactactgaaaaagaaagcaaggaaaaggtaagaaacttgcaaacttggcgtccatttctcctgcgcgtccaagattttcagctggcacaatagaaattgacctgcaagaattggccttttctcctttttgttatatgagttcattcataatttctcatcttgaacttcagtgcaacccattgtgttagtttgagactaaaatttatattcacgcaaagatgctgaaaatttgttgtgttagtattggcgaactggcgctctcattcatacagcatcatggcatattggcatgcatagtttgaacacaatatttacttcacagacgaatctgagcaaaataatctctttaatttcaaaaaaatccagtcacattctgtacttgaaagtttgcgaatccaggctatacagctcgttgtttacaccgtgccctggattcacctcaggtcaaagaggatgaacatactaaagaatggcagcacacttatgaacaaacaaaacaaacgacaaaaatggtgtcatctctgatctaagctacaactaactaaaaatttttgctgttatagcttccataacagcagtattgatatcatgagaccgctgcatgaacaatgccatggcatgatcacttgattcacttcccaagctttgggagtgtgagagacactgacggtgtctgaaaccccatgaactgatcccttggtgacctcctgatctccgggctcgggatcgggagcttgcaaccggtaggcgtcgggagacccatgtagtgcagcctaggtgacagcctgatcttcgggcttggccgaggagacggtatcggcagcctgtttgtagtaggagagggcaccactcttggtgaaagattgacatgctcaagagccatgctctgtagatcagccgggtagtcccggacacagccaatgcgagcaccattcgcggttgcccatttgaaggatgggcggctggccatgatcggtgccaccttggtgtcctcgctgttttcgacaaccgcttccttcactatgtctacctcaggcagctcaatttgtgagctgtccatgatctcatcatgtgtgggttcagtaggcttctcagcttcctctggtttctcctctgtcttcttgaatgacgggaattcatcgtcatcgaccgaacatctctgcaaaatcgcattggaaatgtttcatcagatatcatccctgaagaccttttgttttgagacaagcaaaagttgtttggtgctgaatttaccttgacatcggcaagatcaacactgttctcctccaagaagctgatgaactctctgaagttctcttctgttgggaggtagtgaccgctgtatggccatatcgcctgaagaacaccatctttggcaaccaatcttccagcagccgttgtagctgccccagctaggaaacttgagtgctgaaatttacccttcttcttctgcacagaggattaaattaaacacagttagaatcgattcatcgtaacacaagaatgcgctatgcagaacccgcaaaataaaacaaaacggatactacattccaattattacctgtccaacatacaatgatcttgttgtgctcaacacaaatatccacttggaatcttcagtggtgttcacaagaactccactcttcctgtacatcagcttcccaccctccacaacaacttcaaaagcttccctctcgttctgaaacagaaacaatatattcagatttgtcaggcaactgcaaaaggtttcagattcggagatcttcagagaaggaaaaggatgctgaaggcacgtactggtccaaggtacatgatcagctgtgaataaagcttgcttctcgggcacttttggtgatgcatgtctctcccagctcctacatccagcctgaaaaacccaaagaaaacaacattaacctctgactacaaccaatgtgaacctttgtcagatgaactgaacattagtttcagatgtctactactcctaactacttaccagtaaaagaatggctcagtgctcgagctcgcagaccagatgtcgtagtacagatgcaagttgtggccgtagcggtggcgcgggtcgatctgaagtagccgcaaaaaagattttgagcagattagtgatgagttcttcatgatttcaaacaagagcaaagaggtgagatcgataattccaggaagaggggcttacagcttcgagccagtgctggagcgcgagcttctgggctttctcgttcttggagaggcccttgccgaccttggcgatgcgcttgccggccctggaccagcgggacgccgcggtctcctgcttggcctcgtcgaagaaggagatggacttgatgtttaggcaggcggagtcgtaggccttccaccacagctcctccacgacaatggcgcagtcggcgaggttccgccgggtgcggtgccccttgaacagcttctgcaccttggtcgccgcctggtccagctccgaccgcggcttcggcgagatgaactcgatcagcgcggcctgcgccggcgacgtcgcggcgtcgccctgcttggctttggggctctgctgcagcagcaggatccccggccgcgcgccgttgatgcaccggctggccgcctcatcgtgcggcggcggagcggcgacggcggcctcctcggcggcagtgggctcccagttcttgaagctgagagacctctcgaggacgccggcgccggtggccatgggcttggaggaggaggggagcttcctgcaggcgaggagcctggtggaggagggcgacctcaccggcggcgagcaggcatccctggggctgtgtggcttcggggaggagaggaggaagcttctctctgtgttgagtggccgcagagtcatcggcttctccttgaagaagacgaagacgacgtctacttgttgttcccttcccaactgctctgcaaaatcatggaccaaaaataagataagctttggaagttggaacgaaatccatctcagaatcagatttgtactggcagatagcaaccatttggttgaactgactagatatcaatatatatataaaaaccgatttttattcatggggagtcaacaggtagacggtagaccattggtggcctatcccaagaaaacattttgttttccttgaaacaattatcgagaggaagtaaaaacggcaggcctaatttgaaccttgatgcagagagttgaagaagaagaagaagaagaagaagaagaagaagaagaagaaagaagaagggagcaacgagctactgctgtactagtgcataccggctgagctcggcggcggcgatgaatagaggaagatgatgaaggagaaggcggtgagcttgttgggtgaggaatggagctgggcagttggtgattgggaggcactgtggttggctcgcccatatataggaggaggaaggatagatggatggatggatggatggatggatggatggatcactcggttgttgtgcggcgactaccagtgatgactgactgcatcagcgtaggagcaggggcgagggagagcacaagtccaaaatggggaggcaagagtggggaaggaaggagacggactgaccggtcgtcgctcgcgcgcgcggaggggagcttgacgagacgatgcttccttccgcgtatacgtcgacgcggctggctggccatgcctatgcctatgcctcggttttcctgtctcgctctcgcgcggtttcgtttgtacccttccggcgaggtgacgactgacgactaaaattttcctttcacgagttttcttttcttttcgcctcttcttttctttctctttttttttttgtttaaaggagaattgaattgcaattcggtccttctcgtgtcaccattaatcaattattactattacgcaacagactcactgggcgagctagtacagctagggggtgcccaggaacccattaaaaatttttttacctataatttatctattttcaccatatatacaccccatcagtataaatttaggcatccgtatcaagctaaatttgattcaaaccagagtaaaacaaacgagtggaaccctcctttattttattctagctccgccccagttttaacaaatctcttcgttcttcttctgtcgctaaatgtagttgtgtttatattcatagaaaatgtaactatatttaaaactgaggattgtatagtaccttagtaaaagggtttttgaaaatattaattatatactttgaacaagccgatctcaagcgagcttcactgttggctcgagctcaacaaaaactcgagcaatctcaaacggagcatgcgtaacctctgagctttcacgcgtgttcggctcgagcttgattattgagctggccttgtaagttgtaatcagtgtaacacaagaacaaggataaggacatctcttgcaaaaactggataatctcattgacaaaagagaagaacaagaataacatgctaaaacaaaggatgatgtcaacacatgttaatttatcatgtggatacatataaatgacatatttcatccactaattaattaaataaaaatttatatgtattctggcttgtttggagctcaagctgccgtgagcctcaagctcttttttacaccctagtagtattatgtaactctatttgtccagtagctactagcaccatatacacttctcattaaaagagagagagagagagagagagagagagacagtcctaactatgaaagctaggatttgatttttattttttgacgaagagagcgttttggaatatactacgtgtaaagagggtcagtatgcaataagggtatctaagcagggtcctgagtgaaacaaatgctctttctttaattagatatatccgtactaaaggacaggaaggcagggacaattggagcagacagggacaaataaacgattcatttgcctttactaaacgcggtagaattttctatagttactcctacctcttgttttctaccgcctgatgtgcttgctgctgccgctgactcccttcttccacttgtggtagatggcttctggtaaacgagttgatactactactactgctgcggctgcatggaaaagctctaatactgtttgctggggctcagtaattccaaactgtacttgggtgtgtttaattcatgttaaaattggaagtttggttgaaattgaaacgatgttataaaaaaattagaagtttatgtgtgtaggaaagttttgatgcgatgaaaaagttgaaagtttgaagaaaaagtttgtaactaaacaaggccgaagtgccttgtaaattcaggattttgcttttcatgcgcttttttaaaattcctgtggtaggttttggtttttaaggttcaatgggaaaattgttttgcttggatttattttcgtaaaagctttcaaattcaagataagccatacatgcaaggacttgtggaacgaaacgaaaacaatggcacctattagttgtaatcattatacactagatgtgtcttttgatttcacaaattgttggtcaaaatccacaaaaattgactcttttaaaattgaaaatacactctataaaaatctaatgcaatgaacaacactagatataatgggctcaaaattcatttgtcaaccaagcaaactcaaaagctcaacaaaaagtcccaagtgctctttgtactaccaaaatccacattcactaaaaaaaatatgtata

SEQ ID NO: 47571 - DNA, 1132 bp, Oryza sativa
ccagcctgataaatcattgcaaataagcaattaacccatcagtattagataacaaatataggaacttttaacaaaacatacggtatttgatgatatagcttgataaggcagacttgtttatttgaatcacaaaaatgttaataattgtaaaaaccaaaaagtggagacaaatgaagcagaaacaaacctctcgaagggcaaatgaagcatggcaacaacaataatcaaactcaataccctggcctatccgattgggcccgccacccaaaatcaacacctttttcttattagttggaacagactcacattcatactcatacgaggaatacatgtaaggtgtattggcttcaaactcagccgcacaagtatcaacccgcttgtatgttggagcaacttctagtgccaggcgccttaatctcacatcagtttctgaagaagatgtcgcaaaggcaatctgcgtgtcactaaaacccctccgcttcacttgatagaagtcatcttttgacagctgatctaggccccttgaaataaggaattgctcaacatccactagctccttgagctcagtaaggaaccatttatcaataaagctaatttcatggatatcctgaatcctcatgcctttcttaaaagctgcataaatagcatgaatccgatctgggttaggtacccgtaaactatattttaacttttcccagtcccagtcaagttccttgatgggtgcacaaccccatcctgcaaagccagtctccaatgaacggacagccttctggaaagactcctggaaggtccgtcctagagccatggcctcaccaacagacttcatctgtgtggttaatactggctcagacccagggaacttttcaaatgcaaaccgtggaatctgcatcgtaaatatatggtaagtcaggaaagaaggttaacagccctgcattaacttacaggtacaaattctgtatgatgaacaatgtgaagaacatgtctgagtcatcaactttgagtttgtactataaccaacaaacatgcaggtttagcaccattattgctatacgggcatgggtagttttgtgggtacacattggcccatctatatcaactaaaatgcagtttttctagttcatgttgggtattt

SEQ ID NO: 47572 - DNA, 1553 bp, Oryza sativa
atctgtgtccatccctaagcatcattgcgagtaattgcatcattatttgctggtagagcatattccaatttgtggatgtttaaatgcattaaagtagttgattactatgctgtgaagtttggacagcaggatagtatttctgagaaggtaggtatcacatcttacatgtacagaatatgcacttcatataaattctcaatttttgcattacagactggatacccaagggaggttggaagtactactggaacaattatcattgtataagcagcgctccaagatatgtggataatgtagctcaattgattgtgatattttggatctttatttgactaatatttagcaaagttttacagttgcatgggtaagatgataacaaagcaattgggagcacaccatgcaaaatggataaaagcatataccaaaacaaagctagtcagtactgagttaaataaacactactaggttagtgacaggtaaatgctagcacagtaatgcacagtttctttgacctaccaaactattaaatacaaagatggaatgaagcacatcaggagtaattgaagttatcattttaagtgatacaagtgtgcttgcaaaatcaataaccacccattgccaagcaaagggaaaggcctgccaggccgaattagtttggtactgtggtcatgtccgcattgcagaccctaactattgcaagcatttttagcacaactaaaggcaagatagcttctaaaataaggatgaaaaatgcaacaattgcacagtgcaccaaatatcattgcccaagaaatcttagaaacagagggaaaaagcaaaccttagtgaccacgtagtcaatggaaggctcaaagctagcaggagtcttcttcgtaatatcatttggaatctggtccaaagtataacctacagagagctttgcagccatcttggcaatcggaaaccctgtcgcctttgatgcaagagctgatgacctcgacaccctggggttcatctcaatcaccatcacctccccatcggcagggttcaccgcgaactgcacattggaacccccacactccacgccaatctcccggatgatcgccacggagtagtccctgagcctctggtactccttgtcggtgagcgtctgcgcgggcgcgaccgtgatggaatcccccgtatgcacgcccattggatcaatattctcaattgaacaaatgatgaccacattgtcagccatatcgcgcatcacctccagctcgtactccttccacccgagcagcgacttctccacaagcacctgctgcgtgtgcgacgccgccagcccggcacggcaaatgtcctcgaactcggcccgattgtacgcgatgcctcccccggtgccaccaagcgtgaaggccgggcgaacaatgagcgggaactccccgatgtcctcggcgatggagatgcactcctcgagcgtggtgccgatgccggagggcggcgtcttgaggccgatgcggtccatggcctgcttgaagagctggcggtcctctgcggcgcggatggccgggagggaggcgccgatgagg

SEQ ID NO: 47573 - DNA, 8235 bp, Oryza sativa
gggacggggaggggcggagctgggtcggggcggaggagagggaggtggccatagcggcggcggcggcggcggcggcggcggcgggtgaggaggaggagtggggcggaggcgtggtgggtggtggggaggtagggttttttgtggagatgagagtgggggggtacccgtgttaagggtttaacccttctactaatttaatttttttattgtgagctttgcttacttaaaattggacacctatacggtttctggtgtccacgtttcatgttcgaattataaacgcgctcaaacttaacgttctccctccgttttataattttcgtttcatattataattcgttttaatcttttatttcgttataaattcttttagtttaactaaacttataaaaaatatagtactccctccatcccataatataagtgattttgagcttttgcttacactgtttgaccactcgtcttattcaaaaaatttgtgcaaatataaaaaacgaaaagttgtggataaagtactttggataataaagtaagtcaaaaaataaataaataataattctaaaattttttgaataagacaaatggtcaaaaagtgcaagcaaaaactcaaaatctcttatattatgatatggagggagtaatattttcaacgcaatataagcatattatagtaatatattaaaagttagttttaataaaacaaatttggtgatgtaaatattactattatttttataaatttgattaaacttttaaaaaattaaaacgacttataatatgaaacggagagagtaggagcatacttctatcatatttgttttcgatgtctgaaatttaattactgaaaccgccttttgtcgtgaccttttcttttattttgggaaatttgatcccggagacacaaactggctgtctaatttgacttcgatacggatttgcagggtgtaaatcagtgatttaataatagcccggaacgtaatttgggatgtaacctaggtgtaacagtatataagaggataatgtgtttttttagaacagataatgtgtgttcacatcatcggcttaaaccataggaagaagaagagagggaaaaagaaaaggatgcggacaagttaaaaacgaacagaacagacaaaacttttgtgttttatgttccctgtaatagcatagaactagatagatgatgactagactgagaatatcttttttatacgatgctaatagcatcgcctcaatgggctgataatcagtttcattgtcatgctatcggggtgatgcagggtgtaattaacgtaaatcatttaatatcacctggttattgcgtcactgcttgcttggtgccccatcagtggcagagccagagacgccatcaagcccaaacgattaataacatttttggataatcgattaatttatataggtattaacagctatcgataatagagacggtagctaacaaaatccgggtagtcgtccgagttgttcgagaggtgccctccatagattaatttcctgtttagcttggttttttttttctctgctcttggttcagatatctcaacataagaggcacagtgaaccaaacaacagggcagaactaaagcaaattcagtcacactcgagtgcaggataaaagttcaggtacaatctctctgataacacagttctactcctacgattgatatacaaatttaatctatctaacaatgataaagcataaggatgtgaataatctcagtactaatgccggttttttgtgtccatatagatacacttaataattgcatgaggtcgatgtttctgatgacgatgagtcacgatttgtggatggttttggtttaaagaaaaaaatgagcacgcgattggcgccaatcaacggtggacccggcgagagctcatgccataaagcaaagcttgacggcccagataagatggccgctggtccctcttatggataagccaaaacaatgtatgcaaggggcaacttggacctaatcgtgatatttcgtagagaaaaacttggctctaataatgtcacactccaattaccgagcaaacaagccaatcaggagttgacagaaatgcaaggcctacctttgctcatgacccaattgacaagagagaagagtcccctacttttgtcttgccctgtggtatttaatactccttctattttaaattatttatcgtcctatgtctttaaagtcaaatatatttatatctgactgcaatttagagatccatataatatagcattacaagatttatatttttagattctctatgagaaatatttgcatgttgttgaactatacggatctctcgaaattgattgtcaaagttataaacgtttaacttatgacaaagctaaaacgataaataatttgtgaaggagaaagtattgaatctttaagtggataggctcaccacgacatgaatatggtgttgtctattgagacgaacaagttggatcacaacgtggttggtgggatgagaagggaaaggatatgggttgaagggagagatcgatgcaacgggagagatgcctcatacccgcactcccctcctccaaccttgctgccacgtcctctcttcccctcctagcccagcgccgtgttgagggcggctaccgggttgatggcggcgtcgacggtgttggggttggtagttgggttaattgtggcgtcgatggcgtttgtgtcctagtcgagggcatctccgtcggctgggttgatggcggcgttggcggcggctagtgggtggaggaggagaggtgagagcgttgggtgtaagcggcgaggtggtggctgcctcacctctcttggttagtatacattggacacactttacactgacatgtggggccagtgtgctgactcaaccagtcaacagagtcaaagatgcaatgctggacgaaaccgcctcctaaaccgcccaaggagtcgatttggaacggttttgtgagttggaggatgagatatacccaattttgcggttgaagtatgcgattcaaccatgcgcatgagttgaggaaggtaatgtagagttattctgaaacatttctcatcggaaataagttcactttgtgaccctcaaaagtgattgaaatctaatccgtgaccctaaaccacaaaactggatatcttgacctccaactcttaaaaccggtacaatctgactctcttgatggttttggagggcggtttcgctaacatggcgcctacatgatgatgttgactcagttttcggtccatgtggagttgacgtggtgtttgtgttctagaattaaagaaatatgtgctgggcccatttgtcattcgcactaaaataatgtgggacccactgacatgtatggcccacatgtcattcctgtttccttcttcctcttcctttttctccattctctctctttctctttctcccatttctcttcgtcttgtctgcagggagaaaatcggcggcgggcgctcgagggtccaagaggccgcggtggcgagcgggaagggaggcggtggctcggcggcagcagcggcgtgtgacccactgggagaatttctgcattccacaaccaaattccaatgagaaaccaattatggcacaagatatggattaccaatgaaagctacttaaggagattgagcatcgcgtcgttgattctaagtacctcgagtccaagaatatggaaatcaactcttccaggctcaccggcgacgcccgccatgaatcaacctgcgaacacgcgaaatcttctcatttcacggcgtgccgaaaatggcaaggcgcagcacgagccatagcgccgtaactcgagcttggcctcagactggagcgtcgtgagcgcgcatgggaagctactggactcgaggaatgcggcgaccgcggccaccacagtgggcctcgtcgtcgcgtcggggacggcggcagcggcgagcccttggaggacgaattggtcatgctcttctccttcctcgagtccttcatggctccctcttccgtctacgccgctgctgccgccgagccgccgccgggttgctgcctcccctcccgctcgccgccgcggccgcttggaccctcgagcgcccgccgctgcctgcagacgaagacgaagagagatgggagagagagagaagggagaggaagggaggaggaagaggaagaaggaaacgggaatgacatgtgggcccacatgtcagtgggtcccacattatattggtgtgaatgacaaatgggtcctgcacatatttttttaaattctagaacacataagcgtcacgttaactccatgtggaccgaagactgagtcaacatcgccacgtaggcgccatgtcagtgaaaccgtcctccaaaaccgccgagagagtcaaattgtaccggttttaagagttggggggtcaatatatccggttttgtggtttagggccacggattagattttgatcacttgtgagggtcacaaagtgaacttattccttctcttcgtgttgttataaatttggtccaaccctcactgggctggtcaggggcttggcccaaatctgggtccccgcggcaatcactgcaacctcaaggatttgacaactacttggaagttggaacttggaagaccagtcgcgcgtgggtacggttgggctcttgccacgtcctgccacacactgccgccccggtcctatcgatcgaagcgcgcgcgcgttccaaactgcgacatagggtagtacgcatgccgcgagcgatcgagcggttgcagcatgaattgggcaaaccaacccatgcacgcacgtagccacgtactccaacgtgcgcctccgtcgatcgccacctttcccggatcaagtacgagcccacgcacgaacgcacgcacaccactaggacagtccactcccactgcccttctccccctatatcgatcgcgcgccaagccgcccccgcccatgaacgcacgcgcagacacacctgcggcgctctctctctctctctctctctctctctctcgataccaatgatggcgacgacgacggtaacgcaccctgccgccgccgccgcgctcaaccacgagcgccacctcctccgccggctcgccgtctcttctcccacgatcctccacgccgcgtgggtcacggccctcgtcgccgtctgcctcgcgctctgcatcacccactcccgcaagccgctgccctcctcctcgtcgtcgtccaaggctgccaggcgcgagcgcggcgcctcgtcctcgacacggcgccgttccgcgccaggggatgagggcagcagtggcggcgtgggaggctcctccgccaaggccgccgccaccgccgccgccgccgccgccgccactgccacgacggcagccgaggtgtccccgacgccgagcgacgtcgctgccaaggccaacggccgtgtcggcgagactcaggcggcggcggcggcggcggagggagcggctgtccccgtcacggtcatcgacgtcgggacgcacggcccgatcgcgccggcgttcccggcgcccgacccgctcccgccgcggcggagcctgtcggcgaagcacatgcgcctcgcggagcggctcgggtcgcggatatggtcgacgcggtgggggcgggacgaccacgatgacgatgacgacgaggacgcaggcggtgacccggccgccgccgccgacgagggaggcaccacgctgtggacgaagacgatcatcctcggcgagcgttgccgcgtcggggacgacgaggacgaggacggcggcggcggcgcggtggtccggtggaggagctaccggccgaggcagccgcggtcgctgccgatgacgcggagcaactcgttcgccggcgtgggtagccgtagcctgcagctgcaaggcggcggcggcgcatccaggccaccacctgccgccgacgtgcccttccatctaggtcggacagctagccttcctgccaaggatgaactgtgacgtcgtctcacgaagtcacgaggctagactgctatagagttctcaaattaatgttcttccattttgatttcttttatatgtgacaccaccatgtttcagtgaaaatgtatgcagtatgcgtagttgaaaactttggcacagttgaaaaggtagaacttctattttattttctaaatcctataagtacataatctaagcgagaatctagattatcctttcttaataagcttcgtgcatctttataaatcttactagattatttagagtaggtggggattctggataaaagctaccaaaaatttgaaaaaataaccattttagaaaacttatatgaagattgaatcgtggtaaaaaactaatttcataaatgaatcttttgtccaagcgctaatcccgataacactgagctaagcctataacatctcagcgccattaatattggtgctgagattctattgaggtgacgaggatttgccaaatcaagcttagcttggcgctgaatccttcacaggatagaattatgtccatgcattcatttttagaaaactcagcgcgactcagcggtggaggtagccctattccggcccccctatatagctcctttgttcgttttctctcattatcccctatttcttttttctttttatctctttatccactattattttctcttttttctcctatctagtttcctttttcgttctctctttatctgtaaatttatttgttatgaatatagaaaaatatgaaagaagtatatatatggtaaatttaggaacttaaattatataatataatgtttgcattaatacttataaatcgacacccttatttttaggattttttttgttttctctcattatttgtaaatttatttgttttctaatttgaaaaaaacgaaagaagtaatttttttaaaaaaaaatatatggcgtttgtaaacttctttcattctaaattttaaaagtttgaaaaaatatactataagtcttttccatataaatattaggagagtgttctttccatgtgaatattaggatattaagagaaaaggttaaaagattaatgttttttcatacaaatataaagagggtattgggaaagtacagttcttttcatatgagagtaagagaaaataataaaaaaagaattaacagagtaaagttctttctaatttaatgagaaaaaaaataattaagagagttacgttctttcgaattttcacgggagagtaaaataaacaaaatgagaaaaagaagattgagattgaggagaaaaaataataagaaaaataactagagtggggagaaaaaataactaaaataagtagtatggcgctgagctcagatgatttggcaaattctcgccatatcgggcataatctcattgtcaatattagtggcgttaagatgttataggtcagcaccatcagggttgacgttgagcaaaatgttcatttttgcaattagtttttaccacgatttaattttcaaataaattttctgaaagtgtcattttatcaatatttcggtaaacctataagcctccaaacaagaccttttaccagctgctacacatagaagatatatgtaaaatgaggttagctattaacgtatgattaattaaatattaattattttaaatttaaaaataaattaatatgatctttaaaacaacttttatgtagatttttttttaagaaaacataccttttaagtggtttgggaagaaagtttttctcgctgctgccgaatgcacgtacatgctctccagtctccagacgcacataatattaattgggaagttttcatcttaattttcaattaaaacaaatgattgtgttcttacgtaaaatgttccaacctctccttactattcccgcacacactctttccgaactgctaaacaatatttttttaaaagaaaatcctataagaaagtggctttaaaaaatcgtaataatccagtttttaagtttacttagctcatgcttaattaattatgcctaatctatcgttctgttttttttggcaatttagtccttttagaaaacttatttcgaaactaaccctcaccaaaaaacttcaacaaaaaaataggccatggactcagcaccaatccgttggcgcaaaggtccaacgtctcagcgccaaatagtacggcgctaaaatttgccacgctagcagagttgattgtggacgtggctgtttggcgctgaccccatgtatgtaataagtagacattgtgctattctttgtcatgatttattgatagtgcagcggttgaaccacttg

SEQ ID NO: 47574 - DNA, 883 bp, Oryza sativa
atgtcccaggacttgcatctggtgtgcggctacgtgatggttcagcttcgctgctttgcagttctcggctactagaaacaacaggtcgccttaaggatccgcttgaccgacccaacattgtcgaactagagaactacaagtcaattgaggatcacatatcacatcgcaaaaagataaccaaaatatcttcaggctttgatggagcatttatcacaataacaagtcaaacctaaacaaaactaaaaaaaactcaccaaagcatcttttgaagtggacatgtctggcctaaccggggacttctgttttgataagctgccagcatttattcctgtaggtggaacctgacgtcgtgtaggatcatctgaccacccgcttcttcttccctcttcagtggctaaatcaattcaggacataaaccatatagaattaatgaatgcagatttcacaaaacatatgagctaggtcatagaaacaaaataatctttttcaaaactcgcctcatcaagtgtgccatgatttcagttacaagcaagagtaggttatgcaattatctgataggcaggaaacagaaaggaacattttttacataacttactgtttttactgttaccattttttaatcgtaatttatgttgcaccaccttttgctctaatcacctgatatatgtgttgtgatttgatgataaattgtaaagaaacaagcagctatcaccacatctcctctactattataaaaattgaagatgtttccgcggtccattatccgtgtttgagttggttttaattttatgttttggttttaatctatatctcctctactattataaaaattgtagatgtttccgcgggacgtaatccgtgtttgagtcggttataaaaattg

SEQ ID NO: 47575 - DNA, 5707 bp, Oryza sativa
ctaacctagacaccatgtctaagttattaattactactctaatacttgtacaggaacttccttctttatccagagtcctagtactagagcacttagtataaatactaaacaatgaacccgcaaagatggaaatatatcttacttaaacaaagtaattaaataacataagaaataaacacgaatgcttactttatagaagaagttctccgaacccggagcagagtgtaccgacagctctggtactcctctcaaattcctcctaggaagctacactcgtcgagggagaagtcggatgagcgccaaacttccgggcactcctccagagcttcccctcactctctaccttattctaatatacaaaagatacaatagagtctcttataattcagctcaaagttgtgtgtctcggaaatgagaaggtgacctccttatataggctccaaatgacggctaggggtatgggaaatgaacaaaacacactgcaaccgccttaggggagaaatccgagccgtccaggtgaaagcagatggcgggaagggctaggattggttcggccgaactggtgggttcggtcgaactggtgggttcggccgtacccaaaaactctcctcccggcctctccttcggccgggaggttgcttattgggtccccaacaacctgggctatgttttggcccaattctaaatggtttttattgatttattgggcctctaatccgtttaaacgtgtcctagatgtgcagagatgcattttgtcgcatgacgcatgtgttttctcctcaaattatctgcatacacatatttcaccaacactagtggaaatgattagtaataatacctaccactaagttgaataccatgttttatttcattatatgcaggtattgacggtcagatattatgatttaagaaccgtcaacagggtgatgaggacacaactagctcagatataaccatgactaccttatgtattaataaactaaaggtgaatatgttctatattagatttacttattatatatttgaacaaacgttgctacacaatgagtttcatgtgtttttgtttgcagaggtacttgcttgggcgaaagaaaagagaccgagtgtaaggaatacatggataattgaagaagttgattgggaccaaaccaataccttctccaagtcttcttttatctcaccacgtcacttttggtccatagaagacaagagataaagttctacacgttttggattcggattcgggcctcctgacagcatcaacttcaaatggacctagccgctgatctagaaggaatttcagggcccatgagtacttgttggaaagcttatggagtctactttcaaatggttttggtcccatgtcaaaattcctaccgagctgccgggaatctgcaaaacaagccacgtacctcatccagtccgaatgtgatttgggttttgggccttgtaattgtgtcatgggcttagcccatgggggtgtgcgccctagggcaaccctaggacgtccctaattatacttaatccgttgccgtcatcgtttagagttgggttttgcttagattattctattaaggacagtttcaccgctagatcggtttgtggaaccccaaattcgtgtactaaatcattcatatgcaatttggttgcaatctatgttgttcttgcttgtgttattcgattcgcatgcagggattagccttctcggcgaggtcaaccgggtttcggcacgtttgataaccagaggagacgtggtgctacgattgcggggctcagtagcatgtttgttcagaagccggatcgagttgtgtcacgactccgtccaaatcgactgtttatcattacctattggaagatcgggacctaactccctcattaacgggcttgcctacgcatgcgcttgccttctccttctcatggtcacgccggttcctccatgcccgcgccatcatggagcttccccatcatcactacttcgccgggacgggaaggttcggcttggctccatcccctagccgacaaactccagagttgcacggtgcatgactgtcgcttgtgcgctcccacttcttcaggctgtcgatgccacctaagctacacagctcagcgccgcccttgaactgtggcccccagccacgaagatggagcaccacggcggaatcaactccgctagcgtgcgcactgctcgccggaccaccgttgccgctatcgtcgtcgttccgctcgctcgccggttctttggatgggaggagagagaggggatcaagagagtgattagggttaggatttctcacgcacctcgttggtcacttcatcggcgcggagcaaatccgagacatccatcagatcagccccgcattgggctgccaccaccgatgggccacagaagatcactgggccacgctcgccaccgcactcggctcgcgcttaaactggccggcccggtttttgggccagtttttagaagtaatgggctgaattgaattttttttattttaacccgccgattaaatgtttaatatttcaagaattttggttatatccctcttagctaatttaaactgctaaaaattattttgattagtaagtaaattatttctagttaaatgaaaccatgagagaagtttagctacaaaggaataatgatatgaaattattttttgaccaaagtaattatagttttatgtcaattatatttgttgttctattccttagttattttctgcccaacggtgttttgacaatgaaaattctaagggtgtgtttcggcactgctggttcccaactttctcctctcgtttttcacgcgcacgcttttcaaactgctaaacggtgtgtttttttgcaaaaagtttctatacgaaagttgcttaaaaaatcatattgatccatttttgaaaaaaaaaactaatacttaattagtcacgcgctaatggaccgctccgttttctgcccgcactgttcctagttgggcctccagtagcgaacacaccctaagtttattttatatgtaattgattaagccaacataaattagttatatgcattattttcagcaatgggacaacttaagaatggaagaacaatattgtcaattcccttgatggatctacagtctcaaaacatgttttggcttatgcttatgagccaaaatttgaatattcaaccttaaatttagagttgaatttaggttttttttttctcttttagatcgctaagaacacgtatatataaattatatttacatattacttttcgtttgcaaaaatatcatttcgcttattccgtcgataagcgaaaccatagagtccctaatttcactgaatggaagaacaatacggttttgaatttagccatgttagattttgaccagcgagagctacagtgccgcgctgcactgtgctgctgctcgctgcattgcggcgctgctgctgcttgctcacatgggccggccaaggcccaaggcctgctgctgctgttgggctgctagctagcttgttctctgggctgggctgcagctgcagctttgctctttttctttttctcttttgttttttctccctcattctctttttcttctaattatttgtggggcatcacacttggccctaagagaggatcctcctgaggaactcaatagagctgaggaagaatatgaacatctcaagtggacttacaatgaaaagttagctacttggggaaagttcaacatgatgtctttgatgtacattaagagccacatcgctcaagaaattattggaggaatcattgattctaacaacgcaaagacatacttagctaatattgaagagaatttcaaattctcatataagatttatgctagtacaatcattaacaagacgattactagcaactataatagcaaaggaagcatcagaaaacacatccttgaggtgactcatatggcacataaatttaaatctattgatatggatctatatgaaggtttcttagtgcatttcatcatgagctcttttggttctaaatttggtccatttaagatcaattagaacactcagaaagaaaatggattatacagagctaatttcatactcggtggaataggaagagcatcatagagctgaaaaacaaaagcttaaaaaccaacccaacctcgctaatgccaaccataaaggcgaaagaaagatgtatcaaggagaacgctctaacagcaacaagaacaagtcaaacaactctcagaagccaagtgggagtaagcaagatagttcaggctctcaaactaaagatgccccttttaagactccacactgccctttctgcgaggtagatggatattggcaaaggaattgctcatgtttcaaagtgtggttagctaagaaaggtaaccataattttgaagaaatatctaatgttaatgaattcctttatgttgaattttcccttaatacttggtgggttgactcatgtgacattgtgcatgtttctaacttattacagggattcaataccgtttagaaagtagcaaaagaggagcaaagcctaacagagtggctgacaaactagccaaggaagctataatgcctagaagtgttcattcaatgtgtgcttgtcaaaaccgcatcttgcttaccctaacagaaaaagctttgtaagttctctgaaaatcacttcagatcggaaaattgtatgatcgaacatgtctatatttctagttgaaataaaatcctggtttaaaaaaagaccagtactggacatgtctggaaataataatggtctatattggaattaattacatagcattcattgatccttcagtttcagcacaagtaatgtattgtcagttgtcaccaatgaagttagtcctgttgtgctactatgtgcataaatgcatttgtgtctctaaatatcgtcaactagttgagatggtcattatctgcgcaaaacgttctaatctttcgaatagacagctggaaatgtttgttgatacattcatctgctcattagagattagttgagattagccggctatcaatgttttgtatcgacaataataaaaggggtagtgtatgaggtctaaattggatggatgcggagataaagatttagataagttcaagtcctcttgatgagaggtagttccctattttagtttgaggattgtatcctctagagttgtattgatttaacgatattgtttgtgacttatacccttgtaggctcctcgccctcctttataggttgaggggcaaaggtacaggtaggaaacctagccggattcgacatcagttacctttagtacttcaagaggaaagacctagtcggggcttagggcactaccttaactggtaaagaaactctagtgacttagttttctacaattataattatcttagttatggtccacctcctaataccagtcaggtatcaggtcgtgtgggtatttggtacttataatctccacaccggctaaccacaacacaagttatccgtggatcgcttcgattcatgtatcatgttttttcatccatcgatctcagttcttgcgcttgaataagttcagtccatgtgaaaaacttgaataagttaagtcgatgtgaagaataatttttctttaaaggattcagataataaaaattgaacaagtcaacaaatgctcaatatatttcccaaaaggctcggatcatgaaaaaactcagttttcaaagaaagtggactgattaattag

SEQ ID NO: 47576 - DNA, 3955 bp, Oryza sativa
tacatcttgatctttacattgattgtggatgacatgtttattacttcctttattttataataaaatcatttttagcccattttattactagtttctagcgatccttatatatcagaatttgtgaaagtaaaagataaatatattgggaatagataaatagaggaataattgcattggaatttgataaagtgggggttaatctttttagttttgtatcagtatttttcatctcctgttcactgatgatagtctccctttagtccaatcgcagcgatcggcagctattgggaaacctaaacccagaattttgaggaaaagtatcttacgctgctagtcctagaaggaagaatgatcaagggaaaattcaaaagcataaaagaaagattcagcaagagagtcaattactgatcagtgcctcagagaaatatctgtcaaatggggagaggttcttgttaagttggttttgcatagcctccccaccccacctatgctatgatcatgttcaaattctcgtatttgtgatgatcttaagcaaatgttaaggaatttctgatgggataatgaatttgaaagaagaaagttcattggcttgcatatgacaaaggctttatatcaaaattgggaggagaaattgggtttagaggtcttgagatattcgaccaagcattaccggtcattagtatttgtcatgctttataaaataattttggaatggcaccgaattaccctctccacctcggtgtattcctaggcatcatatttatatttccaagaaacacaacgctagtatgaaatgttttcttttttaccttaagatcggataaaagttattgatattaatttatagttgacatacactagcccaacctatctagtttaggagttagttcggaggtgattatggggtgacgtatattttagcacgaggatatctcggcacaaaactattttttttacaagtttctttaagaaattccaaatccatttttgttttcaaaactatagaatccgcataagtttgtgaaatcatgaagcgataagctatcaaaattaaacaatatacaaaccgggctcccttaaaatgcaaaccgcggaggccgaaacagctactcctgatcaactgcgacgaggtgcaacgttaattgttacttttccactctggcccctccacttcccatcaattcccgcttttaatccgaacgagaagaaggggggggggtgggtcgcgctcgccgaaaacaaagcgccaccgccgcaccacaaggaggaaaaaaaaaagaaaggaaaaaggaaaaaaaaatccccaatccaaaacacactccgcccctccgatccccccctctctcaaaccctagctccccccctccccaccaccaatcccccacgcgattcgccggatgcgcccgcccgacgcggcctaggcccctgcggttcaccggcggtggtggggtgagagagcgcgcgccggcgaccggcgaagaggagggggggggtcgatggagccgcgcgtgggcaacaagtaccgcctcgggcggaagctcgggagcggctcgttcggggagatctacctcggttcgtgccgccgctccccgccttgtggggggatttccgtttttttggttttttttttggtggattgtgttctcttctggtgtcgctgaatctgttgggtgtggatttgcgcctgcaggtactaacgtgcagaccaacgaggaggtcgcgattaagctggtgagttgatgcgataatactcatgttttcgcatattctacaattttcctttccctttttttttggggggggggggggcgtcggggtagtcaattagtggattggggaggaagtgatggataattgttctgaatcaaaataacctatgaattcaccctagcacatttggactggtaatttgtgtaatagaaaggccaataagcactggaacaaatgtcgcctgccatacggcttgggaatattttgatatgggttgggctgtgtaagctcttctgtctctttcacccagctcgtctgtctctttcactctcagtagtttagattagtaaccgtgaattgattttacagtgtattttaaagggatgtggcagctggacccttttcatctgtttacatccatcagcaaaaaatacgtatttgtttacttcgcttctaactgtaaccctgtcatttacaatctttttttttttgaaatgtatgtcacattatcagtgtgagaatgatgtttgttattatgtctcactcagtcaatgtctcctgattgtccatttaaacaactgcaggctttgccctatatggttgataagcccctctttggactgatatgcatttctttttctttgcgtttgtccaggagaatgtgaaaacaaagcatccacaattgctgtacgagtcaaagctgtacaggatacttcagggtggaagtaatgcactttcttttatttactttttttttccttttgcattccattttttttccctgggagataataacctgcattctgtttttgtcctgcagctgggattccaaatgtcaagtggtttggtgttgagggtgattacaatgttttggttatggacttattgggcccaagccttgaggatctctttagcttttgcaacagaaaattgtctctaaaaactgttctaatgcttgctgatcaaatggtacagtatgaaattaaggccaagtgttgttgctctttgtgttattattacatagtagtcctatctggttaaatgcatttgattgtttctaatttctccatatttttattagataaatcgagttgaatttgtacactcaaagtctttcttgcatcgagatattaagccagacaattttctcatgggccttggaaagagggcaaaccaggtaagtgatttaggtgctgtttttgtgcttatagttctaggtcttaattgtaacattaggtggctgtagttacattttctcccttatccgttgtaggtatacatgattgattttggactggcaaagaaataccgggacacttcaacacaccagcacattccatacaggtaatatattgtaatccatctatctatgaggttcatatttattaatcttttatgtttgcatcaaattatcatttttttcacttatgcattactttattaaaattgccttcgcattgcctactgtcacctcactggtcactataactatattgtgtttattcataaaatttggtcatcgatgaaagttttttcttaccaagtgccattcttcttctgagtgagacttctacccgtcttaagaaaccatatgacaattgtctactgaagtgcagagagaacaaaaatttgactgggacagctcgatatgctagtgtaaacacccatcttggaatcggtaagtctggtgcaacttgaattttgatcccatgcctatgttaaatgcacaattgtatgcatttcttcaattattttgtcttgctggtagatctagtttgacaaatgaactttggtatttttttttcaacagaacaaagcagaagggatgaccttgaatctcttggatatgtactcatgtacttcttaagaggaaggttagttatgttagctttatttgattatctgcttatatggtctgttgtgctctaaacaacacatttgctcttcttggtaccagtcttccatggcagggtctaaaagctgggaccaaaaaacagaagtacgagaaaattagcgaacggaagattgctacatcaattgaggtcattcttcccctctgaagatttaattatggctatggaccaacatattcttaccagcattttctttttcatctgcaggctctctgtcgcggatacccttgtgagtttcaatcctacttccattactgccgttcactacgttttgaagatttgccagactatcaatacctgaagagattgttcagagaccttgggctgcagga

SEQ ID NO: 47577 - DNA, 1144 bp, Oryza sativa
caatgcagttattctataatttgagccaagaagtttcagggaatgtttctgcatgcgcacaaaaattcaaaagtacattttattcctataaactatttttgccacaacattgttgatttgttgtactaccctaaacttcgctcaacaaactctatatacctttattcaaaccctgattctaagaggcaccgaaatataatttcctcatgaaaaaagggcgaagcctgttttgcccgtaaactctactcagtccattttacacctggcctaaacataaattcagttctcttttacctcttatttttaaccaaccgttacaggatgtgtcaatttcattgaatatagtagtagtaaaagttacatatacatgtatgaaagaactataaaaagggacaactcctaagatattaagttcacgaggtgttttgctcatgcctaagcccaaattttggcttcgattgtctttcagagggaccttttttttttctatcggagattgcgtagacttttggcgccacgtttcttggacttcttccttgcatccatgctgagtttcaaaagagaatagttttcccatctccagttgttattgctgtcgttgccgtaaagagtagcttgtcggatttgtcgcatatccagccctacttatgtctttttcgttgccttccactggtgcgctatagccatcttacccttagcgctctcgagaactttttcaggttaagcaccccagccctctataagctattggtatacaagttcttgttcagttgactttacatttttcgctcatgatgttatcagctcttgtccagaggaaccgtttgtttgccaagcacttcttttgagagaattgtttgagcccgaaatgctttgtttgagagagtttatcgttgggttataggacaattacccactatcaattgtttatacacactacctcttttgagtatttttcttgtttccaaaaacaaaattggtgctatgtatgcagttttttatgagctaaaagattcccttcgaatcatgtatatatcacatctggtatgatgagacatatatatatatatatatatatatatatatatatatatatatatatatatatatatatatatatatatatatatatatataaaaatat

SEQ ID NO: 47578 - DNA, 6113 bp, Oryza sativa
gtcacggggaatgtcaccggagcaatgtcaccgaatcccaatccatatctaagataccaaattctttagtataaaactttggtatattttcttatggaccgtaaaatttcttcaataagggtacctaccttgacggtgatccattaatactagatgatagaacattatgagccagaaaaatgtatatgtgtacaaattgtttttttaatttgttctaaagataactagatgaattatattatcatgatctacgtattttacatcacgggccacattaaaactaaccgattagtataggagtatgaatttaggaactatcaaatcatgaaaagctgcaggtaagactccaccatattgagtaaattttgcaattattgattctgaattttataaaatagtgaaaacatgaaaaatattataattgagaccccaaattaaccggatacaactcgttattattaattaagaattttgaaatttattaaatcatgtcaaatctaccaattcgaatagaacttagtttttattgattttgaatcttaaccttataaattaatacatgaaaaagctagcactaagactcaaccctaatacaactcgatattattaatttcaaatgtaccatatcagaaaaatccctttaattatcctaaaaaaaagacttagtatataaatattaatataatagctttgcagtgcgcggtttagagactagtttgttgataatccaacatggattgtattctttagttatctctctgttttttattacttgattgaaaattttctaaaaaaaatatgttggattttctttttccacttagttttgaaatagagaggaaaacaaacaatacagaatagttagttgaatggattcaaaaagaaaggagtttcatagctaagaaaatagatgttagaaccgaggttattttgcaaccacgtttatacgaaaaggtgccaaatgcaacgatgattgagtgttgagctccagttttcttttggtttcagccagaacattgtggaaactttgggggggaaaaccgtgcttcttgaatgagagcttcccaaagtttgattggaaattactgaaagattgttcacaaatatcctcggtcggtttgagacccccctatttgaactcctacttcatatttcaagcttttggacctgtttggcatagctccagctccagctccaccccttctgaagctggagcacagccaaacagtttcagctccactaaaactaggagtggagttgggtggagctctctcacaaaatgtactagagttgtggagctgggtttaggtagctccacaactccactccaaactcaatttctgaagttatatttagaagctagagctataccaaacaggccctttgagcattttcaaaaatgcatagcttatacaagtgcatttggttcaacattgttttttttcaataaaatgggaacgcgcactcgagttatactaatatgtacttcctccgttttttaatagattacgccgttgactttttctcacatatttgaccattcgtctttttcaaaaaattacgtaattataatttattttgttatgagttgttttatcacttatagtactttaagtgtgatttatatcttatacatttgcataaaatttttaaataagatgaatggtcaaacatgtgagaaaaagttaatgacgtcatctattaaaagaggtagtatttagctgttacacgcatacacacacgtacacaaacacgtgcgacgctagactttgacttaccgagcttacccttttttttttggcagcgactagctaactgtagctatatactccctccatccaaaatgtttaacgccgttgattttttaaaaatatttgaccgttcgtcttatttaaaaaatttaagtaattattaattttttttatcatttgatttattgttaaatatacttttatgtatacatatagttttacacatttcacaaaagttttagaataagacgaacggtcaaacatgtttaaaaaaatcaacggtgtcaaacatttagagatggagggagtatgtctttcgctagatctttacctgtgctacacttacgtgtttaataattaatcagtcgattgatgcatgtcatctagatgagccaggtgtcgatatatccttaattaacgtgttacgcattctggagtagtatgtttgaatattcaagggctctaccacatgcgtgccaatatatatgttcatttacatgtttaaataagaattatgttgtgccatcttgaccaagtcttgcacgctacacgtacaacgtgtgttaagtcaaactagctaagaaatagcagagaaagctagatgttgtgcacgtgcgaagctagttagcagattaatcatgctgattatctgggaacaatcgatttcagaaaaaaatatttcaatagatcactagtattagtaagtggcataaaaaagaattgaaaaaaagattgaatttacgtgtagatttggacctaaacagaaagaaagaaatgttttgtgagaaaagggaaatagctgagtgggcttaaaagtccatcaagattcagcccatccagctcattttaggaggacaaatggggaagatgtttttatagatgcctttcctcgtgttcactctactcgtctattcgccacagtatcaaccttttttaattttctgttagcatgttttttaactattaaatgatgtgcttttaaaataaatttattttttaaagtttataatagttaatatttaactaaacatgtgctaatgaattctcttattccacttgtcctgaaaaatctccaatagaagagaaacgaacgggtgggacctataaatattttgtattttagccccttctattgcactagtactccgaaacattgcactcaacaccctcaaaactacaaaataatataaaatattactcctcttaccatcaccatcctccacccgtagttggcgccggcaccatgccaccatctcggtgcggaagaagccaataaggatggtggtcaatgagctccccataatatggggtagattgggtcatcacctctccgtcattcccttctggcccctactcccgtcatcgatgacgacaccacccgccgccaccaccccttcctaccccgctttgaccacacgctccccgtcaccaagttgtggtcttctcagccactgcgatctccttacccatccatcgtggcatgacagagttgtctcggtgacaacgcacctcgagctgacgatgatatgcttatggcagttgatgtatggtagtcctctatggcttggttgcgcgagcatatcacatattttggggatggtgatggatggggatgtcctgaaatttctcagccgcgtgaacgttgccctacgctaggacacttcactagcagcatggcatccatgccttcgccaagatacaagtggcttcgtgggagcacgatagtggcttacgtagacgagaatcttctagctggatggacactcgtttctatgcatcctcgtcatctatccgtgaacagtgtaatcacacgctagcacagtgacataaaacccacctgatgatgttctcaatacatccctctcgctgcatgtgattcctatgaggaaaagggattaccgttgcttcaacaattttacccgccgtatttgtagacaatgtagattgtaacggttgcctggcaggctgccaccatgtaaaaaaggattattattcttatttatttagagtgtcagttctacggtaagagatggtttgctatttgctaagacttgatactactacttgtaatatactccctccatccctaaatatttgacgccgttgacttttttaaatatgtttgaccgttcatcttattcaaaaacttttgtgacatgtgtaaaattatatgtatacataaaagcatatttaacaataaattaaatgataggaaaagaattaataattacttaattttttttaataagacgaacagtcaaacatttttaaaaaaagtcaatggcgtcaaacattttgggatggagggagtaatacacagtagaacctatacttcaataaaaagattatctttagtaccctctactttaattcacacattttagatcctctctcattttacatcgctgtcgctgctgcctgtgattcctgcgaggaaagggtgggggacagggggagtgactagcgtggttgctacagcgctacacgttcgcgttttgcacgcggaaccgcccccacctttctccctttccccttcctccatcagcagcagcagcacgggcctgaccgtgaccgtcccccacgtcgtcctccccacacacgcgacgccagtacgccactgccagcgcgaaacaagcaacacacgcattcctcctcccgattcgctcgcggccgcaccgcaccgcagctctcctcctcctcctcccccacccaaacccacggcggcagattcgatctcgaattctcgaactctctcgatcgaaccctgtgccctctgctccccgcaaaatcctccgcatttgatgagtagtcctatcactcttcttcctccccgcgcaaatcctcgccgccacttggatgccagggagctccacctcgccgccgaccaccaccaccacccttctctcctccgctccccgccgcggcgcctaggccgctgccgccgccgatgggctaggagaggagagggatcgccgcctccctgcgatcgccaccgggggagccggaccctctccgcgagatctggttaattgatttgcctactaccagtattccgctagattctggaccgattcctctctgttgatgcaaccactgtacagttgttgctttccttgatgatcagaaggagctggcgatttcggaggtgaatgcgttgtttcatatgggtttgcagcttatgctacaacagctatctccgatttagtttattacctttggggagcgtagagattggattccgctttgcgttttcctctttcctgcgagattctagcttatccttcgattaaacctattcgcgcggctattagcgcaagtggttaggacggacgcagactaaaaaaggttaggttattagggatttggttttccatttggattgccgattgcgggagcatatcctattgggagattccggcactgtaaagatatccttggcaactgagttgatttaatgttaatgttagtggtggtggggagggcagataatacgcattctgatctgcctgtcaagttgggggagaagagatgggttcctcacaggaatccactttttcctccgcctcaacggccgcgcaggtgaatgcctgcgcgctggacttgctcccggtatacgccaaggagcttatcgccgggggtgcagccggtgcattcgcaaagactgcggtagcgccgctggagagggtcaagatcttactgcaggtttgaactgctcagagttccatttcattattatgtggtagctgaatgacatctcagcttatgccaatttctgagtgtacgtatgctgttgctttctagaccagaactcatgggtttcaatcccttggtatcctccaatcattgaggaagctgtggcagtatgagggaattcgaggcttctacaagtaagttacatggagaaaataccttacctcaggctctggctgctcaatttagtatcttaatttttatttcgtgttacttactgttcatgaagggggaatggcgccagtgtgcttcggattgttccatatgcggcattgcattacatgacttatgagcagtatcggtgctggatattgaataattttgctccatcagtgggtacagggcctgtggttgatctattggctggctcagccgcaggtgggactgcagttctatgtacctacccattagaccttgctaggacaaagctggcatatcaggtattgcatgcccatcctaatgctttgttgattgtcatctttagtagtcaagaatctctctcagtagaactatcactgaaattattcgacaatcagcattagtagttcgctagtattttccagcaaatattagtagtttctgtgatgccatccttgctaagggctgcaggaa

SEQ ID NO: 47579 - DNA, 7621 bp, Oryza sativa
ttcctgcagccccgggccgaaaagagacttgagtctcgattcgactttaagagatgcttttcaacaactcaaatggtaatgtaccgacctcccgggttagatcattacttatcggctcccagagccatttcacttgattaggtggctcccagagcctttttcatttttgcggactcccagagtccagctgccaagcagcaagcaatccgcttccactcgggaagcctagtctatgatgcccacagacatcccgaatcacacagattcgtttctgaccactcaggtcatccatctgccacataggttgattctggttacgattcccattccacaacaacttttcgcaaagcacaggcaatcaaatctacgcaacgggaaccacctcacatccgcccatgaccgtgggcacggctgttcgaacagttagttaacctctgcagaggggtacactttacccacaagacacgaacttactctagacactggccggtgtgagaggtttgtgacaaagcctttctcaagccgacttagggtcacctcatgccacatagaagaatcaaatcctcacataaatataggccattttagttttcacaaatcaaactccaaccacctcgatcggtaattctgcaagcttctctttcttgcttaccaggaacccagtttggctccaaccgaccctgccccggtgttcccaactattggcatgcgaggtttccctgaaccgactagttacttagccagggtgtcccattccaccttgtggttgcactgtgattatgctcgatgagtttcccataggaatcggtccttatatgcgaatacgggacagcgccacgtagacacggctcccacatcgtgagttttcacaattcattttattttcaaacacaccgacaccacatgtcgggttttcaaggcttcacaaacccatttcccaagttttcgacaaacaacggtgtatgtgggatatttggtatacacgctcagagagcacggatactgaagtaccacaagggtggagcgacaaggaatcagggtagtacagcctacatgaatttgtgcaactactaggtaggtccgtcggtttggcacacaaaccgaggccaagcatgttaagtgtgtgattctaataatgcaaattgcaaacaaaataataatgattttccaattataggagcaattgatcaaagggtgacttgcgttgctcaaggtcttcacgaagcttcacgaatctttgagaggcccaagactgatgataatccggcaaccgcgactaaacgcaaacaataaaaacctaaacaaaagaccaaataaagatcctatttagactaataattagtgccattaaatagatctgaattttacggaattattggaagtggaacggagtcaatcggagctacggattggaagatatgatttttggaagattaaaggattttctgtctaaaggaaaaaggatttattaaatccttctgaaaagaaataaaggagagacgtgaatcagacttccttgggcggcttagggcgcggcccgatggcttgcgcggctcggccgagcctttttgggcctggcgagcgcgggggtcggcccattagggcacgggagaggggggggggggtccggtggaccgagtgcaccgagcggggtcccaggtggggcccgcttgtcggtgacacggcccacggtttgatgggcgcacgcgagggcggcgctagggttcggtggggatggcgcacgggcggtgcgctggatggaccgagacgcgtcgggcccacgcgcagcctcacggctcgcggtggaccgcacgcgcgagcgggagacggagggagcggctgaccggggtcagcttgactcggtccggtcgagctggcgccgacgtggtgccttcgtggcagccacgcgggccggctggcggaggaagaagggggatgccgagatagacggcggacggcggcggtttcaccgggacaccttgcgacggtgagaggcaacagggagcacaccggaatgacgaggaagacaagagagagtgagccaacggctcggatttctttgggagaggtcaatggcgatggattgcgatggcggcggctggcggcgagcaaaaggggaaaatccaccggagcaatgggagttcgattcggcggagtgggagcatctctaggactcaggggacccgtttctagcgtcggatgggatggggaggtgccgtggaggtccggcgacgagaggcggcctccgggagcgagcgccgatggcagcaaggctatggcgagcggcggcggggcttggggcggcgcctaagaaccaccggaaggctaaccgagctaccaagcgagttaaaggagggggagagcaagcgaggaagaggaacggagggctaccgcatgtaggatcgagatgtcgactagagggggtgtgaataggcgatttaaaactaaatgacacctaatcaaaactaacctaaattgctaggcttggtgagggtcaactctaactaagcaactaagttatgtttttcaaacctagggtgatagtggctcaattatatctctaggaaagtaaatcacactcctatgtcaatgtttagcaatcctagggtgatatgatctcaagtttgtctctagaaatgtaaattgcacaaatataaatacgacaatcaaatgagacaaggagacaagagattttgcaccgaggttcggaaactcgccggtttcctactcctcgttgaggcgagcccaactctaccgctcaaccacgaagccaccgcatgcccccttcgtcaaggggtgggcaaggcgggagccggcccacggagaggactacccaagcctcgatcactagggtagttcttccttcactccgaaggtggtgaactccaaaccactcacaaaccggcgccgggcctcctccacaatcttctcggagaggtcaccgggcaactcctccacaagccgtctaggaggcggcaacctccaagagtaacaagcaatgacccggcgtggagatgatcaatcaagtgccacactagctctacaatggaagcaatgcacttgactcttggctagatcaaacctctaacacactaaatggatgaacacaaagctcaagtgggtgtgagagaggtgcaaggggtgtatgcaattgaattgggtgccaagagagctcccttgctgctggagggggagtatttatactcccaccaaccaaaactagccgttgggggcgaaatccccaaactttgtgctctgccggtctgaccggaggtatgcggccggtcagaccgtgctactctacaacggctagaaaactagccattgtagcgctgtcagagggccccatcggcttggcctgtcagaccggtgttgagtgggtggttagaccggcctcggctcggtctgaccgaatacggctccatcggctctgtatcggccaccccgagcagcaccatcccggcctttagggggccggtctgactgcgcatgtgccgccggtcagaccggccttatgcgccggtcagaccgcagttgtggcgccggtcagactggccatgccgcgccggtcagaccgccacaatgtggccggtctgaccacccctggtcaggccgagcccagtaaaagggcaaatgattgtgtgtgtgtgtgatgaaaaagagagcaaagtgaaaatgcaatgacctaatgtggcaatttaatcatctctttgctaggtcattaccccccttgatagtacggtgaaactaacaaataaactagcaaatttgatcgccctacacctcgatcagttctaaattaaagcactagttttaccgtcttctttctctttgctttgcgccgtcaattttaatccatcgataatcatccatgcgcacatatgacttggtcctaacttaaaatatatagctcaaagacaatagttagtccacaattagtgcttgtcattaattaccaaaattaataacgggggcctagatgcttcaccgcgtcgggacagggcgccgtgacgagcggcggcggcgcgggagcaagctctctaggagcggctggggaaggggaagaagaggtgcccggagctcctcgtcgcacgtccacgcacgcaccggcctccccggtgcttgacgacgaacgacgacggtgcaagcagagcagggcgacaatgcgcggcaggcgaaaacgagagggatagagaggaggaggagctcggcttgggttttataggcggatggggcttcgaggggaaggaaccgacattggggcggtcaaggggagtgagctggcagtcgcgctagctcggctggcatcggtccaagcggccaagcggcggcagaggaggtgcggtggctgaggttgggaaaaagagaaaaagaagggggaaaaggagctcgcttctttgccgatttggggagggagagggatgggagtgggagctcgacctcatggttttggcaggacgcgcgtggagcggcttgggcacgcgcgcggggccgagcggctgcgtggcgcagcgcggcagggcagcggggccaggcggctgcgcggcgcaggagcgacagggctgacggtggcggcgaccggccagtcggccaccacgacgcgcggtcacgggccaaaatcgaacagcggcggaggtttggatggtggcggcgggatttcaaaggcggtggcgaaaatcgaatcacggcgacggcgcatagcgcggcgagaggagagagagaaaggaaacggagggagcgtctctcgctcagcgcacgggcgacacacgtgaggagagaaacgaccgggggagaagataggccgagagagaatcggtccacaaggatttgagggaggcaaagtagactcttgtccaggaaatcggtttggagggaaaggagatttggaatttgaatttgggtttcgaacttgatacttggtcttaggaaaacagggaggagtcaaggaatggattcaaagtggactcggataattttggaatcgggacaagtatttggcgaggattcaatggagacaattaagtttcggagacttgaatcggaattgaaatcttgaggtgggggattttgatatcaacgagatggaacaacgggagattgaattgagatccatggcacaacttagactcgcacacaaagaacgaaattttcgcatataagattttgccgaattagtttttaacgtctcatgaaaagcggagcgttacactttctttccaataaaagcaagaaccggtttttaggataatatgcaccttcgggtattcttggtcactaaccattgcaggttgagattaagaacgagggtcatgcgatgtctaagaacactagctacatcaactgtacactttggtgatccttggtattggaacacactctataggagaatccgacatcacacacttggtttttgatgtcttgcgacacaaaagtccaagtgtggggggaaggtcgacgagcttttcatgatgagttccatcaaccaaggccatcttgggttgaagttggtgttagtcctagcttgctgaaaaaagaaaaaaaagaagataaaaaagaggagaaaagagagatagaagaaaaggagaaaaaaatgggagaagaagaaaagagcaagagagctgacgagctatatttagatcaaagactgcattatgtgcgtgtctttgaaatgtggctatacacctcgctagtagcaatcatgctgcccggcaacacctagtgcctctctcgagctcatgtgccgccttggctcagcctttatctacttctagctgtgcacaacttatcgctcccgtagcacctacgcgcatacaagcaagaggagttgccctcttcatttctaagtgttggctactccactccagttgacacttgcacatttgctcgaaaagagatgcatcctacgtattgtgccaacggatcacgccttcaaggcacaaggatcttgcacctgaggtgtgtgcatgaccaacttgcttgcctgagttagcatggtcaaagcgccttcctccggtacaatctgcataaagatggaggagaaatcgacaaccatatgtgaccataccactgccccagagatttcaaaatatacatcatgctggcggtaagtacactcaggtatgcgaaagataaaacaaggttcaccattccttttactcatacttattttcatttgaatgagacttgatcttacatggttatgtttcttgtgtctatttgcatatgctttgttttgggtgttcgcgcaagacatctataggctttttaaattaagcatggtgcttaggttaaaatagtctattttaatcaaattggacatggagtttagtttgattaatgaatttcagagttaatatgttcatagacattggatatatatcttatgtggactaacccctgcaggaaaattttcaaattgacgggtgagtcctcaagttcaattcacaatggaggtaggccagggccaggaacaaatcaattgctaacatgaaaaggagaaacatatcacctatgaaggtgcacggtgcgtatattactaattgctcctttagcatgttcatgcaaatttacctcatcactgtataagttgtgcttaaacgaaaatctggtgaataataaaaatttgaaaaaaaatgtttcagaataaaaggactgtctctcgaaaaataaaataaaatattagcaaacttatgggatccacgcttctcatgttttgaatccaatttcattttggcgtggatgtgaacaactaatttcaaggctacgataaaatcttttcaaatctttatagtcccttgggtatttgttgtccactaaccttttgcaggaaataaaaagacaatcaaggagcagtgtacaataacttcaaacacttatatcatgctccttggtccatgggaaagagatgcacaaggaatcaagcagaacaaatgcaaaactttgttacattcgatccagttctaagcctggtaagatctatctggtaagaatctcatacaccatgtgcatcctcatctcatttctccattctgccaggatacccaccatatccattgttgccataaaataaaaagaaaaaaagattcaataaaataaaataaaataaaataaagttggctccttggtcttccaaccaagtgagttctttttgcttcacttttgtctttatttttctttttgtgtccaataaagcctcccagatacaaagacaagtgtgggggtgatcttgcacatcaacgccataaccaaagtaagatcacccagaagtgatgagccatgacgaaccacacgaggaaaattgatgcagccagacccaatgaggggtcagtcgaacctccagtttgactgaaccacctctaccatgaatcgtcctctgttttatacagagcgtaggtttgcacaatttttactttggacatccattctatcttgagtttaatttgactatcaattctaaaatatcgaagataattgaacccaagctagggatggtacaattagagtctatggtctccctgaaaatgacatgcatgcctattattctttgctcattacttgttacttgtggtgatatatccaatagggaccccatgctatctaggtaattgatgaatgagttata

SEQ ID NO: 47580 - DNA, 796 bp, Oryza sativa
aaagtctaattgcctcaatgctagcaacaggagcaaaagtttcattaaaatccaaaccctcaacttgagtaaaatcttgagcaacaagtctagctttatttctcacaatcaaaccatcctcattttgtttatttttgaaaacccacttggttccaataatattatgtccagaaggtggttcaactaaagtccaaactttgtttctctcaaaaatttcaagttcttcatgcatggcgttaatccacgattcatcagttaatgcacgtgacacatctttgggttcaaaagaagcaacaaattaccatcatgagtcgttaccttagaccttgtagtccgctcacctaaattaccaattatttgttccggcagatgtcgtcgttgaatatgcaaaggagcagcaacttttgaagttgatccacgttttgtatcagtactggtcgaagtagtaatctctagaggaccatctcgatcagcatcaacagtacccgatcccgacgaccttggccggtctgaccgcacatcttgcgccggtctgaccggaggtgtgccggcggtctgaccagccgagccgacctcgtcgttgtcgctctcgtcttcaaaaatacgaccatcctccccctgaacctgtgacagtgtacctgcaatatcgggtctagtacctggactagcctcatcgaaagtcgcaagtctcaacgattttgttagactccaaaataagtacacgatagccacgagtatgtgcggggtaaccaagaaacaatccatcggtagaacgtgcctcagggctgcaggaatt

SEQ ID NO: 47581 - DNA, 1903 bp, Oryza sativa
atattcaacaaaaaattaccacaagagtcaaaaactttacttccagttttcttaaagtgaacctcaaaattttcatcaacaatttgtgaaaccaaaagcaaattgtactttaagtcctcaaccaaagctacattcttcaattcaaaattttcatttaccttaaccaaacctgtagcgagaacggcacttgtagaagcatcaccaaagataatcgattcagtcttggatgccttcttagagggaggagaaccaatttttatcaccggccatgtgccgcgaacaaccggaatccacgatccacatgttctccttccttgccaccaaagcctatacataagcagaagtcgaagcctcagtactggagttagatgataataaaaacttaggaatccagtactgagacacacgaccagaagatccaataggcatatatccacgtgcaaaatcaatttgagaattttcagaaaaatttctccgaggccggtctgaccgaggtacagtggccggtctgaccggtgtccggtctgaccgaggctctgcagctgtaacatactgaaaatttgctattttctaaatatgcatcatgctgattcttatgtttttaataacttcctaaacctaagaaattacaattagagggacctcctaaaactaacatgcataaaatccatgtctagtattaaaatctttcgtgcttttattctaaaattgatctttttagatcgaggtattctctttgatttgattttgcattttaaagcttctttcgaccaaaatttccttaattcaaatttagtttgaaaatcctttttacttttgtgaaatatggtccaagaaatcctccaacactacctttgaacctaaatcgaagcaattccaatcttattggaattaattgtcaacccatcctttgatttcaaacctattcttattaccaaatattcaagttcctccttttgatctagccaccaatttaatccctatggcttgatttcctatccagcacaagattaacaatattttaatgattgctcttgtgcttagaaaattccaatttattttcctcatccaaaattcaaattccctcaaacttcacctttaaagatgttgcactcaaataaaccagaaaatatctcttctggaaattatatccaaatataatttcctttcaaaccttcctattcaaatattctccaaattgaaatcccttgtaaaacttagccatccaaaattcctttgaatcaaattattcaaacctatatgaaaattagattccttccttttgtttttgggccgaattctccttctttcttactcggcccaggccggcccagttagctgagccaactcgtctctccctgtgggcgccgccaccaccgagcaccgtggccgcgtgtggcgcgcgtgtacgcgccgccgccgccgcccacagcgctttgctgccgccgtcgtcttgccttcaccgctaagcatcagccgctgacgtcagccgccacctcacatcgctgacgccagccactgcaccaaaccgacatgatcgaccaatcagagttagagccggcgtcgagttcttcttctccacccaaccggcgtcgtgctctccttctcttcctcctctccgaaaccgcctctaaccaccgcctttcctcgcctatatatagccgaagaggccccgtttccttccccatagcagagctcctcgagttctcttctctctctctccggccatgtccggccattgccgccaccactcgatctccctcaccggtgcattacggaccaaaccctcgcgccaccgtgcttgcctcgacgaggtgaacccatttttctagtttcccctttcccttagtaatcctataagccactatagccacttcttttatcgccggagcaaagcttttgt

SEQ ID NO: 47582 - DNA, 4545 bp, Oryza sativa
gactgtcgcatgtttttgttgggctgtatcagtcgtttttttggtcccttggattttgtttgagattcgtgctatctagacttttgttttcttttgtatgtgggcttttgattattgtaagttcgggcttccatacgtgggctaaatgggcttcttttttttttacatttttgtgggacccactttgtgttgccgatagagaaatttttttgtgagagtgttaatggtgggacccacatacactattcaaattttgaaatccgcaccggagagagagattgtctgaatcagactagagagagagtgtgagagattcattttgctttttgcctttttcctcgtcgtctcgtccggcgatttcggcggagatttcgtcggcgactccgggaggcgacgacgctgcgtaagctacgccgcggcgtggattcgtgcaggctacgtcgcggcggtgattccactggagtttgcggtgtgggcttctccatcttgtcctcgagctccttctcctctttttctctggtgagtatgttttgattcttctccagcttcatttgttagcttgctgctcgattcgttgttgttttgctccgctagttgtgctccttttgccgatggagagagagagttatagaaggagaggttgacgattttgtcgtctcgttctcatcgtctccggcgacgcggcggcgatttagcgaggcgacgaggctgctcttcggcgagccgcgccgtcgattgcgcaagattattccagtggctttcctttttgttttttttccttttttgttcatttccatctcctatttagcatgctacatgttgtgtttcgttgattctgtagtactagtcgttctagttttcgtagatctgagcaccttttgtttcggtgtttgtttcattgaatccccatgattcgtgttcgattttgcttttgtgattttttttaggtttctgtgatatatttgttcataaatttgtgctatgcgatgttctagaaagtttcgtttatgtgatgtgtgatgtgtgatctgtgatatgtgatatgtgatttacgaattgtgctctgtgatctgtgatgtgtaaagttagatctagtttttcccatgggaatttgagttgaatctatagttgctcccttgttctccggatgttaggttgtgatttgttgaatctgcgagttgctattttagtagatgcgtgtgatttgttttgaatgatgtttatgaagaagtttgctcatgtttggatttatagaagtttgtgttgcattattttgtctctcttactatttgtactttatttgtagtcttcaactatttgtttagcttgctagctgatgaattattgttagctgtagatctgatagtgaattattgctgtgatttatgtattgattatgtttctattttccctgtgtgctatgcaatgttctatttctcatttcatttttttccattgcttatgatatgtgcatccttataataactccttgtgcttttttttttgtctctctccctttgttttaattattagatgggtcatcaaaagaactgttgtacagattcagaaactttgcatcatgatgatgtgtgtgatttagttgtgtgttgtattactattgctacataagtactatatccacgttgtattttgttttctagttctttgtgtgtactcaaatgtaagctagaaatatgaagcctgagatattgatctgaagtgtagatcaatataggttttaacttatatagatcattcgattcctatatagacagccccttaatttaatttctgttaagttagggcaggcatgcaggttaattgattttgttacgctagtttattgagaactttatgatctatgcaaatttgttagccttgtgggatttggatgtctttttgtagctgttcataatgtttgtagtagactggattacactctagtgcaaaccccatttttgttattggactcgtgtttatgtacttaggtctaacatgtcttcccctttggggatttagacgccatttgtgtcggttctactgctaatgtttgtagtagactggattcattggattgcgtgcctctgcatagaccaactgtggaatggtcatgttccctagtgtgaatcaggtgtacagggcttaagtttgtgagattgtttgactttttatcatagtgtggacctctttgcatatatttgtgaggacatggagatatactataacatttgacttcaagttgaaagtactaaccaacgtatatatattgtactgggagttattttgttcgtttgccatgtttaagtaatgttcatttttttcttgaatacagtggtcaatttctgaggaattatatatctttttttaatgcataccttcacttattttataatttatagtctgccaaactttattgatttttaattgctatttttaatagatggttcaccaaaagcgttcaaaattggataattgtagccagcccataagtgaatctgatgatattaattcagagttttcgcgtgaaaaagatgatgattacaattgtgattttgatgataactcagccagtcatgtaagtttattttacatttcaatttcattgatttgaaatatagttgtttttttcatttccatttgtaaattcatgaagagtttgcaattatacattctcattgcttggtagccaatgtaatagtatgaccaatattttcttgttttatttgttcttgaattgtcatgttgttccaaggtcagaatagtatccattattctttcattattttttttcattagtatgcagttgtagctctgttgtagccatgtttcatagcacatttgcaatgttttaattgtttaatatgtttttttaggatatggatgtttcacaaccacatgtaaatgaaatttctacaaatgaacttctgaaaactttgaaaaggaaactcagtaagtctaaaagaagtgaagatgataacattaaggtaattattttgtttgttatttttcattttatatttttccatcattcttgtttttaattttgaattttttttaagatgaaaaggtctgaatctattgaattggacaatgatgtaatgataaatcaggttctacgtgatatcatacaaagggatcaaattatcaacagtttgaaaaaaaagcttaatattcatcacaacataggtgatcaaaatttgaaggttagttttttgcaatgcccttttatatctatgtttggtttttatttattgattaaattgttttattttctttttgtcaggacaaaaatgttgacactgatttgaagtctgatgcattctctagattctcagtcaaatatttctcaaaagttgattctttaagtccacatcacaaaacagtcattgaaaattcttgttttcaaagcatgctgctatttgacaagtgttttgttcccaattcttttgctctctggattgcaaaacaagtagatgtgaactgttctgatatagttttgggccaaaaacttattccattgaacaagcaatttgtccatgttgtgctaggcctccctgttggtggtagtacaatccattcaaaatttgattctggcaaacaaaagattcttcagatttttgggaaaacttctattccttctgtcaagttctttggagaaaagttaattaaaaatgaagaacttcctgatgatcaaattctcatctgctttatgattgtttccttgaattgctttctttgtccaaactcttctttgattccaagtacaaaatacctaagtgcctttgaagacatggacttaattgaaagtttggactggtgcaagttagtttttgactggttgatggaacacattagcaagattgagaaatcaaaaacttttggtggttgtttattccatttagcggtaaatttttttccctccatttatgctaatttatattttgtactaaatgactattcatttaatttctatattcaatgtttcataggttaattacctggattttctcaactttggttcacaaaaagtattacttgatacaccaagaataaaagtttggaaaagatctatgattaaggactattccaaatttgataaaatatctgaaggagtgtatggaaaaagaccagtcaatgatattgcttcaacttgttacccaatggtaaatgttcagttttttttttcaaattttttatctttttaagttctaataaattttcttagattggaattgaaaattctgttttaattttttaggggaataaaagagctcatcttcatttgctgatatgctcaaaagttctgttggtgatctgttgccaagtgatgttcaagacaaaatttgtcatttgctctgctatcattttggaaaagaagatgaaatctttgaagacaaggctaagaaacttcttataatgttctgttgttgttagctgattgtagttccaattatcctactcaacctgctgcacatgaaaattcaggttattacttttaatttacgaattttgttgtttattttatttttaatttttttccattca

SEQ ID NO: 47583 - DNA, 4756 bp, Oryza sativa
  unsure (1)..(4756): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntggatgggttggggtcacatgggcagttacagtttagcagttacagacagcccctgcctcctctggaataggtctcaccacctccttgtttcaggaaacaaaagccatcatgggtctcagtgagtgagagagagcaaaggagaaggcatcttcttctcctttggacatgcaatgcctctgcatttttcactgcattttgcattgcattttggccttttttttttttggggggggggggggtctcaacttgtgcattcctctgcatttttgcattgcattgaagaagaagaggagtggtttgtgtgtggtggttgcgtgttgtggtaatgaaatgtggagaagagattcctgtggcgacatgggcatgtgcaggggatatcaaagtggtaggcgagtacacggcaagagaagaaagaaaagcaaagcaaaccaaggcttctctgtaatgctaatggctatacatgctcttctcctccaatcatgagctgcaactgacatcctgcaatttactaattactagtactattatactgccattggtgattaattaaccttttttttaatttcgtggtaaacttggttgaatcttgcggctgtcactgatcagggattcattcatggttaagattcggtttaactacatgtacaatttgtgtgattataagatggcaacttggcaccaaagagttggtgagcagaacatgagaaaaaacctgtaaaagaaagcgatagaaccaagaaattaaaacggcaggtcgccgtataacaaaacagagctgctttgctgctaataatgaattagcaactgtgtgtctgcaggtggatttggttgtgccaccactaaccctaattaaaaccggcgatgaatgtcagagacggtgaacaagtcaatgggggcaagtagattatcatctctgaatctcatctcaccttcttatctgccactacaactacaacatcatcagtatatacaatgtacaaacctaggattcctgggaatgagataatgcgctgcgttgacattttctgaacctttgcacgaatgaaccgttgcaacagcagtaaaagaaaaaaaaatattgtcctaaccatcttagctctgcacccagcgtgcggggtaattaagagcagcagtagtatgtactacctggtgaagcagtaaatatactcctaattaaggggggagatttctactacccctgcaagcctagcttgatgtactacaacattctctctgacagacgcagccacacaccattatcctccacttgtttaccgtaagctgatcaaatctgttcagagatcagatcatttaaactgtctgctagctgcgctgattaatcaggctgtgttcagtggtcattggcatgtactagtagtagtaatagatctaacaatttcgatcaaccaaagtacaacacatcttctgattaccaatgtgttttcaccatctctggttgcatcattgcagacatgtacattgcagataaagataagatgattaactaaccaattctttctgtgtgttttttttaaagggtgatgtaagcaggatttggatctgagactgagactagtgccatctttcactttaagcttactactactatactactgctgccttttgcatccaatgcaagcattaaccacctcctcccatatgattctccctcaataagttaattaaaaaattgttgttgggttaagacagcttgtgtagatccaaaatgtggccactttacccaactactccatccatccatccttgtagtaccctctaccttccaaccagcttcccttccatggtagatagccactatttggccaaggtatctttgcatgtttatgcatcactacttgtacgtatccacaaagcaaaaaaccctgtgatatgctacaagatccttgtacatgcagcacggctcattttgatgcatggaatcccatggcatttcccttttaattggatggaagtatgtttgagggagagagttttacagaggattgcattgcacggatcttaaagcaaatatctgatcttcgtttttttaaaaaatgtaagaaatgttgttagtattcgaacatgtcgttgaaattcagacgggaatcgtgggtccaaagatgtcttccatttatttttgtttgtatatcttttttttgcaaaataaataaataagtgtaatactatatgaaatttcatttaaatttttatttgatctgcatattaatctgttttatatttgttgatccattcttgccaagtggcaacagagatgcaaatgggggttgtagtgaagtgacatgagtagaggagatccactatcacagcaggagtgagttgcctgcatatggatggatgatcgaagtatggcagatctagaagggagcatacaacaaacatcagctgatctgtgtgtgagactgacagagttggctcctgcagttagtcattgatcactgggacccacatgcacataaaaaaaacttgaagcacacacaagctgcatcgctgtgtgttgcagggcttgcagcactgtagtacttttgagcctctcccaggacagattgggtggaaagtgaagtgaagcgaagcaatcagatctcagtagaaccaaaagcaaaatgcacaccatttatactagtagtacaaagctcaaacaaaacacattataataagataaaaaaaagtaattaaaagtacaattagttccatatttttttctcttaaaacatactccaaatattttaccagttgtgccaatgcagctagctacctgtgatgtgtactttcagcaaggtataatagcagggtactactagctaacactatcacctttttcctccttccatcttaaaactgaagcaacactcatgagggttgatccccggcctgagtgagtggcacaattccatatcttgatactcaagcaatgccatgttcccctggcctcctctctttgagacttttttttagccttttgaccactcacataataatgccttttgggcagtatacagtacagctgcaagcacacacaagaaagagaccaaaggatagatgcataggatgccatggcaaccaacaaggtggtgtcactcactcacattctcactcctatctaggatgatcctctcctctgctgctgatgactgcatgttaggagagtactagtaaaactaaaccaaaagcctgcagctggaaaggctgtcaactgatgcttctcttctcttcttcctcccccaccatcctatgttgccttctttctttctttttcctcctccaaagttggataggatagatccatctctctctctctctacatcatgatgtggagcaaaatagataaatcgaacatgcatctctatgtgctgggaaagatacctctacaatgcacaaggggccgccttggaattcgggcaaagtatatgcattatgtgccttttgttggtttagaggttgttttagctgctgtgtatggttggtaatacagtttaacacaacatgttgcatctccataagttgtatggattgttaaataatcctccctctgtatttaaaggtactattgaatttatttgatcaaacttttaaaactctgaccatcgatagtccttaaaatatctcaaagtatttagtttgaaaataaaaaggatcatatttagattttctttacaaacagttttacaatattacaattttgttagatattattgttatagaaaacaatggttaaagttgcacataaaaccaaattaataaaattaacagtgccatatatttaaatagggactaactttccctgaaaaaattcccttaagaaaaggggctaactatatttatggtgccaaactttttaacaataatcattttttatattataaaatatatatagttacactctaattacagtataaatttaaatacttatacattgtaaatgttaatatttacattgtaatttttctaatactcactgtatatactatatgacatttagggctaggaatgattatttactaatgtaaaagagaaaaaaaaacaaagagataaaaggggagggaaccatgcgcaccgagataagcgtatcggacggccacaccttcgactaaaatcggacgcaaaaacatgacgacagatttttagtaatgtgatttaaatatataccgagatagtaataaataggtaaaagtacttacaagctgctattgtaaattacggctgtaagatggacactgccgaattgtgaaattgtgaatgtacatgtagcacacaactattcaaaactcagcaaaaaatttctagagatcatcgtattttgtttgccttttttttttgaaaaatctagaattaatatactgtccttcgttttgttttgcattccgaaaatgctaatcctatgacatgggcgtacaatatatgtatgcatctacgacgggggatatatacgtacatatgagccgtacat

SEQ ID NO: 47584 - DNA, 16687 bp, Oryza sativa
aactaatttgatgttgtaaatattataaatctatattcaattatagatttaaagtagttaaattgctccaactttgaccaattaagtttatagaaaaaatattaacattttcaatccaagatatattataaaaatatatttaattatagatttaataaaactaatttgatgttgtaaatattataaaaatatattcaattatagatttaaagtagttttttttgaaaaatttaaagtagtttaactttaactaaagttaaaatgacttataatatgaaacggagggagcatatacgtctgcaaattaatttatatacatcgatcgtacgtgcgtatcagatcgatcgagctagctagctagtacgtgcgtgcaaggtgttacggggattcttacttttaatatcacggcggtagaaaagattattaattaattacggtcgatgttattgcgtatctaatggaggatccatattccgatcgtttttactaagatactactataacatcacgtactgtaatatttattactactagctaatcactaatctatacggcatatgtttaattaactatttggttgtctgcactctagctattggcgagagacccgtacacgcttgattgatggctaatgtgtcttattcgtcatgcatgcattagctccaaacaagctagctactaatcttatcctcggcttaatcatttggcttgaaaaagaaatacgtactcctagtatgatagacaagctagaatcaattaattaaagaatggatttgagtttgcagaaactgacaaattaaacctgtgacttatctgacacaggagcaacacaatgatcgacatggcacggagagtcgtctgagaaattattacagggacaaaaataccaaaaaaaaataacggtcagatatgatcctactatgctactatacgcataagtaaagggtactgtaaaaataccccttaattaagctataccatatggtattcgatcgaggaggggccacatgcataggatcgtccaatgacgtggctaggatttagagtaaaaataatctatctaaatataatgagtcaaattaaaagatggttaattacatataatttttttatagttttagacaaatatctactacaattttagccttgagttaaaatcttaatatggtccataacctaccgtgtcacctagctagctccgcctatgtcatcgaggtccaaattaacatgagctacagctacaatctacatgcatgcaatggacatacttcctccctactcataaagtaagtcatttaggacaatgtttaagtcaaaacttgtgaatataaatcatgaataactctcaagttgttgagtttgaaaatgtaaaaattatatgaatagttttgtctcgaaaaatactttcataaaagtatacacatagataactttttaataaatatttttatagaaacaagaagttaaagttatgttttggagaccatgtcgctgtccaaaactaacgactttatttacgaatacggagggagtacgccatggctagctgctgcgtgatccgaatagtaaagtgtgcagtgaggcgatagagaaatgccttgtgtccaggggaacagggcccggccgtgtccacatcgattgagcctctttgcatgcatgcttgccgtaggacaattactacaaaatccttttggacgcggtagtatttattattataagtttattaattggtgaagtattggagatccacacaaatcaggaccaatccaaatcaatatatccacaccgatgcaactacatacaaaaagttcagacgatcgaccgatcgaaccatatatatggatgtgttggatttaatttaacgctatgtaaacctgcaaaattcaatttcaaattacagtggctgtctatcgatcttttttttttcatttgacatctcgaatcaacagggctttgaatttccatataaaaaagacgtgaatattagggaataagctaatattaaataattagaagggcgtgagacttcgaaccagatcatctagcccaccaccttgtgtccttgtggagctagccggaagacccctgggtgtttctcctggatttccatatctcaagtttaagttttttttctcaatattgcatcccagcctctacatctatatataggatgcatacaacaatactcatatttatgttgtcaaatccatgatttctttggaataaattcattttttaaggaagacctcaatgcaagaaggagggaggggatatatagttcctgctgctttatatttttataaggaacagtcaaatcatttttatactactataaattatctacacttaattcgtaataattacaatgtataaatttgtaactttcaaaatttacatagtaatttttataacacataatgtataagagaattaggattaaaaataatttattatttacttggaagaggagatagaagcatacatacttacttataggagagagtaattaccgagggaaaagtgactaaaattaagtgaaaaatgtggtgctataattttaggaaaccccgaaaagttagttaaccttgtttatatgggaaactggcacagttaattgaaagaaaaaaaaaactccacatggagaattaaaataaaaaacctgcagtgacacaactactgagactgcccgccgcaagtcatcgttgtccagcaaattgcaaatgaacaagcagctttgattttctatgatagtcggtaaacgatatccacaaaccccaattgtgaagtagaacacaataggcaaaaaggatacatgatcgatgacgctgtcaatacccttttagaacaccaagatcggatttctcatctgaagaaagagagatcagtagagaaccaccacagcgacatctctaagttggcggaaaatgacacccctagaccttaacatcatcggcaccagtggcaccagttagagattgggtaaggcttttcggtaattttaccatccttgagaaaataccgagaggtaccatactttctagtgtaaaatttaggctgcgttctttccacaagtttcccaacccctttccctcgttttccgcgtgcacgcttttcaaactgctaaatggtgtgtttttttgtaaaaagtttctatacgaaagttgctttaaaaaaacaaattaatccatttttgaaaaaaaattagctaatacttaattaatcacacgctaatggaccgctccgtttttcgtgcggtggagttgggttcccaaccccaagtatcaaacacagccttagtgtttctaaatactaagtaccttgaggtatcaaaaactttaatgtaaaatttaagtatctcgaagtatttttttgaagtacccagttaagctctctcaactgtcgatcacctttgtgttgccaaggttaataagtattataggttattgttgtctacctcgtcacacctgacgcaatggctctaactcggtcataatccaatctccacataagctatcaattcaacagcactcctatttcgttggaatatttccaacaaaattgcatcactttgaccagtttgccgatcccaaatgaagctttatcaattgggtaattttaccatccgtaagaaagtaccggaatgtatcatattttttattgtaaaatttagtatcttgaggtaccaaaagattcagtttaaaatttagggacctcggtatttttttcaagaaatataaaatttctcttattaattaatctccgtcaattacatcaaggtgatcatttttgatacactaccttgttccatcggtgggcaccgaaaacacacctgcggcagatagatcgagttttcttcagatctgcatgcatgcatggcagcagcaggtatagccaatcagatgaaaatctgatcacatggagacaactatccgatcacctccgtgacacacccaacaacgatagctctcgcgatcaatcggccttcgccaccgccgcccgcgagcccactgaccagcagccaagatcgaaacctgcacgccgcatgcttatttgcaactcaccctcctcgatcgatcctcatctgaatatactgaaaccgtgtgtaaacaaattgtaatcctatcaatatggcatttgggcaaaatcaatcagtgatattcctttgttcctgtctaccaccatgctgtgctagctagcttatgtctacatttgcgttgctgtgatattcctcggtgcgtacagtacgtacgtagggcatgtgcagaaattattgcttagctagctagtagtgttcgttctcttctgatgttcagtcaaattttcagtgggggtttcgagagatcggagagaaggaaagatgagatgcgtctttctcgtctgcatgcttgggcttcagatcgttggacatgactgtctgctctcccggctgcatctgtttgtcatggcatatgtgtttgtgcaattggatgatttggcttttggttggctgatgaccatctgtgtgcctggaaatggaggctgcacactgtgccgttttgggcgcctagcttgcctcatgcatatcattcagtcattcagtctgatgactgactgtattaatatctactcctccagtactccaatacactagtactactacttttgaactctgtctggttttggttacttgtgtgtgcatggttattttgaaatcatatcagcatgttcttttctgattttggcctggtttagttcccaactttttctttaaacttccaactttttcatcacatcaaaactttcctacacacaaactttcaacttttccatcacatcgttccaatttcaatcaaatttccaattttagcgtgaactaaacacactatgggtttttatttgcacgcttgcaagctcctacatggtgtgctttgtgcaaagaaagtttatataatttttttcttgaaatacttttctctttgtagcaaatttattcgtttacaccttcaaatagctattacaaaaatcagattattcatcacctatcttaaatgggtgtctttctttaatagttttgagctcttgattaattatataggaccagatcatcacagctctttgggtagctaaagataagttcagacagtcaaaattttgtctgcagctagccagctagccagctagcatgaagttagttaagctgcctatgtgtatggcaccagctaatctacactagaatttgaaaaaacctgaacttgttttgattactgatatacatcagtccagtatatagatggctacaaatgattgtctaggaggagtgtactcaagacttcagagccagagtcgacatcacgtctagtcgatcgtctatacacaataatatccgtataatgccaaattaacagctcgaccaaacttacacgaagttggtcatctagaaaattggataatgcataacgaaaattgacctgcaggagagagacagttgtctaatatagtactagtttgcaattatacatgagccaatcgaccaaaccgtgttcaaccttcagaagcacattaaaacgaacaaacggcaacaatccaaactcaaatcggtggataaaaaaaaatgcaagctagtcaaagatgaacatatgcaacgatgcacagctacctagctagctggcagtttcatgctgcaacacacaaaagttcaggatcttgatagaaacagcttggaagttgagcgtcccagatcgagtaatatggaagtaaggatctccaatcggattaggtgtgatatgcagcatgtttcatccggcaccaaccgtgacaacgccatggatgacaattttgccatgagaaacggcgtctcggccggcagcaacagatcaggttgggaataatttgcatttccaggctaatttaacctaacaattttgagtattaatgggccggttagtcacacagggttctgaagagaaagttgggccgtggactactctattctactgtgggctgttgtggcaatattggaaattgctgaacgtaagtgaaaaggctaacgggcaatcgatcgcccctagcgatcaccccctccttcacgtgttttttttttttgacaccacattacttttctattttaataaatttatgcaacctgtacacctcaagtttacacatctaaattttatacacctaaagtttagagactcaaagtttatatatccgattcaaatttgaatttgaattcaaatattttttatatacagtatttctatacatctaaattttatacacttaaagtttagagatccaaagtttataagtcaaaaatttatatacccgattcaaatttgaatttaaattcaaatatttttatatatagtatttctatacatctaaaatttatacacctaaagtttataggacaaaaatttataagtcaaaagtttacatacccgttccaaatttgaatttgaattcaaatatttttatatatagtattttcatacataaatttttctaactttattttctttttttttaaaaaattatggtgtagtatgaagagaagaagggaaggagaaagagggagaggagtgtatagcggggatgggggtgatcgccgtcctttagccatgcccgaaggtaagtgcatgacgatattgccatggatgattattcgcagttttctactcaaactccaatgtcatttataccgagaattccacgagcgatccgacctatgtggtgagagaactgacaacttgacagtaagtaaacattgagtaccaaagagaagtgcatgaatacaatagtaactcgaggttttgcatattgaaactgatcaaaacattgaagaaaactcgaggtttcagatctcaagccgcgcttttatctcatcgataacagatgggaaaccctgcataagacgcaggtaaccaccagtgactaccaccttcctgaagttgttctcttcaacgaagaagtcgaggcacctgctcttcagctccgggcagctgtgcatctcggcacaggccagagtctccgccaccgtctccactgtcacgctttcccacagcttctgggcgcacatcagcttcagcctgtccaacgcaaacctgtccgctgccgcgaacaatttcttgaaaaacgaaggagatagtatgtctctcggtggcaaagcgtccgtgtacacgaagtgcaggagagctctgaacgtcgccggctcgatgtcgtgcagcgtgacgcacggcatggtgccctccgccatggagccgaggagctccgcgctgaacaccggcgagcgcgcggcgagcacggcgcggtgcgcgcggatgagcgtctcgccgccgacggagaaggacacgtcggagccgtcggcgctgcccaccatggcggcgagatggccgcccaggttcggcggcggcacggctatggggtgatggcgatcgtcgcgcagaatcacgaggccgaagacgaacgtgaccacgccgtcgatcgcgtggagcgaatccacagcacttcgcttcacgaagcgataccagccaacgaagcgccagaataatcggtcgtttttctcgacgcgcaaaaggattgcacgtcaatatattagaagataagaatattcattacacaacgcattaaggtagaccgacttatgccaagagagaagggaaacaaaagaccaaagaaaaaaagactaagaaagtacgactcagaataatcggccgtcgtcttcggttttgttggatgattggatcctgatgatctgcgtacacctgtctgcatggtgcgaggatgatgatggtgcgccatctttgcccatcaggagagcttcgaagatgacgctgattttggggtcgttcttcatccccacgaagagagagatgtactcgccattaattgtcgctcttaagcccacgagggaagagctgaatttcggcattaagctccctggccgagattcttattccgggcaaatacttgccaatggcaagcttctgggattcgaggtagtcgagtttgtactcgatgaaaccggaggccagcatgttgccggcgggcggcggcgtatgtttgttgcaaggggatgaacagctagctgacgggagaatttagggcatgttcagattgctgccaaaataaacatttctaaaatttggcaatgctaaaattttgacaagtatgttactaaatttcggtagaatcgattatatatgttagctaaacgattttggtctttttcttgaatatatggtaatttagtgtccattatgttgtttcttagttgccttttgccttttactatgtctattggattttaatccaaagattaaaaatctatgtgatatgattataaaaatctttcgaaagatgcataggtactcccactgctaaaactctttaggtattaccaaaagtaataaactaaaggggtaagtccattttacacccctcaactcttaactttgtctaaaatacaccctcaaaatacaaaacaggatatttgataccccttaactatcaatgccggacactttaccccttgagtggtattgtgctggttttggtacacgtggaagtcacagggcatgccacctgtacaaatgctacatgtcaggcctatggttggttgtgggagaggcggcgagatgttgtggcctgcgacgcgcgccgacggcatggggacggaacagcggcgagcggctgccatgtgcgtcagtacatgtgcaggtgcggctcagggaaggagcagcggcaaggcgtcgatagcagtgcagtgtgcgggggacagagcacaatgagcacggccgtgggcttcatacccaccttggccctagagcgcggatcggctacaacgaggtcggcgtcgctgaatctggccacaaagactacagagagctcacctactgctcatacacgctactgcatccactactactagggtattcttctcccatgaccatgatgcaagtgctagctgtagaacaaaaggagtaatcacgaatcaagaatgtatagagctagcagcatatacagtatagcttaaggaaataatgattgattatttagctctccttgcaaatcctccccaccccatctctgcagggcggcgagttccgatctggtaggatgaagagagaagaggggaggaagaagaaagagaaggtaatgagaatgaacggtgggtccatcttcttttctgtttatttgttggttgaccggagtgtcggctcatcgccgcatgggcaaaaaccaccttcatcgggaacgaagaggtgtaaattagacagttttgaaagttgaggggtgagttatattcggtttaaaagttaaatgtgagttttagataatgcaataggtgagggggggctaatgtggacttatccctaaactaaatacatccacatgtttgccgattttatcaaaaaatgatatggttcaaaatgacaccaatctgaacgagctcttatactagagctagtatactacacagcatgctgcatgcagcgatatactcgtaataataatctagtgtgtgtgcatgattccaagtgctatggataaggcgatgcatttcgaagaaaaaaaatgagaggaagagacatccctccaaacattttttaagaagaaattatgagcgtgttcggaacacagaaccttagagttgaaaccacacaactcttgccactacactatcaagtgcatctcaactctatagaagccattcattcatctgcatctgccgttagcggtgcatttgaattttgtttgaatgtgtgatctggaatttggatgaattagagctagcttttcctcgcagaattagttttttttggtgaatttgggtagatttagtgtagaattatgatttttgatgtgttagaaatgatttgtatcaggttctgtgaagaaacagtacaattttcagctgcttcaaagcaaactttcaattctgaaaactgaattgtttccgatgtgcggcgttcagctgtcactttactacgtgaacgttgttcttctagggtaaaattaccagagatcgagatgaaaggagactgccatggatttgccgcttaccagctttaagagacttcaacatccaagaacaagtatatctatgataataacatggcaaaatattataaatacaatttatatcaaacttaactgctctctggctatatatttcaggtctcaactctcaagctatgcatttatctcgtcaatcactagtggaaaactctgcctaagataaaagtaacgtcgtcggtgaccactccctttctgaagttactctcttccatgaagaagtcgaggcacctggctttgagctccgtgtagttgtgcatcttgttgcaagccaaagttatcgcgacggtctccaccgatacactctcctatggctttagagcgcacacatgatctttagtctatcgagcatgtatatttgtcagatgctactaccaaactctcaaacaatttagtcctcgtcattgtaggcgccgaagaggctccgggtgacaaggcgtcaatgtacacgacatgcaacagagctctaagagcaaggataataattggccataagccaactataaacttatgtggaagagagataaataaaattgagaagggttggctcttatgcaaaagccagctatgaacacgctccaaaatatttactacattaaattcatagtgagagaaagagggagaagagaaaaggtagagccaaccttatacttaacttattagaaatgttacctataatatggactaatagccaatagtcaactatactagtagagtgtggaggatggatgcccccacttttatccatgattctgtaatccgttcaatgaaatacccaaagaacaattcactatatcaagatataataaaagaacaattcactatatcaagataacatgatctcttgtgcaacactgctacctatttcaagtctcaagcctggagccgtgcctttatctcgttgatcactaacgggaagctctgcataaagatgcaggtagtcatctgtcaccgctgccttcttgaagttgctgtccttcatgaggaagtcgatgcatctagttttgagctccgtgcagctgtgcatctccgcgcaagccagagtcgccgcgacggtctccgccgacacgatctcccatagcttctgagtgcatccgcaatggttatctatagactctctacaagagatctatgtcagcatatttttctacttggaagagattaaatgaagagagagcaaaactatctattagcctagagatagtctatagagaaaaacgaaacaatggattagagagctatagatacccatgtagacatattattagagcacccgcaatggtaaagtaaggtgctatctataaaacatgtacatctcagcaatagactagaataatagtaaaccatctcaatagtatgtctacatgggtatctatagctctctaatacattgcctcgtttttctctatagactatctccaggttagtagatagctttgctctctctcttcatttaatctcttctaagtaggaaaatatgctgacatggatctcttatagagagcctatagataaccattgtgggtgcccttaaagtggtttactattaatctagtctattgctgagatgcacatgttttatagagaacaacttcctttatcattgtgggtgctctgagcgcacatgagcttcagcctatcgagcgcgtatctgtccgccgccgctagcaatcctcggaagaactcaaccgccgccgccgccgtcgaagacgacgtggagctcgctggcaaggcgtcggtgtagactaagtgcagtagagctctgaacgtcgccggctcgatgtcgtgcagcgtgacgcacggcatggtggcctccgccatggagccgaggagctccgccctgaacaccggcgaccgcgcggcgagcacggcgcggtgcgcgtggatgagcgtctcgccgccgacggagaaggacacgtccgagccgtcggggcagcccaaccatgccggcgagatgcgcggccaggttggggggcggcacggctatgcacggccgccaccgccggcgatcgtcgccgtcgtcgtcgcgcaggacgacgaggccgcacacgaacgtcgccacgccgtcgaccacgtgggacgactcgaggtcgccccgcctgatgaagcggtgccaccccatgacgcgcgtgccgccggcctcgccgacgaccgacctccgtgctcctcctcgcgtgctgcggcgacggcgcgccatgcttgtccgtcaagaagacctcgaagacggcggcgtcgatccgggggtcatcgtcgtcgacgtcatcgatgaacatgaagatcgagacgtgctcgccatggccaccctcgatcccacgcgggtagagacggatccgcgcatggtgctccccggccgagaccttcgtttctggcaacgaatcgtcgatggcgatcttctcggattccagatagtcgagcttgcactcgacgaaaccggaggccagcatgttcgtgttgcacgtatggcgatcgatcgattgatctatcgatgaacagggcacgctcaagggaaaattgattcgtcggtcgatatgatctaactaaaccgatttcaatgtggataagtttgattaaggttccgttcttttctccaacaatcatatattaatctatttttcaagtttgtaataattaaaactcaatcaatcatatattaatatcacctcattttacataaaaaaaacttaattttcatcttcattttcgtctttaagagcatctccaatagatgactaaaattaaactcccaaaaatcctgtattggggacagccaaaaacatatttagcctaaaatacaccctcttctccaatagatgactaaaatttggttcccaaaaatttaaaatttttccacatcatcattagtgggcccttcccaactaattttctacctgctcgttaaaatcacaggcgagagcggagggggagatcgcgtcgcgcgtgagaggcgaggaggagatcgcggcgtgcggatgcggaggggaatgggcatggtcgacgcgacgcacgcggacggaaggagatggctgctcatcctagtcgcgcgcgagatcgcaactgataccgttggcgaggttatatatcagacgcagcgatatacgaaattgatcgaaggacacagtgctatagacgcacatagagctcttcctctgtcagcgccggcggcgttagcacttcactcaatcagagctcttcctctgtcagggccggcgacgttagcacctcacttaatcaggcaactgcagcaagcagcaacgattggtgacaggcacaagctcttgtgcagtgcgtgagtagcaaaattttgctagcaaccatgttttttactttgttctatttcctttttttatgtttctgatctgacaatgtcttgatggaaaaaaaaacttaatttgatatgatgaataaatatttggaaaaacggaaggccaatcacatttttttttaatttgatctgacaacgtcgcaaggggaaaaacttaatttattgtgatgaataatggtttggcagttgatttgatccaagatgagtcgacctcgctcctcgtttcaacagctcgtggatgaatcatcgtctgacgatgacgatgatttttttttgccacggcacaaatcgtccatagctattggcactctgtcaatgcaccaagacatggtgggtcagtcatgggacatgaagtgattgatcgcaacagagaagcacggcacttgagattataccaagactacttttccgataatcctacctatggcccagttttattcaggcgcaggtttgtataagtaaattttatataatttatttttgttatatgcatagatatgcatgtctcattagttatgattcgcaggaatagaatgagcaggcctctgtttctccgcataatgaatgcagtagaggatcacgatgactattttgtgcagaagagaaatgcagctggtttaattgggttcagttgtcaccaaaaggtcactgcagcaatgcgtcagttggcttatggtatagcagcagatgctttggatgaatatctcggtattgcagaaagtaccgctatagagagcctgagaaggtttgtgaaagcagttgtacaagtttttgaacatgaatacttaagatcacccaatgagaacgatacaactcgattacttgaacttggggaggacagaggtttccccggtatgttaggctccatagattgcatgcattggaagtggaagaactgccctacagaattgcacggtatgtaccaagggcacgtgcacgagcctacaataattttagaagccgttgcttcaaaggatctctggatttggcacgctttttttggtatgcctgggtctcataacgatatcaatgtacttcatcgatccccgctatttgcaaagctagctgaaggcaaggctcctgaagtgaactatagtataaatggacacgattatatgatgggatattatcttgctgatggcatatatccttcttgggccacatttgtgaagaccataccagaaccacatggcaacaagaggaaatattttgccaaagcacaggaagcagtaaggaaggatgtcgaacgagcttttggggttctgcaagctcgatttgccattgttcgagggccagctcgacattgggatgaaaagactctgggatacatcatgaaagcttgtgttatcatgcataacatgattattgaagatgagggagaagttgattgggaagaacggttcccagagggaggagaaaatgtcagagtgtcccacgatgaaatacctgatcttgataattttatccagatgcacaaaaaaataagggacgacgaaactcactatcagctacgtgaagacctagtggagcacttgtggcaacattatcttgataaatattgaggttttatttatatgtttgaattccatgtaataaatagtatacatatgtgaggatttgcaaaatcattttaatttgttcttcatgtattgaataaatggtgtactgttcggtttaagaatagtacaggagaattaataaaagtgcacttcctttatgcattttgttgaatatgtcggctggcagtgataaatgtgtcatgtggtcttcctgtcaatcatgaaaagccacagatgaggtagaggccccagaagcttttcaatcatgccaggaaacaatcaaacatcaggctctcagtgagagacaatacagattaccacaggtcaatagcaacatcaggctctcataaagtctgattcattacacagactaacaccaagggcatgataagggaagtacccatctactaacaccaacttcggacaaaacaaaaagacacaattctgaatataaatagtttgcattgcagacttagtaaacctagataaatttctaacaaaccactgatctaaactgcagctacgattgccatctctttccctcccattctctgatctggtcacaatttgttcagttgcttcttcacatgtacgaaggtctcagcgaggtggcttccctgttgatagcaataagatggagttcgaattaaccataatacatgtacagagtatagagctgccaagttttctagtctattttaattagtaatgtacaatatttgaagctacctatatgtttgtactgtaaacaataattgaagctagctagtactgcaagtgatttttttgactgatcactgtcgaaaatatggattcagtaacctatcattcaaactgaaattgaatatgcactcacatggatcagttgatcatgcagcaaggtatttgatcttcggctcttcggtctctgtaggttcattatcttcatcaacatgattggtagtatcatcatttgtgggtatagctttttccaaaccatctgtgcttgccttctgttttttggtggcatagggtttttgggatgttatttgcttcatcttatcatgccacttggattgtgacctcaagagagtccaacagtgcaggaattggaagggcttatcttccaactccttaaatacagcaatggcctgagcaatctgcacatgtcaagtcaagtgaatgtggttagcaaacatcatatcttttatttataaactaacataaaaacacaagctacataactatgtagtaccttgtcgtgtatactaaccccgctttgtcttctaccctcaatctggctcagatatccacaaaacttgttgacattctcttgtatagttttccaacgatgcataagtgaattctggctgcgatctggtgtggatttactcgttttgtataagtgctcgtatattctagtccaatatgcagcacgagtttgatttgtgcctagctctggatccaaacttacatgcaaccacgccgacacaagtatcttatcttcttgttcactaaaattcttcgatcttttttgatttgatctagccacggtagtcctctcaatagtggggaactgctgcgtgacaggctcgctactcatgccattctcatcaagctggttactcatatcatcctccacaggcatcgtactcaaactatcccaatctaaggaatcgttcccctcattcatcaaattagtatagaatccttcttcttccattatcagtaggacctacaagcaattatctccatcatgtatgttaaa

SEQ ID NO: 47585 - DNA, 6037 bp, Oryza sativa
ataaaatcttcagtagaatatgaaactagcatgtcccatttgtcttcttgaataaaatagttttagtacaattaagtggacttcaatagaactttagggtgagaagaatatggtctgttagcaacttgtgaagactattttggacatattcatctaagacttgtatcaacgaaaacaaagaaatacacataaggaccttgtcagtactaggatatcaatggggataatatcagtgagtcaacctcaattgaacacaaagagagttagatccatggagagaagcagaaaataaatgagttgttactctgaaattacctcaaacaaatccagtagcaactcacgtcgttgagaggcgaggtggacgaaggggcacagactgccgacggtccctggattgacagtcgatggtgacttggacggaggccgctagcgctctggacggaggggcggcagcgacctagatgggctgccggcggcgccctggacggagggccggcgacgccttggagaacctgcggcgtcccggacggacggacggctggcggcgccctgaacggagttggcgcgaggagaggaagctggtgcgaggaggggaagaaaggcgcggctcctcccggcgaacgaagagacggtggttgagggaaagcgcgggcgaggaaaaaaattggcgccaggaaaagaaaaaacggcgcgggcaggaacgattgcttcgattgggagcgcttctagttgcccaatatttggttcaggttggtcctggttttggaggtggctaaattttgggaccatgtttaggagtttgttggagggctgattttcaccaaattcctaaaatttatgttttagtaacctgtttagcattctcttggagatgccctaactgttggagtacgtatacatcacggtcagttgggccatgaagtgcaaaatccctaattggctaacgtgctagcgggccttaccaatttacgattttctattagagtaagtctacttgtactccctcaaatatatgtccattttgattcctatcccgtaacagtaataccagatatattgatccctccaactattaaaaccggtgtaacagaatcttgtatttgggtttaacttttgtaccttttgcattggagtgtgcgtttttgtattataatgtgtgcatctcttaattgtttgcagtcagttgttaaaatgtggcgaatggtttaaccttaagaagacaggagcgagtactctttaaccgcgttctggccggataatagttgtaatctcacatctctagatgtggatgtttttagtgagtaatatatctcttttttccaaaaacaaaagtggcgaatggttgaaccgaagcaatttcctgtctatgttatttctggcctgaacttgttttagcacaaagcataccatttatgggactttctgggacgtttaattatttaccatttttaagatgcgccaattaaagatttgtcacttgctatctatgacatgtgggtcctcatgtgtctatgatatgtgggtccactaacaaattctttagaaccacccataagagtggcaaatagttaattatgcccctgattcctcaatgagttaactctatggtttatcttggcatgtggattgaatgtttttaagctgtaggagtatttctttgttgtttcattaattacacaaaaaaatattgtcccattattactggccttattcagtaacatcttacataatgtttgctaaatatctgtttgatgtttttattagaaaataggataaacctggcttcacagctaacctgtttggtgttaaggcactacctccgtcccagaatataaggagttttagagttagacacagttatgaagaaaatatgtaaaattaaattgtggaagagattgtgattggtagggtgcgttcggtctgaccgaaaaattcggtctcggtcttcggtctttcggttatttcagtctttgaaaaatgaggaccgaatttcttcccaaaaaaactcaggaccgacaaattcagtctcggtctcggtctaaccgaattttgacagactggggactggctagagatggaggcggcgcgatggcggcgttgaggcagaggcaggctcgcggaggcagcgtgatggaggcggagggtggagacggcccgggcgcgatggaggttgaggatggactggcggaggcggcgcgatggaggcagagggtggaggcagcgccggcgtgatggaagtcgaggacggaccagcggaggcgccgctgaagccgccgtggacgagctgctgctgctactcaccgactgccttacctccgaccaaatctgggagagagaggggagggtagtggggacccactgcctcctccattgttgccgctgcaagcggcctcctccccactggccatatctggaagaggtagaggaggagaggagagttggggagccattgttggtgccccctctactgcttccgtcgtcgccgatctcctcccatcccgccactggatccgcctcccatcgccatcgcctttctcctgcaacactgccgatgccacctagatctaaccttcccataggtggtctggggtcgcgccaccaatctgcaacccctgagcggtcattgtcaccgttgccttcccgagctcccaccctcgtcgtggtcattgtcgagcttgttgccgctcttttgccaaggcgtgaggacggcgaggagcataagtgtgccaccaagaaagagatcgagagaggagggatttgcactggtgagagagagagagagagagagcgggggggggggggaggatgagattgagaaatgaatggtgagggatggcttgtatcacgacactttgaatatgctacagttgtcgaccgtgccatgctggtcgctagtttttgcaggcggtcccttaagtacaccacttgtaaaaatatccttattattccatgcaaccctctttaatctaccgtttgtcaaaatctattcttgcagacggggctaaaactagggcctctagttatttttacaagcgtaaattgttcttctgaaaaaaaaatcaaacctaggtgttgtgaaaaattgtttttctagtagtggaggtatgagatgatgtgtcactcatccggaagcttctcatagcaaatcaacatgaaagtgatgtacaactgttgttaagtggtggctataaaaataaaagggcaatttgggggtttcccatgggggtaaccttctgtattttgcctataaatatagagctaagtctagtgtttaataaggtgtatagcgagagaatctttgtgaggaaaaattgtgagaaactgagattggcttggtcaatgcaattttacttgtgatagttcaaattcacatttaatttttttgtccttgtttacccgaaaataataggagaaactcctattgtattttacactaaaagagataatatttacaagcatcacattcatatttcacaagcagcatatatctctccatgacttcagctaagcatgcatgctacaatttgttactatccataataaattgagtcgctgaagtaataacatttatctcgtgggacaactacatctgcaagcttcatggtaacctccgatctagatagacaaagaccgagcccaatcaaaatcgacaagaagcataaaaaactcaacaacaaacactagattgaatatgttgaatgctaaaaagaatctaataaacactagattgattatgttgaatgctaaaaagaatctaatgcaggaatccttcttctatcttcagttcaaataaggcagcacacaacttttattgaaaaaaaagaaatgcaaatataaaccaccagttagtgaatttgtttcaaaatctcatcatacaaagcagaaccacacaaacattctccaaaatatcaatccaccttctctagaatctcacatcccacattgtagttacataagcagaagtgttgtttcaatggtaccatttcaccatctaacataaagaactagagcatttttatacaagcaggtgttactgacaaatcatacaaaactaggtacgatgcttcctgaaaacactccctaaacaagacaactaaccagagaaagttatctatcaaaaagagctaccatgtgatgtcaaggttgttaaggagcatatttatctccttttaacaccgatggggagtcaatgtaaccctccctccgtggctacaatcttcctacagttgttgtcctccaagaagtattcaaagcatttcttctttaatgcaatgcaattgtacgtatcagcgcaccagagtggctgcaaatgattcatccgtcatcctttcccatagattctgggtgcaaatgagcttcaatatatccagagcaaacctatctgctgctgccaacaaactttcgaagaattcacttgtcgtctctcatagcagcaaggcgtcgatgtatatgaaatgcaatagtgctctgaacgtcgccagctccaggtcatccagcatgacgcacgggatggaactctttgccattccacaaaaaaaaaaaactctgcatggaacatcggggaacgcgcggcgagcacagcccggtgcgcatgaaacatctcgctgccaacagagaaggagatgtccgagccattggcgctgcccaccatgatgccgagttggttccccaggttggaaggtggcactgcaataggttcgttgtggttgcgcagaatgatgaggccacatatgaatgtaaccacatagcgagagtcaagttcactcagcttgacgaagcgccaccaggcatcaaagcggaagccctgggatgccttgcttaccagcagactcctctgggaatgttgcacggctggtaaaccatccttgcccatgaagaagatctcaaagatgaggtgggtgttggcgtcggtctcattcagcatcgccaccgcgagagagaggtactcgccattgtcttgttgacgcggagacagccaccacagaagacatgcattgtgctcccccgctgagattgttagctttggcagtctctatccgacagcgagcttctggatttctaggtattccaccttgtgctcgatgaaattggagacgagatccatcacacatggctgggtggggacgccgaaggctggggtgggagatcgggagatgaggatagtgacgggacagcgtcggaggctgggaatgcttctcgttggagagcgtaggagccgggggggggggcagccgtgcgagccgccgaagacgagggaggagaggtggggtggggaaatttcgctggagatgaagaagaggagtagcggaggaggtgggggttggggagtacggatggcctcgtcggcacggtgccggcggcgcgcgcgagggttgggggatggagcggccgcgatacacatgtgccgggtggaccacttgaacggctccgacgtgttcttcttcgtcggtggcgagacgttccatgcgcaccgggccctgcttgccgtgtgctcgccggtcttcaaggctctgctccttagctccacggcggaggcagcagcctgcagcatcaccctgaacgacatcaagccagcgatgttcgaagctttgctgcacttcatgtacaccggcgacttcctgccagcgggagcccactcgtcgtcgcctgacagcagcgacaccaacaccgacacgctccaccggctgctcgcggcggcgcacgagtataagctcgacaggctgaagctcatgtgcgcccgaaaactcgaggagagcttgtcggtggagacggtggcgaggacactgggctatgccaagatgtgcggctgctcggagttgaagagcaagtgtctcgacttacttcttcttggcgaagaagaacatcaaagcattggccacacatggctacttctggctctggcataacttcccttcggtcatccaagagattaaagtgttctggtcgcttgagcgtttacagatatagatagatactccctccgtcccaaaaaaaacccaacctaggatgggatgggacacattctagtacaatgtat

SEQ ID NO: 47586 - DNA, 13238 bp, Oryza sativa
tctcccatcccatcctaggttgggttttttttggatggagggagtacttgttaacatctcattcttatacaagaagccagagatcttcttgttctattttgggagtggatttttatccctcgaggggatatccctttgttgtttgcctgtcacccaaatagttataaatttgaaaaaaaaagaagatatattaacatgtgatatatcgctccacaaatatgcaaattcaaattcaatttctacacgaagttgaatttgaacttacatgcttgtagagtgatataccacattctaatacatcttctcaaattttttcaaattttttcataatcatttaggtgacatgcaaacaaggatgatatataatatacttcgttcctataaaagatctatcgttatagattctcctccacatctctgaacttcatgccatcacctttttttttttttggaaacccatgccatcaccttggacatgctgaaatcatacacctgttaccccgtaaacgcacagtaaactacacagaaatatacagtcggagcaatgcctgaatgccattttcagtaacacaaatacaaccaacgaatcacagaagaagaagaacagcaaggtgaccagcagctcattgatgttcaggacagcagagttgcagatgtacctcccggctgcacggggtgtctcgtagagcaggatgcggcagctcgcgacgtcgtccatgtggacgtacaccatcctcccgtacatggtgaatttcgttctcacctgcagtgcgatttcatggacattaagagtcagagacttgaaagcggagagcataaatgtagaagtgtttctgaaagattgcgctccattgaaatgcacgaatttcattcatatgaggtagttcatgatcagagaacattctctgcatttcgggtggtgttttgcgtaccatggaataggcctaggacgatatcggtggtagcggggcttaattcatggagaaaatcccctgtgtacacttaaaagttcacctaatcctttgtgtacccctgaattttgctcaatcccttacatacccctgaattttagtttggatcccttccataccctttccgctagttgaccgttagttgaccgttaaattcttatgaaaaagtccattttgccctttggtataaagaagcatataaattaatagagtatattgttggagaatagaaatttgttatatgagactattatgtttatgagatagttatgcaccatactatttgcgataaatatacttttaaatatgacataaaaaattaatacttatttattagttattaaaagatttttttagcatatgtgttctgaagtaataaacaaatctgttgtattactatgaaaacacatatgctacataaaagaacttttaataactaataaataagtatcaaatttttatatcatatgtaaaagtaaatttgtcacaaataatatggtgcatcacatactcataaatataatagtctcatccaataaatttttacatttcaacaatatacttcattaatttattatgtttcttcatagcaaagggcaaaatggacttttttaaaagaatttaacggtcaactaacggtcaactagcggaaagggcatggaagggatccaaactaaaattcaggggtatgtaagggattgagcaaaattcagaggtatagaagggattaggtgaactttcatggataaataggggattttctcttaattcatgacacaccaacataagtttggacacttcattcttaagacaaccaccaatcagttctcaaaataaatttattacccctatctctatatgtatacatctttctccttcttactacttgtaccataagtttattcactctctagtccctaaattgtttatcggttctcgccttttcggtgtttgaggatatgctaattggcttatcgaacctaggacaaatcgacgtgtgttcaccataacgggtttttttttcgagtgttcgttcgatgatatctatcttttttgcggcgatgggttttcagatgccgctgtgggttgcacgcaagatgtttaaggtgtggcggcataatttagtgtcaacaccctggtcattaggggagcctaatttatggcaaaaccatgatattcttttggagtaagagaaggcatataggcacaacacattatgagtgagtgtttgagtaaagatgattagaggtaaaacgatgtgggattaattaatttaaactaaaaatagattaataagtttttttaaagtaacttttgtatataattttctaaaaaaaagaccctttagaagttcagaaattgtgggcgtgaaaaacaagatattttccaatcttcttaaaatgatgctccctaggtagacgaattcataagacatgagttactgcacataatatacatcttggactgggcttcagcccatatgcaccaaagtctcaaatcccccaaattcgtagcaaattcggcattccaaattctaatttgaataatatgtaaactatttgagaaatacgttaatacggtactcgcgtagaaatactgcacatgatcgtcgtgctctactttacacgtctggatcgtttggcattttctaaacaaattctcgccgaaaagaggagagatcacgcagaaagttcatcctctaatccatccctttttctctccattctcttctctaatcctcctcttctcctcgctgcaacgcgacaaatcgaacagatcaacccaaattttgatcatcttaaaattctaaattgatctaagcagtggcatccattgctactcctcttcccactccaccctcttctcgtcttcgtcttcttccccgacacgtcacctcgccgccgatggagtcccacgacggcggcggcggcggcggcggcgatggggactcgctcttcgaggggatggtcctcttcaccccgtccctctccgtcgatcccgatcccgcgccgcccgtcgccgaggcccccgaccccaagccgcccacccctcgcgacgatgccgccgtcgccggagctgacggggcggcctcccagcagcagccgccgccgcctctggatgaggacctgttctccgatctcaccctcctgtccccgcagtcccccgtcgacctgagcggcgcccaccaaggtcaagatcaggaccactccgccgccgcgcccccctcgccggtgccggctccggctgcacccgtcgccgttctggcccggcaggcgtcctcctcggcctcctcgtcgctccgcaagaagaagagggccgtgcgcatcgggtatggccgctcgcctcaacccgcgcctccttcccctcctgccgttgcaattgctgctacgaccgccaccgcagctgctaccgctagtgtaatccatggcagcgtcctccccgatgcttcgatgcatcatcaatccgctccgaccatcccagtccaccacctcgaacaccttgataatggcgttgagcaggctgcagcggtagcggtggtggatccggatgagaattctcttcatgtgaaagaagaggatggtgaattggaggaggatggaggtgctggggctgaagcaatggggattgaggagagattggctcttcttagatcccaaatctccggcaagctcgagtctatccagcagagagccactgctgtggctgccaagaggaggcagttggctggtaggcggcgaaaggttgcggaggacgtgggctctgcggcatccaggcacaaggatttggagagggagcttgaagaggcgtgcgaggccgaggactttgagagggccgagaagatcagcgactcccttgcggcattggagaaggacaaggatcggttgttgacagcgctgcgtgatgcggagctcaattatgattcggtggatttggaattgcaggatgtgctggattcccgcattgccgcagaggaggaagctgcttcactcctggagcattttgcaaaggtaatttagctgaatttcttcttacgcactttgcatgagactctgaggtctggactcttgacaagatatgtacttcctggaatccaggctcccctgcaagcaaccattgcttggaaaccgataccaaacctgaagtttccctacttgaactctaatattttcaaatagctattcaagcatgacctaattctaagtgcttagtaatgaatcattgcagaatacattttaaacgcatggtccaataaggcaataaggcttcattttccagatatcctagtctatgctgaatattttggccactatgtcataaattcatttgcacagttgtcatattctcctacaaaagttgtcttgtggcattgcatctgatcatcatgaactatagactgtagtagtaagtacataaaaaactgaaaatgccgtgaaaagaaattttagcttaagtttgtaagttaaacctgagtgataaaaagcagccctgtatgcttcaaagtatcagtgcattgtgttctgttcttctagttgatattacttatcaacattaaaactctgttttttaggatgctactgatcacactgattcagcaagcaaggaggcagaagaaatatcattgaaagaaatagaagggtggcgagaatcaatggaattgctagaaacaaagaaactagagacggaagtagaaagtgaattggttttggcagcacgttcaggattggaagattcgatagaacatctggttgaagatgacaaaagagaaaaggacatgctgagtaagaaggggatacccttgcagaggagttaactgagctcctgaaattggtaaggttgaaagaagcagagatagctgaaaacaatgctcagatccaggaggttcaagaaaggatcactgccgttgtctccagattttatggatcccagacagatattgatctaaagctcaaaacccttcaggaagcacaaactaaaatggactcagaggctcaagcacttgccctaaaaaagaatgaaattgatagtttcatctccttatcagaacagaaagactcaaaattacgggaaattatcaatgattgttcctctgaagcaaaagcttgccagcagtcagtagatatcagaaggaagcttgcatcgtcaattttgaagtcaagggaggacagaattgggttgttaaaaatggaggaggaaattttgcaagatatccaagtgctcaggcaacaaacatcagatgcaagaatcagtcttcaggtacattaatcctttttcatgttgataaaaaagatcatcatgtttaatttttagaggacaccgtgtaagtaagaacacaaatatttttatgtacttattgagtttgatgacttgcaggagatatcttcaaggaaggctgtcattcagcaagatatagctacatttaagcagaaattgagctttattgacaaaaggggccctgaactagaggctgaaaagagagttgctgccgctgcaaggaatttcaaggaagctggaaggatagctgctgaggctaaagcgctttactctgaaaaggaagaacttcatgctaaacttgagaaagctgctactgatctggaggtaatcgaaaaggatatcacagctaccactgacaaaatacaggaatgcgaagggcttattatactcaaagaaaaagaatcagccatgacaagttacaaaagactcaggttggatgctgctgctgctagagcagaattgactgctgcaactgaaacagacgatagcgaagaggttgaggttctgcggaaagaagctgaagctgcagaatctaaagcaatggaactaaaaacatgctatgaccttgaactggacgacaacgaaatcatgtttcagcctgtagtccctatagtattcataaccaattcaacagggcagcacttgctagaaattgcgtcttctttcggtctatccccctagaagcaaacttcgacagtacttgcatgccaccatgcttgttacagtttgtagagttttgccagcgacagctgcctattgaagggaacatctgtgctgcaatcaaagcttatctccagatatacatgtcttcctcattgttcctccttacctcctagcatttgggatctactctaaatcgaggagaggttcctaggggacagccaagtgtataacatccattttgcgtactcaaactcttcagggagtttgtctccccctcatttttgtgtacattaagactgtaattcttttgttgttgtggtaattttggttgagctacagtaaatgccattcatccgaatgtaatcagtataagttatccatgaaataaactctcttctgcattgcacaactagtcacatcgagtcatcgagtatgtgttgaaagttagtcctagctaagaactgttttatagagttgttgcttcagcatgaagaagctgtgaacctcacaggccgttgtgaaatctatcctactctctacctgccaaatataatcaccaaaagggagtgacattttagtatactttttttttctgccttttgtactcctaatacatactttcacagttcatataaagatctcgagggtgaaatttcaggagcaattccagtttcagcttgggagaatggagaacactaccaagggcaaggtgtgtgtcactggggcttctggctatgttgcctcttggcttgtgaagcgacttcttgagtcagggtatcatgttcttgggacagtcagagacccaggtccatctttcattctgttctaattgagttcagtttacttgtttcatggtgatggatggacttgttaatttgagtttaaatttctgtttttggttactttggcaggcaatcacaagaaagtagggcacctgtggaatttaacaggtgcaaaggaaaggctggagcttgtgagagctgacctcttggaagaagggagctttgatgatgctgtgatggcttgtgagggtgtcttccatactgcatcacctgtcatcaccgaaactgactccagcaaggcatgctacactaactgtgaagaccactttcaccctgcaattatgcgactctcctttttatcttggaattcagatttaagatgccatctggttgtaggttttaacttttaacagatgtgatgctacttcatttgtaggcagcagtgcttgattcagcgataaacggcaccctgaacgttctgagatcatgcaagaagaacccatccctcaagagggtagtcctcacctcttcatcatcaaccgtgaggctcaaagatgaagctgatctgccacccaacgtgttgctggatgagacatcatggagctccatggagttctgcgagagtctccaggtgaacagagcacaatccgatatatacatttgcaggtttttggcattgtttcagctgctctgaacatctatctttgtacatagatatggtacgccattgccaagacacttgcagagaaggcagcctgggagttcgccaaggagaacggcatcgaccttgtggctgttcttccaaccttcgtggttggacccaatctgtctcatgaattaagtcccactaccaccgatgtcctcggcctattccaaggtacatgaaacgcaaccgtgaatacgaagaattttcttcgatttcagttagaatcatgaactgtctcatatgaaactcttgcatttcaacggagcgtaatctttcagaaacacttctacaaagacgctctctgcattcagtcctctgagtgaatgtccatgaaatcgcattgcaggtgagacaacgaagttcaccatgtacgggaggatggggtacgtccacatcgacgatgtcgcgagctgccacatcctgctctacgagacaccccgtgcagccgggaggtacatctgcaactcggctgtcctggacgtcaacgaactggtcaccttgctcgctaggcgattcccttcgtaccccatcccaaagaggtcaagaactccggcgaaatggaacttttttttttctgctgattgatcgattcattggtttgtgtctgtgtttctgaagatgacattgtcttgggatttctctgtagtttgccgtgcgtttacggggagcagacttatggtttcagcacggccaaggtgagggagctgggcatgaagttcagagatgtggaggagatgttcgacgacgccgtcgactcgctcagagctcacggctacctgctgaacagcgtaccatgacaattgacgacaaatttatcagaattcagaaattgggtatgccccgacgaagatgaagctgtagctagaatcatcagttgcacacaggaaaaatgtgtctctgtgtcagagaaggttgtgcgctactgaagaagtggagatgattatgtattatactccctccgtttcacaatataagtcattctattatttcccacattcatattgatgttaatgaaactacatctatttaagtttcattaacatcaatataaatgtgggaaatactagaatgacttacattgtgaaacggaggaagtagaagatttataacttgttgagaaaacgttaatcgtattgttcgtgtatccaaaacataaattttaaaaaaatattatctcgttcagattattgttagtggtgactattactccgtagtattttatttcgaccgcttgttagttaatgaggacgatgcacaaaatttcatactcgtgtctaagatacaatacacttagtaaacatgacatcttttaagtatttgcttttcttttcccaggagtagtcaaagttggatgatgactaattctgttgactgctacttaaaaatggatggagctatgtttaaaattaagaagatttaactgcaactactgtagtataatttttttttaaaaaaatatttttgaccagagggagggtttttttttttttgagagagtaatagggaggaggtttaaacatgaccaaaagcatgactcgctgatcgatctgagcccatgggccttatctcggcccaagattccgagacgtaatcaagcaggaggacaaagtcatagagataagccgtttttagcgcactcgcttgctcaggttcctcctcatcttcttctctcctcttatccccttcgccttcctcctccccgcctacacgaccagttcctggtttctgctgccttccctcggtctggatcaacaaggtgagtcccaatctttgacatcctgcctcacttccattcttgcacccaggtttgcttggatgatttctggtttcgttggcgacctgcactgcacctgttcgatgaattgccgcaatggatagtttcttgattgattgagtacgctagggtaccgtttgcactgagtgcactagatgtccgaacacacgctgagaaatttgagggatttttttatggttgttgagcagaggaggtcgtccaatggcgagtggtgggagcagcaatgccgggagcctgacgcagtggctgagggagaaggggttcgacgaggaggccatcgggcggatgtcgagacggtgcaagaaccttcacggccttgacgccggcgaggcctccggggtgtgggactacctcctgaacgtcgtcaagatcgagcggcggaagctccggtacgtggtcaccaagtgccccaaggtgctcaccctgtccgtcgacgacaagctcgtccccacggtgcagtgcctcaccacgctgcaggctaagcccggcgaggttgcgcaggccattgtcaagttcccccagatactgttccacagcgtggaggagaagctctgccctctcctcgccttcttccagacgcttggcatctctgagaagcagctcgccaagctgctcatggtcaacccgcgcctcatcagctacagcattgaggccaagttctcgcagaccgtcaacttcctcgttggccttggcattgacaaggagggtatgatcggcaagatcatggcaaaggagccctacatcatgggttacagtgttgacaagcgccttcgtcctactgccgagttcctcaagtcggcggtcgggcttgaggggtcaaatcttcagagggtgatcatgagttttcctgatattttgtcgcgagatgtcgataagattctgcggcccaatttggcgttcttacagagctgcggtttcagcaaggatcaggtcatggcattggtggctggataccctcctgttctcatcaagagtgtcaagcattgcctggagcctaggatgaagttccttgttgaagaaatggggcgggacatgggtgaggtggtggattacccccagttctttcgccatggtctcaagaggagcctggagtaccgccacaaggtgctcaagcagatgaattcaaggtgcagcctcagtgagatgcttgactgtaatcagaagaagtttgccatgaaatttggtttgcttgcagcagtttaggcatgcatcctctcttcagttcccatgtagcatgtttatttttcaggtgaaagtttttccttttgtactagcattttggacatcgagaattcaaagcattttgctttactgggtgttttctggaatgtcaagtgcaaatttgcctctttcagtgtcatgattaatgtataaccttgcatcaattcgcagaagagaaagcaatgcaaagcatatgaattttcttgtcggcatgctcttctcagttgaaatgcccaagtgagttgtaccactacagcagtaaggggaagacattactacagcattcctatccttggaagctatcacaatcacctatttacactacacatatacaccaatcatttgttatttgttcattacttacaagcacaattggggaaagtgggaaaacagtgcctactcagccaaactcctatgtatagtatatctgaaagatgatttgaaggggatccactcaacacacttgtctattcttctccgaagacattgtctgatttccttttgttgagcttcaggcatgatctcacatgccatctcaaccaagtcaggcaactcgagagcagcatccttcgcataatgatggagaactttaggtaggaagattgtctgctttctgactatgacactagcttgaatgaactcagtcctggcttgatccagttgatgattcactttcttggcagtgtacagcctcacctgcagaactttttacagtaagaatattgtgatcactttgcagacaaaattttagcatatctattctgcttacaggtggatctgaaattgctccagtggaaagagcaaaatgagcaagtggctctggaggatgaagagcatatggatgtatggagctccctgatgccgattttttcagtggagtaaatagagtccgtacccactgcatgtcaattattttgttagtttctttcctcaaatgtgtttgtctttgtattattggtggaaaatattgtgcaggtgtaaaccataccactgaagtgcgatgggattggcatccaataattgagttctggataatttgggcgtttactgaaagcccacccacattatatgcagcctgacaacagattgttcaagtatgtaagatatatcaaaacatttcaaatgatgacagtatcattgttcaaatttgatagttgtgtaccttcagaatcatgtctgtgtttttcatgcgtttctcctgaagtccataagccataaaagcctgttatatttcagaaaatactgcgggttaggtgtgcatgcattctgggtttaacactgaagtgtagaacatagcgaaggtgacaactgttgtcagtcataaaaaaaaaatgttatgactactatgcatacatgcatcaccaaagcgttgtggatgttgatccaaaaacagagctgctcttcatgtgccatttttgttgggtcaattttctcaagtcgttttatcagcgatctgagattaaaaaaaagtgaacataagtaaataaatagcatttcctgctttataggatttctttattgcagagttgcttacctgacagtctctagcattttagaggcatattcaaacttttctgcatccatatatatccttgggcatattatcatcccattgtattgttcacttttctcattcaatgaatcatatttgtcagagcttgtgttgacattgtaatggcatcggggactccaactatcaacacggtgctttaaagaaaatgtacttgatgaagaggagaatgaaggagttgataaagtctcaaaatccgccaaattttgtgatggctggcttgcaagtttgcagtatactgcagaaatgcatcttacgatgtcctccgaaagtttgcaagagatctttggcacatattcagcgattgaagcactcaagaaatttgcaaggctagaatgtcctgaagatgatctcgacagcccctgtgaaaaacatgaaagatagattttctcagtttgagagattttgacagaaaaccatatgtttgtgcctgagctaaaacctgtactttgaagaggaaaaagatataactgaaactggcacaaactggtaagttttatcagaagaactaaaagaagagattgttcatacatgtttagaatctgaaactgttgatactgttggcaagttgtaggatgctgactccttgatatttctcaatcggagggcaccttcatcagctttctttctgcttttctgatggtgtatttcttgatccacctgatcatgattgtaaacctaaatatactgtatactctctgaatttatgtgcagtatagttctgaaaattgatccatccaaggtgcaaggcatgtacctgggtagaaacacgaggggatacacctaggtgttgatcaaatgctgccctgtagagggaaagcaaatgcagttccttgcgaacaacttcctcctcaagggctgctatctcccaaactaagtctgcaatagactgcaggaaccacaaggtcagtgatcagatatcgataactaaatgtttataatttcatttgccttttcacttcgttttgaattttaaagttggaacactgttttcagagtatcattattatggcacatgatctttgttactattcttaaggcctcaagttattttgaaaaaaagcaagatgattagaacaaaagtacgggtataaaacctgaactgaacagcttttcttcagcttttggaaacaaataggaccttgagatcatgaaatactatgcaacttatgaggatgtggagcaaacctttgatatggttttctcactttgttctgcacttgtaatcacgtgatgctcaggcaaatgctctgccagg

SEQ ID NO: 47587 - DNA, 1556 bp, Oryza sativa
cgttgctattcttcttcacgctcacaataaagggggattttgctgtttctagaagagcaactttcaacatcatttacagtaacatgtctcacggtctcacctgacagtttgtcaagtgagttggtgtagaaaatgacacagcaccgcaacacagaaaaaaaagggaggcttgatgcagcaaaatgctgctgcctctgaattatgatgcaaccaaatggtgatgaacaatatattggacattgataaaaacgattagagttgccctgcttatctatacattaatcgattctgctttcttctagctgctattatctcgcaaatgctttctgcaaaaattgtaagagcctagaagaacaaaatttatcagcagcctgctgaaaagattgtgtatgcttgctaaccttctcgagtgacattgctgcagataagaagatgaatggctagctcttggtgtttctgcacaacaaatggttgtttccatgaacacctctgatgctgcgtcttccatggattcctagaccttcagtcaccaagaacctaccaccaatcaagagcaagaaagtattgcaatcctattcagttctccataactagctgaagagaaggagaagaataatccaattaccgaaactaatgaacttaccaggctgatatatcatgagctgttgctatgcagtgtagctagcaatgagcagaacagaagaagaaggccatgattcagcttggtctggatgatgagaaatcttcactctctctcccaactccaatcccccagcttctacagaactcagcaaagggtctgaagaacagaaggaaatgcaaattctccttggtactagagtagagacaagaataatgaagaacagcagaaatgatgggcaggagatgtcctggactcctggttgccagtactacttctccaacctatgctgatagataataatggccaggaagctgatatttaagactggatgagaagagtaggattaatagcaagaagaggtggtgacccacaaggccaaagaagcaaaggaaagcaaatgaaacctgcatgaagatatggtcaggaaaaggatgaccaaagaaagcagagtttaaaaggaagcaaagcaaaaaagaaaagaaaaatcgatcaatggcatcaagtgtgtcgtccctctgtccctcccagctgcttgcctattttcctccattaaaagaacaaagaaagccgagctgctatcaataatggcgtggtggcgataatgatggcttagtgctgatgaaatcgcagcgctgctctacagaaaaaatcaaaaaggatatgagaacaagtactttctcctccgtttcacaatgtaagtcattctagtatttcccatatttatattgatgttaatgaatctagacataatgtggaaaatgctaaaatgacttacattatgaaacggagggagtagtagagattactagtaggtggctgcacgagcagatgagaattaggttgcccgttgctaccatcttggcctccttcttggtccatttgagcaaataaagccacaaccaccacaacaact

SEQ ID NO: 47588 - DNA, 31640 bp, Oryza sativa
cgaaagagctggaaaagggggcaatcaaaatggcttagactatgggtacgtactgcatgcagtactgtatacatagctggtcctgcagtatatgagatgccgtcctatgataacaaatactctctctttcccaaaatataaacatttttaaaatagtgacaagttaaaccttttaaattttgactataaatagcaaaagaaatttaaaagattaatcgtataaatttaatgttactatatttatcattaaacaaattatcataatatacaactctttatttaaaatattttactttagtagatattgttggttaaagtagtatttcggagaatatgtcgagacaaaaaaaaatacttatattttgggtagagggagtaagttttttttttagggtatgttgattggttattatgctcttaaaaaacatagcattgaccatcgaatacttacaagtaggtttctgcttctgtaaactttcttttaaaggaataaacattactctgctcctatatgaatcttaaagcacatgtcgggtttaggtagagtaactaacctggattaaactaaaacaatcaaactatcaaaggaagattcccctaatgcagtcttcaatatattcatgtgcaattgttttcttaaaaaccacatcattcttgcataaccgaagtcaaagtggtcagtaaataatagcagctcctaataggacatgcattttgtttatgttcgtatacgtagtaagcctgttccaattattaatagaccactgccctgtttatgctattgtaacaagcaaatggtaagtatccaattggtgaaattttggaaaagatagttttctttagtttctagcttctatgcttattaatttctaaattctacacctactaaatcttaaaatgtggtgcgagaattttttttaaaaaccgaagccagcttaagttggaattatattaaggaggagagaaagtattaaccttaacaatatcaccaagaaatgtgaaagaaatcagaggaggcgaggaaaaaaaacacaaattagaactacacactaaacaaaaacttaagcggatattctcgcgatgtcttttgctctacacatgctacatagcttaatttcgtcttatattttggtaagtagctgcgacatggttttttcttgacttggtgcaagaatttggacgtttcagaagtgttgtatattcttaaatttgttgcggctatttttttaataaaaaacagtagaataggctagctcctaattattgcagctaccaaaagctcttcaaccagattctgtgacggtgcccattaaattaaacttaactaaattaagaagaagcaggcatagacgggatcgaattacagggatgcatggggggccaaaagagcagatggatgggacggagtgagctactactactaatcaacttgaggagggtaaaggcagcaatcgagcgaaagccgaaagccgaaagatcagcagcggccagcaaggcagcaccagcagcagctgctgctaaaagccgggaagcgagcagcgccttctccttcgaggagtccaagaaagagcccaaaagccgcaacggcaacggcaaaacgcgatgaaaccaacggtgcgcgcgcacgagcgagtcgtcctgcatttctgatctgcgccggcgctggaggggctggatcgacctgcgacactttacagcgcatgcagagacgacggcagaagcagcctcttcgcatcgcttgcttttcgccaacaaccacgacgatgataacaacaacatcagcggctagcagcaacgtgtcaattgttttttttctttaaagaaacacagtacaaacgaagatgctcataacacacgtatattcaatcttgtaaacacacgtatacaaaattattgttacggaattatggacatgttgttttcagggggcaatccccttcggttcgatcatgtctgcaccgctgcatcaatgagatggcgctttggacggagaatctgaaaattgagggtcggaatgtaatctctacttgtaaaaacatcttctcctcccctctaagatctctaaatatgatgtaatgaaaccttttcgtttctaatgtcataacatgatttaccccccccccccctccttctggtgacttagtaaaaaaaaacatatgtataccctgcctctctagacaccttcgaaagatttggaccggcacatttaatctatagtgctacagctttcgtactcgatctactaggcacttggcttctccatgatcacaaggcatcatcggtgcatcgccatcagaatcatctccgaattgaccaccactgcagcgcattaggcaccattctctacagtgcacacgaaatcgaccaccactacaccaccctaagaaagaaaaggaaaaaagaaaactcaagtatgtatcatctaattaatgtgtgtaggtgcatccgttcatgcatgtacagtgcacgacggcacacggcattatcagagaaattatacgggtgcagtgcagcagagatatgcaaagtgttactgtcatatgatggagctagagtatatgggcctgtttgaggagctttaaattctgagaagtagttgtttgttagtcagcttctgagaatctggaaaagctcttaaacccagcttctctagcttatggcttcttagtttatttttcaaaatctgtaactatatattctcagaagctgtgaactgtttggggcagcatctagcagaagccgcttttgagaaaagctacagctgagacatgctccctcaaacagggctatatatcgatggaagaaagggtcacgggcacaaaatatagggtgataggcacgcaccaccgaatggatggacggacgcgtgcgtgcgagcgagaggcggtcgcccgtccatcggtttctccgagtttgttaatagcagccgatcgacgagacgacgacgcgccaaaggcccaaaccgcatgtgacccctggggcacacacatgacacaaggacgcgtgcttggtacggtgaattggtgatcatcgcgtcgtctcgtcatcaactaacaaaaaacctggcatcacgtgactgtgcgaagcaactttttgggaggatcacattagttctttttttctttcttgaaagaaaagagggggtcatatgattgaagaactggagcattcgttaatttcgaaagtgtgtagaagaacgcatatacatgaaataatcgatcgtgtacgtggctgcactgaatgtctgcagttaatttgctgagcccacggtcaaattaactcgcgaacacgcatgcgtgcgtgcacaatgtgcagcttatgcgcgcattcatggtgcttgtgcatatttctgggcgagaggaagcaacggtaatcagtgtacgcgtgtggttcatgatgagccatgcacgcacgcacgcattcatagtcacagtcccacgccgtcggccgcgcgcgcgtgccggcggttgtcggtggcgggtggggaagggaagggaaggcaacgtgactgacgaccaaatcaccgaacgatgagtctttttttttcgcgaacgtaaaaggattacatgtcaatatattagcaccgaaaaatgagtcaccaaccaaacaattggggaggatcgtacggtcattgccgttgttgcctcacacatgtggagggaggggaagtcgcagccaccatcacccggaaacactaatgcgcgatcaatcgctaccgcgatggggtaacgatcaccacccctccccccctccctccctccacgttttcttttttggcaccgcattacttttctattttagtaaatttacacacctaaagtttatacgcctaaagtttatatacccaaaatttataaatcaaaagtttatatatccgattcaaatttaaatttgaattcaaatattttttatagtatttctatacatctaaagtttatacacctaaagttgtagacccaaagtttataaatcaaaagtttatatacccgacttcaaatttgaatcgggtatataaactttaggtctataaattttaggtgtataaactttagatgtatagaaatactatatataaaaaaaaaatttgaattcaaattcaaatttgaatcggatatataaacttttgacttataaatttttggtctctaaactttagatgtgtaaacttgaggtgtataaatttactaaaataggaaagtaatgcggtgccaaaaatgaaaaccaggtggagggagggagggggaggagggggggggctaccgatcgctaccagatcggtagggcgatcgatcgcccattagaactaggaataagtctatttttcctccctcatctattgcccttggtcgaaaaacatccctcaaacgcaaaaccggatataacacctcccccatcttcgaaaaccggtgcaaatcgacttcttgagtggttttgagtggtttaggctgatgtggcaggttgacttgattcaaatgtgctgatgtggcagccaggtcatcaaagggattaaaaatagaagtgggtcccacgtgtaagtgacaaatgctaaaataaaacaaatggtggggcccactcgtcagccccattttttcttatcttcttcctccctcctctctctttctcgcagccgcacgcgcggaggccaattcggccgcgcggcggcgcccttctcatcccagtgagcttctccttcgcgcccagccggccgcagcctcccggcgagctcctccaacacacgcgactagccgtggcctcccggcgagctcctcccccgtgcccggctggccgcggcctgtcacgcccagaaatttagcccaaatttccagactattttgtgtattaaatccctgtccaggaccagccagggtacacaaaacgacaagtaatatacagttccaaacgtaaataaagcgtaaaatacttacaaaagaggcacttagtcctcgcaccgaaacgaaaacagcagcagcggaaaaaggcgatcctagcggggcttcagctccactccacaggcaaaactcaactggggtctgagccttggtcctctaacttcgtcttcagctcagaagcactacacttctgaaaagggggaataatagcaagactgagtacaaccaccgtactcagcaagccacaccaacgatgcagacgtgcaaggggaacacaaggacggtttgtggctatttgcataaaggcggttgtaaaacattttattgagcaaaacagtaaaactgttgagtaattaaagtaacattaaatctccactgatcaacgctacaccacgttgaacaggcccaaccaacccacctaaactacagtgtattaggtcgatttattaagtgtgagactaatcacggtgaatctggtcgaccgcccataaccgcgggcacggctattcgaatagttttactctgatcagaggtgtacaactgtacccacaagacacagccccacgacacgttcccgtgcgccgacatgccaccacgacataccggaaagaggccgtgacaggacccttcgcataaccccctctaaccgatcgcaccacaccttagggttcgcccccgtccccagcaggcaacgggcagcccccctttcgtgccgcggtgaatccggaagccgatcaaccggacaccccggccgacccaactccatcacgcccaccctcgcctgggtacgtcggctagagaaaagctacactacaagcccagccgttgcccacgctggcttgtggtaagtacgataagttcttccagggcatcccgcgaaccggtccttaactgccatgggtgcgaccagcaaaaccatgcacccacagcccaccattcagtcgcattttagttggataattacgaccatgaagcatggccaggtgtctcgagcacgcagctcactctgatactaaaaaggtctaatactgcaattatcccatcaactgagctagtggtaattaagcatggctaagcatatagttctagctaggtcacataagtaacatgagctagtcgattcattacccaaggttgacaaagaacagatatcaagtaaacatggcacaagcgagcagataggtaaaaccctgaccccatgtaattagcaaaacatgcatatttgtttgcaaacagtaaaacatttgtaaattgggatcaacatgctcaaggggaatgtgtgacttgccttgcttcttcacttggatcttctgaactcttatccttgcgaacgcgatcttccgaaacgatgggaactacacgctggcatgcaaaacgaggaaaaactctaataaaaaccaagaaaacagtacataaaaagtaaaccaacatgtagagctcaattttagatgaattttgcaagttgaatggctcaattcgtaattcgaatgaattagatatgaattttagaagttttgggccatttaaatgaatttttagaattaaacacgatttattgcgcaattattaaatattttctcaaaggaaatggcattcgctgacgtcagcaaggggcgccgacgccgacaggtgggcccaacacgtcagcgggtcaaggaggtgcgggcttggaccgggtccaccaaatgagcgggccccacgcgtcagcgggcaaaaggatctagcccaccgtggaccgagtccacggtagaggtgcaaggcggaggggtgggttggctcgccgaccaacccgaccagacggcggcgcgcggccggacggccaccggcggcgacaccggcggcggcgcggcgcggcgcgacggcgacacgcatgcggcggccggcgggcaaagagagaaaaagaaagggaggggaggaggagggagatgctcaccgacgcgggaaggacgacgacgacaacggtgatggcggcgtcggcccgacgagcgagggggcggccggggagcggcgaaaacgagcggaggaggcgaaaagggaggcggcggagctcaccgaggggcatggcggcgaaggaggcggctgatggggctcgagcagagggaggcggcagcactccacggggcgaagacgacggcggtgattcggcggtctccaacgaaggtggaagagcggccggggtaccacgcgatgcagcgaagccgacggtggtagggcgcggcttggcagtggctggagcggcgaggagcggcggccggagctcgtcggtgagtggtggagagagggagcgcggtggggaggtggttccggcgatgaaatgggaaaacggagtggggccgaggtgcggcaaggcacggcgaagccggtggtgcaagcgccgcggcgcggggacgtcgacagtggcggcagcggccggctggagggtcgccggcgatcggcggcgcttgggctcgtgtggggagagcgggagagagcgcggggagtgcgggaaagttggggaaaagggagaggatggccgggggattgtttttataggggaggggaggcgggatcgagcccgggagaggcggagtcggggcggcaaccgccggtggcgtgggcggcatcgtggggtgtgggtggcggttttggaggggagaggtggggggaaacggcgcggacgtgggcggcgaggtcccacggacgagcgcgcgcgcggggtggaggaggtgggcggaaacggccgcgtcgtggggcggctcgggcggccatggcagcaacggcagctgccggcctgaggttggggatgacaggtggggtccacgggttccatctgtcggagagagagggagggagaggccggctggggaggcaaaacagacttgagggagagagagagagccgagcgggccgagggagaaggccggcccgagagggagataggggggaattgggccgaaaggggcccaaagagaggagggaggattttattttttttctttttattttaattgatgcaatgatctttgtgctattaaaactatttctcgagctccgaaaattcacggaaaattccggagagtacattagggcacaaagaatattacaaaatatttccggccaatgatttttaaaggaaaatttcaaattctcccattatttcacttgattaaattgatttaacttttatttaatttctagaaaatgtattattaattgatttttattcccgaacgaaaatcggggcgttgcctcccggcgagctcctcccccgctcccggtcggctgcgacctcccggcgagctcctccctcgtgcccgcccggccacgacctcccggctgcaacgccatcttctccacgagaccatggagccccgttgctcacgtcgcccatcggggacgaagatggccatggagcccgtcggtcccgccgcccagtggctcctgccgctccgccgggctcccgcggtctcgccgcctagcggctcctgccgcccccgccgccccgccgctcccatcgctccgccaggctcccgcggtctcgccgccccgtcgctcctgccgctcccgccgagctcccgccgtcccgtcgctcgcgccatctggtcggatgggaggtggttcattcgttcatggacgtcttccatgtcaccgaccgcctcggttgcaagctcaccaacgacagcgtcatcacctacatcgagcaggttggtgggttttcttggtggtttcttgattctggcacgagtgttcgacggagttgggattttctgatggcatacatggcttctttgcagtctctggggatgtggaacgggccaacgcggccgatggcgctcgaggggttgacggcgctggagctgacaggggccgaccggacggggctcatctcggaggtgttcgtcgtgctcgccgacatggactgtggcgttgtggagggccgcacgtggacgcaccgcgtccacctcggctgcctcatcttcctccgcgacgaggaaaccgacaccgagaggatggcatgaatcgaggccgcctcggacacctcctccgcggcgactccagcagcgccggtggcggcgctgtggccgctgtccccacccccgccgtcacgcacgccgagcgccgcctccacgttggacaaaaccacctccgaaaccaccgagggagatgatttgctctggtttttagagaagaaggaggtgttatacccggtttgttatacccggttttccgattgagggatgttattcacacaagcgcaggagatgagggaggtaaaatggacctattccttagaactacccaccatcaccgccaattccaccgtgcggccgtgcctgatccaccaatcttcgctgcctgacacgcccatcgacggcccaggctgtctgtccgtcacttcacattcggcccagtttctgtcactcccgttcggctaagcccatgcaaaatggcccggcgttacaggggcctagtacgtgctgatgaccaagtaatttgagccaggggtttgcagtattgatgaactcaaaaaagggccttaaattccattactctatccattcaaaatggtataacaaagcacaagaggattaaggtgcaatagggtaggatgtctttgtggtgtctctatacgggtgagtatacgcatgtgtatacgagagtctttgtcgcaaagagaaaagtaaaattattgttgctacttacccttgtcccaaaataaatggatgcgtagcatataaaaaacaatattgtggagaaaaaccaaaatgctcctaattattggaaagttgtattggacctcgttcagatgggatgatatatctgagatatctcctgctatctagtaggtattagctgatatctagatatcacgtgatatctctaaggtatcatttcgtccaaacaagatatcgccctataacacttttattttttttttcctttcgaccgtgattaacgcttcatgtgaggaggccatgtgaggtatgtcgcggaaaggccgtggggagccaagacccaatctctcacggcctgctagctgccaggcccatccaaacacttgtataccccagctagatacctatttagaaaaagaacggaaaggaaaaagtctactttaacttttttaaaagtacgccgaatctaattcgtaccctttaagcagaaaaccgggtaggatgactccctcaactattaaaactggtataatttgactccctcagcgattttggagggcggtttcgttgacgtggcattttgacttggtccaaccggctgactcagcatgtgggacccacatgtcaatgtcacattttcctcttctctatttcttttctcattttcccctctttttctccatggtgttgggcggtggctggcggcgacgtcttctctgcacccgtgtcgctgccactggtggagtacgccgagcgcgccacacgggacggcgtatccgtgaatttcaacgcactgcagctcatcggtgatggcgggagaggaggtaaccttcgtgtcggagtgaggcggcgccgggagggggggcgggggctgttcctgtgtcggccggggtccgagcgggctgagccgctgccgacggtggggagactgttccatgaccgcccctcggcagctgcagggcgtttgggtgtaccgcaccaccgcttcgtctccaagccaacccgccgcagctccccctctaggccaggccaccgccactccgctcaagaccggggcaacgctgcgcgtcaggaggtctagccaccgcttcgcctcgaggccacagcatcgattcgccttgggccatgtcgttgctccgcttccgagccaggttgccgcctgtcatgcccagaaattcacgaaccataatttctaagctgaatgtgcattaaacccctgtccaggaccagccagggtacacaaacgacaattgttgacatacagatccacgtcttacaaaaatataaaagattacagatgcagcggaaaagataaaagcgagataagcctaaagacttgactcctgtagcggggcgattccattccacaagcatccttgacggcagcgacgaaaccaacttcttcgagacatttccaactgagaagaacttcaactctggtgtgggggaaaagagagcaagactgaataccacccactgtactcagcaagtcgtaccggaagaggaggtatgatgcaggatatatccaaaggaggctaaaggtccttttgcataaagctagcatttaaaagcagtagttgaaagcagtaaaacagttgcagtaattaatcaatgttaaccaatcaatgtccaacgctacactacgttgtaacaggcccaaccaaccacctgaactacaccagttcattagctaactaggggtgggactaatcacggtgaatctggtcgaccgcccataaccgcgggcacagctattcgaatagttttactctgatcagaggtgtacaattgtacccacaagacacagccccacgacacgtttccgtgcgccgacatgccactacgacataccggaaagaggccgtgacaggacccttcgcataaccccctctaaccgatcgcaccacacctcagggttcgcccccgttcccagcaggcaacgggcagccccccctcgtgccgcggtgaatccggaagccgatcaaccggacaccccggccgacccaactccatcacgcccaccctcgcctgggtacgtcggctaaaggaaagctacactacaagcccagccgttgcccacgctggcttgtggtaagtacggtaagttcttccagggcatcccgcgaaccggtccttaatcgccatgggcacgactagcaaaaccatgcacccacagcccaccatgtagtgtattttaattaaccaacaccattgcggtggcactaatccaaagctatgccaataatcaaagtctatgctttaatgtaatcccccttttgtgtactagttgaactaagcatggctaagcatttcctaaaccaacatctagtcattttaatacccaagttatcaatggcataaggtaaacaatatatggctgagtaatagggcccatcccacatgatattgtaaaatagtgcaacatttaatagaaatgcgggacatttgtaaattgggtataatatgatcaattgtaatgcatgacttgccttgctcttgcactgatgagaccacaacaacgtcttcgaggaatcgcggatcgacgaaacggccgaaatctatgcgacaaacaaagcacacaagcaaaacatgctataagtccactgaaacaggaaacaaaaccatttttaatggattctatgcatttttatgaatttactgagacttgaatggacttaatcggagctcggataaattagatatgaattttagaagattatctgtgtttttactaataaagaaaaagccttaatgtatttattgcgcaatatgtcccagggctgacgtcacccaagggagggggtggtgccgacatgcgggccccacgggccagcggcacaaagagagggagagggggtggttggctggcgggccccactggcagtggcacaaggcgggagggcgcgtggctggtggctcggctcggctttaaagcctgccggccaagcgtggcgagcggcggcggcacgcgcggtcaccggctacggcaaccggcggcaaccgatggcaagcggcggcgcgcgacggcaccaccgctagcggcggcaccgcagcggcacggcaccacgacgcgacggcggcgcgcaagcggtgagcggcggtgagagaggagaggaaggggagggcctcaccgacgatgaacgaggggggcgagcaacggacctagggaacatgatgagagaggttagagggagagagggagtccagggcgcatggcatagccggccggaggcgatggtaatggagatgctcaccggcgcttggggagaagcgggctccggcggtggacttcgacggaggagggatggactaggtagcccttgacctcatgaggccaacggcggcaatggagtggcgcggcgacggcactagcgacggctagcggcggttggagacagcggtaggcggcggcgcgtgggagcggcagtatggcagcaacacgtggcaagtgagcagtggctgagatagcccccgtagcggcgaagctagcggcggcgagcgcacgccggcgcttggggagaagcgggctccggcggcggacttcgacagaggagggatggactaggtagcccttgacctcacgaggccaacggcggcaatggagtggcgcggcgacggcactagcgacggctagcggcggttggagatagcggtaggcggcggcgcgtgggagcggcagtatggcagcagcacgtggcaagcgagcagtggctgagatagcccccgcagcggcgaagctagcggcggcgagcgcacggcgtggtgatggctttagcaacggcggcgtgcgaccggagctcggcggcgagtggcggcactagcagcgaacggcgcggcggcgttagagagcgtgggagagcgcggcgaaaaggggaaatgggagaggaggacgtgtggttgctttttatatgcgcggggagggcggacacggctgggaggtggccggatttctcgccgacgtcggggatggagagagagagtggggggattcgaattaaatcccgcccttgcaggcgcacgcgcgtgggcgggagaaggcggggcgtgggggcggcgacgtgggggcgtggagcgcggagtgggcgcgggaggagcgggggaagcggtggcgtggggaggtgggggcgccggcagttggagctcggctccaatcggctggaggtaggggaagggctgacaggcgggccccacctgtcagtgcctgagagggagagggaggccgggtgaacttcaggagagggagggaggagcgggccggcgcgggaagaaatgggccggcggcccaagaaggaaaaaggagggaaaaagaaaacagaaaagggaaaaaggattttctcagggattaaatattgcactttgcttattttaattggttaaaattatttccaaggctttgaaattttcactaaaaatcctgttagcatattttgacatgtagaatccaagaaaaaatccacatgccgattccgattattatttacatttattaatttgatgaattagctctaggttaaattaaatcatttcttcggacgatttattttatgaattttaaagcaaggaggggaacttcagggcgtgacaccgccgctctgtttgatggcgggcctgctcctcgtccctgctcatctgcagctgtacctaggtggtccaagctagagggagtcggtggcatgccaccaccgccgctgccttctcatcgtcgtcatcctcgcctcgagcctcggcttcgggtcatcggcgcgcttgctgctgccgctgttgtggtcgtcgccgccgccaccacctacgagggagatcggcatcgcatcgcggatgagtggtgaaagcctgaaaatgggagatgggattcgagaggcgaggcgcacaccgggagggttcttctgcttcctagtctctgcctccatcaccgtctcccgcaatgacgatcctgtgatgtccgtcccatgtggcggtgctcggcgtactccaccagtggcagtggcacgggaggtcgggcgcagaaaagacgtcgctgccaggcgctagccaccgtgcaacgccctgaagaaagagaggggaaaacgagaaaagaaagagagaagaggaaaatgtgacattgacatgtggggtccatatgctgagtcagccggttggaccgggtcaaagcgccacgtcaacaaaaccgtccttcaaaaccactgagggagtcaaattataatggttttaatagttgagggagtcatcctaccctgttttctaattaaagggtactccctccatttcacaatgtaaatcattctaccatttcccatattcgtattgatgttaataaatctatataaatacacatgtctagattcattaacatcaatataaatgtgggaaatactagaatgacttacattgtgaaacagatgaagtacgaattagattcggcatactttaagggagttaaagtggacttttcctttccgctttctccgatggaggatctatcgcgacgcgaattcttcgcccatctcttcgtgccacacgtcgaaaaattgaaggaccaacgtttgaaccaatcagcaggcgctagaagcccgaattaaatttgaaaatatactttgattcgtttatttctcaaaaatattcggaatgcaaatttattagcagaaatataccgtcgatctcacacaattatttcacgaaagtgacgtgggagtgatgttgtgaacagtctcgcgtgaggagagcgcgagaccgcacggtatcgcatgatcatagcacgagaccgctcggtctcgcacgacgaaatcgaggacgtacacggcggcggcgtcagaccacgcggtctcgcgcggccaaaccgcgagaccgagcagtctcgctcagcgatagcgactgcctctgccgattgaataaggttaattagtgattaattaatcgctaattggaataattaatcactaattattgttaattaatcattaattatggtaattaatgactaattaagcagctccgttggacatgacattcggtctcgctgatttcttatgcgagactgttcggtctcgctgcttcatcacgcgataccgtgcggtctcgtgctcctactgtgtgacactggtatattttcgctaaaaagtatacatcacgaatatttctgcgaaaaaaccaaatcaatagtatatttttaaatttaattcctagaagccccaactttagatttttagatttatgcacacgatgcacgagtgcaattactatattacgttcaatcgagaataagcgaaactgtagcaccagatatgattctgttataccttcatggatagtacgtgcttaggctgaatgcttgtgttgagagctcactactagtttcaaattatctatagtcaatgtaatagccaattcatacgatagttgcttactatactattaatatatggtccacatatcatacacccattgcgtcttggagtccgtgctacagctggctacagatctgtagcccgctacttttctatatcttcttttatctctttaaaatatgtttatagctggcttatagcctgctattgtacatgctctgattggtatatagacacatgatgctcccatgcttgtgcagttgtgtaagcagtcgatcgagcaaagcgtacgtgtaagcagccatggctcaattgggtcaactcgacgccgagagcaacgtcgtcgtcgcccctaccgctaccggagacgagggagccgacatcgtcctcgcgtcgcttccgactagggaaggatggtggacggcgttcgtcctctaccacggctgctggatgacgccgcaggccgcgacgagcgtgtcgctggtgcgcgcccagttcgcgccgcgccccgacgacgtgctcctcgccacctacccaaagtgcggcaccacctggctcaaggcgctctccttcgacatcgccaaccgctcccgccaccccgtcgccggcgccggcgaccacccgctgctcacgacccacccgcaggacctcgtgccgttcatcgagacgccattccgccacctccaccctctctctgccctcgacgcgctcccgtcaccgaggcttctctccacccacctgccgcaccagctcctccccccgcgtgtcgccgagctcggctgccgcatcgtctacctctgccgggagcccaaggacgtcgtcgtctccacatggcacttcatgaacaaggtaggcaatggcttcttcctcgacctcgacgaggccttcgagctgttcgtcgatggctgttccctctacgggccgatctgggatcactgcctacacggtgctcttcctcaagtacgacgacatgatggccgacccggccggccacgtcaagaaactcgccgagttcctccgcgtcccgttcactgacgaggaggtcggcaccggcgtcgtcgtggaggttgtgaggctgtgcagcttcgagaagctgagccgcctgccggtgaacttctccggggtggttgatcggatcggcggacgaccgatggagaactcgtcgttttttaggaaggcgaaggttggagactggaagaacaacttgactcaagagatggcgcagaagcttgatgccgttattgcggagaagctgaaaggatctggtctcaccttctgagtatggggattcgtgcttgctttttatgcatgcattgctcctgtaaaagtagaacagtaatcttcagctgtaactgagttgtgtccaattatgtacgtgcacgctcgtacaggagttggaaaccatgtactgtgtattgatttcctcgtggacacattttatcccttcctccccatttattcctttctcttttgtattcctattcctcctcgcattcttggcaacggtggcgggcactcccgcccatccacgggaaaacggcagcggcctcgtgacaatgaaggagaagaggatggaaccaacgagtttgatgagttcgccagcccgtccgcgggaatgaaaaccgcttggagaaaaatatgacctgctcggaagttctatatgcaggtgataggaatcggatggatgagattgccatgcattcttttgatcacaccatgattgatgcacaaatccatatgaacaattcaaggcagaggggaaatagggagcaaattaacatcgatcactatattcattgatggtacgttgaaacgtaccgatactttgctaacatatactccatatgttccataatataaaggattttaaagagatatgacacattgtaatagggagtagctatatttatggcgccatattttaacaaaaaaatagtcagtatgtatttacattgtaagtttataaattacatatgtaattttagtgtatttacaatgtaagtctcaaaattacatatgtaattttagtgtatttacaatataagtctcaaaattatatatgtaagtcccaaaattacataagtaaattaagaaattacatatatgtaactagtatataatcatcactcatcattatgtatgtgtggaaataatcttcttctgcctcacggaagcacagttgggaggcctcaggcctgtgctgttgtgtggcataggcatgcatgcaaaccgactgtaatcaatggaattttacggtgccataaatttagcaaatctgttgtaatattataaatctagacagtggtatcatatctctttaaaatctcttatattttaggacaaagtgagtgctttaaaaaaacagagggagctagctaccctatataaaatattcatgcacacgatgcacgagtgcaattacttattacattcaatcgagaataaccgaaattgtaccaccatgatatgattcttaattttatagcttcatcgatacgtgttttaggctggatatgcttgtgttgattggtaaagacacaggataatatatatatatatatatatatatatatatatatatatatatatatgcttcctgcttcatgcttgtgcagttgtgttatttgttgctccaaaccactaagctcactcgtgtcagccgagcaaaacttaagcagccatggctgaaggtcgtcagctcgaagcccagagcgtcgtcgtccctacagccaccggagacaagggagacgacatcctctcgtcgcttccgacgagggaaggatggtggacgacgttcgtcctctacgacggctgctggatggaccggcaggcagcgatgagcgtgtcgctggttcgtgcccagttcgtgccacgcgacgacgacgtgctcctcgccacctacccaaagtgcggcaccacctggctcaaggcgctctccttcgccatcgccaaccgccaccgccaccccgtcgtcagtgccggccaccaccccttgctcacccaaagcccgcatgacctcgtgccgttcatcgagctgcccttccgccatatccacccgctcgcggcggccctcgatgcgatcccctccccgaggctgctgggcacccatatgccgcaccatctgcttcccccgcgcatcggttgccgcatcgtctacctgtgtcgagagcccaaggacgtcgtcatctccacgtggcacttcatgaacaaggtaatagaaggattctccattgatttcgacaaggccttcgagctgtttgtcgatgggtgctcccccttcgggccgatctggaaccactacctaggttactggaacaagcacgtcgaggagcccgacagagttctcttcctcaagtacgacgacatgatggccgacccggccggccacgtcaagaagctcgccgagttcctccgcgtcccgttcaccgacgatgaggtcgacgccggcgtcgtcgaggaggtggtgaggctgtgcagcttcgagaagctgagccgcctaccggtgaactcctctgtggtggctggtcgggtcggcgtcgacgagcggccaatgaagaactcggtgttttttaggaagggtaaagtgcgggactggaagaactacttgaccgaagagatggccaagaaattagatgccgctatcgaggagaagctgaaaggatctggtctcaccttatgattagcttaatctaatatcgttatgttgtttcttttaatgtatgctctcggtgtgtcttgtgtacaagtacaataatcttcacaatgccttgtaattatgctatgtccaattgtatgcaccattgtacaagagttggaaatattatattcctgcaataaaatgtgatctttctttgtgttctttttgtaggaaacctcaaaaaagggcatgagctctcacaatttcactatgtaagaagagagttgatccagtttatgaggaaaaccggatctaaaactcttacaacaacacggttttataaggaaaactggcgaaaactctgacattgtcatagtaagctatccacatggaccaaacaaactaagcttaagaccaactatctaacaagggaaattcctaagatgaagcttcaaaatgaaccaagtccataggacaacaacaacgtccgatccataaagaatctaaggttctcacgcggagagagacccctaagctagaggaaggccctatagcaacgcttccaagaaagtgaacggttcccaagagcatcatagtcgctagctctggcaagccgagcaaggctttcgccccaggattacatccaaccaccaaaaccacgaggaaagctacacaatatcgtctgcacacctaaaaccaccttcacagccaatgtccttgcctcgaagtccaaacaccgcaaagccatagctagccaccacaccacagaacaatgctcctcacgattggaaggggaggagccttatgcacaagcggtctgggcacaagcggcaacgcttggcccgacaccaagcaccgaccggccagccatgctgccacctgtacctgcaccgcatggaggacgaccgggcatagttggaaatatcggcagagagatgacaacaccgccagacagccacgctcccgagcgaccattttgttgccaccgcctcaagggatctaggcctcttgcgtcggatcctcgctgggggaacaccagatctggacgttggggtgctagattcagctgcccccctcgccgctgcctgccggtccgctgccaaacgcactgtcgagctcttgctctccttcacctaccccgccgctagcaagtctcgccactggaaccggtcgggatgtctggatctggccggtgcagcgctccccccgctgcatcgatgcccctcacgctgtcacgtcatttagggagaaagagaaccccaccaccgccgtccttgcagcctgccggtaagccaacctgtttaggcggcggcgaggtgggcgtgaggagggaggggagcggtggctggtggatgggcgcagttcgcgtcgcccctaggactggagcgacccggacgggagactggactagcgagctaggacgacggcgcttggtgtggtgcgttctttcgccatctggacggccggtggtggctggagataggaggcagcgtcccggaacaaatgtcagccactatctgccagacctttcagggctctaactccagcttaccgtgcagtagaatgaacgtcagttcttggtccttcttcatacttccaagctgcataaacgtcacaaatagaacagcacacttgttattttcgtactacagtcacagttttgtgttagtgcaacaactatgtcagccaattgagctgacaaatgaagcatacaaaatagtgtgtaagctcattaaagaggggatattttctgttaaatacttttacagagctgagccatcaagttgcaaaacaatgggttccaattcaaaagggatctggaaatataaaatttcagcagggatcaaagttctcatttggttacttatgaaaagtagcatcttgacaaaagataacctcttgagaagaagatggaaaaagcaaagaacaaaaaagtgctagcttttgttccgcggatgaaactgttatacacatgtttgtgaaatgccaacttgctaatttcttatggaatggcatgtatagatggccgaataggtcgcccggtctgggccgaggttagtcgggctggcacaacatgccgggatgcgtcgtgctagcccacgggctgcacacatggcccaataagactcgggtcgtgccgggtcggcccgaagacatggcagccgattgtgcttctccatagaataagtatattttttctccatcaactctttgggctgtgtcttatatagctgaaaataagtccattttatatccctcatctctttgggcctttgccttatatgattcattaagtctattttggatccctcaactattttcttctattgtgccggaccggaccggcccaccgtgccaaagcattggcccaggcacgacacaactgtcaggccggaccgtgccgtgcttgagccgggccatcgggtgggccttatggccatcaataatggcatgtactttaatttgaagaaaatgaggtcggctggtgacggcagcttcaacagcggcgagctgagaacgcccatgggtggctgacttggctggttctcgtggccgattggagttgatggaaggggtagaaagaaatcgtggcggagtggcaaggtttgaattttacaaaatttcagtagcacacacccgatattgttaatagcaatgacattttttaaaaaaatcggtaaatttgtaatggcatggatctaattaactatatttttatgccgaattttagttatttctaaattatatttctacttgaactcttttttatctttttgtccgatgaatgtgagaaaattaatctaacctccatagtaaacatggtgcctcatttcaagagggaatgcggtgcctaattgcaaggttgttttaatataatagatagatgaataatatccatcatatctttggttgatggttacatagcttcaataagaatgatacgaaattggtggtgattgggatagctctgctatcactagaagagataccatcatctcaatcgggcggtaaaccccatctcaatcgggcacggcgtccgtcacaggctagaagtcacagatgtgaagagttatttcaatcgggcaaacggccgtcacggataaatctatctcaatcgggccctaattaaagggcgtcaccgatagctttgacccagacgaccagtcaaactatagcccgtcacggatgaacaactacgcccgtcacagatgacccttatctttacccacgcggggatgaatctatctcaatcgggccctaattaaagggcgtcaccgatagctttgacccagacgaccagtcaaactatagctcgtcacggatgaacaactacgcccgtcacagatgacccttatctttacccacgtggggatgaatctatctcaatcgggccctaattaaagggcgtcaccgatagctttgacccagacgaccagtcaaactatagcccgtcacggatgaacaactacgcccgtcacagatggcccttatctttacccacgcgggaagttcaaacttcccggtcggtcacccactatagcccgtcacggatgaacaactacgcccgtcacagatgatccttatctttaggtcaagcacgcttaacattaaagttctttagagattagcttccagaaaagtagttataacttgttggtataagtattctattaatcctattaagccctaggccaggatgtcaaattggggttattaaatgatttcaaatggaaaagtcaccaaaaccaaagttgtagaactcatcgaggtgcaaaatttttattttggtcatttctccatctgacgctatttaaacaatttgaaatttgaaattcaaagtttgaaaagttcaaatagaattttagatcagtgaacgacttcaactgaaaaagtcatcaacaacaaagttgtataactcatcaagatctataatttttattttggtcatttttctatataacattttttgaaccgtttgaatttgaatttgaaaatatgacaacttcaaacaacattttcaaatactaaatgatatcaactgaaaaagtcatcaacaacaaagttgaataactcatcaagatctaaaacttttattttggtcatttcttcatacgacaaagtgatagtaacattgttcacaaaattgatatatctcttatctggttttataaactacaacattgttcacaaagaacgaggaacgacgctgaccccagatcgtttcgtcggtgttatcgacatcggttcttccgaaccgtcagtcctgcatctactcgaggactacgactcctcgtcaacaagtacgccacgtgaggtattggctatcgacgggacaggcacatcggcacgcgctaataccggggcggaaaatcagacgtctacaccggctcagcacatcaggaccctcaacgcaatactgagggagaccccttatgaccccgttctacacgatgacctcgcacaatggacggaacggttacgggagtcagtgaccaacctcagcaacgagttcgaacaggccgccgctgcaacccacccggaacagcaaccaactactggtgccaatggcgaaaaccccgaacagcgggaatcaccccatcgagccagccctccacctcgcggcaccagcgatctccgcgatcacctaaacggtcgccgagaagctcgtcgcacatgggaaaacgagaaccgttcccggcatcacgtttcttcacgacatcacgacaatgaagaacgaggaggccgctcgaacgaagaccaagaccgtgatcaccgccacaaccgtcatattcgcgacgatcgtgagcgacggacgccgggcgataccagtcgaggacgccgccatcatgacgaagacgacagagaacggcgccgggacaacaacggagggcgacgacaggattctcgagaacccagccggcattctcgtaatcctacaccggaaccaagcgacccatcgtcgtccttatcttcttcctcctcctcatcgtcagacagacatccacgaaggacatacgatcgccgacaacccaccgcccctagtgctgggtgtagggctttcggtcgttcgttgcgcgatgtccgatggcctgagaggttccgaccgggggcaatagaaaagtacgatgggagcactgacccagaagaatttcttcaagtctactccatagtactctatgctgccagagcggacgacaacgcgttggcgaattatttgccaactgcgttaaaaggctctgcgcgttcatggttgatgcaccttccgccctacttgatttcttcgtgggcagacctatggcagctgttcgtcgccaacttccagggaacctacaaacgccacgcgatcgaagacgacttacacgcattggcacagagctcgggtgaatccttgagggaatatgttcggcgctttaatgagtgcagaaatacaatccccgaaatcaccgatgcttctgtaattcgcgccttcaagtccggtgttagagatcgctacactacccaggagttagcaacgagacgcatcacaactattggagactgttcgagattgttgactgacgtgcccacgttgacgatgcacttagacgcaagaacgacaagccgaagaccgagggcgagaagaaatcagccacggacacacctgagtcaagcaaaaagaaaaatcgcaagaacgcgaaaaggaaagctcaagcagaagtactcgcagcagaatatgctaaccctcccaagcgcccaaacccacaaggtagtgacgcaaggaaagcatggttcccatacacaagtcgaacagacattctttggaagactgccttgtttccaaaaaatcgctcgagaagcacatgacatcggaacaaggcaaacgagtacgcgtggtcgagaaggatacggagatgaccgctcaggagtcggacccagcgtatccagactctaacctccacgtctcacacattttcggaggctctacagcgtactcctccaagcgagagtataagaaagtggagcgagaagtctgctcgacgtggcagggggctgcacccaagatgaagtggtctgaacagaagatacaattttcggaagatgaccatcccaagaccgccgttatcccaggacgctatccgatcgtggtcgaacccactattcggaacatcaaggtcgcgcgggttctcatcgacggtggcagctcaatcaatctcctcttcgccagcacattggacgccatgggaataccacgaagcgagttgacagccaccgatcaacccttccatggaattactccccagtcttcgtccaaaccaatgggaaaaatcacgctgcctgtgactttcggccaagcaaacaacttccggacagagtagttcaactttgatgtcgctgaattcgatacagcgtatagcaccatcatcgggagaactgcacttgcgaagttcatggccgcatctcactacgcgtattaagtgctcaagatgccagggccgaagggaacaatcaccatccaagggaacgcaaagctggcggtacaatgtgacaagcggagcctcgacatggtcgagcaaacgccaagtacacccgccacaaccgagccacccaagaaaatgagcaagacaaacaagacgctgaaaccggacggcgcaatcaagactgttcctctctctagtgccaaccccgacaagaccatcaagatcggggcatcactaaacgagaaataggaactcacgctcatcaccttcctccgcgacaatgctgacgtgttcgcttggcagccgtctgacatgccgggcgtccccagggaggtgatcgagcacaaactcatggtgcgacccgatgccaagccagtaaagcaaagactgcggagatttgcaccagaccgaagacaagccatacgagaagagctcgacaaacttctcaaagctggctttatcagagaagtacttcatccagagtggctagccaacccagtcatggtgcggaaggccaacgggaaatggagaatgtgtgtcgacttcaccgacctcaacaaggcgtgccccaaggatcacttccctcttccttgaatagaccaactggtggactcaacagccggctgtgagatgctgagcttcctcgacgcttactccggctaccaccaaatcagcatggcgagagaggacgaagagaagacatcattcatcacgccgttcggggtatttttctacgttaagatgccatttggactcataaccgctgggaacactttccagcgcacggtccagggcgcacttagtgaccagctcggcaacaacgtcgaggcatatgtcgacgacattgttgtcaagaccaagaaaagcgactcattgattgacgatctacgggaaacgttcgacaacctccgacgatatcacctcatgctcaatccagagaagtgcacctgcggagtaccgtcgggcaagctactcggcttcctcatctctggcagaggaatagaagcgaatcccgagaagatcaaggcaatcgagaacatgaagtcgcccacaagactcaaggaagtacaaaagctaatcagatgcacggcagcactaagcagattcgtcgctaggatgggagaacgaggacaacccttcttcgctttgctgaagaagcaagataaatttgtatggacacaggaagccgaagaggcatttattgcactcaagcgctacctatcagatccccctgtactcgttgctccccaacctaatgaagaattattcatttatattgccgccacgccatactccgtcaacactgtaattgtcgtcgagagagagaatgtccaatgaccagtatattatgccagcgaagctctccacgacgcaaaaccagatatccacagatccaaaaactgctctacgcagtaatcatgacatcaagaaagctacgacactacttccaagcccacagagtcacagttgtctcctccttccccctcggtgaagtcgtgagaaacaaagacgttgtcggccgcattgcgaaatgggtagtcgagctaagtcagtttgatgtccactttgtaccacgaacagccatctagtaggaaatcgtccatctatgacgttttgctcatgacgttgtataatttcgtcattgaatacaacatatctatgacgaaatttcatgtttcgtcatggatcactcatggcggagggtagacatcgaaactccatgacgaaatttaaaatggtgtcataaaacaatagataatttcgtcacaaaatggtgcgcaccattcatgtaacacacttatgacgctcctttattaatacaatatgctgaaatatatttcgtcagttgtaagtaaatctctattctgctgttgttggtcccaccttgcatatgtggctatctaggttgtcactggaccccacattgtatacgtggctatccagattgttattggaccccacattgtatatgcagcacaggtgcgttttcgggccagcagatgctttgtgcagtccacgtgaatttgtgcagcccatgtgtcaatctgtgcagcccatgtgaacttttttttcgcagcccaaatttgtgcagtccttggaccccacattgtatatgcagcacaggtgcgttttcgggccagcagatgctttgtgcagtccacgtgaatttgtgcagcccatgtgtcaatctgtgcagcccatgtgaacttttttttcgcagcccaaatttgtgcagtccgtgaatttgtgcagcccatgtgtgaatctgtgcagcccatgtgaactcttttttctaaaaaaaatgctgcagcacttgggggtcgaacccacgacttgtgactaaccataattctagcttaaccactacgctgcaaggagctttcatgctgatgatgttttacttttagttttcctttcaattctcgaacacaagaatgattgaatgctttatgcgggcgacctagtggtttggtcaaggagggaggggggcggtggcgcagggtttggtcatagccagggagggagggtggcggcggcgcaggcggagctcagtggggacggatcctagccaccgggacggtgcagaggaggaggtttcttatcccaccggtgcagggaagggcggctccacaggctggccggcatcgtgatgtggagcatcgtggtgggtggcggcgcggtgaagtgatcttggtcggtggggctgcagagggatcccggtcggcgcgggggatcctcgacgactgagacggatcggctgctcctcgcccaccgtcttatcctagcacctcctctctcaatcctgtcgtcagcgcgcacagcccatcaccaacgccgttcagtagatataaggtatgattttccataagtacattactctgagtatgaaatgcaagttcagctatgaaagattatgctttgtgttgtatgaatagagaaacaagtcagagtgttatgaacaaatcaacatggtttaagtcatgtagcaaccagctgttccatctaatgttttagaaaatattctgtcctaaaaaatggattagctttgtttgcctaattgctttttttaacatgccaaagcagatggacagaacttggatacatgggagacaattcacacctgcatacatggagggagtgaaacagttcatggaatttgttggacaaagatttgatgaacacgttgacataccatgcccatgctgtaggtgtcttaaccacacttcactgcctcagcaagaaatgcatgaccatatacatatttttgggatgtcatcaacatacacccggtggatttatcatggagaattagttgatacagaagatgtcgaatatttggaacaggtacatgaaactaaccataatgaagggacagatgtgggcgggtatgaacccgaggatgacaatggagttccagagttaataggtgaactatacactgcggcagaggaagatggacagccaccaaggtttgctagaattcttgaagatgcgaagcaggcactttgcccaggatctaaccattcaagattttcctttcttgtgaggctgctccatatcaagtcatattatcgaatcagcaatacagctttcactgaattattgaagttgttgtcctcggcattccctcaatgtcaattaccaaaatcttatgatgaggcaaagaaatatcttcgtgaattgggccttggatatgtgtcgatccatgtgtgcaagaataattgtgtgctatttcggaaggaatatgccaatatggatctatgcccaatatgtggtgaatccagatgggaagatggggttggcgacaggaaggttcctcgcaaagttttgaggcattttccacttatcccaaggttaaagaggatatttgcatcaaaacgaacagctgaagacacacagtggcacaaaatcaagcggaagccagtggataatgaaatgagccatgcagcagatggggaggcttggaaggacttcgacagaaagtatcgaactttcgcagaagatgcaaggaatatgaggcttgccatagctacagatggattcaatccatttggcaaggtgagcaattcgtatagcatgtggcctgtccttgttatgcctttgaatctaccaccatgggaatctgttgatccatcgaactgcattatgtcattactgatcccaggtccaacatctccaggaaaggattttgatttattcttggagcctctgatagaagaattgcttgaattatggataggtgttagtacttatgatgcattcagtgctagaaagttcaatcttcgtgccgccgtgctatggtgcatacatgattatccagctctaagcaccttgtcagggcgaactacaaaaggttattatgcatgcattcattgtgacaaaaatccgttgtcacgagcaccaagaaataagataggctacttggccaccgtcgtttccttccaaggacacacgcttggcgaagaagccatgcttttgatggacaccatgaaaaccaggttgagccaggaaaattcagcacagatgaggtcctcgagcagttagagaaggtgaaagatgttagaccgggtaagcatgatacaagtaagaaaagaaaacgtggagaggatgaagggccactaatttatagccgcaaagtaagtctgtggaagctcccatattggaaagatttgttgctgccacataatcttgatgtgatgcacattgagaaaaacatatgtgacaacattttgggcacattgctcaaaatcgagggcaagacaaaggacacagtcaattcgaggatagatttgcatgatatgaacataagacataacttgcacttacagcaggatggcaactcagttcgcatcccacaagctcgctatgtcttgaagaaggaacaaagaattgagttttgtaacttcctcaaaggtgtcaagtatccacatggatatgcagccaacctagcaagatgcataagttcagatggttccaaggtgcaggggctcaaaactcatgactgccatgtccttctccaaagaatcatacctgccggcataagaggatttgtggacaaggatatatacgaagcaattgcagagcttggtaacttcttcagggaattgtgtagtagaaatctaaggatagatgtcctcaaacgactgaaaaaagacatcccgctgatcctatgcaaacttgagaaaatttttcctccagccttctttgacgtgatggtgcacttggccgtacatctacctgatgaggcactacttagaggtcctgtacaatatggatggatgtacccaatagaaagacgacttggcacctttaagaattccatgcggaacagggctaggcctgaaggatcaattgctgagacctatgtagcaagtgacaccttgacattttgttcaaggtacatggaggatgttgacactagatttaatcgggacgcccgtcatggggatgggccattggatggtaacagctctgtttttatgcatggtgttaaactcataggatccactaggatacagtacatggaggatgaaatcatggataagctagtttggtatgtgctaaataactgtgaggaggttcaaccatatttggagtaagcaccatttatgtaggtttatttcacatgtattgtattaaatataatattttcctaattg

SEQ ID NO: 47589 - DNA, 26578 bp, Oryza sativa
tatatatatatatatatatatcagatctggaagctgaggaaagaaaatccaggggtggtcagtgaagcactatttgcattgtcatgtggtcctgatctccgagtaaagagttgtgcatcttgcattgtcaacggagtccggtatagcactgttgaccgtgagaaatacctccaaacgcagaatagtggtgtaatggttgatggtacacatgaaggggataacattgaattttatggtgtccttagggagattcttgagttgcagtataactctgatctagatatctatcgatcggtggttcttttccgttgtgattggttcaatcaagttggcaagacaaaaggagttagggatgacgggcatttcaaatccatcaacatccaatcattttggtacaaggatgaccctttcattttagcaactcaatcgaagaagatattttacttgcaggacacctctttgggcaacgaatggcgaattgtgcagaaattcgaacataggaacatgtataatgtgtctgaaaaagatgaccacatttttgatgtacaccaaaatgataattgttctgatacagaacatgaagtgcatgaaggtaatgctgatgaggatctagaccatttgcaggaagatggagaagttactattattgaagctaatttagaagaccttaacaaccaagctaacttgactgaagacagtagggatgatgcagatgaagatgacacaatattgcagtactgtagtgacagtggcaatgggaacgctgaagatgacatgccggaagacaccgatgatgattaaattatatcttgagttgtgtcatctatctgatatgtcatatgtaattgggatgagctataaactcatttattttgtgttatgtaactgagatgtcacaactgatttattctgtgaactcatttgccattgcagatctgaaacacatcgagattctgagctagcaattttaagaacagagttgttaccagcaatgatttgcatttatttgatttctttcccaggttcatggtgctaactcatattcctaacaatatgtgaagcagttgggtcaaaaatttcaggagaagagaaaatattttacttctgttttttgggcaatccagtaagtttcctggtgaaacagtatgcaaagtgatgtacatatatatttgttccaagtgacatactgcatatcagtctaaaactgtacagaccatgacatttcaagcagcaaaaaccaatttcaatctgtacaaacacaacttacacttcaagcatctgttcaaagcattacacttttttcttaattgtcatattcaattgacataaaaaaatgacacaaatatggtcttcacattttcaaaataacacaataatcagccataagtttattcacattcacgatctcaacctgaattcaccaagctgtacaaagaagtatcatttcttctcaagctactgttgtcgcccacatccaggaagcaagcagcataagcaccagaagcttgctactcgatcatggccagcaccaggtcctcttcaccagcagcgctaagagcatcggccttggagatgcggcacctggaccagctgctactgcggcgatgcggtcggagtcagagacgggatgcggtcgcacgtgtggtgacgcggcggccgcgctccatcggcagcagatggcgcggaggcggaagaatgtgtccggcgggaggcgtgccaggacgcgctccagcacgccgtcgtggaggtccccagcccacgcgtcggcgggctcctgcgcttcctgctaattctcaccgccatggaggaggaagctctttttttttgttacgatttggtttggtttggatctgaatccgttgttatatgtgtgttgatttacgattgtaccctcgttatatgtgagttctaccgataagaatgaggggtaagtcggtccaaaccacccggtccgttctattaaaactggccggtccaacatttttcctacaaacaccgaccggttcacccagtttaaagtgaacataaaatttttaaaattcaattttcaattggacctatatactccctccgtcccataaaaaaccaacttctgactataaatctggacgcaacatgtgtccaggttcatagccagaagttgatttttttatgggacggagggagtatccatgaatggtaaactgagacgattttatcacctgcctggctcaaatcctccgtcgccgatcatcctccagcttggctttagatccaccggcaacgccaccgaggctggaaccaggttcttgcattccacggtgtcgatggtgaatggcgaggtgagcaaccacgaggatgacatggaggtctcgatgacatgggagacgacgaccgcgcccctgtggtagacgtccacagcagattttgactatagaagagccgacaccaatactataggtgttggttttcttttttttaaaaaaaaaccaacacctttaatttgtcataggtgccaattaattaaaaaaagacgcctataatatattataggtgctagtttctaaaaataaattcagtcatgcttaaagtagtgttgtggaaaaccgtattccgtctgacaaccgtattccgattaatcggtgaatgcttcttaaactactaaattgtctgtgttttccaaaaagtttttataggaaagttgctttaaaaaaataatattagggggtgtttagttcccacattttttttccaaaaatgtcacatcgaatgtttagatacatgcattgagtgctaaatgtagacaaaataaccaattacacagtttgcgtgtaaattgtgagaccaatattttgagcctaattgcgccatgatttgactaagtggtgctgcagtaaacatttgctaatgacggatgttttaggcttaataaatttgtgtcgtagtttacgggcataatctataattagttttgttattagtttacgtttaatactttaaatgtgtgtccgtatactttaaaaactttacaccctggaactaaacacccccttaatccaaattttcaagttatataatattgaacggagggagtatatttttaaagtcaaattgttaatccagatagattagtataatttgaatgtttttgatttatggataatgttaattactcatggatggaggatttttcgttcggcgcctaaacctaccgccaatgacagccccaaaacattccattgccgcccatttgcccaaatcagaatgggaaatgtcacttttatcctccatctaacgaagagcaaaacaacacccaggggcatttgtgcaaccactatatatttacaaagcctctcacccaccaaaccctaatccccaaatccagccgccacaccatcggggcgccgctctaccagagccgccgccgactaccgccgcaccggagccttcccccgcaaccccgtcgacgacgaccgctgcgccggagccttcccgtgcaaaccgatcgacgacgaccgctgcaccagatccgtcccctacttcctcgtcgtcgacagccgccgcaacgacgccttccgctgcaaccccgtcgacgacgaccgctgcaccagatccttcccccactacgccgtcgacgacttccactgcatcggagccggtaccccgtcgacgactactgccgcaccgaagccatctcccacaacaccgttgacgcctaccgccgcaccggagccgggtaccccatcgacaaggtccctgcaccgtcgccgtacctagctgatgggaagacgtcgacgtccagtagcacgaggtacgcaaaattatcttgtcgtctcaagctcagatgtttatgtgtactgtctcaagctattagatgttatacatcatgtggattgatttgccgtccaacttctattaagaattttctgtgtgcaatccgattgaggtcactatctacaataacagttgatgctattgctagtttgctactgcatatggcattgtttctgtgttattcaggcgcacctttaaattaatcatgctatgttgattctcaaataaatttgtgcctcaagttgccataagcatcttccagagtgtggatttcagatcaacaatggaaattttatttagattctgctttgtttgtgtttatgaatgtaccaataatttgagttagtcgtataaatagatacagtttattaggtgaaagagaatgatataatggctatatcatttatatgaccaatgttgttcactgtaaaagtgtttccagagttctcatcaaaattgtcttttaaaatggaaaagtgaatcaccctgttgtttttactagatattgaagtaaagttgtttttcaccattgatcattaaatccccaatgttgatgagcatggtctctttttttttcatcccaaatgcctagatactttattgtttctatttctgaaaatgcttatatgcttaggaaatgccatcaaaatgccatctagtattctgaccattaaaatatgtgtattcatgtaagaacctgcacaaaacgaatatgaaagaacgcggcaagagaaaatcttgcagaatataagaaggatggatgaacttggcatcaaagacatagctgccactattaaacatatcgaaacacaacatgcatcttcaaagacaaaaaactcaggcaccaagaaaagtcatggagaaggttctgatacatcagagtttctccctgaagatgatgaacaaggggttcagtgtgatgatgattcatatttagaaccggagcagcccatccccataatgattgaggtgcttcttctatcttggctgttggggggggggctaggatatctgcaataatttttccgcatttaatttgtgcagcatttgattatttttttaatgattgttgctaatttattcacatgcttacaacttttgtgtttattattgtagtaccctcgacaaactagacgaaagaagtgtgcgacgaagaagaaacctaccctcaagatgccaccaggagtaaggatatcaaagagagtgagggcgggtgctccaaccgaaatgcctcctggagtctcaacaaggtcagcgaaaaggcaactcatagcagaacaaggtaaaggtaatggccatgaagaactgcctctagaaacagaaaacaatggtgatgaagatgtgggcagtggacatttgcttcaagataatgatgtgaacaggcccccgagcccggtgatggactggtcatatggacatgatgccaaccataaagagcaacctgcacagcaaaccaattctgatgttgaaggcaagttagttcaacgaagagaaatttattatttttaactatttgatgaatgctaacattgtaattgaatactctgtagtacctatacgaagaggcacaagaaaatcaaggccaccaactgcaggaataatgcttgacaagatgaccaaagctatgggaagaatgcccattgctgttgccgaagggaagaaaaggccagatgaaccggtgcaagctgccaagtttgcatcagaggctggtgttatcattaggactaaagttcctgtcttccctcattggaagcagtacaaggatgatgaaggctatattaacaacttcatgggcaagttatctgtaagagcctatctatattcttttatatttcatctattatatgacctagtgttactccttaatgattgcaattcaaaccatcaggtcaggttggccattaaccaaaaaaaccagccaacaagggatgcttgtgctgatgtattgcagaaagggatacgacaaacacggtataatttgaagaaggcctacttcaatggagtacctgctaacgagattagaactacctctcccataagtagcatgactgatgaacagtggctggaacttgttgcaaagtggtcaaatccaaagaatatggtatgtcatctctaatgacatatttgtttcatttcatacctgcgactatgtctaacacatacatcttttgtagcaaatctctgaacagaacaagcaaaaccggcttaatgttaggttccatcaggctacgggatctcgcagctatgctgcacacttgcacgcttacgtaagttcccattatcttttagcattaattgtagttaagaaccacttatctaatgtaatagatatataaaataattgatctgcattttctgtactgaaatagaaggagaagaacaaggttgtagagcttgatgttgtggatgcctttgaggactgccataccagtagggaaaaaggtctaagtgatgctgccaaagatgcaattgtaagtcactctgtatattcttacaacattgaactcaattccttgttacctatgccaacatattattaattcagctcattttatatttacatccataggataatttctgtccttagtgtgcagagatatttgcagctaagatcattacagacttaatggaatttatagactctaacaatgttagaatacataccaaactaaatttgtagctgctggaaacttgtcgctagacaacttaccatatacaacataagttgagattgggttaaaatgccaaataagctacataaacattttttcatcaattgatcctggttgcagtttgtatttttatcaatatcccgggtttgagggtgtgattcatgaaaactcatttttacctaagctgctgtagtggtgtttgcatgtattgaggttttgaatcatatgaacataagactgaatatatttcagcctttactacttcaaaacttatttcattgtaacttggaaaagtaaacttaattatgagggattatgtactccacactagtattttctttctaaacattagtggtttctagggaaaatatttaggcatcataggaggaatagaaaataaccaacgctaagtaacattgcaccccctccaaattttatgaaagtagttgaggggaaaaccttgttcttttatagctaccagggtgttccatcaatcaaaagctgccatgaaagctaatcaaatatagtctaaagtcagccttctgatatatgctaaaacagtatcctagattctgtcaagaagcatttggcctgcattgttgctagaggctagatagaaaataattacattctaccatagttagagctcaaaatgtttctggtctctttcacagttaagagggcaatgcaatatttctaaatatgggaatgcttggcttactcatataatttgtttctgttttggcttatggaaaacaaatttggttaaatttgcattctatacaagtttccttacctctagtttgtgcttcctggtagctttccatcagttttcagtgactttttgaatgtgttgtgcagctgccagtattttgaatgtgttatgcagcagccagtttttcatgtatctaatttcatagctaatgttcaatcattgctgcagtcaagtatgaaagctattatggaagaacctgtacctgatggtgagacaccaagaactagtgcagaagttgtgtccaaggttctctctcgggacaattccaataccacgtttttgaaaaatgctggtctgcagatgagctccaagaaatcagtgacaccgacagaagcagcacttcaggaagaacttgcagctgaaaagcaaagttcagccattctccatgcagaagttgtcgaactaaaagaacaagcaaatcttgcaaatgaagcgctggcaaagactcaaaaggagttggcagagttcaagcagcagcaggaagagaacaatttgctccttcgacgtatcttgagcctttcccagggtaacttaaatctgtcctagtctcctttatgatcttctgcactgtgatgaactccatctacttatattagttgtttgatggttctgtgaacttattgtcatgtggtggacttgattatgtgaaatgatgtttggtgctatggtggacttaatgtcctcctatggcaaacttttgtggacttaatgtgaacatatgtgtgctaggttctgtgaacttttttgtaatatggtgctatgtgaagttggtatatgtgatatatgttgatgttgggcctatttgtaatgtgctgtgaagttctgattgtttgtccatgtgatcaatcttgatgttgggcctattttcttatgtgctgcgaagttctgattaattgttgcttgaaatgggtgaatgctaaaaatttcctagatctcatagtgggatgggccacaacaatatgtgaagtatgtggccaaatgggctgggctaagaaaaaaaaaatgagcgggccttcatccctactgtgctaacgtgtcatccaaacaaatcaacacgtggcaacatcaggtaaagacgtgtgtcacaaatcagatatgtacacgtggcgcttcaaaatgagagcacgtggtgcctccaccttcggcaatgtggcgttagcgtacaccaccacgtggacatacaaaatgtaaacacgtggcgttaaatatgactgccacgtggtgtctccacctttggccacgtggcatcagcgcgcaccaccacgtggacataagaaatgccaacacgtggcgttaatatggctgccacgtggcgccaccacgttcgaccacgtggcatcagcttgcaccaccacgtggacataccaaatgccaacacgtggcgttaaatacgactgccacttggctctagcgtacgggagatgatgatccagcgtggcgtacacgtcatccgccacatcacagccaacatggactccacgtgtgatagccccgtggcatggacgacgtctgtcctagccagctgaaaagcagttctatgacgagcaccttcgtcatggatataagcatttctatgacgaaatctactgtttagtcatagaaaaacatatgtgacgcgacttctatgacgaatcccatttcgtcataaattcgtcatagaagttactttatgacgatttgcgcgtcttccatgacaaaagtagattgtcatagatgtgcctatctccactagtgaagtcccaagtactcgccgattttgtagctgactggaccatgcctgataatcaatcagacaaccagatcgacaacgaaacgtggatctcacgcccagaaattcccgaatagaattccaagcagaatgtgcattaaaatccccgtccaggaccggccggggtacacaaacgacaatattgacattcagatccacgtcttacaaacatcataaaagtcttacataaatgcagcggaaaaacgaaagataacaggagctaagccttgacttgaactgcagtgggaacaccactccacaggcatcctcgacggcacggacgaagcctactcctcggagaaaccaccatccgacacatactcatactctggggttggggaaaatagagcaagactgagtactacccactgtactcagcaagtcataccggaataggggtatgatgcagggaattatcaaaggagagctagagtggttcatttgcataaagcgagcatttataaacagaagttgaaagaattaaacaattgtaataattaatcaatattaatcatccactgtccaacgctataccacgttgcgacaggcccaaccatccatctatactatccaatttcaaaagactaaactaggggtgagactaatcacggtgaatctggttgaccgcccataaccacgggcacggctattcgaatagttttactctgatcagaggtgtacaactgtacccacaagacacagccccacgacacgtttccgtgtgccgacatgccaccacgacataccggaaagaggccgtgacaggacccttcgcataaccccctctaaccaagcacaccacacctcaggtttcacccccactcctcgcaaggcaacgggcagtcccctctcgtgcctaggtgaatccggaagcgacagaggccgtcgcagggcctgccccgctccatcacacccacccttgcctggatgcgtcagttagaggaaagctacactacaagcccagtcgttgcccacgctggcttgtggtaagcacgataaattcttccagggtttcccgtgcagcaactctttagataagagtcgaaccacacctcgcgacccctgagtgcctccacggcctggtcttttttcacctccaccatcgccctctcgagttccgcgacttcacacttcgtcttccaatattggatgcaacggtcttggccggcaagtctactctcgaggtctgctcttccattccgagaacataaaaaccaagttactccgggaagaagaatgaaggagatgaaaacaaagatcaccaacctacggaggtcatcgccatgcccatttccacgggtgagtttcgtcccatatcgtcctgcgacataggcgtttgaagggtaatcgccggggcgaccaccggtaacttgggctgcccacgctgctggacatcctcgacatcgacatccctacaaacgacaaccaaaagtactcaggaccagggtgccaacagagatcaaggcagcgattgcacgaataaaggcagttgaagccgacaactgttatacaaagtgtagtcgattacaaatgatctgaggccctactcttcaaaaagcgggagaacagactctcccagttcgccaacctcctccatcacgcccttacgagtgtcgttggcggcccccctgtccaagatctgccgaagatcgagttcgggatgcgccagtcggacacacgctaggacgtgacaggccccggtgtaaatcccgtttgacgcctcctccacgatcctggccatatgcttggagggtattgcctccatcgccgtagccagttccacaagtgaggacgtcagcgagaactcgccggggttcgctgggatggttgacgtgatgccacactccccggcgagctgatgaagaccggtgtaggtgacccgcagcgacccacggatccccgacaggttgttcttgagttccgacatccggtcctcgagtccccgccattgccgctcgttaccggccaccagctccctcatcttctggaggtcctcgcgaacctccgccaggtcgcgttccagcttgtcggcacgctcgttcgccgacgacgctgccgctgtcttcacctcctcgatctcgcgacttacgccgcgagcgccagcctcgaggatgcgttgcatctcagcttggagctccccccaggtgaggacattagcagatggcccgcgagtaggtccgagggcactggacggactgcttggcgtcgcttcacggctctttggcgcgacaacaacatcggttgaggttgctgcaggagacactccagaggccccttcggacttgtcctgcgccgctcttgcctgcgccgacctgcagaagatcctcaaatcaagccatcagaagacaaacgaggagaggatctcgacttccgcttacttacttctcgcctagcgtcaccagcttcctccgccgcggaggtggcgaagacgcgtccatggcctgggtaaatcaagcacgagttgagggtgacatctcttgaatacgagattaacgaaccaagggacttaccgatggggaggatgctctctggcggctgccgagaacggaggtgaacatccttcccgttttcgggacacggctgccactagtcgtggcagcagcggcgacggccacgtcgggcgtctcccgagcgacgctctccttcagtgaggccgccgcctggtggtccgcaaacggtccaataacgtcagtcagagggtgagcctacaccgcatgaaatcattttccgacccgggaagcaaaaatagcgaggttaccgagtacactcacgttgattgcggcttcgcgctcggtcacctccttatcacaaagaggcatggggacgtcgcttgccgttgtcgggccgttgatcatcaattggccgacgcggcgctccacagtggcgtcactcaagcctgcagatcaagaacagagttcaataaattagggagaacatgcacagaagaggatcaaattaaacacaagaaaaataccccgaggagaaacccgggtcgcgtcctccggcccagagtagtcaaaggctgggtgggggcgagcctggagcggctggatccgcctactaatgaagtcggtagcgacttcataacccgacaaacctcgcgctcggaggtcatcgatggcatcaatgaacgactgaagagcaggggtcaaggcgggttttgcggtccaagatgggattttgtctggttgttcctcaggaacaaggaaccacctcgcccgccacttgctacgagaagaagggcactggaaggggatatatcgcgacttcaggccatctcgaagtcggaaacccacacatccagataccctggtagattccatccaacgcaactcatagtagaagcgaaagaggtcgagaaacggctctaccccaatgtaggcctcacaaagatgtgaaaagatgctgaggaaggcaatggaattggggttcaaatggagcagagaaaggccgtagaaattcaagaccaagagaagaaacttagaaggcggaggaagaaagccacagagaatatagtcctcgatcgcaactatacggcccaggacaagttcaggttcaatacctcctggttccctctccatggctccgcggccggggaggacgccatcctcctgtagcttcttaagcgacgcgctggtggaggtagacttgccgagatccatcgccgccggagatcgccggagaaggggccgagatgaacaagctagggctttgcaggagcggaggagacaaggaacgcctggaggctggagagctttcttcacaacgggcggacttcaaaatggatcctcaaaatcctcttaaatagacgcatttccgacggtgcgaattccaaggaaaggagagagagattaccgccggaaatttctaggtccgttacgcacggcagtttttcggacttcagtttaaattcactcatgaccgttgggcttcacatggtgttgtcgattgcgtcctgtctctacggttcgcacaccgagaacgacaacagcctcgacaccagaagtcgcgatcggttacacgagtccatttaagcagaaatcgggggctactgtcagggttacgggtaaggtataccctttacccttcgatacatgccgcgtatcggtatggtatacctgcgcgtatacggacgctctctgcatacattaagggaatccgtcatggagttcacagatggaaagagtcctactcggacaagactgggtcgtcagtgcatcgtgcagggtccgatatctccgagttctacttggaaaccgcttgacctgcgttataaaagggaccccctgggaggacctaagagagggaatctgatagccaacatcaccaccacagcctacgaagtcggagcctgcgaaagccagattgccgagaggtctagtcggattaacccgatacgatctcgtcggtttcatcgagttccatatttccctttgtaacctgtgatttccatcatataatcccatactaactggattagggctattacctatcaaggggcctgaaccagtataatcttcgtcttctgtttgcttgatgtcgtactacgtagacccttgtaccagcgtaccccaatactctctatatccggtctacgggtatcacccgtggacagaatgttatctcaatcgggcctaaagttcccgtcacagatgatggtcatctgtgacggccgcaactttaggcccgtttgagatatggaatgttatctcaatcaggcctaaactacggcccatcactgaaaggtgtcatccgtgacgggcttaagttttatgcccatctaacatgtctgtgcgaccatatctcaatcgagcacttttcggcccgattgacatgacttccttgtgacggcccgctatttctaaccatattaaagttcgtcacagatagaaggatatgtactagtgtatgcgatcagctttatggaaagcccaaaatgctactccctccgtttaatattataatactttctagtattgcccatattcatatagatgttaatgaatctagatacggtatacattcatacagatgttaatgaatgttagtaatggtaaaaagtctcataatatgaaacggaggaattacatgttttaaaaaagttgccatacgagtattagacccccactggtccgatatatgatgcttgttattggatcacctattggtccatattgagatgcacgaagaaaattgtaatggggagtggctctgccaaggaaggtacgtagccgccaagatgttttgttcgatctagtcatggctagaaactggtcaccagccgattggagtgaagatgaaggatggaagcacctcatgctctgcacaagtggcgaacctaattatctaagacttggaccaaagagaaatggccttcaaatcaccatgaacgtggctccttcttgccttcctcttgtttcagtagccctatcttctccttttctgtaattttctttagtcgctctggtaaacctttgtattttgatcttttattccttctaatataaccggcagatctcatgccatcttaattttcaaaacaaaaaaaaagatgctctgctgatttttttttcttcatgctgtagttgatagacgtcttatatgtgttctggaaagtttggtcccatgcatgatggtcggatgacaccgttcgtacggcactgttgatcccgtacgtctagatgcatgagacgtcgatgagccggcactaaattcatgcgttcacaaacggtccaggcactccacaaactgactaggaatgcccaggagtaacaaacttggtgttcacctcgagtgctcaaaaggatgagcctaggttactccgttgcactaaacatgcaccagagaaaggagaggagtgggagagctaaagaatatacaatagagaggggggggggtctcatcttacattacatgaactcatcaaaacagaggagatgaagttaacttgtccattcactcaaaaactaataatcgctactaatagattaaaattggaagttcgaccctcagggggccgtaaaggagtttgggtggcatcaaactataacaacggaatacgacgagacaacaaactttcatattcaattttttaaaggtcataacgtagatgaatagaagccatggcgaaccggacaagcaagtaaaaggacggcaaatgagtaattctatgcggttggtgtgacttttaaaaactataaatgaaagcccgattatgataagttttaatttttaaaatcacaagacaataagataaatgtttaacaaattttaaacaaataatgtgtaaaaatttagatagctttgtataggtgttagccgcgcaatatgcacgccacctagctagttatattatcaagataatcttaaaagcatgcaccacgtttaatgtggtggctgaaaatcccacattagtcgaggaaaaagaaaaagatcttattattagattacggtgggtccggattataacggtgtagattgattaatatagttgtatacgagatacaattatatatgtagaaatagaagttaacaattatatatgaaatctaagcttacaaaaataaaagctaatagttgtatatgaaatccaaatatttcaatatataatggtacctatagaaataaaatttcagagttgtatattaaatttaactctaagtgaattatctacctctgtgcaaaactatgcggaacaatccccttactcactactctatccatcccataatatagcaacctaaaaccggatgagatatatcatgttcaaattcgtagtactatgatacatcagtacatctcattcagtcgtaggttataatatactggatggagacggtacatttaatcgagaatagtcgaaaccaggattctctttttcggtttagccgatttgatctgaggccaccgatataccgaaattttaaacaaaatttagttaaatttgaacaaatattaccgaaattcacgaaaaatttaaaaaaagtagaaaaaatccggccgaaataatatcgtatccaaacctagtcgactgtacgagaatatgattcttgaaatttcagtccgaaatttccaaacctagtcgactgtacgagaatatgattcttgtataccttcatcgcgtgtttcggctggatgcttgtgttgatggtacagagttacggaatacagactacagagacacaggatcgaagctagtgtagttgtgttgttgctccagatcactaagctcgctcgtgtcagtcgagcaaaccttaagcagccatggctcaaggtcaacttgacgccgagagcgtcgtccctaccgccaccggagtccggaggcgaggaagacgtttttggctgtttcgtttccgatcatgtttcctcgatcggtttcgccgccgtatatgtctttcgttaggatgtactgccaacatcctcgcgtcgcttccgacgagggaaggatggtggacggcgttcgtcctctaccacggctgctggatgacgcagcaggccgccacgagcgtgtcgctgcctcgctggtgcacgcccagttcgcgcggcgccccgacgatgtgctcctcgccacctacccaaagtgcggcaccacctggctcaaggtgctctccttcgccatcgccaaccgccgccgccgccggcgaccaccccttgctcacccaaagcccgcatgaccttgtgccgttcatcgaggtgcccttccaccacctccaccctctcgccgccctcgacgcgctcccctccccgaggctgctctccacccacatgccgccccagctgcttccccggcgcgtcgccgagctcggctgccgcatcgtctacctatgccgggagcccaaggacgtcgtcgtctccctgtggcactacatgaacaaggtcggcaatggcttcttcctcgatctcgacagggccttcgagctgtttgtcgatggcttctccctgtacggcagtacgggccgatctgggatcactgcctaggctactggaagaagagcatggaggaacccgacatggtgctcttcctcaagtacgacgacatgatggccgacccagccggccacgtcaagaagctcgccgagttcctccgagccccgttcaccgacgaggaggtcggcgccggcgtcgtcgaggaggttgtgaggctgtgcagcttcgagaagctgagccgcctacccgtgaactcctccggggtggttgatcggagcagtggacggccgatggagaactcggtgtttttcagaaaaggtgaagtcggggactggaagaactacttgactgaagagatggccaagaagttggatgccgttattgaggagaagctgaaaggatctggtctcaccttctgattatctgaatctgatatttgttagtattttttttatacatttatgctttgtgtgctcctgtgtaaaagtacaataatcctcagaatctcttgtatttaaactatgtcccattgtatgcacgcttgcgcaagagttggaaaatcttatatcgctcactgcaataaaatgcaatctatttcttgttttcaagggctggaattttgtgcgaacgtagaaggattgcacatcaatatattagaaagaaaaggagattttgttacacaacgcaatcggccaaacaagcctatgccagaagaaagaaagaaaaaaaaaagaaaaaaatactactacgaaaaaaggttactccaacaaacgagagggaagaggcggagccacactacactcctatcaaatccccaaaagcggcattgtctgcggaagacaactgacggccttccgagcggatggactctataagcacggataccgaggagagcgccgagtcgaaaactcttgagttccgttggggctggaaatattaatgaactactatctctatttcaggttataagacttcctagtattgtccatattcatatagatgttaatgaatttaatcacacatatatagatatatatatctagattcataatatatatatatatgggcaatgctagaaaatcttataactgaaacggaggaagtacatatttgggcctcatttgcaccgccaaaaacggctaaaacctacttaaaatctgtctagttctattgtactataggtagctacattttaacacgagagagtaaggggttgtttggttgatgtctaactttactacaactaaccgtaaagtgtgaaataaaataaaagtgactatgaattagtatgctataagtgtgacatggtttaaaaacataaaacttgtgagcctaaaatataagtcaaacacctacctaaaatataagtcaaatatagtttggtaaagtgaagagatgaaccaatcaacctaagatttaattttgatatcatggtctcctctcatgactggactagtatgacggcgctcggcgcggcgcgctcttccaccgcgtggacagccggtggtggccggagatacgaggcggctttcccgggaaaaacggcagccgccgtcctccagacctttctgggttccaagcccagcttaccgtgcagtagcacgagcgtcagctttgctgaaatttttacattttaatcctttttaaaaacttattttataaatagacccctaacaagacttaaaccgagaatggtcctttttggaccccagagaggctggcgccgtcctccaacatgacggcgccagccatcatggcgccgcgacagtgccaccatggcactagggctgtcgtagcgatgcggacttggcagaagaggggcgccagccaccttgacgccgcccctcatacgacggcgccagcatggatggcgcgcctctcctctgtgggccgcgcctttaaaccctgtggccccaccacctttctcctctccactcccatttttgcctgagtcgtagcctgagccgctgcttgttgttcttctccctctccccccctcacctctccacctcaaatccagtcaatttaaactcatttttcgcgggatttttcgccatgttagaggacggcgccagccactctggtgccaaaaaaaaaccatttttgttttaagtttttccagaggtccatttataaaataaatttttaaaaagtactaaaatgtaaaaatttcaggtcagctttgggtcctccaagctgcataaacgtcataaattgaacaatacgtggtcgttattttagtactactactgtcacggtttggactgccatttcggaaccagttagtgttttacttcttcttccaatgcaattatgcataaacgcgattgaaaagattcaaagttttgttaagaaccaaatgaatcagtagaattcaaatagtgaaattatgaaatcaaggccgaaactgcagttgtgcatcgtcgatgggtaggtggttcatgcgaagtcgtcagagcacgtacgcaccttgcatccgagggagcagaagccgaatcgaaggagtcgagcaggccacggccacacacctcacagcaccggccagcggcggcggaacatgttgcactcgccgcactgcgcgaagtatacctcgccgactgcagaggcctcagccaccgcgactacttctcttgaatcgccggaccaacctgcaatacaatgcacaacatcaaaaccaatccaggaagccgagcaattgctctcaacctagctcatcgaaaagaaaagaaaaacagaaatgaggtttggtcacttaccatatgcctaaatggtctctcttcgttgaatcgcaagaacaatgtgtcaactaaaccttgaacaggggaaatcccaagaacagaattctgctgatttgggatggaaatcgtaagaatgagtgtacagccaggcttatagtttgaagaatagtaagaatctgctcatgtccaaatttatagtattaaggtgtgttatctcttttactagatttgtttgttttgtgatagggagagtacgtgctatgctaaccttgcacctatagatggccatatggcccgagacctccggcccagcccaaggcacgccattttggtccggcccaagcatggcatggcccgattggggtcgtgcccgtgccagcccggcccgacatccgggccgtgcttgagctgcaccctcgacatggtgggtcggtccggcacggcatgatcgaagaaaaatagtatagggatgcaaataaacttaaataaccatataaggtaaggccaaaaagaagaggaatataaaatggacttattttttagccatatgggcatagccaatagagttgagagacgaaaatagagttattctgtggagaagcacgatgggttgtcgtgccttcggcacggcccgagttgtattggccgtgcctaggccgtgtgtgtagcccgtgggctggcacgacacggcccggcatgtaggttgggccatgccggcccgattaacctcggcccgtgcaagaaaaaaaaaagaaattgtcgtctttacgtgtttaaggcattgtcatcatgccatgttcagttgttcaccatgatcatgtcaaactgtcaagtgccaaaaactgagctgaccacaattagatgtaaaatcaaaagtgtttttgattattattctgtgatgaacaattggcatcggagattattggttttgttatttggaatttattcacgaagtggttttggagatgattggatttacaggtgaatcgcaggtgttgttatttcatgtgaccggtcagaccgggcagtgtgagccggacagaccggcgtgtatcgcgcggtcagaccggtgcagcccgcggtctgaccggccgacgctgtgtcggtttcggtttcgggttgtttgtttggatatccgtgattatttcatgattatggcttctagatggatactatacgtatgtaatactgttgtttgctactaatgagtcaagttggagatagcttggtctcggaatatggtttctttgtttatttcatgtgtaggtgactcgatgtctcggaagagtatttgcggtgatggaccggaagtcggcttggggataagacgacgtccgtggtggtcagagatcatgcggaatacttaggctagagttgatgcacgtggttgatggagattccatatggcatacgatggagttattgtgtgcgtatgggatgcggagtcgaatttggaaggagtccaaatttggtatgattggttatgtaaagtttgtttcttgtactagagggtttcctaaggtgtttaggactcctagtatgagtttggttcgtggctttaggctgcctacctcgggtataaatagagggggagcgtgaggcttcccagtatcgctttttagagcaattgagttgagttttgagttagggtttcgagtttagtcgaaatttttgtaaggagtgttgttggtgcactttgtaaacatagagagaatcaataaagtcgtcatctactttaagagttctttgatttctgtttcaccgggtttcggcggtctaaccggcgatataccggcggtcagaccggcggcaagcggcggtcagaccggcaggagcacggcggtcagaccggcggcggcgacaggcgcggcaggcgacttcggcggtcagactagagattcaacaccggtcagactggcggcatctactcggtcagaccgatagatcaatctcggtcagaccgacttccgtcaatttcgagggtaacttttatttccgctaaaagttttcggtttttgggtataccaaccattcaccccccccccctctggttggcttagttaatgtgattcgatcttacaagtggtatcagagccttgttttcttctttggatttttatcgatctagagtttttgccatggctactcctgttaggttttcaactaagcctcatgttttcgatggaacagatttttctcattggtgtagtaggatgcaatcttacattatggctgaagattatgatatttggagaaaagtttctcatccttatttgattccattaatattgctactgaaaaaactgcttttgaacaaaattgcaaagctcgcaacattcttttgagtggtatttctcgttcggattatgatcgtattgcgcattttcgaactgcatatgaaatttggaatgctttgagtaactttcatcaaggaacaaataacattaaagaacttcgtcgtgatattttcaaaaaggagtacattaaatttgagataaaacctggagaaactttggatgactatctttctacgtttaataaaattttgagtgatcttagatctgttgattcttcttatgatgctaattatccacaatctgagatttctcgtcactttttgaattgtcttgacatgtctatttgggagatgaaagttacatctattcaggagtcggttgatatgtctactttgactttggattcactttacacaaaattgaaaacacatgagatgaatgttctttcacaaaaagttgattctaagtcgagtgctttggtttcttcttcttcttctttggatgttgatgcttcttcatctaagccttcttttctagctatttttaatgccacatccgatgatcaactcgaacagatcgaggaggaggatttggctttggttgctaacagaattgctcgagctatgaataatgccaggaacaggaaaagaggtggtccaaatcgttgcttttaatgtgattcaattgatcatcttcgttcgcattgtcctaagcttgggagaggcaaaagagaagacaaagatggtgagaagaccaacaacaacaagtcgaagggttcatccctagggaggaagctggagaatctcaggaaggcttttcaacaagtttgcgccgccttcgagccactaagtgatgtagatggtaagagtggagatgatgacaagggaaagaacatctccggtgtttgcttcatggcgcgtggtgaatcggatacagagtatgaagataatgaggtaagtgcttttgaggaagctattaatattttgagtgtaaaaaataagaagtgtaagaagatgtatagaaaacaggaatttatcattgaatctcttaaatctgaaattgataggttaaaatctcttattcctaatgatgatgattgctcaaattgtgaggttttaatgaatgagatttcaaaaattagagatgttaatgctgcacatgatttgaaaaatagatcttctcttgcttgtagttttgctttgcacacacgcactttggatgagttgtttttaactaaaaagttgttgcaaaaatatcaaattgcttttcatgctagtttgatgtttaacatgatttctgctaaaaagttaaaacaacctcatgatgtttttgattgctcaacaagtaatttgaataagatgaaattgaaagatgctttagatcgtgttgagtacatggaagatgttgtaaaaaacaatgaagtgttttcttgccccagatgtcgtaaaagcaaaggtgttatggtagatagtgaaaattgtgctaatttggaaatggaggtttcttatttgaaaaattctttgctaagattttctgatggtaaaaagaacctcaacatgattttagatcaatctaaggttagcacaaataatcgtggtttaggttttaatccttatgctcataattctagacatcctcctgttgtgttaggtgctggtgctagaggtggtgagattttggttaaacctgatactaataaaattgtgtttaaatctgctagtattatgtctaccttgagtgcatcttcttcaaaatccaatgttgtgcatgcaaaacctcttgttactgcttatgttgctaagtcttctaattctaataatgtgtctaatcatcgtgaaaaatatacttgttctttttgtggcaaagatggacatattgttggtttttgtttcagattagctcataaacagaaaaaggagagagagattgttttttgcaaaatcaaagtggcaaaaatctggttttccctcgaggaaaccggtcagaccgtagtggatcccgcggtcagaccggcgatcggtcagaccggctgctgtcggatcccaaaactaatgattcggaaaccgacatgtttaactgtatcaagccctggatcagtagattgatacagcttcaacaatctggatctttattgcgtgcattagaacaacgctacaaacgagatgttgttccataaattaataggggaatataaaagattgtggctaactattacagtagaagctatagagtgactcaaccctaatattttgctattgacttaaaccatctaactaatctagatttgagaactaggttaaaataagactaacttatatgattgaactcctggcttcggcaagaacttcaatttaattctggaaaaaggggtttgaagcaagggtcagcaagctattatattcaataatgaatgtatgaaaaggtaatatttgagtaggattacgattacctgcagaaggcagagaatatagaaatagaaagcctgatgttttaaatgcagcagcatttagtaaaatcttgaattaggtttctaaccaaagtaccatatgagtcccgatactcaattccgtgagcacggctattcgaatagattcaggtttactttactgcagtaaatgtacgctttacccgcaatccatgacatgtcaatattcattagcttagtcatggcaaagcttttcggttactagcatcagtggcacctgttccatgaactctcatcctcatgcgctctgaacgtaattttatcagcagcgagaggagttctggcgttcccgaggtttttagagagggaactggtttgagagacccccgtcatctcaaccaggttttcacaatatacacacacttaactcaacaaatcatttacctgcgcctcagtaaatgttatatttgcccttctcggcatatgcccttctcggcataagtttgcctcttgcacgaggacttaaataagaaccactgtacagaggtaccacctttgctagataacttactttgcaaggtctgtccccattctagtattgcggccgtactcgttcgtttgacataagtacttggtaataactatatcgactgagacagtactagccacccagaaatcaaccaattcctacgtactgtcccaatctaagttcattatatttttatgcaaactaactaggcagggctaagcaaagctagcatatctggttttctatgttcaggttatgcattcaaaatcatgtatgactaatgcatagaatagagatataagaatataggatctttatgctcaaaggggatgaataataacttgcctttctccaacgcgaataaatccaaggtaggcaacctgattatccgatccttgaaatgccacaggttgccatccaaaataagataaactctactgaagaagaggaagagccaaattcaataaaagccataaaataaccagaaaacgataaacgtctaagagggatagggtttagggtataatctatctcctttaaagggtatagggattattgggttaatattttatgtggaggttctagagggttggaggttgaggtggagaggggatcaagcaactcatgtcatttatatttcatgtgtgggtcttggttgcttggagagtaagggatataactggttaagtgagtatgtggctagtattggctggtggtaggtttgggtagtataatacctagggtttggttatatttaagccgattgtggagtagggcaacatatcggctaggttctatattttatgtataggttctagaagagtaggtagctaatagtatggtggataggtgggtatggaatttggatggtggttggaatttaattaggaaggcatcggctagggtttgggtgtttgctagtcgttgctagagttgaacagtataacgactagaattggtatcttctctacccggtgtcaacagacagcataatagctagagggataggaggtttgtgtgggtttagtggggcgcaagtgttactccgacaaccgtgactggcggcggagaggctaggatcacacagagcccaagagctgactgtgcggcgtgctgtggagatcaaggaaatagtgaagctccgaccactatacgcatcgaggcttcgggtgccaggaggagcacttcgaccttaggtttggttttgccgggctttacaaccaacggtccgacgtcggggatagtaaaccgcgaacgtccccatgaaaggcgtaaagttccaaccggtggctttttagtggctaaagggtattttgggttaaaaagaaatatttgaaaagacaaacataaattcaaatagtatttgaataaattcaaataaaatattaaaagagtaaatttggggtcaaaagatagggtttgaatttagctggatttagatccaagtttcactggaaccggatctacggtttaggagatatgggcttctaaagaataggatttgaactaaatctagaaaagacgaaaatgcattgttcatgggcccacctgtcagctttcctttttcttttggggctatctatataggaatcgaatgatttctgaagctccaatcatgcagattttatctaccat

SEQ ID NO: 47590 - DNA, 2133 bp, Oryza sativa
caaggaaataaagcccaaatcataatccaacagcctatccaaaaaagtagtagggaccaaacttggaagccaagtagatgaaaaacatgtcacgtgaatcaaccatgtatgggaccacacttttcaatcccctacttttcaacagcactactagttcacaaacagatctagcacgaatcaaacatggagctaggagaagagaaagaagagagaaaaagaggatccaaatcgcagatggaaggagagagtacaatgtcagaatcaaagagtagttctagaggaaagaagaaatcaaagacaacttctgaacagaaagttgagatccatacaaaggaaacacagaatctggagaacacaaagaaaaaacaagaggaaggcaaaatcaagagaaacaagaaggctccagttcaaggttagttcaaggctccaattcttatcccctatatacaattcctgaaaaagatcaaagagagagtttaggtcaaatatacaattcaaaagaatacatgaaattgttgaatatgtcaaatgaaacaaggttaacaatccactttgctggataaatacaacaactcagaactgaaaatttcatatgtttgctatgtagatctgaactatgtaatgataaaagtaaaactacactgcattcagtactacaaaactgcattctggatgattgtattactatgtactattgatgaataccaaactaaatttataaaaaaaacatgacagattgattagtcttccaaccttactgaatttcactccgaagatatcacagttatacagttatacagaaatataacaactaggctatatagcatatcctgaattgtcatacattcaattttatcagcataatcaccatattaaactaatgacaaattcaaatctcaatgtcaaccacttgtctcatccaactcaatattacataaaagttcaatatctcatacaacacaaacaaaagagccaattcatatgaactcacaaatttcttaacatgttacagtaaaaaagtaataaaattacatataagaatcacagtaattctagtattaactcattgtaaaaagattagttcagtaaacaaaatagtttagctcacacaatcatgcacaaattcaggaacacattcaagatatgttttaaactcaagactatctcagttcaatgtttctctcatcatcagacaacaaaatgaagatttcagataatagatcattgttgatttgttcaatgtctcaaaatagaatataatgaaactagttacagtgaacttgtattacaaatatatagagtgaacactacaatttcaattgaaaatacatgtaactacaaagaaacaatgtaaaattcatatgaaatcatgatctaatgcagtttaatctcaatttcaagatgatttcagatttttcgagcaaaaaacagggtatcaaatacttcaaaagtagtacatatgtaaaaaccaaaacaaatcatatctaattgaaatagaaagaaatagaaaagaaaaggtgccatcagatattataagaaaaagtgccatcagatagtttgttccataagtaaattttacctggaattacagtagcattacactctaattgaaatacttatttactgtaatactacttatggaacatactcatacaggtttgaaaaacatttaaagactatcttgaatatttctttacaggtgtcatacaaaaggacaaagaatgcaaaagttctaaggaaatagaaggaaaaaatataggtaaacaagagttacagtaaattttaactggaattatagtagcattacactgtaattgaaatacatacttagtgtaatattaaaattattttgaaagaattatacaaattgattcatttgttcacttcagtgtctataatcaagtatcaaattgattgtagttggatttttaagtagttacaatttatgtttactggaattatagtataatttctctgtaatacaaatatatgttcactataaatggacttatgaaaaagattgggaaatacactctatgtttcagaacttgctggtttagaaattcaaaagttctttgcaatattaatttattctttctatgcaggtggcatacaaaaggagaaacaaagcaa

SEQ ID NO: 47591 - DNA, 998 bp, Oryza sativa
cctgcagccctgaggtatgcacataatgttgtgattctgcttagattgcatttaatgttgtgattctgctttctcctcttccttttttttaaactaattagcagttgttatatcaggaacaagacaaaacccctgatgtggcttccgagatgtaagtgaattatcttgacaccacttccatacctgcaacttcaaaatcacatttttactttgcatttatggtagctatacagttcaagttttttattgattcaatcactggttttcaatcgtagcatccagtgcattttttaatgatttatttctctccagtttcttgagttctattatgcttggcacctcctattgttataagctatgttggcttgctgaataggctaagtttttttttgtcataatttggccatggtaaaaagaactgtagagaaatgtctgctgtcctgactgtgttgggaattcagcaaattccttacaaacacccaataattcctagttttctctagggatgactgggtcgggttgtgccagcccatgggtccatcctaattcgtttccatgcaaattaactcaaaaattactaaattgaacaccgtttggtccaggtgtgaagtaaatgggattcccacaaacatccctagttattccaattgtgaaacctgtgactaatttgtcatacttatttgcatcaagtggtattttgtttgataaatttgtgttactggttgtttcaagttccccgaagccacggggtaggggcagaaaaggaagagggagctcagtgcaattgaaggaaggaaatgcagaaacacctaaaaggtaatttggtaatcaaagaagcagtgtagacaattgactacatattttctgagacttatgtttctgtttaatggcagtggtggaggcgatcttcccaaaaaaaggggtcgtccgaaaggttccagcaatggtacacccaaaagtaacatctcggcaacttcaagcaaatcaaaggggaaagc

SEQ ID NO: 47592 - DNA, 11440 bp, Oryza sativa
gatcatgcctattgctaactgctttctgtcatctctgcaggttgtttcacaactgtcaggttgtctcattgtgtttatcttggcatacttaattctgtacttatgttattctgttcaacgttttatatatgccagtggaagcagcgatctccctgtcgcagattgcaaccatgttgaagctgactacggcctggctaagctctgcacttccagcattatccatgagaggtatggctaagccttaaagctctactcccttcattcaaaaagttgcacatgttactttgttactaaaactaaaaagaaattaacttatcttacatgtaataaagatagttttaagatagttcattgagttttgatcaaacatttaatatatctcttcatttaaatcttagatacatggaggactacaaatataactaacttatttggaaaaaccaaaatataaaataggtacatttttaatggaaggagaaacctaaagggccactcctaattacaattggaattggatgaaaatcatttatatcatcgataaaggccagcgtaaaaagttatcacaacttatagagattgcatgttgccacttcaaccttaaatgtaaagcatttctttagatttttcacaggaattaaggaattagataggataaatgaatggtgaaaggttatgattgatttagaagagaaagtaatagaaaaattaaatagggatagattggttaagatgagaggatttggcgaagaaatagttgcattttaaaacaaatttgtattctagaaatagctatattttagtcttaacagtggtaacaacaagccaataacagtccatgtaagaattggcccctgtgcattcgttcagtggctatgggtgtgtttagatcccaaaaatttttggacaaaaatagacatcaaatgtttggacacatgcatgacgcattaaatgtggaaaaaaaatcaattacacaatttgcatgtaaattgtgagacgaatcttttaagcttaattgtgccatgatttaataatgtgatgctacagtaaacatttgttaatgacagattaattaagcttaataaattcgtctcgcagtttataggcggaatctgtaatttgttttgttattagtctatgtttaatactttaaatgtgtgtccgtatacttaaaaaaaaattggccaatgaactaaacatggcctatggaaacaaacgtctggaaattgaggttcagattactgcatagtgcatacccatgaggccacacggcttgttcctcttcgggctagtgggctaccaagtccatgacggcacgaccattatcaactagtattgacttggtcggtcgtctcgtcgtctcctctcatctcatgccatagcggaggcagacactaaccaggtcaactattccattatttctcccaactatcccatctccaagtcgacagaaaagatgttcagtggtcaactaacacgttacaagatgaacgtcacctaatttttcagaaacaacggcttatgatttcgttggtcatctgggaagcatcatcggtcaaggggttaggtctaaactgttcagtttgcaatgtttcagtcccctactggtcaatttgacactagtaaactctatatatcttcataagagtcaactgaaattggaattgaatctctcttcaagccgagacgcgatagcgggattcggcagctgtccatgtctagtttgcaatagatggtcgccgtcgttttataacggggtcatgcactgccttgcgccggtcaaaaacgaaaagaacacggtctcgtcagacaagaaacattgtgaatgttatccgacagtggagtcgaccaggataggacctagtaagtgcgatgcttgatcagctcacctcccttttgcaggacgcgtcgttttctttgcacaatttttcgtcgccccgggacccgggtgatcctatcacctcgcatgcctcgcttggatcggcaacaacgcgtgcgggatgtgccatttgagtcccagtttttatccttgatgatgaggatgatgattcagctagcgtagcgttgttaacttttccgtcctttgcagagctgtgaggctgcctgaattcagccagaagaaacgaaggccatgattgagctacgtgcctaacatatcctaggttagtgcatatcatctctttaaaagttcaatccaatattttttatttgcggggaagttaaatgacaaaaaggccgtgctttatgggattacgagcgagaggcgattctccagtaaattccgcatccgctggtcttccggaactgggctaactgtgaaccgccctcccattagagcaagtttaatagtatagccaattactagctccaaatcatctataaccaatgtaatagctaattcatacaatagttgcttactactcctttcgtttcacaatgtaagtcattttagcatttttcatattaatattgatgttaatgaatctagacacacataacatctatataaatgtgggcaatactagaatgacttacattataaaacggaggaagtatattattaatacatggtttcacctgtcatacacacattacgtcttagagtccgtgctgcaactggctacagatctgtagcccgctgctcttctatctcttcttttatctctttaaaatatgcttatagctggcttataccatgctattgtacctgcccttagcgccctgtagttatacttatacaaattctttgggtggtagcactagttggactcggcaatgttggagcttttcatttctttttaaagcttggaactacgtagtgccgtggtgcgcattggtagaacggggagtggttcgggatcgtgggggctctccgaccgcgtgcaacgtgccagtccaactccaaccgacccacacaaacacaactttctactccactacgtgaccattacaaggactcgtaccccgtcctcgctcacttgggccgttcaccgcgctgccacccgagtcggcgagtcgcggagacgacgccaccacgcgccccaaaagtcccccaaatccaccaccgctcgcgccgcccccaccgtaatccccaaccccgaacgccactcccccccgtctcgcgtgaaagcaacggccgcgatacccgtggggttgggtgacgtctcccgcgacccgatcaaatcctccgccggttcacccgcccgccacctgaaggcccggcacgcgcgcgagcccgttttatacgggaacccactgcaaaaacgccccgcgtcaccactgcagccgcgcgacgcgagggcgtggcccaaccccaaccccaaccaaaccaaaccgtcgcgcgcgccactcgctctccacctccccgcgagtgcgaggccatgaaggggaagcggggccgcgtgcggctcaacgtcggaggccgggtgttcgagacgatggcctccacgctcgccagcgccggccgggacaccatgctcggcgccatgatcgacgcctcctggaaccacggcggcggcggggacggcgacggcgagggtggcgcggacgagtacttcatcgaccgtgacccggagtgcttcgcggtgctgctcgacctgctccgcacgggggggctccacgtgccgccccacgtcgccgacggggtgctctgccgcgaggcgctctactacggtctcctcgaccgcgtccgcgccgcgcggtgggggccgttcgacggggaccggctgcggctggcggcgtccgtggccgggagcgccgcgggcgacgggacggccgtccgcgccgcgcccgacggcggctgctgcgtcgcgcacggcggcgccgtgcgcgtgtacaactgggtgatggaggagcgccgggccgtgcacctcgaccacgcgccggtcaacgacgcggcctacctcgacgaggccacgctcctcgtcgccgcgcgggagaggcccggcaccggcaggcgcgacggcggcgtggcggccttctccgcgctcaccggcgacctgcgccaccgcttccgcgtcgcgcacgatcgccacgtcaggtcctacacccccggggcgctcgccttcgacagccggtgcaaggtcttcgcgagctgcaagggccggttcaacgagtacggcatcggcgtctgggactgcaccaccggcgagcaggccgacttcttctacgagccgccgggctgcgcgctcggcgacgccgacaagctccagtggctcgacggcacgagcacgctcatggcggcgaccatgttcccgcggacggactcttccttcatcagcctgctggacttccgggacaagaagaacgtcgcctggtcgtggtccgacgtcggcacgccggcgtcgctggaggacaagcacgtgctgcacgccatcgcgatggaggacggccggtcgctctgcgtgatcaaccagtacgacgacctcgggttcctcgacgtccggagcagcggcggcgccggcggcgtgcggtggaggtcgcggagcaagctcgccgccaggaagaagaaggcggcgccgcgcggcgaggagacgtgctacccgaagctcgccgcgcacggcggccagctcttcgcgtcgaccaacgacaccatctcggtgttcagtggccccgaccacgtgctgacgtcgacgctgcggggcagcgacgccggcgccatctgcgacttctcgatcggcggcgaccgcctcttcgccctgcacaacgaggagaatgtcgtcgacgtctgggagacgtcgccgccgccgatcatctgacctgaccatcattgggattggtctctgtaacaagagaggagtgacaatgatgattaccgaacactactgacagagaaactggcagagcaacacgttgtaacttctgttatcggtaggagtaaaaagttcacgtgtcatccaaatggcaaaattggagtttagaaattacacattaaattagagaaaaagagatagatgtgcactgtttgatcgcggtgagtcgttataacggtgtaatttatcgatatgcttgtgtacaatataaaattaagtttatacaaacaaaaggaagggtattaaaatctaattcaacttatttttgctatgtgctgtgcggggaaaaaaactgctaattattactaaaatgttttcctagtaattactactagaatagagatatcagtggaatgctgtcattttcaagaatcagctttgtcattatcctttgtcactcctgttcaattggttgtgatgttaatgatcaccaagcaacgattgttgttgctgagccttgatacatcagtagtcaatttttcggtggtgctctgtcaaaatcattttcattttcaaactgttgtgtcagatagttgccggatgtttcagggctacagtttgcaaatatttgagggcgaaagatctgctctccactgattatgatgccccaagatgtcataatcgtatcacaccgtgattaacttgtctgtttgtaccttttacttgcaaacctgcttgctatccatatctgcgagtaaaatcgaggaaagaaacaaaaagcagagtagaaaagagagcaagaatcgaacatatcttgctcggatctctctgttttgtccttctagtatatttgcctactccttggcctgtcctcattttccgaactagccatcttttttcctaaaagaacctgcgctagattcacattaacaacctcacatttgcattctgttttctgcttttgatgcaatccctaactaactactgtattaagtagcaaacatatcacatacggatcgaggtctcgagctctgtcaccactgatgaacattctgaatatgctgcaaatcgcaatgccgttctctctctttcagcaatgaccactcgtccaatttgaagcaccgttgcagcagctggtggttgagcgtttcgcttcagagtttggtacgtagaaaacaaacaaacaatcgaacaaacgaacagacatccgataaattttctcacgacatgctttgacttgaaacgtaaggtaaggcgaatcaggatgtgcagggagatagcttcgttttcagtcgtacctactgactactgactgaatgaatgacaggatgagcttgtgtcgagtgtgtaaagattgcaagaaatgtatatttatggttgtgtggaagttgtttgcacatatcaatctttgttgtttcgtacgcagactaactactactactacaattcatctggtaactgcacaacaagagtaaagagctgcagatcagagggaaaattgccaggacaccctcgaagggaaccttgcaagtaagcactaagcagtaacgtgtgtggtacccaactacccaactaggcctgtgaatctgcagaagtggttcggaattcagaacgagaagcaagtgaatctgttgctcgtcggttgtaagttcagagtactcggtgtgtgcaacattctagcgagaggggctggtgtcggtcggatactctactagctacagtgattatgacatcaaagtacgtactaaacctcgtatatactattcaaggtgtactttgctggaagcaaagcataattggatcctaatgattgcttcagtaaagtaaaggtaaagcccgcaagttggccaaaagcttaatccggaacagagtagtactaaattctgctagtaatcgtccggcgaaaatttgtgctagcaatgaaccgtgagcaggtggaagtccataacgcatggtacaactgaaatgggtgcctcggtagtccacagcaaccaactgcgggttgaataagtggcctgtggccgccttcagagtttcagacaaaccttcgtcatcgtgcacacgcacgtagcttgccctgacatgggtttaccctgttcgaataagttcacatcaggtcctcaatttgtcgccaagttcgaaattcatccccacatcccctacctacaaaaccatgcaaacgaggtccttcagcactattgtccccggttttggctatcggtggcgcctacgtggctctcttgacgcggcgcttacgtggtaattcaatctgaaaaaataataaaacccacgggacccacatgtcagtttcacacaaaaaataataaaattgttggggcccatgtgtccccacatgtcatcctcactactccactcttctctctatcctctctctctcgcaggccaagcgagatggagcggcggcaggccgcaggtagagcagcaggtcgggtggatgagaaggatgtcgccgtgttcatcgacctcgccggggcgggagaggagatgcaagcgccggccggcaggaagagaggagccacgggtaggaaaggagacgcgagcggcggccagcaggaaaggagtcgcggacagtggccggtgggagagaagtggcgcgcagtggctggcgagagaggagtgatgcgcgagcgttgaccgatgggaggaaaggagtcgtgggaagcggccgcttctccctctccattccctctcagatccctgccccctcggctctggctctaccaagctcaccgcccggtaaggggggcggagagggaggaggctcacccctcgggctttgcctatggctcctctcctcccgccggccagcgcctgcgcgccgctgctttcccgtcggagagaggggggtagagataaaaggagagagaggatagagagaataggggagtagtgaggatgacatgtgggctacatggacctaccattttttattattttgtatgtgaaactgacatgtaggtcctgttttatcaatttttcggatcgaattgccatgtaagcgccacgtcaatgccacgtgggatgaagacctagtcaaaggagccacatagttgccacgtcagccaaaaccggagtataatactgccaagggatttcgtttgcacgattttgtaaattgggggatgcgttgtatccggttttgcagtccatggatgaatttcctactcggtgacaaataagggacctaaagtgacttattcctcaccctgtttccccgtgcacacagctcgtcggatcagttcacagtggatttgccggctgcggcctgccttgacggaataggaggcgccgcaaagatatggcagggttgggtcttaccgcctcggcctagacccgcgttgcggcagggaccgggaccaccgggtagctggatggcacgcgactcgcgctcgtgcgagcggccaccgcccgtacgacatgcggtgcgtgcgcgcgatcgccaggttttctggcgaggtgagcgttacctccgcgtgagctcgcgcacgcagctcagttcggcacgtacgcacggcttcccctcggtggatggatctcggcgcgcccggcgttagctcgccgaagcgcaacggcccggccggctacgctagatcggcaagcgcgtgtgcgtttggggcgtccgcatcggacgggtgctgggtgcaacgacgtgcggcatcgcgggcttcctgaagcgggcaatctttggatgggctgcgaaaggcccaattagaagatttgggaggcccccatcttgctcaattttccatctgacccacgacgacagttatatatgaataaagcgaagggcaacagttatcaattttccgttgaagaatcggagcataccacacaatcttataagtttcaggtcaggttatatttttctttcttagaaaaaaaaaggagcatactgcatgtgcatccttaatactacacacttggaatttgttaagagtaccaaagacaataagaatgtggtaatgtatgtacagaccaatagattacggagtatatgtgctgctaaaatcgggagatggtcagttctcaaatcggggacacttaaacgttgtttggagctagtgagcagacagtcgcacgtccaggcaagccacatgaaagctgccagatcaggaaacatttgggtgggtggagagataagcggcgtaccaaataggggtactacacatctggctcactccacagagataggaatttatagcggccctaccttttaatcattgtacacaagacatcatgttttgaagggaccaaactaaagtagtgctatgcatgtcttcagttaagacagagagatctagagagagaaagggggtagatatcccgctcagttaatggctactgttgttggcaatagagagaggtgaagaacgtataagaagacaagaaggacgacgacaattctccgacaccagtatttatcgtgccacatgaaaataataatgcataatgttttttttgcactcgtacagtacaccctctttgtaaatagattttaaactctcgagaaaatatcctctcacatatcatccgaatagttataaaaaaaagataacatagatagattaatatgtgatatatcactctaaaacatataagttaaattctaccaatacaagttgcaacaaaaagaacaaactaaactatagcttgttaacatacattcacagtcaaatttatttattatgttatgaattataggaagttaaattcgatcttatatgtttgtgaagtgatacatcttatatttatctatcttgctagtttttctaaaataaatatataaccatttaaatgatatgaaaatcgagggaatattgtccactcgagagtttagcatcatttcccatcttttatctctctcacctccttctgtcgatgtcacattacggtcatttgtgtagtgtgtgggagctggagactaagggtttgttaggagctggaagccagccaaacagtttcagctccactaaaaaagaaacgaagctaggtgtagcgctctcacaaaatgaactagagaggtgaagctgggtttaggctgttccactccagacccacctccttgaagttcgagctcgaccaaatagaccataatctgagaggcagctatttaagtagacacacgatgagaatcagaaaaaaataatgatgatgttaatgttttatattttaaatcctactatgtgaaaatatatatattaatatttgttatccaaaaatgaaactagtagtactaatttgttatgaaaaatacattcatattgttgtattttcaactactttcacaaattcataattagaaaaacaatggtaaaatatgtacaatagaaattgtgtcaacgttataaacttgtaaataattaatgagaacatgatttttaccaagcactagcgcatatcatattatcatctacaggctaagcaattaaatatgctttactacgatctactagtatatatgttaccacaagcagaggaatacaatattgtatacgttattaaaatccgcgatgtatgcttgaatttcaaaacaaatacagtactaaggctgtgtttagtttttgaaattggggaagaagtttggaaaaaaaaagttagaaatttatgtgagtaggaaagtttttgatgtgatgtgatataatgaaaagttgggagtttgggggaagtttggtgtgaagtaaataggggctaaatggactacaggtacacttgcacgtcacatgcattggactttcccgactaacggacggagctagtacgagactacgagtcaggactcaggaaggtacgtacgatcatcacttggcccggccccgatctatcgtgtcggcacggcatacgcaattaccgcatacgccggtcatcacaaacacgcatagtacatcggtctctctttgtgactttgtctcctcttgccgtctccacatcgtttcctaccacgcgcgcatgccgcatgtctagctcgatcgctataccagctacgagcggcgcgcgccgctcgcgctctgcatccatccatccatcgaccgacgaactgtcgccggccggcgcgcacgcaggtacgtacgtacggcgccgcatcgatcgtacgaattaaggtctcgccgtcgatcgatcggtcggcgaccatgccatctactccccacaaaaaccgatcgatcgatctgcagacgtgcggccaaatgacagctcaagctagcgatggaggagatggatcttgcttcctagcttaggcgcatgcagtggcagagggcgcgcagggggggccacacagtgtgtgtgtgtggtggtgcccacactacagcgagctacggaccgaccaatcacgcgcacaattaaagtaaccctgcaggggccaaaaataaagattggcaaaagatactgtgccaatacacctgtcgatcgaatagtagctagctataggagagagtggagtacatgcatataccgtatagctttgcattcgtataggttagccaattattttgcgtctctagctttgcattcgtataggtatgcactactttatgctatataggctcgcacatctcacaacttggttttcaaaagagttcgaatcgatctcgctgagctagctatagctggtatagttatctagctactgtatatgtctcagaccgccgttcaaaaagcggcatggtggtgcatgg

SEQ ID NO: 47593 - DNA, 2730 bp, Oryza sativa
ctagggcaaaaatcatccttgtacatacatatatgttatatacgaagatggaaccgatttaattttgcctttactcgtcccaggcgctactcctttagcactgaggactgtgaggttcatccagatcatccacccctcaacatcctgtacattgcccaggcttaatctagaaagtatacagttcaatcgtcaccatcctaatcctctttcgattaaggctgactggattttagagcctgtaataccgatcaatagtacaatattgtgatggacctaatatcatagtaggctcatatttcactagacatacccaccgattttgttatggaccaataagcctatcactgatggttggctaactcgataccaaacatgatcactcatgagaaagaacatctgtaattgtggacaccattctacctgtgtgttaccgtagaggatttgggtgtccatgtccaacgtttgactgtccatcttatataattttttttataattagtatttttatttatgttagatgataaaacatgattaatactttatacgtgacttgtctttttaatttttttataattttttgaaacgttggacatgaaaatctataaggtttatctttttttttttgagacggagggagtacaagttttatctggcagctctatctcgtcttgaagctcatgtggcatgctttaaagatagctgagccgttctgttgggaggtgtcaaattttgtcagctcccagtagcagtcacatgtatcatgcatgcgaccggtcgtaagttgagcggtgtggcatgcatccaattctgcctccaccaccacttggcatgcctcaaactggaagaaagacatttgtactagccataccctgcaaaggattagctagctagctagctacgtacaacaagtgtgaagatcggactgtagatttgcaggtagcccctggtgctgcatcaacatgcctgcaatcacgcgaaaaaaaaaaactattcgacgcgtgctctcgtgctctttggcctgatccttttggagcaagcgatgctgcactcaaaaccactcgatcttggctgtgcattttctcgggtttgtcaaatactggctgtgtttagttctacgtcaaaattagaagtttgaagaaattggaacaatgtgacggaaaagttggaagtttgtgtgtaggaaagttcgatgtgactaaaaagttggaagtttgaaaaaaaagttgtaatctaaaccgggccactataagcatttaagcagttatgatcctctataccatgtaatctcatttactaatgtgaaagagagaaatgaagagagagtaaattaagtagtcacccctcgtacgagggacaatttctatacaaaattcaataaaaatataaaaaaattagagttactgagatttgtgtgttgtaggtaacttgtcgtgtatatgttaatttgtagagatatattaacataaataaaattataggtgatagtcacatctattataaaatttgttcttagcagcaacaaaatttctccagcttaggcccggtttagtttccaaaaatttttgttttgatgtgtcacatcggatatacggacacacatttgaagtatttaacattgtctacagatctcgccaggaaactgcgagatgaatttattgagcctaattaatccatcattagcaaatatttactgtagtactacattatcaaatcatgtcacaattaggcttaaaagatttgtctcgtaatttcccggcgaactatgtaattagtttttttctatatttaatactttatgcatgtgtccaaatattctatttgatgtgatagggtgaaatttttgttttcagaactaacagggccttaggccaagaggacgacctaactgacatgacactagcttatactccctctgtccaacgaaaagataaatcgtggatttccgtgtccaacgtttaactatccgtcttatatgaatttttttataattagtatttttcattgttgttagatgataaaatatgattaatactttatgcgtgacttgtctttttaatttttttcatttttttaaataagacggacggtcaaacgttgtgcacgacaactcatggtttgtcttttttttttagggaggtaatactcctagccggccggagagatgtctttatctcttttgactatctcgatcgcaaaagcaacctgatggagtgatgggtcgtggcttgggtgatgggtccattaattaactgtacacatacgcgtgcgaattgtagctagcctgcaggtcggtcaggcagagtaacagtagtcagtttggacttgcagctctctctgctctcgtactgtcaaagtcgggtaaggggagagaagcaatatttggcaaaaaaatatcctgcgccgctgcgcgcttttccccctcctcgtgtcgtgtcgagggggccacagcccacaacccccctccggcgcggcgcggcgcagcgcacggctcggctttattgcgccagaagccgttcgcgttcgcgaggggcgcgcgcgcgacatggcgcgatcgcatcatatcgcgcctcggcgcggcgcgggatcgatcgatcgatcggtcggggcggggaaaccctagctagccaaggcagctagccagccggccagccaggctgccccatctgccagcgcggaatgttccaccgcgcgtcagtccgtccctcccccgcggatcgacgggttcctgcc

SEQ ID NO: 47594 - DNA, 1302 bp, Oryza sativa
ccgcaccggccggccggccgccggcatgcatgccgcgtccgggtgctcttatcatcgtatgccccaggtactcctcgggctcgatccgtgatcctgcaaaattttttgggcggttgccgtacgcggccggatctacaacgacggtgagtcggtgacgcacgcacgcgcgtgtgtacttgctgtacggattccctcttgctttgtacaagagtcctttgatttgtcctgctaattttgttcgtcttttccaagggatcccaactcccaactgccttttcctttcttgggattacaaaatactaactgtatttactgtgacattgactgattttgattggttccaagagatggatcttggaaataaccgacataaaatttgcatggatctactgatttcccctcagatctgcgcgcatctctcgttcaattccttttcttactgtagctctcaagattggaatgttcgttgcatcagcttaattagaggaggtgacgggaagaggaaagaaatttccctcagatctgctaattactccttccatctcactaaccaccagatcgatcaggtcagtagctagctattgctgccacagatttcttgtgtgtcctctacttgttcagttctacacgtgtcgctgctgcttgaagtaattgcgtgatagaacccctgtctcctgaatcctgatagctccagaaatagtagggactaggtcactgtccacttactgttctattggtgacgtctcgtacttatctctacaatgcaagccgccgtacttatctgcagtgccactgtccccccccccccctccctctctctctctctctctctcaaaggaaaacttcccaaatcaaaacaaattttgcgcaaacctgcaactatgtacatacattagcttcaaccattttggtttaggggagatctagctggatgtggaatcttgttagtcttaatcttttaagaaaaaaagaactctcttcggtttttgtttcattttcagcttactagaaacaaatggtccggttgtttctcttattctgtttaaccagataaagtaaattcagaggttttattatggtgctaaacatatctatcaattgatggttcctgcgcccgaagtaaagttcgctttttatttcattcgtcactttgactgtgaatgccatgttctctcttgatcagtttattttcaggagtactagactactggttgatatatgtaaatatccatatctagtagagaggagatctagctagctaatgcaacatcttcatgtcttttaattcttttaacacagtta

SEQ ID NO: 47595 - DNA, 6580 bp, Oryza sativa
gtcaaagtccaatgcctgtacattcattgatttgttttgtcctagtgtaattggagaactgtcattgtgttcttgctctaaagcagcatttcagaatccatcgaaaaccaaaagtgggatcaacaaagaaacataaagttgagattataaaccccagaactactataccacacccaatgtgttgtacattttatagaatgccccagtacaacataggggtaaaaaatttacttgctgtgtatttgtgtagcgggtatacgcgtgattaatctgttattgcctctggtccggtttgtcatcattgtatatacttgatatctcataatttttcattcaattatctgcagattgttcgcttggaattcagtcactatgatgtcaaatcatccaagacaatatctgtgaaggactttgcattatccatggttgcttctgcagatatgaatcacataaacaagctacttgacagagttgatgattttgatgattatcctgatctcaaggatttgcgcattacctttgaggtttgaaagtttgctatccagatattccaattgtagtacttgggtgtaatgtctctcttgatcatcataattattacctgaacttcaggagttcaaggcttttgctgatctgcggcgaaaattagaaccatttgcaatggcaatcttcagctatggcaaagtaaacggtttgctgaccaagcaggatctaaaacgtgcagcaactcatgtaagattcttcataattccgtttatttccttttgacataagatgtagtctgaatcagctaatgttaatgtaagtcttaagctattttggactatcactggcttgtttcatatttccagccctgtgctaactgaacagctaggtcctaggtcttgggagtaggaccttcccaagacacccacataattggctgcattttctgattgactttacaacattttttataggtttgtgaagtggacttgactgataaagtggtggacgtcattttccttgtgttcgatgcaaaccgggatgggagccttagcgcagatgagttcttgagggcattgcaaagacgagaaagtgatattcgccagccagcttcttcaggtttaatgggagtatttacctgtttgttgaactgtacaaagtgttctcttcagcagactgtgatctagtaagcctcttgataacccccaaagtcgtcctctgttgcccttggttacgacactccttttgatttcatatgctatacttgctaaatataaaatttcagcagcataattcagcttgcataaggttcgagtttgtgatgtttctttgccatgcgcaggtgctggggagcgaaaacgaccacccactggagttctgcaaacacgattttgctgtaaatagtcttgcttatcaaagttaccgaaacatgtagcagctgcaaataacatgtttcgcactaagcccaaggcttcgctgacagaactctactccactaatgtaaaatgaacctatgacatggaacctcgttaactgtctacgccttgattcagttactatatccttacatgtctacgtttggatatcaatcttgttggtaatgactaaatatgcaaaaatgaatcggtgataattgtgatctctatttggtagagaagctttcggtatgggctacacgacttgcaacaatatacatgatgttgagattaaggggcctaggttgttactaccacattttgtgcctaccgagtagtgactagtgagtactaaaggtctattgggaaaatataaagtgtggacatatgttgatatatttggtttttgcctttttgcaagacgttcctcccaagtaattgtccctttaccaacgaggggacctcgatatcccctcgagggatgaaaatagcttcccctttaccaagggggggcaacgagcatgctgaaaaacactttactatctatttttgaacataccgaaaattaaaaattaatgatgatatcgtcgaggaaaaacatattacacacatgttacacgcagataaataatcgacagcatcgactgatcatcagtaggggagcctgacgttgagccgcctgagccagatggagtggagcaccatgtggatcatgtcgaaccggcgcgccgggcggtggagcacgaagtggcgctgcgcctgcagcacccgggcgcgcagcacccggtacctccgctccgacacccgccgcaggatggccctcagctccggtatcctcgccgccggcacggccaccgacatcttgccccagtccagcacgtcgccgaacggcggcgggtagccctccgagatgatcaccggcacgcacccggcgaacacggactccaccaccctcgggctggccacctcgaagccgctcgggcacaggcagaaccgcgcggcggccatctgcgcgtggtagtcctcgccggcggggaggtactcgtggacgcgcatgtccccgtcgccgtcgccgtcggcggcggcgccgcccttgttcccgatcagccagtgccgtaggagcgattcgcggatgtggccgtgcctgccgccggcgaagaaggcgagcgtggtgcggttctccggcggtagccccgcggtcgggcgccggaggacgccgtcggcgaggtttacctccggcagcgtcgcgtccttccgcggcctgaacccctccgacgtgttggcgttgcacagcacccggatcgcgttgccgtacagctgccggtgcgcgctggtcaccatcggcgcctgcgcatcaccggccaacttagtttcagtgatatgatcgagacacaaattaattaattcttgcaggaacaaacttagagtgcttaaatgttgtctaaataatcataatttttttaaaaaaatattaaaaatatagattaatgtgaatatatcactttacaaacctacaagttcaaaaattcgaattcgttttctataagttctaacaaaaataaccgtttgaattcgatttctataagttctaacaaaaataacaaatataactgagaatatatgttaacatgttcaatttaatttgttgtttttattataacttgtagaatcgaaattaactttgtatatttgcagtgtgatatatctcatattatctatcttattatttttttatatttttataattatttaggtggtaatgtaagaatcaaaggatatcgagggatgaattaaaaatccatctccaagtggtccatacgtacgtacccagtcgtggcaggagacgatgacgtggtcggcgccgcgggagcggttccagtaggggtagcgctcggcgacgacgcggacgtagtcggcgacgaggccacgcagcggcgcgaggtcgccggtggcgttgaggcggtagacgtagtggacgaggttgcagacgctgatggggaggaggaaggcgtgggcgtcgtcggggcgccgcgcggcgaagcggctccgcgggtcgtccatctcgtacatgaactgcccctcgatggagtagatgtcggtgcccggcccgatgtgcgccaccggcggctccccttccctgtacgtccagatcttgaacctcctctccatctccacgtagctcctaatcgcaaatgcacatcggtttttgcaacaacggtagaggagtggatcgatggatcgacggtgtacgtacgtacctgtggaatgcacgcgcgttgcggtagatggcgccgcgcggcacgtagtcgtcgtcgcccgccgcggcgacgaccgtggaggctgagccgcggcggcggatgctctcgtcggacggcggcgtcgcgcgagccgcccggcggatggccgcccgggaccgagctaagccggcctcgatcttgcctcgcgtcacctgctatacgcaccaagccaccgatcaatgcagcgtgattttgcagtgaacattttccattcgcgtgtcacgtggcgacgtgcgcgagtaaattaccttcttgttgattggtcgagcatggacactcgtcggcggcgccttctggggttcgtccgggacgtgccgtagtgagtgctcgctgccgcggccgtcttggatgccggtgccggaggaaggagcgggcggcagcgcgacgccggcggctacgacggcgaggagtgctaaggcagtgagcggcacggcgacgcggccgctctgctccatggcaatgtttgcaatggctaagttagctgctgctccactcgtttgaattggcacgcgcatgtggccacgtttgaacggtaggccgcgatatatatatatatatacgtgttgcgtgtgcttgagttgactgatcccgtgatccgcactgtcagctcagttcgttacaatcgccggtgcctcctgagtttacaaaccttcgaaaatgtgcagcgacaacggcaacctatcgtgatctgcagctgtgccgcagccattgtgcatttgtgccggactggactggactgtacatttctgctttggtcatgttcagaatcttaggacgtgacggcctgatgggcagcgaaaacctgcttaccgtcactgctcctaacacagttgcaccgcctccatgcgttctacgagctgggaacatatactgtgcacatttcgtgcatacgaattagcaaatgtcacagtaaaaaattagacacatacttttaataatgttatgcatacatgtgaaattttatcttcaaatttattatattttaaccataacaaaaaagacaattctgacagatttttactcttaaaaccgtcaaaattttcattttttttatgattaaaatataatgaatttaaatatactccctctgttttttaatagataacgccgttgactttttctcacatgtttgaccattcatcttataatttatgtaattataatttattttgttatgagttgttttattactcatagtactttaagtgtgatttatatcttatacatttgcataatttttttaataagatgaatggttaaacatgtgagaaaaagtcaatggcgtcatctattaaaaaacggaggtagtaacactttacatatatgtgcagtactattaggagtagatgtctgtttttttttagatttgctagttgatatgtacggaaatcttgtatacataggatatgttcacctacgagttggaggtaatccatacattgtgccccatcgttcattccgtcgccattgttcccgtatccaaatgttggtctttcccctgtcaacggtctaagtgcttctgaatagcataatagtacgttgtccaatttattccttcagttccaccctgcatgctattagtctaataaacctgcagtaaaacagagcaaatgagagacagagagccaatgcggaagaaagaagaaacccaagcacaatgacatcacaaactgccacagaaaatgcggcactgtacaccacactacacataagcatcccacaatggcgaggaagcgcaatatttacaattttgttccttcccgtcacgccttggagggtacacggagtgaaggaaatacaagtaattttttcagtacttgaaaacgaaaagatcccgataaacggagcaggaaggacctagtaaatgctgttgagaatagtcccacattgaaagtttagggggagtggcaccaacttaaaaggggaggggtccctcacctcatgagctagcttttggggtgtagaaaggctttctcccggttgggccaacgtctcccggttttaggccaacaaatgctaccatagactttacttattaatctggcttcaatccaggcccttgcaaagctatctacatgaagccatccagatgattatttacaggtgatcatgtagtgtccagctactcgggtcgaacgcttatcaggttggggagcaccgtcgcctgcagcttcttcacctcacttgtcgtgaccctgcaggaatcaagcgacagcgagcgcaggttctgcagatccttcaggtggcggaggccggcattggatacacgagtgttggagacgttcagcgagactaaagcagttaagcctgcaaaccgggcaatcatgtcatattgtcatgtgataacagcacagatagacaacaatagagtgggcacatagggacgtcatatttgacacggaggaataataccagaaatcagctccagggttttgtctgtcaggttaacgttctgagaaagattgagttgcttcagagctttgagatccttgatattcttcactccagcatcagtaattaacccaccgcagacttcaagagattcaagattcttaaaaactgaaatagcatagatcatgttagctgatgtgccacgtgaacatataggattcagcagatgataatcaatctgatatttctgataatgctgctaaaatcatatgccactatgcttataagacacttatctatagatatgtctacttgacagggttcagagggagcaaaatacatttagtaccaagtgtattgcctagtaccaatttaccatggtacagatcagaccgataaatattggacgaaaaaaattgcaagctcattttgttgtagctaacattaataaatccattttgtattgacattgatgtagcattgtataatggg

SEQ ID NO: 47596 - DNA, 1228 bp, Oryza sativa
gaaaggtcttagacagggggatcctatatccccattgtttattgaacttggttgccgacgccctttatgaaatgttgaccctggccaaggaagttggtcacttagagggagtggttccaaaccttgtgcctggagggctcactcacttgcaatattgcggacaacacgatcctttttttgcagaacacagaagaaaacattctaacagtgaagttcttgctgtattgcttcgaggcgatgtcaggcatgaaaattaattaccaaaagagtgaggttttcgtgataggagtagatgatgctgaagcccaaagaatagcagaaaaatttaattgtgagagagggaagtttccaatgaaatatttggggatccccataagctcagtgagattgacagtggcagattttgcagcctccccagataaactagagaagagactggcgacatggaaatgtgggcacctttcttatggggggaaagcaatcttggtgaattcctcctgacttctattcctatgtatacaatgggtgtctacttgctaccagaaactactcaccagatgatggactcaattagagttcgttttttctgggaaggtcttgagaataagaggaagtatcatatggtgaaatgggaagctttatgcagacccaaagagtttggagggttaggttttattaacactagagtgatgaatgcagctttgcggtgtaaatggattgttagaattgaatctggccaagatgatctttgttgcatgctacttcacaggaagtattgcagcaatgagggggagggaggtttctttcaatctagacaagagggtggttctcagttttggaaaggtttacatgctgtgaaacattggttgaggctagggagctggtatgaaattggtgaggggaattcaactagtttttggaacgatgtctggtctggagaggcgcctttgaaagttactttccctgcaatttataaagcgtgctccaaccataatgaaacagttaagcaagtgcacaactcaggtgaatgggtgataaatcttaggagatccttgacagagttggagttagaagagtgaacagagttgcaggagttgttataggagttccaaatgaatggggggagagataagatgagatggaagctaactaaatctggtgtattttctgctaaatcactatacagagagatgacctttggaggcgtgagagatagcagaatgatgga

SEQ ID NO: 47597 - DNA, 1345 bp, Oryza sativa
ctagatttgacatgagtgcttatggtaacttcgttaatctcaagatatgtcagcataatctttttaagatgtcaatagggatagagtgcgcgtgtgtctgtattgtgagggttttcgtttgtattgcgttctaaaaacacaaagatcatcggttattcccgctaaaatcggttgattccacttggaccacattggcacgtgtactgccacaaatatacccacgtactactgtttgtctgctgtactgcatccgggtttagcatgatgtttggtcgactattgagatggtcaagagagcagggcaataactgttattctgataaggacgcatcttctttaataagacaagtgagatgcacgttgtctgaaaacagttctaccttactgctcaccctgtaccttgcggtacaaatcctacaccaaattggctctaccatttggtgccattttgaccgacgatgagcacgagttctacgtgccaagactcttgagctagaccgacacttttgatctcattctcaccagcccaagtgattagtgcttcccttgtccctttttatccagctgaagtcttttggttgcttccacacttgcacacacctgccagataatccgtgagatacgacggctacgaaatcgcaatgaatcgggtccatactccaatcctcacctactgaccaccaccaaacaccaactccttccctcagagttgcttcacgtcttctcaacctactccctcaagcctccagtttttccacgccctgataggtgacttgagcgctggccgctggaattcagcctaactccggtcccatatcgccacgttggccgcgcacgtggccacgtatgacgtatgcatgtggttcatttgggcctcgcttggaatgctgtagttgggtacgaagaccatttctgtttgtaagatacatgggtcctttgcggtattatatctgtagtagcagtgaattacaggtaaactcggttccacaagttagcggcagctgttgcagatgcggtatcgcagacaatcctgcatattgcgatttctgtacttgagaaactgataggcgaagtaaaccaccgtgattaaccttattaaccctctgtgtttcgtaatgtttacggattaattaactgttcacaatacaaatacagttggcacaaaatgtgtcctgcccaaaagcgggaaggcaggaagggaaaaatttgcaggaactaacgtgtggaatcaaagaatcgttgctgcatcctaccgatgataggctgtgttaagaaccaccccgcctcctctccatgcatgtgcgcgttcgtgcgtgcgtacgtacgtgttgtttgatttcagagg

SEQ ID NO: 47598 - DNA, 1386 bp, Oryza sativa
gcacctaccgtttcactaagatacctctagttcaactaacgttaccatattaaattccaatcgtctagaagcaattcatttgacctcttgtatctcaacgtacttcctctgtcccactaaacgtgtactccgtatgagcgaatgattgcttagaataatactcaaggtctcggtcatggcaagccaacttggatgttgcagaccaccttacctgcctgaactcaattatgggatcatagatggagcctagacagaaaatatacagctggagaacctgattaagggcagactaagggcttgtttagtaaacagggacttacctgtcacatcggatatttggatattaatttagagtattaaacatatactaattacaaaacccattccataatcttggactaattcgcgagacgaatattttgagtctaattacgccatgatttgacaatgtgatgctacagtaaacttttcataattatggattaattaggcttaaaaatttcgtctcgcagattagctctcatttatgaaattagtttttttattagtctatgtttaatacttcaaattaacgtccaaacattcgatgtgacacgtactaaaaagttttagccccatctaaacaccccctatatggaacgatcaatcaaattaaggtttgcttgctagcacaaagcaaagacaaagaaacatttattttttacattctagctggtacatcattgtctttcaaccaacatgtgtcgtgcatccgaagaataagatgtccagcaaataactaacattttgttgtttggttaggccgtgtttagtttccccctattcccaaatttccatcacatcatatcacataaaaaaatttcctacacacataaacttccaacttttttttcaaactcctaactttcttcaaacttccaacttttttcaggaactataacacacccttaagctcactctatctcaaccgggtcagggggtcacccatgtggatgctgatgatgtaccaactggagcagttgtgacaattgtgaggctgtgcacaaatatgatctggcaatcttatcaaacaattggttcgctacttcgctttcatgtttgacaaaagaaacgatgatagctcgcaagtcacaacaacagcgagaagtcggactcaagtaggtagaacaccttccccaattctcagggtagttttcgacttgtctagctgtcagaatatatggttctaaccaaacaattacacggctaggttgttttcatgctgtacaatttcttttaaatttcccgcaaaagatcttttaaattcatatgttccaaattgatgggatctaatgacagggttcaactgtgcgcaggccaatcattagtcattacgggctgcaggaa

SEQ ID NO: 47599 - DNA, 5686 bp, Oryza sativa
agttccacagcctcacccgcggcgtctcctccgccggccgcaccatcgtcgacccccgcacgttgatcttcatctgctcgcatcgcacgcaacacgatcaaccaatcaatcggtcgaacacctcgccggcaaaccagcaaacggggagaaacatccaagcaagcaaacgagatgaaaacagagagcattccaaccaaccttcgccgacgcggggcagatctgggaggcgagatcgaaggcctttggcaatggacaatggtggagttgtaaaagtatgttaggtaagcagctcttgggggagagctggtgagctaacgaggggtggagcgccttttatagctgtcgctgggatgccaaattgccaatatcgcatatatttcttttttcctttttctttaagtaaaagaaaaagaaaaagagtagcggtgttactccatcaattttcataattcttgacttttataaagaaaaagaaaaggagtagcagtgttactcatcaattttcataattattgacttttttaaaagctaaacttttataactttaactattaataacttcaaaaatatttagtttaaagacactaaaacaatctatatagatttgtcttacaaaatgttataataaaaataaaaatatgtttatttattggatatatcataataagagtatagtaaaccgtgtcattatttaaaagataaggaattatgaatatgcaacctgaataagtattttatttggaatttatgccagtaattgaccggtggtggattgcttcggaggaggaagaggtgaggagttggtgggatggatgacctgcgtgaaagcggaggaggtcgggggtggatcggattttcctggcttggcttggggaaggtttgattccatctgcgctcgacggctcgaggcctccgtctccgtggacgcggtccaccccaccggacaatggacgcggcggtgatgatgatctcttcgccgcatcagcgatgacagcttccttcctagtactatctatcattcacgcgggcctaccctaatgacaaacaggagcagcggcagcttcccaccggcgttggaaaatggtgtgatccactgatcgatctcccgtgtttttttgttggcgaattgacgtaacgacttgtcttttcgtttatgcttatacttattagttaaaatataaatttttaaccttaaatttaagttgattttgggaggttttcatcaaagtttattttcagtattgtttttaaatcgctaagaacacatgtataaaagttttatttgtaaattatttttcgtttgcaaataaataaacgaaacgatcggactgataatctctttgagactatgcaataatacatcagtctccggtgacactgtcacatcttctgtatcgtttccacgaacaattttgcttggatttgcatgtgcggttaatcttacagcagcaatctgagatttttccccagcttaaatgcagcgagttcaaggcgagatcgggctgggtacgatctgctcggcacatggtctgacaacgcaaacccgagttaaccgtttcccaaatattcgggcacccaggttatgtatggaactatggatcgggtcaccgccgcgtccagctttatctggtgcgaaatccttgtccaactcgtgctctactgctctgttcagctgcaccgatggggcagttggagtttagatgacgcgaattagatggtgaattacgtgtggcactacgtacggcgggtactactagctcgatcgctgctgctgtcaaatactaccaggcgcgcttttggttaaacagtaacgatcaacgtttgaccattcgttttatttaaaaattttgtgcaaatatgaaaatatttatgttatgtttaaagaacatttgatgatgaatcaagtcacaataaaataaatgataattatataaattttttttgaataagacgaatggtcaaacgttaaataaaaagttaaaggcgtcatgtattaaaatatagatgtagtaaattttagttgtctcgttgaaccagctgatacatagtactgatgcggtgatgacccagcagcaaggctcgtgtgtgcacgcacagaccagctcttacggctgaacgtttcatagtataagattattggttagtggtataattgtacgaaggctgtgtttagttcacgtcaaaattgaaagttggattaaaattgaaacaatgtgatggaaaaaatgaaaatttatgtgtgtaagaaagttttgatgtgatgaaaaagttaatagtttgaagaaaaactttgaacctaaacacttctgcgtagaaagaaaagtcgctcccgggcgagggcgatgcgacgtcgactggtgcgaaatccttatccaagctgctatcttctgacgaatgtttaggttaggtgctacagtaattaatactgtagccaattactcactagctctgaccaagccagcgatcgatcagcttcagatgacgaggtatgcgaatgcgacgccgcgacaccggcagagagccggaacgtacaacgtgtgctcagtgccatactgctgccatatgccgtgttcctttcatcctgcaaacctgtactctgacccagtctaacaagtaacaaagctgtctgatttgaaaatgaacggatatccgttcgacgtctttgcgttgcaggtgttcgattagtgctactggtacctcattcgtgcataatgtttagagcctgctaataatgtttagaatgatggttgctccagagaaacatggactcaagtactgcatgtctgcatacaacaatcctaaaagggaactttcacatgatgtcagcatcccggaccggtacaccgacagccacaggcccatagccaacagaaacgtacactgtcacggcgccacgaaatcgtaataaccgatgatgtgcttcgcacggccttgcagttgcagtggacagggagtccgggaccaaaggcgcacggagaaagtgtcaatcaaagaccccatccagagaccgcaaaatccaacgtgaatcatgcggagattttcacacgatcgcacggctgattcgaagatcgagcaaactactctggggcctggcggctttacacctacctatgcaaggacgtgcatctgcatcgatcatatggctgcgtttggtcgcaactcgcatgggggaaaagtagatgcaaaaacatagtagtggttcgccgttcgagcagccgcaagaggggtagtagtgggtcggtgtagttagcgcagctgcctccattgcttttgctcctcgggaggtttgtgtcgtgtctttgtgtccacgggaaggcttgacggaacaagagcaaagagcaggtacaatagtagcctattagccagctataaatatattttaatgaaataaaagatgagagagaagagcagcgggctacagatctgtagccagctgcggcacggactctaagacgcaatgtgtgtatgacaggtgggatcatatgttaatagtatagtaagcagctgttgtataaattaactattagatcggctatagatgaattggagctggtagtgggctatactattaaacttgctctaagtaaaatcatcgtcttacgtaggatccgagtcaggatgagatatggcgcgttgccggcttgccgcggcctgccgccgcactgcaccggtcgcggccggcacgtgttgagccttttgacgaggccttccggctgggggccttaaaccgaaccgtactgcctttagtgccttgtaattgggctctgaggcaacgaggccatgattaaattaaacagaaccaggcagcgttgctattagaataagttccggccagtttggtttgaggtctaaattaggcttaccaatttttttttggcaacctcaacaataattgtgtatgtttggattgaagccaaattttgacatgcctatgtaacataggccatttcaatagccaaattagtttaatttggcttcaatccaaacacatgttggccttaccaaaaattgacataccaaaacttgccatgccaaattttggtaaggccaacattggtcacaaaccaaactagcccttcattttggatcccttcttcgttgctgagttcgaatttcgtcctcgaaactgcaatacaagatataatgagtttctcaacttacaaaactggtatactcgagatcctaaccagtatagagtctgttcttagccgacgtggcgagtgggccccacatgcgaagtatatttcttgtttcagcaatctccctctctccccttcgttacccatcgccggctgggggaagggcgaggcaaaggcagcgatggtgaacgatgaagcttcgatttgcggaggcggccgatgacgatgacggcggagatggcggtgctggcgactatcagggttgggggtctcgcatgggcgtttctcctctcctctcatcgcttctccatccctctcgttctttctctttctcgtctcacctttttttttcttgttgcatgcaccgccacgtagaggggttctgtgcgctcaagcgatgcggggtggtgatggccttggttccgatgagtccatagcggttgaaaccgaagtagtaatcaattcacatgatagtgcagtggcaagggtatgtggttttaacccccgaggtctagtgtttaatcccaacacgctcacaatttatattaaaaaatgtttggaggggtgtatgggcacaaataaaacgaacaccgaatcgaaccgaattactagttttcgcgtttttggatttggtgcatttatttttatgtatatcggtgtccatgtatagatcggtttttgtccgctgtgaactgacttcaccgaagataccgaacatctcgtgcgcatgagagcaggtacaatagcaggctataagccaactgcaaacatattttaaggagataaaaaaaggagagagaagagcagcgggctacagatttatagccagctgtagcacggactccaagacgtagtgtgtgtatgacatgtgggaccaggtattaatagtgtagtatataactgttgtatgaatgagctattagattggctatagatgaattggagctagtagttagctatactattgaacttgctctgagagaggcaagctgcgggtgcctcgtctcccgcgatctgggcctatatgtgtggttcttgctcttgctctatgggcccactagcttttgttggttctgcgtgatgcctgcatgtagggttgtaaaaaaaaaagctcgagactcgtgagcgtctcaagcgctcagctcgagctcttaacgagtcaaacccgagtctagctacaagctcgcgagctttgtcgagccaagctcgagcttctcacgagcctaattgtgtgtaactttagaataaattagtatctattcaaatgaataattagtgtattttggcatcatatattaatcttgagttctcataatatttttcttcaatattgttaattaaaattattgtttttactaaattttatcatcaaaatatacattattgtatactcggtcgagctcgtgggcctagccgagctcgagcttgtgtcgagctcgagccaaggcaggcaagctcgttcgagctcagctcgatgatagccctacatgcggctccacgtctgggtaagtggatgaatgcatagataagagcaattggatgatggg

SEQ ID NO: 47600 - DNA, 2381 bp, Oryza sativa
ccgttctacccctccaccaacatagcaaaacagaccacacgacgccgcaccgccgcaacgcaaaagccctaaaacgcctctgcctctgggggatacaaccctaccccgcccccaatccgcgcctccgtctctccgcctctcttcttcgataggcggatcatgacgcaggcggatcaggcggtgatcagcctgcgcccgggcggcggcggcggcatcggtggcccgcgcgccggccgcctcttccccttcggcgcctccacaggctccctcgacttcctccgcccgcgcggcggcgcatcctccggcttcgctgccaaggtgagaccgctccatttggggatggtgggggtgatggtcctagggttcgatcctcgcggaaggggacatatggggggggggggggtctgcggggtgcattgcgagtgctggctgatgggtgtgacatttcactggttttttggtttgatactcccctttgatttgcttgaaggatatacttgatttagaatctgtatttctgatagcatttgtgaacaataatgattgacattatcaaaagagtgtgttttactattcttagtgcagtgcttctactctttatcaacaactagctgtgcaaatcaaaaagcaatgtagatgaatggaggagcaaatcggcccctctatttgccccaacaattgcacttctcccttcgctttattcacagggaaagtccctcaatgttctaacagcaaactaaaagaggcttcgagccttcgatattgtagtttgtactaactgcaataaacccagtgttagagaacttttacccaaagaaaacaattagctagaatacaatccatcctagatcgttacatgctccgctgggccaatcaaatggcgagattcttgagttgcaacttgttggcttgtttcaaatgcattttgtctagactgtgtttctggtctggttcatttaatatgagccaccagatatgaatatatagtttattaacctctgcttggttggcatttgccgaatctgttacagcttggagacttgcggtttgaacctctcgagcgggttcgttacactagggatcaacttgttgaactgcatgaggtatttatctgttgctacttatttacttactgtatttcacatgatgaaattaatcattatggaacatttagtatagctgtcttctataatgatggagctgctcatattttgaaatattgataaaccaatagtgcggtttcactgaatctatttgcttggtttatgaaacacactgctcagttgctcacctttgttttgcacatattctgcgttttacatattatatttaatatatgtgcattgagaactgaagatttggaagtgagataacaatctagctatccaaaattcacttcaagctttaggggtgattcagttgcttgcacttgtctatgttgaatatgacaaaatgattagagaaattgactttggtactcagaaaatctgtctccttttattttttctgttgatcttttctgctatctgatgtatgaaacttgtataacaaaattagttttcctctggtgttctatggctcttcatttccctgtaaagggaagttgagcatgccatcatgttgtgccttcagttccacatatatatcatttttgtgttatggacaatgactaagttgtacatgaaatggcctttgtgccttgaataattcccaatcatgctaaatcttttcccctacatacataatggactctcctgcagtaattctgttctaaaaccactcgaattttaattgtaacattgataggagtgaagcaaagttgtggaacaacctatgtttcagagaagtttaaatggataaaacaacatatatttgcaacagtaccactggttcttgtattcataaccaaatattcttgtcttctgctttatttccctcgacatctttccaattacatgctttgattctatggttttgcagattatcgacatacctgagaacatcttgaagcttaagcaagatattgacatagaactccatggtgaagatgaaccctggattaacaatgactcaagtgtgagaactcttcctttacctttcaactgttcctatgtgttgcaaactgtatctgctcagtaagactggtgcagtttcacgtttactgattactacctgtttgatgttttatcatatctggcaggtgcaaactcagtcatataaccgtacgctgagacagacaaccgtgattggcgttcacggattgaacaacctgtgcaaactcctgctattggtggtgaagagaaatcttgggacaaatttcgtgaagcaaaagaatcatacatttcaagtggaaagcaagatcaatttaataatcaagacaa

SEQ ID NO: 47601 - DNA, 788 bp, Oryza sativa
tggctggccttggtcttagctgaccccttggacacggactttggagagaccatttcctttattgagatagaacaaacagtacaacaaccagtgtgctaaaaagcaactgaatagatgctattaaattctatctgttttgaattaacatcaaagataggatcaaatcacaattgaaccacactaaataactcctatatactcagtgttatagcaaagtttacaagacaatacaggatttgaatcaaagcaactgtatcagtaaacaaaagctcgtaataccttgaaacagtaaacacactcaaaacatgtttcagatacacaaacatagcatgccagagagaaatagtattaacaaagactgaataatgcagcaaatcaatgctaaagacaggcagctttactaattatacaaaaaaattactactgacaagaaaattacctttaggctcagatccttagcagtatcttccttggagtcagtttcatccttctgtttcaaactgatcttttgttgcttttttgatgaccctgctccacttgcctttcttgtagatgacttggaatcatccttagatgactgcttcgataacttccctgttgaatcagtagtctcctcaaccttttcagacctagaactttctttccagcagccttcttctccaatgactttagtccaggaggtcgacctctttttgatttgaccatagctggtgagccatcaacacgttctgatgtttcagcagaagctccattggcaacctttgctgactgcttaacaccatcctttt

SEQ ID NO: 47602 - DNA, 2018 bp, Oryza sativa
ttcctgcagcccaggaaataaaattgactcatttagcattcttggagaacataatttagcaaaacttacttcaaacttatcatgagaactagcaaatatagatgaaattaagaacaaacgaagaggtacttacttcacagttgtgaagaagttgtgaaacatttgcagtatcagatcttcacactcaagatccaacatcaccacgcatagccggacctttgccacagtttcaaggattgcaactatccttcgaaacaaggggttctccatatcatccaatttctcaaaagaccccaccattatggaaaacacgtcctgaaccgaaagtagatagcacaggtcagatgtcaggatataggatatcaaaacaagatcatcttcatccgataagaaaaaggtataccttcatgacatcatcgtcatatggagtgtcaggtgcagtgatcctagttatctcagaaatacaggacaccacagaaagtttcacctcatagctagaattatccaacagctctttcttgatcaaagctttcattgctggagttatagcactaatcatgctttcagaaggtgcttgttccactttcaatatatatatttcggcctcctgcatgaacaaacaatcatgccaatcaaagatcagttttctagggaaccaagaagatcatatatgctcttaataaaactgtaatgttaaaggagtatggtgcatttacaggaatcaacaccacggcaaactccgtatatcaacaatccaactccatatgtcaacaaacacgacggaaaatactctagaaaaacaaatgcttgctctttgtgccataacggaaaatcaaacggattgcagagcagcagaaaccaaaatgaatctaaagcggaattccagtccagtaaaaatcacgactcccaaccgaatcaatcctcgcggaatggtatcaagccaaagcttccgaaccatcccgaaatcaaaccaaccatcccgaaaccacgcaatcaacaggattaataaaaataaataaatccaacaaacagcagaaccctgacaggagaggcaaaaaaaaaacgtttcaaagcgaacacaaacgaattccagcacagagagggttagagagactcacgtggatgagcttgagcaaggcatcgacgtcgtcggggggagactggagcttctccccgacgtccctcagcttcccctcgagctccccgagctccgccattcccgcgcgcgcggcaccccccgcgcgtcccccccctgccaccccctggatccggccgcccccgccccgccccgccccgccgcgcgagatctacggcttgcttgctagggtttcagcggggagggaggagcaacgccgcgcaccaccccctgcccacgcgcgcgcgaggcagcggccgacgccgacgacggcaaaccaaggtgacgggaagagaggagaggagatggatttctctatagctatctctgcctctctctctctctctctcccccacacccaccggtccccttttcccctccctccccccgtgcgagacgcgatttcggtgcggtgcggtgcggcgcaacccggaggtgggtggtggagatgtttggaatcgggcggggcattttatgggcgcgacccggggaggggttggggttgggcctcggccgccaaaaaacgaacgggagcggacgcgtccgggggtgaggagggttagggcgaaaatgtgcgcgggtttgtgcgtccgaggtgcgccgccaagttttgggggtctagcggacgggagtccccaggcttgtctgaggcgatctcggccgtcgctggctcgcgatggagcggggggcagggtggatggatggctggggaacactgctgttccacggccgccgaaaatggcagtccgtaatcctcggcccaggtacatcctcggccctgtgacaataggagggagagagagaaaataaaaaaattgactcaccggagtacgcgcgacacggcagcggaggcgttagagacggaggcgaggggctgcaggaa

SEQ ID NO: 47603 - DNA, 1560 bp, Oryza sativa
cgcggacgggtgcgtctgaaggtagaagacgacgttccgagacgaagggtatatataaaggcgggagagaatggtgaccgtcggattagtgtgatctaacgatcattgtttgtaactgtacgacgtatgaacctgccataaataatatgcttattttgtcatgacgtatagagttacgctcgacatcagcccaccgaagtaactttttgtgaagaatgtgggacctagaaatattcaaatgctagattgggcttggaaaaaaagctaggcccaagtctgattctcttccaggaccgcatctttcacaatcaccaagcctaggtccccatcgacatgcatcatttggtttgctcgtctacacaatagattggagcgcgaaactttgaagtatatataggtcatacttgcaccattctttggtacacaacttcatcataaggccaaaaccatctgttgcttgacttactccctattgaccgatgatgctctcccacctcttggtctgcctcttgtatcacctcttccttcatgtggttagaacaatgtcctacctgactcctctattggtttacaacaccgcaagacgatagaacccttctaacctagtataaggcctctacgtacgaaccaaaaggtttgttcaaattaagaaacatttattggttcaattgctcgagtatttttgcgctcacattcacgattgccatgcaagctcaacttaaatttgcgttgtagatacaaacattgggagaaaggcactttttcgaaatggtgcaacctaatgtgcattgctaaatttgcaatggtgtacatatatcattatatttaatgagcccatgataaataatgcttctttggtttatcaatgtttgactctacataatggacgtggatgtggcacgccgtcaaatattgatgattagagtctagatgtagtattcctactctgtcgtgttgtgtatcataacacacttgaagtataggaattgatatatgtgtgttttaaattgcaaggtttcttatattccatccattcctaaatagtatacaaacttctagcatttgaatcttatttcaaaatataagattttatagcacagttcactgtactatttatctcatcaatcacctcctattcaaattttattcccattttatcccctacctaccctctcgcctccactcatctcatatttattgaggacactaaagtattttcctcttaacacaggagtggaccaaaaatgggccaaggtctaggccatcccatcaaagctttagcccaatccattgtattgtttgtcagggttatagataagacatacctcttatccttagggttgtgaaatatacgaatacgatataccctcatgtgtatgggaagatacctccgaaatgaggaaatcggatgatctataaggaaatcatcctcttcgaatagaaggtgttagagtccttttcggaggatataaggatttttgtgatatcgtgtaagggcaggtgtctctgagttctactttgaggtcaagataatcgacagtataaatagaggacccccgg

SEQ ID NO: 47604 - DNA, 1336 bp, Oryza sativa
cccccggcgagaaaaaggataatatgccactccattgggtggggttagataaaatgccacccaatacattgcaaaggataaaatgccactcattaggttactttcaggatattttgccactttgagggattttaagaccaaaatacctctagctgtggatagagaggaagagggaggagcggaaggttgacccggacgatgctcatgctcgccggcagcgggtggcgagcacacggggggcgggctgtgacatgcagacagggggaggaagatggcggcgaagagggaggaagacgagaactgcaatgggggaggaagacaacgacgcttatcgggaaggacgacgacgacgatgggggaagaagacaacagcgatgggggaggaagacgccgacgaagagggaggaagacaacggctgcgacaagggaggaaaatgacgactgcgatgggggaggaagacggcggcggtgatgggtgaggagggcaatgccgacgggaggagggaggaggcaacggcgatgacgtggagggctctccagcgctgcccgcacgtgcgctcatcccctccggtgccacctcgcgcgcttaccggcatcttattcctctccttgtcgccgctagcgggagcacagacggcactcgttcttccctcgtcgccgcccgctaccggcgaccacggccgccgtcgttcgactcccctctctggctctctctcccttcctctctctctccatagtaggggtatatttgtcttaaacctcttcaaagtggcaaaatatcccaaagataacctattagccctatttggctaatggtatagggaaatgatttcccatccattaaaatgcatctttaaatcctagccattcattctccctctttcatttaatgctaacccttcattcatttctcaatctcaatctcacccccattttccattatccaaacacactgattgagtgacattttatcctttccaatatattaggtggcattttatcgaaatccaccgtatgaagtggcatattgtcctttttctcctcaccggctaagcctccagaacagggcccatccacttctccatagaccggacccatcaagcaggctaacaaccgaaccggccaacccctgcctccttccagaagcgcccatctctattctcgacccatccatcccgtccgtccgttcgtccgtccgagccggcgccgcgcgagttatccccgtgccgtgcgcgctgctcgactcgacgatagccagcgagcgacagcgtgcagcggccaaagccaaacttccgccccctccctccaatcccccctcacccatggctgctctcct

SEQ ID NO: 47605 - DNA, 2236 bp, Oryza sativa
tgggtggttttatgtttagttgatcagctttttctatatgctattatgtcaattaacaaagaaatcccattctgtgctttatttgggtgatgcaaaagttctgcactacctatgtgaaagcttggcttatcatgatggatgataaaatgattgaatttgaccttcattggtagcttcaggaaatttaatactcaatgtaggatttttgtttcacctgatttaattagtttggtaaaattctaatggaatgccaactaaagtactttttcctgacttctaatggttcacattctaaagtaagttgcttttcttaatttgcattcagcataaccatgtggacctcaagctggtcaagataaataaatgttttatttagcttaccattgtgcagtctccctccatccacaaaagttagacatatttcacatttgagtttttccaaataagttgttcctattgtagtcttcatgcattcaatacataaatgaagagataaattaaatgtttgattagaacccaaggagtcatttaaatactcattggttgcatgcttgcattcactacttgattttgtaacatccaagatgatttaatttctccttggttttggtgacaaaagtaatatgtgtaacttttgtggatggagggagtatgaaagttggaaggatctgttctttttcatgactaaggctggaaatagcaaagttttgctgatatgggattatttccaatctattttgcatgtcattgatctattggggaatcacatttggcataggtcctcttttaggaacttgtacatcagtacttgtaagtgtttgccatagttgttgtgtaacttcagtattatgaatgcattttagctgtgccttccacacttccctgtgcttacacgtgtgaagatgctattttattttctcaatgtttcctatctttggcccatgtgtattttgcaatcgagttacttgataacatggagttattgcattgttgcaaaaatcttttctctgactctttactagtcacatttagctatcctgttctatttccttagattctgtaagagcaaggctagattatatagtaggtcagtaatgcgaccatttcattttccagtttttaacgcgagggcctgtgcagattatattataggtttatagcacaagagtgtagtgcatctctttgtcaatatttgaggtaagaaactgcattctgctgaagagtcgtataaatgtaatactgacagttgttgaggtggcatgtagcacagtagcagtatgttatttcacttccactgctaatataaaagcaaaagaagttgacccttgtcaatagaaacacttggcttctcatttagacatcttttttgatgtcacaggaggattctgaaactggagaaactggtgcagatgatgccgctgcagccacagaagaaactccctctgttattgtcacagcattgcaatcatacaaggaagctttgattaatgatgatgaaacaaaagtcgctgagatagaggactttttattctctattgaggaggagaaaaattctcttttgagcaaaatcagtaccttaggtgcagaattgacaactgagcgagaccgtatcttgaggataagtgctgacgttgataactacaggaaaagggtagaaagagagaagctttcgttgatgacaaatgtgcaaggggaagttatagagagcttgctgcctgtcctcgacaactttgaaagagcaaaaacacaaataaaggtggaaactgagcaagaaacaaaaataaacgacagctatcagagcatttataagcaatttattgatattctgaactcactaggagttgaagatgtggagactgttggcaaaccatttgatcctatggtaagcattgttagcagcacatgacatactaatccagttaacttttgaatcaaacacttatttactcaaatattgaaatttccatgtctcttttaaattttgtgccttccatggttttgggtgataagtctactataaagggctggatatgtgtaggaatctattttattttccaaaatttcttgggttttcaaagggtgttacttttcttaataagaattgtttgtgcaccttctgtttcagcttcatgaggctattatgagagaagaatcagtggagtatgaagaaggggtcatccttcaggaatttcgtaagggttttaaacttggggagagattattgcgccctgctatg

SEQ ID NO: 47606 - DNA, 714 bp, Oryza sativa
aaatgcagagcagcatacctgaggtagctcatcagaaatagtcctttcagaaagtttgccatcatccacctgaacattattaactcaatagtaagaatagatgaatccacatcaagagcccatgtggccaatttgttttccagttcaacgataaggtgttgaaatgagctgtatattaagttctgagactaatattcacaccatcacaaagtacacccgtacactctatagactaaagccaatcacaatttcatcttccaagtgatccattccaatataatgcagagagcattaatgaattcaaggcgtatttcaaacatactaaaaaaattatacacataatgacctattctaacacctatgattatcacatagaagtctaaggtaaaaaagaaacatctctgaatattagttgctgcatgttagtaattcaactgaccacatcttttccagaaggatcagcatccatgtcttccttgacatctgaactgtcttcacaaattgttgcgataatattgtcatattcattcaaggaagtgcctttaagtaactgcagaaagaccggtttcagtttttcagagcatgcacctatcaccttctctgcaagttcaaaagatgcagcagaagtttcctggaaataaaaaccaaatcaattagatggtatctttttgtctgggtaggaatgtagattcatattgttgatgtcaagaaagt

SEQ ID NO: 47607 - DNA, 4844 bp, Oryza sativa
  unsure (1)..(4844): unsure at all n locations
cctgtcataggcatttgtcaccaaataaatgtttacattttaatgacaatgaaattatatcacactgtcaaattggtgcagatgcactaatgcgctaagttatgagcattccatcccgtatcagcctgtctatgtatatatttattctgttcttatggtaggtagtattggagcaaacacgatgtaaatccgtgtaaaaaaacgcggtgtaaatcttgagcaaaggattcgtagaatagagagattagacaggcgcaccacactttgaatcaacattcatttttgaaatataatacattaggtcaagttgtgtggacgtgggattgtgggaagtacaatcgtaaaccatgataggcacaaaaggaactactgctatgtttgaacaagagcaataaggcaacggacagataaaagcaaaactccctccatttcaaaaatatatgacgtattttgttccgttagggtaaggtttgaataacaatcgctctactcggacatcatttatgcgataaatgaagcataagcataagtacgaacttttgaagactaatataataaattcatgtcacaaaacttatatcctaataaagtattttttggtcaaatatttatcctaacgaaacaaaatgtcttatattttgaaaaggagtatacagccaaatccttcttttattcacaaagagacacagcagataagtttaactgatatattgggtaccagaggcaacccattgaaatttaagttttgtcagaatatgagcacacaatgtgaaactctcattgttttacaggtaacacctctgacaaccatggccacatctcttctcgctggtgagagatatcgaactgaaaccactcactaccgctgagctagcttcttcaagtgttggaacaacttttgctttatccactgtcgatcatatggcagaaatgcctgaattgagtgatcataactgcaaatgcagaaaaaaatagtagctgattgttttttactttgaaaactatacacataaattaacattgcacgattctgatccaattctttaaaagttattttactcacactagtgcactgatgtcagctaggccatcaatgaagttatagaggtcagtgatatcatatgttatgtttggtaccattgggtttatgtccctaattttcctttcataaagaccacacagtcctgtcatttcagaagagagctgtggtgagtaatttacaaagagcaaaagtaaaataaatcaagaagcacatttgaagaaatgaaatagttccgattataacagagtagaatggatacatgtcatgcatcaaacgggcacatagcagatcataaataaaacaatgttttaaacagaataccaaaaaaaattgataatgtgcagctgaagaacatccctctctcctttctgaaaaacagccttcaacaaataatatgtaagaggagagtctagtgccataaatcctgataatgtctctaatgcactatatgcaaatttggacgtttgcagtttatatggtattgaactttcaagttaatttttctaaacaaatcgatcacatgagaaaagtgaattcataaaattgcaagatcatatcgtactcactaggaccatataaaaaaaatatctaagctattatctaagcattgcatcattagttaagctttcaaaaccgtacgtaccatccaatgcatggttaattgaattataatccataaatgttctagaagccctgttttgggatggttgcatcagaataatggtgtgcctcccagcctgcacaaataccaaaagaaaaaaaaagattcaatgcatgcttcaagtaacaagaaagaatggtgcaatttgatgatactgcaaacatgccataactacagagtgttcaacaaattcctgaaaaggtaaatatttccagagtatccattacctgaaatatatcaggctagtactacaaaagcgaggagtcgttatactaaatagtaatatgatagcatggtcagcatcacaattatgtcaaccagaaagctttattatctaaagacagtgattccctgataatacaacaaccctatccaatgtactgcttataaataaaaaataaataccatcagtagcacaaaccacatatctttgcttaaagattatagtatttaagcagtggcggagggctcggtagggcgaggtgtggcgctcgctatacctcacgccacccgataaaccccccaccccccacactttctccggacagcagggcgccgagccgcaaagagcgcggcaacgccgctttggatgagcaacatgaaagggcgcgaggcgctgcgtgggtgcatccgcacgtacgctcaccaacaggtagcaggccaagctgggcttgtttcatgtaaatgtttcttttgactattaaaccctagacccaaattcccccatctccttcacctccatcgattctccaatccggcaatcctcatcccgaccctaatccccatcggcggtgcggctgctgcctgctggagcggagtcggcgcacgagagggaaggtggaggcgaggaggggcgaggccgccaggctcccgagcggcgggcgcagagcggcggcatccgcaccaggcgccagcacagcatggcactgcggcaggcggcgactgcgagctatcaggaagtgaccagccagccaggggtgcagccatgtatcgcaggcagggcagagggcgccatcgccagcacaggcgcacagcagccagccagccactaacctctgccaactagccagccagcagcagtgcagcaccaacaccaagcatagcaagcaagccaagtcatcagcagaaaatggatagaaagaggaaagggaaggcattggcatcacaaagaggtacatattgttgacaatttaagaatattacaatttgcaaattcaaagtgtacaaatttgtttctgaaattgcatttgtgtaatttgttttgcagatttgaagagttacttcaaccggggctctagtagtagaaacccaagtacaaagcctgaatcttaaggagttgagatatgttttagtacatactcttctatttcacttgtttcaaatggatgatgaattatgaacttgtgattagtgcttgttgccatgcttaatgtagacttgttgagataatgttgtgtcgtacaatatcatgcgttgagattttttttttcttttattcttgttttgtgctcgcagtagtccatanngngcccccgggnccactgtatttaagcaaaccacatatctttgcttctatcaaaaagatagcaatggtccatacggcactacatattatggttttctatatagactattgctacaccaccggtaacttctgaacaatacaaagctttaacatatcatatgcacaaacatctcgatcagtacaacatgcacctgccattaagccaaaaaaaacacacgaatgcccaaaccctagaaccctgtgggaggaagggtgaagattggggggggagaacgggtggcttaccatcgagagcgcgggcgggtcacttgcgacggacttggagaaggcggcgcacaggtagggaccttcccgacggcacaccggactcaggaggagtcggcgcgcaggtcagaggaggtggagtcaaaagcggtaagagaggaccgctccggagacggaggaggcgagctttggggggtgggggggcgagaagagctaggtacggggcggaggctcgccggaggcagctctgagcggcgtcgagttcgtcggagtagccggcggcggcggcggcgtgtcggctgggggatttcacgagtcgcgggggaggggggaggggggagagcgtcgagcggtccgggtcggtggatggaaaaggagaccaggtaggagacccaatcctcgcgtgtgagttgtgacacgttcgcagcacgaatcttgaagcatcaaacttactaataagtgttgccctgttaaaccatcgaatcaattcttgtggctctaggatttccttcctcctagatttcctttcgccctgttgccagcattaagagcaaggataatagtatagctcactttctactattagcccattttaaaaccaacatatataatgattagctataagtttggctacaactttcttcttctctctctatctctcacatatgcatttaatgtatttacctaggagcatgtgttaagctagctcttgcatgagagccaacatccttgatttttttgttatctcgtctccacataagcttatagtaggcttatactccctccatctacttttgatagtcatatttccaaatcggaaaattctatttttgataggcatatttcaattcaacaacctattatcttaatgactttctcggatttaatgtatgactctccattctttcacacaagattggctaattgagcatcgtgaaatgtaaatattaatgaatcgcttgtttacgaggaatgactagtagcatgtttaaatggatgataagtagaattactattatacttgctctaaggcaagatgaaatattggtctgtgtgcaagatgaaatatgactatcaaaagtagatggagggagtagctcactattatacttgctgtaaggcataagtaatggtgtgacgttatcatcttaaagaaaataccaacatgatttttaatggcgtaaaagattgggaaagagaaaagagaatggtgccattctttttaacatactgataggcaacataatactacaatcataaagataatgctccctgtctccctccgtcccaaaatatagcaatttaagatcggatgtgacgtatcttagtactatgaatctgggctgcaggaa

SEQ ID NO: 47608 - DNA, 2263 bp, Oryza sativa
ctatatgattctactaaggaaattgagacaatgcacatttcaaacaaagattagccgtatgcatctgttccagatgtagaggccggttttttcttaaaagaaaaaaaaaactgctaccgtctgcattacgccgtaacaacatttgcctctagtcactcgtgacctcatcttttcatttatacttatcagtcaaaatttaaattttcaaccttaaatttagagctaattttgagattttttttcattgaagtctatttttcaacatttgctttattcataaactactttcgtttacaaatatatcgtttggcttatttcataaataagcgaaacaatgaggccatcagattcatgacacgcaagagcgcgaaatgcaaacagtacgaattcccatatcctacctcacagcctcagatgagaagataagactgcattgacaggttaaattgaaccaaacaaatctcgaataaattgtcatgagattggctggaagaattacatcagatctcaactttcgactaaattatgaactcagttgtacccaacgctaacaagtatgcttgccaacacgcagcagtacctgttacaagaggagtagccgcgtaaaccaccatcgaggtattgttacggtgttatcagagctaaatctatagcttttctttacttcattatcagtcatctgaccttgcaaaaaaatacagctcacaaaaagctgttcctcaacttcagtgttgtagtttctcgaactgaaagggcaaaacctgccaactaccgagtaacaaataaccaatgtaacattcccagttaggacatcagtaataaggtagaagttggcctagtcaaacttgcgacaaatatttattccgaggatagaagtttgctgcacgcgtcgatcttagcaacatgtgagcccaagatagcctgacctgatggatttgctttcatgattttcatcatagcttcaaacactgcagcacgaaagaaactgtcctcaattttctttagagtatcctcaacgacttctatgctcaggcaatgtgacaagaccagccgcccaataacttcaccaaaatgtactggagcttttggaaggtcaatagcaagctcatcaagaagagaactgtaaagcaagcatccagtttccaagtcagtcgctttgaaaacattcttgttgtagagatgctccaacagcctcaaaagaggatcgatggaattggtgcctttatcaagagcaagattgatggcttctttaacaacttctgggtagtaatcaggactcttcagctcctcaatgcactgttgtgcttcatgtagaagaagtatgtggaaatactccttaagaagagatatggtcttcttctgaagctctgtagagcttggcttgggggcagcagctggttgctcaactataggatctacagatggagctgggatgagtgattttggtggtcctgtagtttgagatggtgtgacaaccagaccatgggatagtgggccaccactgcccacaagtgcactcgtcttgccactaattaatgctgcactgccttgaggaagcagtctggaattattaggtgatggcttattggccaatgatggggtgaggttccgaactggatcagctctgggctttgatctagaatgcggaacttcccagtcatcactacctagccctggcattccaggcatctttctcgctccaggcataccaggcaacatgccaactataccaggttggttcatagaaaaagctcctggtgaaaggggtcctccacctccagtaccagtacggccagttcttatgcttgcagtcgaccctggacgcaatccaagattgttttctgcctctctatgaatttcactgattttcttagctttcatctgagaaagaattaacagaatctcagagcaattcatatagcaaaataatatcatattgctttgatagaaacagtaaaacagaatccaagatctaatgtttatcagctcagtgactactagaatgagtgccactcggtgtattgcaaaaggtacataggacttgaagtgactaatgtcaggtagaagtattgtaagcgtgtgaacagaccatcatgactaactcttgtggtgtaaccatgtatatattaccagggcaatacttgggcaatttccaaaaaacaatgcattcaaaagactcaacatagtatctcaccatatatatgaaggttcttagtaatctaatttggtttcatttctgttattaataaccactgggctgcag

SEQ ID NO: 47609 - DNA, 779 bp, Oryza sativa
aatcgtgatgccaactgagaattagttgttagatccttcagccggttgaagtatacgtcattaaatcgtcgagactttggattctcatccaactgtttaccaattgtgttgaagaactgacagatggcctccacattttcctcagcagggcatctgttgctttcagaacctaatagctcctgtttacagaaaatgggtaagaaaatatttagttgataggtaaatcaataggtctgtaaagtgcaaacaaggatgtcttgtgtcatcaaatgaagggtgttcaaacaaactgataaaaagtcagtcttaacatcccgattaggtgcacttctggcacatgcgtattcttgacttaatgattttcatttgatggtatattcaactaaacgcgaaagattgcatgcgcacctgaacaatgtgatgtactatcttctcagggaccattttttgcttaagtagctcaccaacaagacgaatgtttccaagtgtccgaagcttcactagcctttctttatcacgtctctccatctcttggtctagaccagtcaatttattgacctcagaccgcagattgtcagcaccttcaaatgcttcttggcaattgttcaacagcacacgtttgaacgtgatctctttaccaccaggttcttcagaagggaatgagggtaacttctcattgagatcaaagcaaagctgagcatacattggacagaaggtaggctcaagaacagccttctcaaatatgagactaataacatcctgaaacaaaaacagacggg

SEQ ID NO: 47610 - DNA, 5816 bp, Oryza sativa
tttgaggcctaaattaagcttaccaatatttatcaatttcaatagtgtttagtatctatttggtttgaagccaaattttgacatgcctaagaaaataggccatttcaatagtgaatttagactattttggcttcaatccaaacacaactttaccttaccaaaattattcatgccaaaacttgctaaaatttggcaccaacaaaatttggtaaggcctatttaggtcacaaaacaaaccaaccctaatattcccacaccttgtttagttccaaaataattcttcaaactttcaacttttccattacatcaaaattttcctatacacataaactttcaacttttctgtcacatcattctaattttaaccaacttctaattttaatatgaactaaacatagccttcatcgacaaatatttgctgctcctactgcaattggagacgagacaccgtgccttctcgaccaatgtgcttgaagttggagtcaaaagttcactttttaggccgagtttagttacaaattttttcttcaaacttccaacttttccatcacattaaaactttcctacacacacaaactttcaactttttccgtcacatcgttccaattttaaccaaacttctaattttagcgtgaacggatgagagcccgtagtttcccactcgatcggaagttcaatctcgctgcgtgtctccaaagtttgttggaacgtttaaatcggatttcctctatccgaaagattacaacttctgacagggaaaatctacagctttttttcgaattaactgaaaatccccaccttgaaagttcgttttgctcatgtgaagtaacaagcgcatagcagtaaaatacgccaaacaaaaatctaaaaatagatgatggccgagttagtgatctctaaatatttcaagaatccccaaacaaaagcttcgaaaactcaaaaaagaacaaataaaattggagcaaacagaactctctctcagtctcactgaactactgaagaacgagtaatactgcatgatctgaaaagccggcatactgacaaagttcaacctatctaattattatttattcatcattgatcagtacacattttaccaattaaaccatgaactaaaattaagcacgtgtaagagttcatttccattaattcctgtaaagcacagcattacaaacacacaatcacctcaagaacacactcacaccaaaagtccattttattctccactgctactgaaggcaaattcatactatagctatacatcgtcgtcctctgatccatccatcggccgctgagaatttctcgatcatttgccgaagagcgacttgaaccaccacgtccccttggtgtcggtgggcgcggcgtcgctctccggcggcgggtcgtcctgcggcgtcttgcgcagcttctcgacgtcgtacccttcctccttggccttctccagcagccgcccgtacacctcgtcgtccatgctcgtctgccggcacaggatccacaggtccttgcgccgcggctcgccgacgagcgcgtactggtagtcgtcgtcgacgtagagcacccagtagtcgccgacgacggggatgacggggaggaaggggggcaggtagaacttgaccttgagcttggcctcgtcgctggccgggtcggccttgtaggcggtgcccttgatgtagtcgcgcttcccgctgctggtccacgtctcgttcagcacgtccaccgtcgcgccgtcgggccgcagcgcgtacgtcgcccgcgtgtcccggccgtcccggggctggaagaagttgggcagcgacgcgatctcgtaccaccggcccatgtacctcgccacgtccagcccccgcaccaccgtcatctcgctcccgctcttcttctccaccgccgccgccgccatcgtcgtcgtggtgattgtgttgctgtgacgatcgatctagctgcgaactactgatgttatctgtttgatatgaattgccaacttgagctgagttgagctaattgcaaggatgagtgtggctatataggagagggttttggcctcttgggggggttgggtttggagaagaactgaagaagctagagaggttagtatagaggataagattactacgtggagggctctggagcgcttaaaaacgagcgctttggtttggttgcttgctccttggggccggccttgtgctatacgtggagacttgcacgtgaagctaacttgcatggacgtactccgtacatctcttttactgtgtgcttttggcggttttctggccgttttcgtcggtaacttgggactggggttcaacctgaaaatctgaacggcgagtatcactgcaggattcagagaagacagtgatctggtttcacacattcccactaggcgctttccctgctacgagtacgagtacaaaccaccggaatgctcgagagcagtccagaacgacccctatggtgatggactgatgtgtgctcggcagatagctttggccgagtctggccttatttagttctaaactttttctttaaatttttaattttttttatcacatcaaaacttttctacacatataaacttttaacttttttatcacatcgtttttaatttcaatcaaacttttaattttagtgtgaactaaacacaccctcggtgtgataagcatgttttccttgctccccaaggttaaaactctttctagcacaaaagaggtagtagaagggtacagtctacggcatggtagattgccagtgtgaagcaccgatcgtaatcgaggcttggagctttgtccgtgtcgctgtccaccaaggtaagaaggtaagggtcttattgcttgcgctatcacttataccagtttgttgccaaaatttaaattttgaaacttttgatttagatgccttttcaacataaattccttcaatattggtttttaaattattaagaacacatatttaaaagttttattcatatttttttattactagttaataagccgttatggcttatataaagtggtaagcaaccaatgaggacctaaatcctattgcatcggatatccggaaacatgaacgtccttttcgttgattttatagcttgcttacgtgtttccatggggttccaatccttggatggtttcatggcttggttacgtgtttccatggggtagttgttgacgaaaaaaatcgaacacatcggcctgagagatctgcttagctccagtgcaggtccaaatcttgatgaagtgcgggcgtgccagtcagtttgatcctgcaactgacaagatatgcaaatagtagatcaaaacagccgatcggctgacaagccgatggagtagttctagccgataatagccgatgttgataccagccgatagcgatagggtttaagcaatcggctatatgtccaaagtagataatgatataaaggcaatcagctgatgatgatgtaataaaataacaacataaaccaatcggcaaataatgatatgataaataagcatcgatccgaaggttaaagcacacatcggctggaggtccgatgtcatgaaatccacaagattagattaaacagtgaaacctttgttgtcatcggctaaatccaacttatatgtatatgcaatccttatgagccgatgcaacgttcagataactcaccgactgaaaccccgatgaaaccctgattggcatcaagaagcaggctagagattatggttctaagcacgacttagtagatcaaacttaactgatgcagcactaagtatgaaaagaaacataatatctagacaatcaagccgttgactgatttttcagggtggtagatgcctaagctaatctaatctagcaacacaatttagccaataccggcagaaaccctaaaatgagaagcagccgatagagctaaattgatatgctaagactagattaacagagacatatgataaataggtaggcaaatataccatccaaatcagagcaatccaagaggtcgaatgtactgatgcagccttgaacgacgccgacgtagacgatacaattgcctgggccgacgaaacattggacttaccccttagccagagatcaaacaccgatgcagccccgcgtcaggtgccaagtcccgccggacgataaaataaagtagaaaaggtaaaaggtggcgatgcgccgaattgtattgattgtagcgatagattacatagaccctgggtgtacatatttatacccatgggttgatacaagtccttgtcggacaagaaagaaactttcctaaagataaaaggaaaagataaagtccttataggacactaaacacactttcctaaagataaaaggaaactaacaaactattcctaattaatagataacttgccatgccgcattctcttcgaactcagtctcttctggataagctttctttggtagattagtttccttaaccgaatatagcaagaatccgacaactgacgacttgacaactctcatcggctaatctcaggacttcgaagccgatgctgactctaaaccaatgactactccgggcttaccaaatttcactgttaacagtagtagatacgaaagaatccagaaagtcatcagagtaagcaacacctccgttttagattttagaaccgcaatccccttcatttcccacaatcatgtttgtgtacatgacacatgaattgcacaacaattaattcaacaatttagaatcgcaattcctacactctctttcaacagtttagcaccacaattgaatgttcagtcattgatactttcttcgggcaacagtgaatgccttctttcctgcacccttctttgaccccactaggagcttaggatgaccttcaaaacattgagcctcgcaatcttggacagtggcctgcatgggcacattagcaatgcagtcataaccaacatttagcaatctactatatgcaagaaaagcttttaatgatttgaacctcgatgaaagttgtgttaacaaggtacattttgtggtatagtcaatcaagcatatgcaaatatttagataagtttggaatcgaacaccctatgaccaaatgaaaatactaattttgaagcattttttatatgataggaaatggtattaagcatagtgcactagctttcttttacctgcactgcccgatgatcacatgatctcgttccctcacacgaaagcatggggaaattaatgttcgcattgatattagggtgtctcttctcatacctatcgatggaaatggaaatcatttttacaacatcatattatgtgactacgtacccaagtgaaaaaaataataattaaaaacaatgtagacttgcttgcctctaatacttcttgacaaagtgaagatagttcctacttcctacaatgatgatagtcctgttcattttagcattgtgtcgtgttctagcttgcaataatgcaactactaattgttaaggtaccggtgaatgggcatttcttatcaatgtaggttcttagaacaagcaccaaattaaggacatgtaaaacttaattaagttcaatataaatttctactccaatactcactctatcctaaaatataacaacttttagctatgattctagacgaacactagttcagattcataactagaatttttcatattataggacgaaggcagtacattatataggtaaaacacatcaagaaaattactagcaaaacaaggaaaatagacaaaataattactataacaacaacacaaaaatgaatgaaatcaaatgagcttttagctagatttgtcaacgatgaaaataatagtcacaatttacaaatgttgaatgcaaaaataaaatcttc

SEQ ID NO: 47611 - DNA, 3654 bp, Oryza sativa
tcgtccacgcacatgcatgcattgaaggcagttgcatcggcatctctttgaatcccgtaattctcatccgcgcatgcatgcagtaaacactattcgttagtttgctttggttgttttaaagacccctaattctgcggtaattataggagcttccttggtttttgcatccaaagaagttacgccttgtatagtcaaatggagagagtactagaacttcagatatagggtattagatatcctaggaagaactatagcatattttagttcatcaaagaaaaaaaactctcaagtgagcatcccctgcaacactaagtcactagccacttgatatagatcacacttacaaccaacaaaataacaacatcaaatttgttgaagtcacataccctatatgatgtctaagaggaccacaattgaaaaggtatcaagccaaaataacttataaaatacaagaagcgaagtactccctccttccacaaaaagttacacttattactttatcaccaatactaaggagaaattaaatcatcttgcatatatgtaacaaagatcaaggagtatatgcacacatgcaaccaatcagtattaagatgactcctcaagtttagttcaaacatttaatttatctcgccatttaagttttggatgcatagagactgcaaatacgaacaacttatttggaaaaactaaaatatgaaatatgtctaaatcttacatgtagagagagtactaaagaaattgaagaggctatcaagctcttgtggatagaaggagtattgaagaaaccgaagattttataaaaaatgcattgttttccggtttgaaaagtacacataagatatataataaaaaacaaaggggacctcaatagaaataatcgaggagttcttgttattatggtatagtacttctaacatggcatataaacccatacattcaaggcaaaattatagtagacttttaggctttagcaaaaacaaggaaaataatcccagtgcccttatccaggacgtttgtatttccagttctccacgctccaaatgaaaaaggaacaatttgtcttttgcgtgtatggttcccactttcccaggtccactacaaaaccggggcaagtccgcgtctcacgaccaatggaaacgcccattaatggcaagcttagccccccgcgctaatcgcctcctcctactaattccttgcgtctcgcttcggccaccgcccaccaccacctcctctcgcctctcgcccccgcatcgccgcttcctccctcccccacctcacgagaccgttttttttcttttttttttgtgttaccgccatggccgccgcgttgacccgctcgtcgtccgtccgttccgccatccgacggctcggatcctcccgcgccttctccgcatccgccgcggcggccccgcgccgcgacgcgaggggggcggcggccgcggcggtggcggtggctgccgggtcggggctggggatctggctgctgccgccgtcgccgcggccgctggcggactccgggcaggcggggaatgaggtggcggcgttcggcgacgtcgcggaggaggaggagcgggaggagaagcgcaggttcctgttcggaggtgagggcatttgatttttgttttttttattgttcatgcgtgttgttttgggttgtaatgcgggcgatttttggcgcgtttatggcgggggagagcgactgggtttcattcccattgttttcgtcgatactaattttgcgtgaaaagcgaatttgtccagtagtattttgctactcggttattcgcctctgaaaaattttaaatccgctattttacaaacggcacgatgattttcgtcgcaatgtttcctcgaatgtagactcgtatcgcagaagggtgttcttcaactacgagaagaggattcggacgcgcagccctcctgaaaaggtagcgaccaatgtgccatattcagagcaattttgtgtatacacaacatacatgataattcttcttggtttgtgtagtaataattgtgtggtgtttttactgcaagatctttgaatatttcgcgtccatccggaacccagagggtgaagtttacatgttacccgccgatttgatgagggcggttgtccccgtttttcctccatctgaatcgaaaattgtcagggaagggagtctcaggggagagcgcaaccctggcgagctacactgtgccccgtctgaatttttcatgctgtttgacacgaacggagatgggctcatctcctttgccgagtaagtagcgactcactgatttgtgtccttaggcgtggtatctaatttcagaaccagacagaattgtttgcacccggcacaattattgtcatgtagtgatttacagaaaatgcaccaggttctattggcaagtagaacagtctgtttgctagccatattgggtttgaatcctcccttaaacacattgtgtggaccatacattaagttgccataagcataacgtcattgcaactaataatcaccaatgcttagatatgaacattttggttaatgagtgccactggtatggtatgacattaactttatatgctgctctattgttttattgaatgaaggcagaagtaacttgatgaatttgctgaaactgcttgccatgacaggtacatcttttttgtgacattgcttagcattcctgaatcaagtttcaacatagctttcaagatgtttgaccttgaccacagtgggtaagctatcctccagctcctcgacctggttgtaaacttataaccaaatactgtgctcttcagatctatatgcatctattccttaattgtacaagcaccttaaccattttcattaaaaaatgtatttcacttacaaattttagtttgaagtgtacttcattaatttatactaactgatgtttctttaattatgatggctgcatgtatattctatgatagcatccctacattctcttctcttgaatggacttgatcataccgtgtatagagcttacagattaccagtatgctactatgctccattgccaaacccccattcatgatagaaggaccttacagtcttacacacgagacctaaggaatagtccacccatacactaactatatatgtgcagcatcattctggtataatcagttttcccctatagcctatgccaaacctcaactctaggagtcctgcaaacaaattaatgtcattggtcactggcgaatgtatatcaaattctcagttaattactatcaacattgcatgcttgcaaggttgccgggagctaaataagaaagatttgacagccctaatctattcacttatgcatttttcatctaatttctgaactttattatttgctgaagcctttaaaggtactataagtatactatccccttttccctaggatttacacaaggataaattgaatatattgttgtttacatgtgacaattcatgtgcagttaaatttgtggtccagaaaagacctgcttttatgagcatgttcaatcatctcacttgttagttgatggtaaagaagggtatggacaatttggcaattttttttaatgctatttctttactctaatctggcatttgaatttcgcagggaaatagacaaagaagagtttaagaaagtaatggcactgatgcggtcctatca

SEQ ID NO: 47612 - DNA, 955 bp, Oryza sativa
gttgcatctgagatatatgcgcatgtcgtcgataatctcacatatgaaccaaggtcaataatccgacacatcgaagagacatacaagtatactattagctatgccaaggcctggagggccaaacagaaaataatagagatgagatttggaacttacgaagcctcgtatgacaatttgccacgcctgcttggtgttatcgaggaaagaaaccctgggagctcttacgaagtgaagaaattcccctcaattgaacatcctggcaagagtgtgctgcaaagggcgttcttagctctacatgcatgcaagatggcatttgtgaactgttgtcctgttctctgcattgatgggacattcatgacaggaaagtatcggggccagatactaacagcaataggggtagatgggaacaatcaggtattgcccttggcatttgcttttgttgagagtgagaataccgacagctggtactggttcctgaaattggttgaaacaaaagttgttggtatgaggccaaatgtgtgcctgatacatgataggtacgctggcattctgcgagcgatagaaaagttgcagtttgggagtatggaacgaggataccccggtgtttgggaagatgtacagagtaggtggtgcatgcgtcatatgggagctaatttcttcaagcaattcaagaacaaggagctcatgaacatgttcaagaggctgtgcaaccagaaccaggagaaaaaattcaatgagctttggaagagattagatgagttgacagccaaatgcagtgatcagcgtgcagcggctccatcgaccgccgttgctgaccctcctcaagctcttggacctctcccaacggatagtccaacattggttagaagaactggattggagattcggaaattttctcaatggattctgcatgaaccaaaagagaaatgggccaaggcgtatgacacaggtggtg

SEQ ID NO: 47613 - DNA, 3670 bp, Oryza sativa
tagtgccaggtacccaacagcacaggtttgagatactatgtcaagataaggcaggcaggggtatctaccgcaagagagtgaagcagaagtgtgttctcaaagccgacggcacatgtcattgctcttgtgcaaagccaaagctgctccacaggccatgcacccatgtcattgctgccgcagcggagtgtggcataccagatgcagtatatgtgtcacagtacttcagtaagcaagcaatatatcatacatggagcggcgagatttatgggttcggcatagctggggaggtcacagagactaacgatgaagtactcaatattcctgacccatcgaagctccgaagcaaggctggaaggaggaggactcgtcgcatccacaacgatatggacgagttggaggctggcaaggtgaagcgttgcagcaaatgcgatgaacatgggcacacctacaagcattgtcctaaagacaaggagaaaccaagtgcggcggaggcaggactatcaggatcagcagcagatggagctcgccctacgggtgaaggcactacctccactcgaccacgtcctaggcgtcatcgtgccacgtctggctacgtggtgtagttcttatgttctatgttggcatgtggctttgtttgtaattcgtttcgaacttatcgatgtgtttatgtttcgtcgtgtaatgtcagacttcggcatgtcatgtcttttggtctcgtgatgtaacgtcagactaaggcgcctaacgtctttaggtatgctgatgtatgtcggacttcgacacgtaatgttatgatatattatcgagctctacatatatgttaaattgcatgtcatcgttatgtaccattagtaacgtttgctatatttaaatagcctgtactcttgttgtacataattattctcatgactttattactatttcataattttgcaagttatcttttgttttacattactactttctgaattgttctaacacgaaacactatattttccagagatggcacgtcaggatacacctcagttgttggacccggcgatagatcaccgacaccggtctcaccttcctgcggtgcagggggctcagcttgggacgttccgggcacggacgtgcggtgagctactcacggttcacgactcctttatcgagaggtacgaacagtgtatcactataagttagttgcgctgtaatattttttataatgacgcattaatttgttattgtaggctgtgtgaggccggcctcctaccgatgtgtcggctggtggaggctgctgccggcgacgcggacccggccagacgatggattgacaggtccccgtccagctgcgcacgttcctaggccgactccccctccgcacggaggtaagtatttttattactatttctgtacatgcctcgcacatataagtgagccgtttcacttgccgattgcttcagggtttcgtgcaccgttcagcaccccgccttcctcggctaggccttctgttgtgccccccacaggtacttaaaaaaacaacattacttcgacaatcaatttacatgcattttatgtcttagcttacaagggtcccgttgtcgatgtgtaggtttcgcctagttcgctatgacgcaggccgcgcacttctcccaggctgcagggtcagcgtctcaggcagctgcgtcgacctcgcactcagcgcagttctagcagtacaccgggacttcgtcacaggtagccggcacgtcgagtcagggtccaccactggaccatgctgggacctcttcggaccgcttgctgccttccaccttgctcttcgacatcactgacttcgacttcgcttcaggctcgacagaggacgtcatcggcccctcacagttgggaggcgcaccgccggtgcagacgcaggaccaggcgcaggccactcctccgcgggacactcgtgctacccatgctgtgccaccggatcgtttcacctactcccaggaccatgtgcgagcacaggcccggaggaccaagcgtggtcgcggcgcggggcagggccagtagagcagtcttctctttgtttatttgcttcactttccagtactgtatgcttgtgtaatgactacgttgttgttatatgtgcacgatacctttcggcgcatgcacgatacctttcggcgcatgcacgactactttctgccgcaccgatgcagcctcctttattcgcgtgcgatacgagtattttcccgccatttggcgcatacaaccaatgtaactttcggcgctgatcaggcatgtaactttcggccccaatcaggcgtacccaccataccccaccacgttcacatgtcaggggtatcactcgattttttgcgcctatataagtcgccttaacgagtgaggcctcacaatctttcagaactcagtcacattcagtactctcttccccacttgcttcattacaaatccgaccggctttcgtcaatggctagacgccggagtgttgaggatccaaactggcgtagcgatccttgtgtatacctactaccaccttggtgccagcgtcctctctgcctatgcggtgatcgatgccaactaatggcttcgaggaatcctgatattcgaggaaggcgcttttttaggtgccctaactatgaccgtgaggtattttattatctgcatatgcttattcattccgtatgggcaatcgctttattctttgtaacactactctattcagcagacccgcactacggcttgcgtatacatcgagtgggtcgatacagaaaatcccgttctcgacctaaccacttgtttacaagaaggtcgctggtatttcgcatccgaaagtactgagcaatacttacagagaaaagcggcttatgaacgataatatcgtgaacaacagagtgactggcgggtgctaactacggcactccctccatgggaagcccgtccaagatacaggtttagtgatcgttgtcaggttcttcgttccataaagcctacaacattgggtcgaaggttctttgtttgtccaaatattcttgacgacgatttcatggtaagaatattttgattacatgaatccttattttctcacaacatttcctaactttgctcgttttacatctattctttcctcttaggaaccactaaggagatgtcaatacagagaatggatagacaccagaagggttctaactctacctagtcgtgatgtgcagcttgaactaccagagcaatacagggttactaaagtgcggtttgagagaggagagggatcctcacgtaggggttagctattatcggacaacttggcatattgaaatttctactgtcatgcttccttgtcccattactacattgtcgttgtgttcaactattgcactacctccctcctagttcgaatctaatatcatgttcaaattgtactactatttcttcatgttacataattctccttgtttaagtccatataatgtttctacgacccagactgcgataggcctatataaattatccgagtactaatacgtcgaataaggtacaaaataatacctcacttaacatatgaaattgcgcaacaaccaacttcaatacatttttataacaatattaacaagttttaccaataaatacttctttatttattattaacataacatagaaaaatcttttggccgtacttttacatctgggt

SEQ ID NO: 47614 - DNA, 12097 bp, Oryza sativa
tcatcagcgttttgtttctcaaatactgtccgtcataaaaaagataaacttctggttatcaatttaaatagatctacatagttagaagttgattttttttttctaaggaggaagagagtgtaacattataagatgaacccggattcatttagtgcagaaagcactttaacacaacagatcgattttctgtacttgtgcagcatatactccctccgtcccaaaaaaatcaatataggattagaggggatataacctgtactctcaactctagattgatttttcgtgagataaagggagtagattgctatccttctggacctctttcggatgataatgagatatgtgcgaatatgtgcttgaaattgcaaaaacccaatcctaatgtcttggttttttctcgagagattgtccatcatacgggcctggtcatgatcgacaatggatgttgggccacacctgggctagacaggtcaatagctgacggacgggtacagcaacgagcaattattttttttttcgagaaatagggaatatattatttcctccgttttatattataagattttatagtattgttcatattcatatatatgttgatgaatagacatatatatgtgtgtctagatttattaattataacctgaaacgaaggtagtactcaagagaagcttcctcacaaaccatacgtgagataaagttataagtattttctagccagagcccaaacacatattcgcatcgagccttattcgctaaaatatggctaatacagttttagctcctctggcccttgatgaatttagggcctgttcacattggtgtcattttcaaccttaccaaattttggtaaagttgctaaaaaaagtgactatatttagtttcctgccaaattttggtaattatataagaaatcatgttaaaattttggcaagttaccaaaattttagcatttgataatgccaaaatttgataaggtttttttacagcaagatgaacatgcccttaatctccctatttcctaatagcaggtccttgaccttcacggatcagaaaggctatgtccgaatatatcctctcctcatactgaatcatattgattgcagccagacagtccgactcaatgatgatcggcaccagggtccactgcaaggcccgagcaattccttctttacaggcgagcatctctgactctgcctccagtgcactatatggcaatgagcaaggtgatcataagatgcaaacataatcttcccagcactatctcttaagtcttaacacagcacctatgccccccttaagcttaaggggagtgacgtacgggaatttctgtgaaaacattacatatatttttaacatatatatcattttaagtatgttagattagattaaatagatgtatataaagatatatgcatgtaccaatacatatatttgtacgtattctgtacgagtacatatgcgcaggcatgattcatgatgtaatgtgattcactactagaaaaatcatttttttaggcggccaaaagtagttttttcaggcgggggaaggaccgcctatagaccaacgactgcgaaaatcgatagcccgcctacgaaaatcctctagacgaacaaaccggccccgcgccttgccgctctcccccggcctccctccggccgtatctgggaggggagccgcgccggagccgccgcccccgccccgcgcgttgtcgtcgccaccccgcgccgtggctggccccacgcctcgcctcaccaccgccgccctcccctgacctccctccagccggatctgggaggggagccgcaccgccgcagtcgccgtccgcgctgccgccgtcgctccccctccggcggggagggagggagggaggggagggggacgggcccggtggggagaggagaagaagtgttgagggagagagagagagttgagagggaaatgagtggtagggagggggtgggaggagaagataaggagttaagattttttttttttgtggtaggtacgatttttgcaggtggagtacataaggttcgcctgcaggcatcgcttaagtagtccgcaggcgaacagcgaacttcaccccgatttatattttttaggcggtcatttggttccaagggttatgtcagcctgcgaaaaaaagaccccaatgtcgggaaaaatgctttttctagttgtgattaataatccttttaactagatgatgtccgatgctttgctgcgggatatgtgttagacaatgtagaaatgataaaataatttggattgaaatattatgaaaataatttgagaatgatgatttagcatgtgtatgtttagtttttaaatgaaataaattgtagatataattattatatgtttgtatgttgagctttttgtgtttaatgggttgatgtggcatgcttgcatgtagcttttaggagtgctaataaatattatgcttgcatgttagtttcaggtgtttaatgcacattaactttattaactttatagaaagaagggattcctgcatgagaccatcgagttgcagaagtaaaggaagcaatgggtcgtatccgtatgcgagcctgtttggtagagctacaactcctaaatttagctccaggagttgagtctggagtggagttgtggagctgtctaaaaccagctccacctctctagttcattttgtgagagcgctccacccagctctgcgtggagctaaaactgtttggctgggctccaacttcatgagaggtggagctagagctagagctgtgccaaacagacccgcacgtttgctcatgggctgactgcttctatgtctgtttgtgagctgaaggaatgttgaatggacaaaactgatcggacagttatatatgagatataatctccgttgttataatttatagagtaaaatgcaccgatggtatcacaacttacgaggtgggtgcaatttagtcactcatcttgtaaattgctcaaacaagtcactcatcttgcttcgatagtgcaaatgttatcaaatacattttcacatcgattgtttgttttcaaattggagtccatattaacctagcatcatgcattttttaccaatgtagacaggataagcattaaaattacaaattaacacttatatttttatgtatatactactacccctactttcaatgaacacggtcatattgtgcttggcaatcaataacaaaattcatcattaattgaattttactaccggtagtattgcacgttggattatttatgaatcgtgtgaccatgtttgcaaaataaattaatatagcatataacttcattgcgaacactccatacgacacatgttttatatgatttacacccccaaaacaagatgagtgatttgtttgagcattttacaatatgggtgactaaattacacccaccttgcaagttatggtaataacggcgcatttcactctaatttaaacctaccgcgacctggcagtatagttatttattttttttctcttcaattaacgtgtatggtgatttcgttttagctatatttagatagatttttttttccaaaaagcataacccatgttgtgacaatggccatatcatgtacgttgctttcttatggtctggcaaaaattctgaagcaattaggagtcagattctcgtctcgagttagcatgcataaaaagcgtggttgaatttcaaaaccaaaattcagtttggttttgaagtttcttattgcctaagagcaagttcaatagtatagcctactactagctccaatttatttatagccgatctaatagccaattcatacaatagttgcgtactatattattaacatatggtcctacctgtcatacacacattacgtcttgaagtccgtactgcagctggctacatatttgtagcccgctgcttttctctctcatcttttatctcatgaaaatatgtttatagctggctaatagcccgctattgtacatgctctaaagactcctttaaaacacataaattgaaaaaacacacgacttagtaacaaggattgttaattcttatagaaagacaaaaggaaattttaaaataggtgttgttgtatcgcaagaaaaattgtaagaaaaaaattgaaaacatgagctatgacaattccgttattttcatataaaatcactttaggattgtttattccatagaaatttcaaacaaaacagtagaattcaatatttttcctttaataaagggttgtatgataggagatttttctctatgattacaatccttaaaatttctcgtaccaatcctcccattcaagagggcctaaaatttaacggaattaccccaaacttagagtaaatctcgtgaaatcggagaaaattattcatctccttcctccgactttcaactcacatcgctcctcccgtcctcccctacctggaggctgcagctcctggcctcccgggcaactagggttcggcaaatcccccgcaaggagggtgaaacccttccccaaaactccccaatccccacccgaccttcttcgaaatcggaggcaaaaccctaatcgcaaacagctcgtcctcgcgcggccgccgctccgcagcaatggcgtccctcttcaaggtacggattccccccccccccctccgaaaccctagctacccgagctcgtcgattccccctcctctcgcccttcctctgaggcggctcgcccgattcgcttttccaggacccgaccaagctgtccgcgtaccgggacaggcggttcaccgggacgcaggaggagtacgaggcggcgctgcaggcgtcggtgacggtgtacgtcgggaacatgtccttctacaccacggaggagcaggcctatgagctcttctcccgcgccggcgagatcaggaagatcatcatgggactcgacaagaactccaagaccccctgcggcttctgcttcatactgtaccctctcctttccttcctcaatccgttttttttttaatacaagagatgtagtttggtgctatgttcaaattaaaggtgctgcttctgttttattctagtataagcgggtgtccaaatgtagtttggtgccttttaagatgtttttctagttctagttatgcattgatttaacagtgaagtatcaatggtggttgtgacttgtgacagagaagctaagggagttttaggagtctgatgttgtgttggtactggcaggaatgtgtgattttccctagaatacgggcagcaaagaattctatctcagtgcgaatatttggcttgagcagttagatattgctattggttaagtgagtaattttgtagtagtgagctcatatgtggctccttggagagctggttttggtccgctagtatgggccaatatagtgcaccaagtttcttgttttttaccctttgtttggttacttttaatctgatgtagtgttgattagtccgcaatatggtccagatgtgtcttggttgtcgagggggcatggtttaagttatatttggccaactggtgatttttgagagtctattgggatcttttttatgtattcaggctcttgttttggtgttttgtgttcgaatttggggttttgtatgctggtagttagccatactttgtacctctaattcgaaatgtggcatcatcttgatctctgatctgttaaggttagagtatgtcttttttgttcattcaaaaaatatataccacagttcctttaactggtgtgcgtgtcttggattcctggcagcaaggcaccccttgaattatcaatcttctattaaccttacagttatggaagggattattctctgataggcatatattgctttattgtcttgtgcatcgggcatgttgttagtttatattggattttggaagatgtaaaaatgacatttatctagtttgagccaacggtgtatgtgctgttagcctacatatcgttataataccttccttcctttcaggtactactccagggaggatgctgaagatgcggtcaaatatattagtggaacaatgcttgatgatcgcccaattcgtgttgattttgattggggctttgaagaaggcagacaatggggtcgtggacggagtggtggacaagtattaccatgatcttattctgcatgaataacaaatgtatgacatttgaccatatttttgatgatagttcatgtttcttttttcataggtaagggatgagtaccgcacggactacgatcctgatatcctttggtactattgaattaccatttattacatttagagcggggttatgctggtaactcagaaacccatccgtgttagttcatactgatgaaaatgttacctgtagatccatcctaaatatggcaattcaactatctgctgattgtttcttaatagcgctcctttaaattttgtatgcctttacatgctgctatgttttttctgttgagttggctacttccttaatgaatcttacgaagaggtggctatggtaagatggttcagaaagagctagaagcacaacgtgagttagttgactatggaggtgcttttcaacctaatgcaccacctcaatgtaagtgctgaaagttttgaggactgtaccttaagcctttaactacatccttgtataattttcatttgtgttaaccttattaactgcagtaattgctttgttagagatttgcatgtgtggcctcttgatatatttttcaattggaagtattttatggtgaaacaatttgctttataactggtccgatcatatttacatgaagttagcattcatgcataatgtagcctttttttattctagtaaagcataattagacattacctttttctctggtgaccatgtgtgcctttccactattgactctgatctcacttgttaactttagctgcattttaccttgtcgtttgccaccaaaaagcgttggttgagagtttggttcactgctttatttgattcaatccttggcagcataccgtccaatcaatttactgtttatcttctgtccaaacatgttcctgattatatttcatcattttcacaaatcttggcattttttgaaatatgcagatgacagaggtgacaggaagagagggtatggagattcttaccggaacgacagaggtcgcacatctcgcatattcttgttcttttctttcccctgaactaatagctaacacaatctggtgtgctgccaccagattaccaacggaaacgttaccggaacgatgagcgatcgtcgcaaagagcacctgactctgagttcaagagagatgcgattgattcggtattagagcctgcatacgtgtcatctggcttttcctgtactaccccttcggaaaaacaatatgtttacaaaatatctcgtggttatgtttgcaggagaagaatcctaggtttcgtgagaaaggtgattctgatgaagaagacgatgattatgataagagacgccggcgctgaactgaaagaaacaattgctgataaatgcaaatgggcagttgcagtgactacactagtaaagcccgtcgagcttatgttttttaccctgttgtgtaccatatgacttatatatctgtcgtcagctcatttctatgttgcggttcatcaccacatgcttgcataggtctcgcatgcgactgggaatggattttgtgtttattgacacttcagcttatgtattgacctgttatttaggttggcaactaattgattttggtcggtaacaattaccttgcgaactatctgaaaaactgccgccttaaacttgcaaatactcgcttgttcctggtgttaagtgaaaatgttggtttagcacttgttaattgtgaaacttcggtcaaaatatatggtctaatgtgaaaattactcattatcgaacgaacaaccgcgaaccttcctgcggctttctgatacaatactacgatgttgatttcgctgacattgtgcatcgacgtttacagatagcaaagtcgatagcaaattaatatgtgaatgatcacttctctgaggccggccggcagtcatcgagatcatgaagatcgtggaggagctcctccttccggcgctggccgccgacttgaccagccggctcgtctccctgctgatccgctcctaccgcagccgcgcaaccaccggcgtggtggaggacgacgacctggagaagctccagctgctgctccttgagctgcacgctgccgtcgacgagggacagggccggcacgtcacgagccagaggctgctcctgtggctccgggagctcacgcagagcatgtaccggggctactacgtgctggacaccttccgctaccgctccgtctccatccaggcgcagcagcaagacgacgctcgcggcgctgccgccaagcggctgcgcaccagcgccggcgccgcggtgcgcctcgtgctcggcagtagcagcagggacgacgacgactcgtcccgtgccctcgcccgcgccctcgcccatctgcaagccgtcctccagaacgtgaccccgttcctccagatgctgggcacctaccggcgggtgccccggagggtcagcgtggacacggagaggtgcgtgccgatcgggcgtcacgtcgagaagcagcggatcgtcgcgttcctgctcaaggaggacgaggcggctgcgcacgtcgtcggcgtccttccgatcgtcggccctaggggcacggggaagagcaccctcatacacgatgcctcccacgacgcgagagtgcgcgcgcacttcgcggtgatcgagcgcttcggcctcgacgaagtgctgctgcccctacacgccgctggagcgggcgcagccgccgccacggacgacacgtcaagccggagcttggaagatcaccggatttacctcgacgcggtgcacaacatcgtccggcaagagcgctttgcccggaacaggtccctgctcatactagaggacgcaccggccgtcatcgaattcgccgagacagcgtgggtcctaccaatggctcacgggagcaaggtcgtcgtcacgagcgaatacgaccaaaccaaggcgggtctcggcgcgacggaggaggcaatcagaaccaagaagatgtccaaggaggagtactggtaccacttcaaggcgctcgcctttcgcggagcggcgaatgatccagcagggccggcgcacccagcgctggcggctacagctaaagagatcgcatccgtcctgaacgggtcattcctagggatgcatatattgatcgccctgatgcgatccgacccaagggagtgcttttggcgcgccgtactccagagcctcgtggatctctgccgctcctcgaactccaagaggatcaaggccgacatgggctacgtgcaggagttcgcgctgatcgggcggatcgctctcaagcttgtgcttccgatgcgtctcacgcttcgtagctgctccatcaccaagcaggggggcgatcctcaattaggacctgagcttaatcgtgtggcaggagggatagcttacagttgtcgcagtgatgactctgggtgcgtggatgtcatcctatgcagatcacgcatccctccctacgagatctacaagctctcctgcgtcatggaggaagaggtccatctagaacgtgcgtcctagaaaaatgaatttggtaccctgtataaaaccatgttaatttgcttgcttctaggtagtatatgatcttgatgaaatttacgtcttgcttgcgtatgtacggacccattctgttccattgatgtacagtgactgtgaactaaacggaaatttattttttgtatcactgatcatgcttcctagacatttgactaccgcttcagtgaatttgaaacccagttaattaaaagttatgtacaaaatccagtgaatgtcaacctgctgcaacggtctccatgttaacactagtcagagtaaccgtcgtccccgtcgtgctcctggtagtaacgccggtccagaacgagtgcttggcaatggcagcggcgcggcggcaaaagtcctccacaacggccgcgcgctccgccgggaagccggcggcagcgacggccatctcctcggcctccagcctcttgctcacttgctgaccaggaagaagtcgccgctctcgtacgtgaactggccggcgaattctgcaatatagctgtgaaacagtatagcacatatacctagctctgaaatatgatgcgccaaaacggctgtaatcacttggcagcaaaaatatggcacacactttttattgaaccaaccgatcaagttcagactttcactcattgtcagagaggcatccaagaagaacagctaagggacagcctgctacagattcaacagcagctaagtgatcaggagagcagcttggcacgagtggcaggatcttccttgctttccacccacatcatgaaaacgtagccgaggcaccagagaagaacatattggaatggaacccaacaaagcagtgccacaaggctgagcatgctgccaacatattgagggtctttgatataaccaaatggaaattctgtcacccatgggattttctttccaaatcgaacaccgtagtaggtgcctggctcaccgagcagctggtacaccctgaagagaaatcacatatatcagccacaagctaactaactgaatgatgattaccccttccgtctttgtgataaatacagaatttagtctactataaactgttgtgtactatactcatattaccaaatgctcaaataatatgtgttgccgaagtggccgtttcaagattataggaaagtgtttttattctgttaaagagacgttaaaatcagaataaaaacaaattttggagcttgagtgcctcctcgactacctcagactatttcctactggtgtaaagagttgctagaagtccaacatagaatgcataggaattagcataaaaataagttagcagtgactaatccccagggtagtggcttcacaggtatcaaactcaatgagtcatggattagcactgttaagtctatgacacttaacttacttttgcatcactaagtgtctaaatcgctaacaattgtaaacaattctaaatgtttataactaatattgaaggccctatcttatttcaaggtatggcaatcatttaaggaagatagggctttaggacaaaaactatagcaaaaatgatattgttaaaatgcaaaacaaatactgaacgagaacgggacaactacaatagatgcatcagtccattatagagcattatgagtacacatcaacttaagatgaaatttggccccttttttttcatattagatgagagcattgcttgtgcttttaaaattatactccagctataagtttttttttttttgtgtgtgtgtgtgtattgtagatgccattctggcaaatcatggagaaaattcataaatcagtaataattggtaaatagaagcagatgatcgttgttcctgcttgaaaatcgtcccatcccttactcatcccttgtccctacagcaaactgttgattctgcagcactaaatcgacaaacgaccaacacagatttatacaatcgcaaatttttggtgctgaactgcaattagtggattattgatcatggaaagatcacagatgggaacagataaattacaccgaaaacctagcacaacacacatagaaactagaaagtcgcagacgatccgaacgcgaggggatagcatcgcgtccgactgtcggaagaggggtttaggggatatatctcgcttacttgaaattgaggtactggccgacggcgaggagggcgacggagtagagcggcggcggccaggagaaggaggcgacggaggcgagggcgaggagctgcagcgccttgaggacgtgggacacctgcgccatccggcggcacgggtccacgccgccgccgcctccgccgcacaggtcgacccaccgctgcgggtggttccagagcgcccagtagaacgggaacggcagcagcacgccgacggccgccgccgccatttccatctcgttgtcgaaggcagagcggtcacgaggggctcgtggaattttcgtgtcgtcgcgacggcacactacttgggtcacctggggcgactcacactagacatcctggggtcacgagcctcgtgacacactgacatgtg

SEQ ID NO: 47615 - DNA, 1345 bp, Oryza sativa
agatagtagtaccatcctaggacagctcaaaagtactacgtcaccgttaggatacaagtctactatgtaaggacagcatgtgagttagtgagtatatatgtttaatgtttttgttgaggtttctcaagaaatccagtgcatagcctgcttcttgatggcaaattgcaagactggagatcatctgtttttgtttaaggtttcccatgaaatcaagtgcatagcctgattcttgatggcaggttacaagactggactgggaaatttctagatggtgatcgagtgaccggtagtccacaagaccacaagcacacaaggcaccaggcacgctttaggggttaaccagaagatagacaaggaaacgtattttgcatcgagtgactggtagtccacaagcacacaaggcaccaggcacgctctagtggttaaccagaagataagacaaggaaacgtaaggcgtgtttactttgggctggtttggtttgaggcataaattggtattatcaatatttgataattttaatagtgtttactgtttatttggtttgaagccaaattttggcatgtctaagaaaatatgtcatttcaatagttaacttagtctattttggtttcaatccaaacacaactttgccttgccaaaattagtcatgccaaaacttgtcaaaatttagcattgacaaatattggtaagaccaatttaggtcacaaaccaaaccagccctttgatgctattttcaaccataccatcttttttaagttattaaaaaaatgtctacgttcagtttgttgctagatttgctaaatacataagaaatcctaccaaaattttgataatattgtcatcctgccaaaattttaacaatattaccatcctgccaaaattttggcattgccaaaatatcataaggtttattttggttaaaatccgtacaggcccgtattttgcagcgaaatgttggaaacaagaaaaaacaaaagagcaaatattggaaacaagaaaaaacaaaagagctgatcgaattctctactactgttgttttacatgatctccaatactcccaaccgatcaaaaaccaatttacctctgcttatcattgcaattgctcgatgaacggagaaaatttcctaaccataacaattgaccacacgcggaggaaacagaaattttgaggcaatatcacactcagcgtcaacagcaggaagggggaaattttgagtcaaatttctaactctatcctattacctgcttgacacattccagaaaaacatcaaaatttctggacttttcctgtgaaataaaaaataaagccccatcactcagcattatcatcatcaaaaccatcat

SEQ ID NO: 47616 - DNA, 1647 bp, Oryza sativa
ccgctttggtgttggttaattaaaataaatcacatggtgggctgtgggtgcatggttttgctggtcgcacccatggcagttaaggaccggttcgcgggatgccctggaagaacttatcgtacttaccacaagccagcgtgggcaacggctgggcttgtagcgtagctttcctctagccgacgcatccaggcaagggtgggcgtgatggagtttggatgggccctgcgacggcctatgcggcttccggattcacctaggcacgagaggggacttcccgctgccttgcgaggagtgggggtgaaatctgaggtgtggtgtgcttggttagagggggttatgcgaagggtcctgtcacggcctctttccggtatgtcgtggtgacatgtcggcgcacggaaacgtgtcgtggggctgtgtcttgtgggtacagttgtacacctctgatcagagtaaaactattcgaatagccgtgcccgcggttatgggcggtcaaccagattcaccgtgattagtctcaccttagtgtaatcttttgaatttggatagtttaggtggatggctgggcctgtcgcaacgtgggatagcgttggacagcggatgattaatattaattaattattacaactgtttaaatctttcaatttctgtttataaatgctcgctttatgcaaatgaaccactttagctcttctttgatgattccctgcaccatacccctattccggtatgacttgctgagtacagtgggtagtactcagtcttactctacttttcccaaccccagagttcaagttcgggtcagatgaaggtttctccgaggagtaggctttgtccgtgccgtcgaggatgcctgtggagtggtgttcccgcttcagttttagtcaaggcttagctcttgttgtctttcttttcttccgctgcatttatgtaagacttttatgatgtttgtaagacgtggatctgaatgtcaacattgtcgtttgtgtaccccggccggtcctggacggggattttaatgcacattctgcttgaaattctatccgggaatttctgggcgtgacactgacctatatacttcatccataaaaaaaaagattacttctaactatgaatttagacatactctattattcgtcccaaaacaaactaaacctcgaacggaatgtatacaaattctttgtattaggatatgtaacatccaaggttcccaaaatcgccgataatcgtgcttaccacggggtacggtaaaagaaaaaccatggtagtcttttaaattcgaaatttgaaattttgataaattttatatggtttcgtacgtgtcggtgacatggggccgggggtatcgtgactagaggcttgggtagccgcggtcacccacgtggcctgaccctctcgggggggggggggatcgggcccgagggtgacgtggccacccctccctctgtctccccgaggggttgggccgctcccgtgtcggccccgagggctcaggcgctcccgtttcggccccgagggctggggcgccccgaccccctgtggttttggcaccacgtgtgtgggttaggtgagcacagcgggactcacctaaccgcatttatagcgggttggacgagcgcgccaagccccatttaatgcggcgcaacgcac

SEQ ID NO: 47617 - DNA, 18915 bp, Oryza sativa
  unsure (1)..(18915): unsure at all n locations
aaagggggacctgggcggtctcccggtgaggagccccacgctccgtcagtacggttttccacagttatcgcacattaaacgtgcttaccaccggggcacagtaaccccggccccggcggtttgggaaaccctggtaacatcccgtataagaatggtttattttaggacctggagtaggcaatatccagattcaaatctaaaaattgattttttttctatttttcctgggatagatcgagggagtatgttgtgtatgtgacacgtgtaaaagcttgtgatctgaaatatatagctgtaaaatgtgtactatcgccatcctgaagattgatgcatatcgtataatgtgtcctgcgtgaaatcgtattaaaaaatgcatgtagtgcgtgtgtgacagtgacaaactgatcgaaccgaactgcttgtcctaatttatattctggtttgatatagtattgtttccttttggagatcgcaaatttcaccttttgccgcgagtaaactcactggatgctatatgtaattaagtctacgcctgcatcaggattattcaggatcctcgtgaagatcttatacgaacaaatctcatcaaattgaacggtttgttgacgtcatctgcatctcttgctttagatatgctgggcaccatatgtttctgcaaatctgatcgagatgatgtgtgcgaaatatataaaaattatgtttcaaaagggggagttggaattggagggtgacagtatgctctgcaccaattccgccactcttgtatttttttattgctttccattcttcaacttgtgatcttaaattcttatctccgtcacaacacacggatatagtgcgcgtaaacagaaaaaactttcatattatttcaacacatgcatgaatgtagggttagttagatgacacatacatggtatttggttgatttcaagcgctggacacctagaatatttagatatatgtgcaattttactccgttttaacagcaattttgttgttatatatgtttttactttatttttatttcatgtaattttgtaaatctttgtatatatgttaccaattttttgttcaacctgtttatactaagaagggattttatttaaatgaataaataatagggagtgatatgagaaccatattggattatcatgcatgaaaaaaatgatagaaaatttagtttcaggtagctagaatttagacactcccttatgatacacatgcacatagtaggaggtgcacttttaatagaactttagactaagttcgggggcaagggttgggaaccttcactcctagcacacaaaacaaagtgatgtttagtgcatgactaattaagtgttatattttttaaaaaaaatattaatataatttttaaaagcaatttttgtaaataaaatttaacataccgtttagcagtttaaaaatgcgtacgcatgaaaacgagtgaggttgattgggaaaggaatgaaaccaactcccacatgtgttcacatctttcgtgtaataagaaaaatatacaatttgtatatttatgtgatatatttggactgcataccgtaaaagctgtccatccgcaaacactatacacatggcagggcaacttggtcctcgataaaacctgacaagttctcagctggatcgatatctatctgtagagaggccactaagataaagatcaagacgccactgtacgtacatgtgccaaaattgtcaaggcgacaagattcgggcaggatgtgaaatgagtcatgttggacaaagaagcataaataattgcgtatcatcgatcgatctagcacgtacacaatcgaatatattcatttgttaattagtacgtcgaggaatgaccattgacggtcgaccaccgtagctatagagattcattcattcatgacttaattaggatacgatcttcaactaattatatataatactgtgttaagcaatatatctcctaattcagaatttccacggcggccacacctcgtcttttcaccttgattggatccattactttgattgcgacttgtatatatatgattcactcatctacgtgcatctcttctgctgtaagaaaaggtaattggttaagatctgtaatactgattagataatgataggttatatttctcggatgagcactgctacatataaaattcttataaacaaagttctcaaccatgcacttaatttaatcagtttaaattaaaattataaaaaatcaacttagcaacaaagttttgaaccgtttaatttgatcagtttaaagttatatatattccagagtcggtcacaaaaatgtgtcgtagtaataaaaactaaagtgttccatccgatactataggttcttatatatattttagaaagaaagaactaaatgtatagagtggcatgtattcataagagaggagggaaataaacaagggttaaggacaagctttgggtgtgttcggcacggctggttcccaactttctcctctcgtttttcgctcgcatattttttaaactgctaaacggtgtgtttttttttattaaaaaaaaagtttctgtacgagaacctccagcagcgacactcctcggctctcctggctgcaatgcatgcggacagctggatgcaacgtatacgatcgagtacgtgcaagcacacgcggctggttacccgcgcgcgtcgcgtacgagagctatagagcgagagcgcgatcaggtggccggccggtggccgtacgtctgcagccgcgcgcaggccagcggcaaataaaatcatggatccgtggatcgatcgaacgtgcgtttggctgtcaccacgatcgatcaacggccacgacagcgccacctgccctgcacgacgacaaacgatcgaccaaagaatcaaagatctacatgtcggtgcgctgcatgcatatgcttcgctacgaatccgcctcgctgtgtgcacgcacgtactaggttttggccgaccaatatattcccccgtttcaaaatatttgacaccgttgactttttagtatgtgtttgaccattcgtcttattcaaaaaatttaagtaattatttattcttttcatatcatttgatttattgttaaatatactttcatgtacacatatagttttacatatttcacaaattttttgaataagacaaacggttaaacatgtgntaaaaagtcaacggtgtcaaatattttgaaacggatggagtagctcccatcgccacgcaaatataatactagtacctaaatatttgacgccggtgacttttttaaaatatgtttaaccgttcgtcttatttaagaaatttaagtaattattgattcttttcctatcatttgattcattgttaaatatacttttatatatacatatagttttacatatttcaccaaagtttttggataaaacgaacggtcaaacatatagttaaaagtcaacagcgccaaatatttagcgacggagggagtatatataatcgtacaatgtttcgttttggcagctcttgcatgcgacgcgacgcgatacaatgggaggcaaggcaaaatgtcatctctcgtaccaatttgttttcttctttgcactggaaaaaagatccgtgcatttcaaagggaaaactaatattgcattagcatttagatgatcacggtttgattttcatgatctaaccccttccaaaacaaatatagctgattttcaaatttaattttcggagttgattttgattttccttttatcgtagcttatttttaagcaagagcttttaagtcggcacgaaaaaatataaaaaaaaattatccacgaattaatatttgatcgctaatgcatcacataagcatgtcttgaccaatattcgaccagttccgtatgtataataaggctctacgtatcgtcttttctgtttttcctcggtccatctaggagatgtgccaaagtgcacatatgtcgagtcctggaaacagcaggagatatggggacgtcgtgactgaatcgcgcaacgcgtgcacttgaactcacaacgcacactgattaggagtggaaacaaagacacacagcaccgaaacaatcgggccagggccgatggatgaaaaatcagtatggactcgagcaaggtaccaaaatattagataaaaaaatatttttaatgtttataatagtgaagattagttatcgcaggcactgcacttcagggtgaacgagaagctataggtaatggcacactatgcagcatagacgtgcaatctctctataccactcatcctcttatgggattctctatggccggatcgattgcatggtagggatgcaagggctaacgacgactattgcatccgtctcaaaaaggatgtgtttctactatttaaaatttatcctaaaaatattatacctagaacctaataactaattaatttgagaaagctaattaggtgaactaattggctgaacatacctagcgttctatgcgggggatgtgaaatttctttatcttccattttaagtttactggttcacttatatatttgtccttgtaaaattaacgggttgtttgtctaatgctctttcatctcaatgtgttaatagtatagggtttatatgctgaatttgtctcaacttttttaatttatttttggatgtgtggtctagctagtttggactgaatataaaaaaaaatggagaaggaaggaatcaaacctagggtggctatactaaccgtgctgctagccattaggcccaagttagttttttttttgactaaattttgtcgagtggtaaattcttttgagaatttttcatgaatggttttcgaatacataataggatatccctcgagggttcaaatgtgttaccggccgaactgcctgcatacaactcccttgtggagtacaaattaatggccgcccagaattctggattccggtagtgtatgtatatatgtgacctattatattcccacttgtattaattcttttacgtgtttaattatatcgactttaattacctctcacaaaccatggtatgcatgcaacaccatgtaatctagattctagaaggatatatatcacccttaattagcctttaaaaagactctcccctaatctccaaaacgacaaaccaaaccaaaccaaatctttcagtccttgtcacacagatctcagagagcctcaagtctcggtcaccacagctctactgtctatctagctatctatcagctgccttccatcgtcagcacacaaactacacaagaatctgcttatttataggccaccttgtcccttctacaatggtgcaagaacacacaaattcacacacacactgacacacacaaaccgatcgattgattgattgataatgaagcaagagcaggtcaggatggcagtgctcctcatgctcaactgcttcgtcaaggccacggcgccgccgccatggccgccgtcggcttcgtccgcctccttcctcgacgacctcggcgacctcggcatcgcgccgctcatccgcgccgacgaggcgggcaccgcgcgcgcctccgccgactttggcaacctctccgtcgccggcgtcggggcgcctcggctcgccgccgccgccgccgtgctctacccgtcgcgccccgccgacatcgccgcgctgctgcgcgcgtcgtgcgcacgcccggcgccgttcgcggtgtccgcgcgggggtgtggccactcggtgcacggccaggcctccgcgcccgacggcgtcgtcgtcgacatggcgtcgctcggccgcctgcagggcggcggcgcgcggcgcctcgccgtgtcagtggaggggcggtacgtcgacgccggcggcgagcagctgtgggtggacgtgctgcgcgcgtccatggcgcacgggctcacgccggtgtcgtggacagactacctccacctcaccgtcggcggcacgctgtccaacgccggcatcagcggccaggccttccgccatggcccccagatttccaacgtgctagagctcgacgtcatcaccggtacgtagatccatcacatctactaagacacgcgccgccatgatcgaggtaattaaggtataggtgttttgacgtatacatgtatctgcaggtgtcggggagatggtgacgtgctcgaaggagaaggcgccggacctgttcgacgcggtgctgggcgggctggggcagttcggcgtcatcacgcgggcgcgcatcccgctcgcgccggcgccggcgagggcgcggtgggtgcggttcgtgtacacgacggcggcggcgatgacggccgaccaggagcgcctcatcgccgtcgatcgcgccggcggcgccggcgcggtgggcgggctgatggactacgtcgagggctcggtccacctgaaccagggcctggtcgagacctggcgcacgcagccgcagccgccttcgccgtcctcctcctcctcctcatccttcttctccgacgccgacgaggcccgcgtcgccgcgctcgccaaggaggccggcggcgtgctgtatttcctcgagggcgccatctacttcggcggcgccgccgggccgtccgccgccgacgttgacaaggtatactagctagctactagcttgctctgcgctgagccgaccagagcgggtcccacctcgtgatgatggcgggaacaactaagctgcaaaaacttttggcgccacctggggcttacgcttacgcacgcatgcaattaaggggtgttctagatggggctaaaactttttagcccatgtcacatcggatgtttggacgctaatttggagtattaaatatagactaataaaaaaactaatttcataaatgagagctaatccgcgagacgaattttttaagcctaattaatctataattataaaagtttattgtagcatcacattgtcaaaatcatgacataattagactcaaaagattcgtctcgtgaattagtccaagatatggaatatgttttataattagtgtatgtttaatactccaaattagtattcaaacatctggtgtgacatggacttggaataagtccgtggaaaccaaacagaccctaacggtgcatgaaattgaagtctcttgcgccgtcgacatcgtcgtacttggcctaccacttttgtctgccacgcgatgcacctctcgctatcacacacctaactggaagtaattaaataattattcgattctgtgttaatttttttttatcttccttagttcccggagagacaaagattagatactatagtagcaacttagtaagctagtatatggagtattaggttagtcgctctcactaagcttaaacaggtgtataaaatatatgcatcgtctgatcgtgacatattcttttagctacttatggtgaaaactttttcgtccaaaacagtgaaaagcatgcgtgctagtgtaggtagtagctaccaggacgaattatatcattaacagtatttgtagcacatcaaggaaaaacttgtctttttaaacactgttacagtcttcagaacgcacaactttaacaggtatttttgtattatatttttttaaaaaaaaataaaggtaataaaattatggtattgtaaaagtatatttttaaggaaaatcatataaccaatcaaaagtttatgaagatatacatattgatgttcaaagttactaaaagttgacttaaacatcacattttcatcttgaccaaagagggttcatatatatactccctcaattttaaaatataagcatttctaattatatgcatctagacaaatgcatataaaaatactttattttttaaagtgagggagtatcaattttgagcatgtagctagactagattagtgtatgtctacgcacatatctgttgttctgcacaaaactactactcatcggtcctaaaatataagaatttaaaattggatgggacataccctaatacaatgaatttagacatggacatatactagtaataccatgtactacctccatcccaaaataagttcacttttcatccatctcacacataccaatagaaagtactacaaatttcggttattctctattttcacaaactccgatgcaatgattattttaaaaataaacttattttagaataaatggaatgagcaaaatataaactggtgtgtttgaggagaaggggattgaggagattgggaagatacgcaaaacgaggtgagccattagctcatgattaattgagtattaactattttaaatttcaaaaatggattaatatgattttttaaagcaactttcctatataaaatttttacaaaaaacacaccgtttaatagtttggaaagcgtacttgcggaaaacgaggtgctttctccctcaatgtcgtccaaacgaacgctgccttattacgggactgaggaattagagctttgccagaaagaaatcagcatcgccagcttggacctaccatccatgcatgcatcatgtggccattgacacatcacatagtatgtgctagctagctagcttttgatcatagttacatgtatctagctaggctagaagctggaaaccgatggatatgatggatctctcatggatgacaggccagccaaagatctgtgcgccactagatacagtgcatgcatcagcttgtatggttataaccctagctagccagctttagcacacacatgcatatgcatgcatgagcccccatcttttgcaacacgaccgaccaactatgttggctctatatagatagctagctagttattccatgcatatacagtttgcatttcctagctatagcttttgctatgtgatccgagaagatcctgcatgcccacacgtgacacgtcacacacacatgtggacaaagtactgcctcactttatccttgcatgacgtcacgtcgccacctgtccatccacgctgctagtgctggcaaaattaataactcgatcaaatttcggtgatctctctgcaaagaatttgatgaattttaccaacatatatgctttaatttctttgcttgattttatttgcagaggatggatgtgctgcgtcgcgagctgcggcacgagcgcgggttcgtgttcgcgcaggacgtggcgtacgccgggttcctggaccgcgtccacgacggcgagctcaagctccgcgccgcggggctctgggacgtgccgcacccatggctgaacctgttcctcccccgctccggcgtcctcgccttcgccgacggcgtcttccacggcatcctcagccgcacccccgccatgggccccgtcctcatctaccccatgaaccgcaacaagtaataataataataaaaagctttactacatatacacatgtatataatttttacggggtggattttttcgttcaaaatgacgacccctcatattgtgcgtgtcgtctgaaaacttattaaaatgtttaaataaaaaattaatatgatacataaatatattatatatcactatataaacattgtaatcttaaactcaacttgcacaagtagtaaaaaaacaaatttgactgcaaatagtgtgtactaagttatttatttacttatgctagtatgctacttgaatttaaacgtacatatttatgaagtggtatattatatatttccagagtatttttatggttcttttacgacatgaaaaacaatgtccgttctcttgaaggatgaatagactttccttaattttaacatatatggtggtaactaaacatacacacacctggatatgtttcaggtgggacagtaacatgtcggcagtgatcaccgacgacgacggtgacgaggtgttctacacggtggggatcctgcggtcggcggcggcggccggcgacgtggggaggctggaggagcagaacgacgagatcttgggtttctgcgaggtggccgggatagcctacaagcagtacctgccttactacggcagccaggcagagtggcagaagcggcacttcggtgccaatctctggccaagattcgtgcagcggaagagcaagtatgatccaaaggccatcctgtcccgtggccaggggattttcacgtcaccactcgcatgaaatgacacatgtatgcaaatgcatatctacatgcgtatatatacacgtatatatacgtatgtatgcatacacatatgggtgtactgtgcatacgttatagcacactgcagctaattaagcttgacagggagatcgatcaatggacaatgctctagtcaagctaatataaataatggagtagtagtatatatgtagtgcgagataattaagtagtgtgtttgcctactaaaaggagaggcaaagtagtactgtgatgcatgcatgccaactaataggtgataagtacgtgtgtgtggccgcatgtatgattagaagaagttggtttttaattaattaattaggtcatgtatgtaaatatatagtacagtactacgtactactagtgtactaccagccaatttgcatgcatgcatggatgccttcatatgcatgtcgatctcaaacgtacggcatgcttgaatgcatcatgatgcatatctatcgtcgtcttgtgggtgtaaactaaattaatcttagttatatgtattataagtttgcaatatttttccatgcatatgaatgctagtaagatatccctccttacgtccaagaaaaaaaaatttacttctagaatacttgtatatctaaattcattcatatatatatatatatgtatatatgtgtgtgtgtatatgtatatgtatatgtatatgtatatgtatatgtatatgtgtgtgtgagagagttttgttttgggggagagagatctagatgctccaaagtccattctcatacagtatttctcacgaaaagggaagtcagcttatactaataattatcacatactcgatcagtccaaaagaaattcaatcttgaatcgaatgtggcacctcctaatataacgaatctagacaaccatatgtttaaatttataccgggagaagatgtaggggttacatttttctcttagattaagtttttttttacggagggagtacgtgacaacggggcccgtacgtctacgtgcacgtacgtacagcgctgtacgtagtacagatggaaaatccaacgttgaaaatctcttcacgtcatgaagacgtggagagatttgtgacgtgaagagattttgtgcgacatgcagcagcagtagcaatctgtactgtgagagtgacgacttgtcacctatcctgaattattagtgctcgatgttgggtgtacaagctagatccgagccagatctccgatggtactaccgctgaaaggaacagtactgcatgcataactgtgtaggagtatatatatatggacaaaagttactttattttatacctaagatatttacaggagacttaaataagtatgttaaaaaaatataaaattagttattatcgattaagatgataaaataagtccataaactaaattcggtttacaactaggaaaaaaaagttaaatcagctagccgtagtacatcgctaaacatctgcagtgcaattagcatttgttatttttggtcgaatttagatttacgtgtttatgtaagagcttgtatcatcgtactctatcgtatcaaattttatgatatccatttaaattaatcacatacatacacctagtagctcagtccttgtattaaactgcatcaattcaggacattttcctggctgatgtaggatcatgacctatataggtatatagacctatctagctttattttgtatgatactgtttgggatctgtttcggctaaatctgttagctttagctgtttgctttatgtgtaaacaaatacagtatcaatcgtttactccgaaagatcgaggctgtagtactttctagtcaccgtataagatatatgcgattaaatcaggatctggtacgaagatcttgcaagataatcacgaagaaaaaacgtacacatttggtttgacgtctgcagcttcagtatatatatttactccttccatcccataaaaaactatctagtaccgaatgtgacgtttctagcactataaataatttgaatatacatatctatgcagatctatagtactggacgtatcacatccgatctaaattcgttttttatgagacagggggagtatatacagtatatacctagctatctacccgcttttcttacagatcttccacatccagcacgtactgtgtatcaagccagaattgacgtaagatcgatcgatcgatccatatggaaacaagagacacgagatcccagaaaggcgtacgtgatcacgagtcaagatcgatggagaaagagggagatcgaagcaaaggatatcttcaggcgaatctggggaaagaaactctggccttttcctgataccttgcagagctcgatcgatcgatgtaagccaatcatcagaaagacaattgacgacgacggctaacgacaccggagattcacatcatcatcgatatatcacatggataacaacgacattgttggttgcttttgagctggccaatctgtgtttagttccaacaacgacttgattaattatcaattaattaattggtaattaatttgaggaccgaaatatgatcgagtagctttctgtttgcacaaggaacactcgatctgtctgcgcatgacaagaaaccactatatatatgcactcacataataacttagctgatagctttaattaactgaaacaaattaacggccggcgtcggtcgatgcgtacgtgaattaattgtacaacatgtgcacataattgattcaaattaaggcgattgatagaaataaatctaaatatatatatatatatatgtttattatagtctccaggagtagtagtggttagtatcactggagtagtaagctagtacctggtgatctgaatttttaagaaaaagattgggatagcaatgtgacaagtactagtactgcgtatctaaccggagatctgcagccgggcagtgcggttgcatgagcattccattttcggtcaccgccgcgacgccgcccaacttcccatatttgaacgccaaatgatcaccccaacttatatagcagatgtggtacgccaaagtaaaatttgccctgactccaagtatatcgcatatgaaataatttttttgaaacaatatagcatatgaaatattaatgctattagagatattttggccgtttctcggcagttgatactcggcaattgcgaatctaaattggagaaatatatatattagagaaatattttggccgtttctcactagtaaattgcttgttttttgagaatcttagatttctctaagggggtgtttagatctaggggtgtaaagttttggcatgttacatcggatattatatagggctgggtgtcgcatgtggtgttcgggcactaataaaaaaaccaattacagaatctgttagtaaaccgcgagatgaatttattaagcctaattaattcgtcattagcaatgtttactgtagcactacattgtcaaatcatggagcaattaggcttaaaagattcgtctcgcaaattagtcgtaatctatgcaattagttattttttagcctatatttaatacttcatgcaggtgttcaaacgttcgatgtgatatggtgtaaaattttggggtggatctaaacaccccctaaacatattatggtacgccatgaacacacctcttgccctatgcctcatgcccattaccatataggctgtttcatttccttgtgttgggaactaattaatctcctccacatggaataaaacgagatctcttattagcgcattattagttaataaaatttgctaaaaaaacttgaaaagggaaattaatatgatttttaaaacagcttttctagagaaacaatttatgaaaaacacgatgtttaactgtttgtgaaacgtgcgtgcagaaaatatagtgaagttggaaaagttgtgcaaagaagagtttttaagtagctacatctgcttcaagagagtctcccacttctccaaactaccaaaattgttagacttttactgcacacacctcgcaacttgtttctcagactctaccgctcttccaaatgtcctatatatgaaatgcaacatttccaattttagatacatatatgacatcgttggttttcttaatttggctttttatagataattgtgcaaatacacttgaggtacaagtcacgtttaaattaattatgatgatctattagtaattttattcaatttatttatttatttgaataatatcattggccaaaatttagagaaaaaccaatggtgccatatatatttaaaatagttggttgagctcaccaaagttggagaagaagatatcaatccgagatggacaacaaatctgtataatcctaagatcatgaaattcaatatttcttaaaaaaatattatttggtcgatgattaaaaagatacaattccctctccatttcatattataagtcacttatttaagtttgaccaaattttataaaaatgtatattagcacttttaacacaaaccaaacatattatcaaaatatattcaatactactagataaaactaatttaatgctctagatatttctaaatttttctataaactcatccgaacttgaaaagaatcccagggactaatttgtatggccgatgaatggaagggacctggctaaaaaagaatccccaagaaaagcaggcccacaaccgcaaggcggcccaacaccagaaaaaattcaccgcattcttctgctccactgagcactccccctggccacatgcatctcgccgtcgacgaccacccccaccgcggtggctgcggccgcgccgccctcggcctcagcctcggccacctcgcggccgcggcgctccgccgggagcaccggcgccgcgcgctcgccgggggggccgtgctcgcctcggcgctgctcctggtggccacgccgaggttccgacactcccccgcgctccaccttttcgccgacatgcgcaacctcctcggcgtccccaacacgctcaacgtgctcaccgcctacccgctcctcctggcgggcgtgcccgggctcgtcctctgcctctgtggcagtgggtgcttcggcatcaggtgcgcgctccgccctttgcccttgctcggctgctgttcggtgaaatgtctcgcctaaaggattataaagaagtgcgtgaagttacattgtttcgtgatttgcagcgagggaagagctgtaattaaagtattcgagaatcgagtaccacgagcttgaacaaaattatataggaggtcaatttaccctgattatgctcgaaaacctagagagaggaggccagcttgtgcctaattgtttcataactgctcattttactactcccctggttatgaacttatttacagttaccaccaaagtgaaagggtggttatgaactcccctggctctaataaactgcttctgtctgagagaaagatggactgtaatgttggtgaccagtgaaataatatttttgctgctatgctagtataactttgcctgggcctgtagctattacatgcttattcatctaattgctttaataatctgtaatcttgctatattatagagtgggtatataatggaatttgagctagggtgttccaccaaaccgtgtactcaaatctttaaatttgatgttgaaattttatttaacaagtgtgtgatcttcatgtttcttgaaatactgcttattgtacaactaggctggtattgagggcatgatgcttaaagagatattcctattttgctatccttatttaacagaaaaacagatcagcaggtaagatctggtgtttaatattttgtttttactgtggaattgtgcagcttgagatgggaggccttgggatggttcctcttctatgctgggaatgtagcagcagcatttggctcggcttactatcacctcaaaccagatgatgaccgcttaatttgggacaggttgccggtatctaaatatctcatctttctgtaatttccccatctactgtttacttatttcgtggtgttttccatggtttctggacttggaattttttttgatatgttgtcattttatgcttcgagtccattgggagaaaaaactgtattaagtagttcatgttcaaaaaatgcagttcacctacttgaatgtccttaatatcatcgaagtattaaccataggcaaaaagagaaaaaaaaggatgtgtctgagtttccatactactgtgctaggcagccaatctgactatcatgttatcgtgcataaccaatgctattaatgaatatgtatctatccttttcctcgatatgaatgttcactggatgctatgaacgcagatgatgatatcagcttcttcaatgttgtctatattggtaattgaaagagttgatgaaagggctgggttatcttgtttgctatcactcttatctctcatactggtgagcagcgcatgtgaaaggtaatagtgccccagcacctatagcgtgttccattgttgatgtcagtatatcagataataaaatgagtcctcttgctctgttctcgatgatttcagggttcttgatgatatgcggttatgggtagttttgaattccgctccttgcattgcaattcctgcaatgctattcttgtttcctccaaaatatacacactcaagattttggtttcttgccacaggtaaccgttaacatcttatgtagtaaggttatgttagcagaaactctttctacaaaaaaaagcttgaacgaaaactgttgtttgattggcatcttggtgcaggtttttaccttcttgcaagatttgaaggccttgctgacagaaaggtatacagtgtgaaccggtacttcatcagcggccattccttggagcacctttgcttcgcgatggttaccttgattcttactgtgatgctgtccttcagaaatgttaagatcgtcaggtacattttttgaacggctgttccatagaatagttctgctcaacctttttccatattatgataggtctagcaactcaaggacatgatcgctctacacttccagtaaatagtatgcatatcctgaagcatctctttagtacactatgcctgtgaaatcgtttgtgcaaaatgcaagttatatgcctcatgctaatcttggttctattctacatctccgcagagactcatgacatcctctgctggtcagggatcatctcaaagttctgaatgttcagaagacggccaccgatgcagctgacaaaaactttcttcacagctaactcatctaccttatccttgtttttttttttcccttggtttccattctctcctacaccctgatgtgttccagattgatgtgcccctccctgactttgtatgttcatgttgtaatttgtgaagcaacccagaattgtacgtgttttgttaacttttgagggtaaaaaaaaaggtacttaacggcgagattgcagtgctaatttttgccctgaattcaattcagccatccattcctcagtttatattagaagtcgtttgattttttttccgttgttaaagtttctcatgtttgatcaagtttgtagaaaaaaatagcaacatctataaaattaaattagtttcattaaatttaatattaaatatattttgatatatttgtattgattaatatattttttttacaaatttgattaaacttaaaaaaaagtttgataaataaaaaagtcaatcgatttataatataatccggagttcataacttttgcttttactggcaagtgggacccactcccagatgcgctgtctccttcgcgctcgcggctctacctctcgtcccagccatcggcctcgcggcgcgcgccatctctccaccgccgccggcgaccaaccgatccaccatcaccaccctccgaccaccagcgccgtcccatggaatcgcctcctccgcgcccacctcggccgttcccgcggggacctcgccctcgcgctctaccgccgcatgcgcgcgctctccccggcgctgccgaactcctacacgctccccctcgccctccgcgccgccgcctccccgcgcgtcgcctccgccgtccacgcccacgcccttcacctcggcctccacgcgcagcacgacgtcgccggccagatcctcgccgcctactccaggctcggccgcgccgccgacgcacgccgngtgttcgacgcaatgccgccggggaggacgaccttccactggaacgcgctcatctccgcctactccagcggctgcgaccccgacgcggcgagggacgcgttcgcgcgcatgcccccgcaggggcgcgtcccgacgccgtgacgtggacggcgctgctctcggcgcacgcgcggagcgggaagcacgcggatgtccttcagctgttcggtgaaatgcaaaggagcggctgcgaggggaacgccgagtccatggccgtggcgctctcggcgtgccttacgccggcgaccttgcattggccaaagggaaggcgatacacggctgcggcgtcgtgaagggcctcatgcatggctacctgttcgtcaccaactcgttgatctgcatgtacggcaagctcggagagatggacgacgccaagaaagctttcagggacgcgacggcgaagaacaccgtgacatggaacaccctgatcaccagctacgccgcggctcggctgtgcgacaaggcgttggacgtgctcgcccagatggagcagatcggcggcacggtcgcgcccaatgtggtcagctggagcgcggtcatcggcgggttcgcgtcgtccggcgacactgaccgcgcactggagctgttccggcgaatgcagcagcaatggctctcgccgaacgtggtgaccatggcgaccgtcctctccgcttgcgtcgacctactggcgttacggctgggtcgagagctccatgccacgccatgaaagccgagctagata

SEQ ID NO: 47618 - DNA, 21429 bp, Oryza sativa
  unsure (1)..(21429): unsure at all n locations
cgtgcggccacgccgggcgtgtcacggagggccgccgcctgttcgatcgcatggtgagagcgcacaagatctccccatccatggagcactacacatgcatggtctacctcctcggccgcgccggcttgctccgggacgcgtcggagctcgtcgagacgatgccggtgagacctgacctgtgcgtgtggggagcattgctgaattcctgcaggattcatggtgatgcagccatggccgaggccaccattgccaatgtcctgcaatccgaggaccagagcaccggcaaccacatgctgatcaccaacctgtacgccatgtgtggcatgtgggacgagtccaagaaggtgagggtgatgacgaaggaggccggattgaggaagaatccggggcagagctggattgaagtggacaacaaggtggtcgccttcgccgccgggagcgcgccgccgaatctcaccggagctgaggatgtcttcggaatgctcgatgatctatatgcagagatggaagatgaacaaagatgaacagcaatgcaccatggatgatactgctagcctagtagccttctactgcctctgaatttctcaagccattcctcaaaagagaaacaagaaatccgaagcaagcagcaagccatcaccaattcacccatcagtgcaggctgtggcataaatggctcggtcccagttgtttctgcattgaagaaagctcaattccatcagggcatccacaggcaagaaatcttcatggccgaagtaccagataggatatatgagagcatttgctggtcgtcagccaaccacctgaatctctcaggttttatggtcaaggactctggactttcaggcgcccaagagcttggcaagcgcattacaccacggttgcaactagcaacattaaaagctccaccaggaacaaattctggttacgggttcgggctactattgacgatggtgaaatcgcgcggtcagttatcaaactctacttgggtaagattgaggtcagcttcctgtgacgctgccagaaggcggcgtcgctcttctcctgagccagcagctcctcgaatgtcatctctgcggcctcggtggcaagggcatcctcacgttcggccttctccaccaacgcactaagctcaatcaactgccaaggtaaatggcattgttatcacaaccttcatatttcaatataacagggcagagttgcttttaataagaacatagtaaaagtttaccagtttgtatgactctgacatctgaagctgctcttgaatatagttgtagatatccgcatccttctttagccttttgtgctcggcttccaatttatgcacctatgccaatacccgagacgtcagtatataaaagagacatcaaaagatgttgttagcaaagatttgcatgaatagatcttctggtcgcaaatgtatcacttagtcgtgttggtacgaaatttgtttttgtcaaatgcatcacctgttcgcagaggcggtcataactgttagccctgcgactacaagggttggatagtaaggccttctttattctgcagcttctttgaaccatctccgacctaataggcataacacattatttggagtaatggatgtctgaagctaaatttcatgcaaatagcaacatacttgtgcagcagttcatttcttgcatctaccaaacagttaatgaactcgtgaacctgaaaaaaaaagttaaaagctatataaatcatgatacacttcaacattacagggtagaatctaattcgtagaggctgttacagaatgtagaaaactaaaagccaaaagaaacaaatagtcgctgaacaaaagaagctttggtttcttttgagcagctcaacgttgtctcaagcccatattacctggttgaggcagcataacagaacatatgaattgtgtgttgtcctttgagttggtggcttcactcttaactcgaaacaaaattctggagtcttaacactactacaaaaaggcggttgacaaacaggattcctatttctggtatatagttggttaaaatgtagagcacacagaccaaggaatctaatcactgaagaagtggccatttaatcagattatatggtccaaaatattgtgatcaacccaggaacagagcaagcagctaagatactactccctccggttccataatttttgaagttttggacaaggttgaggtcaaacttttgtaactttgattatcaataacttcaaaaatatttagtttaaaggaactaaaacaacatatatagatttgtctttcaaagtataagaaaagtaaacatgcatttatttattgtatatatattataataggaaaacaaagtcaacgatatactttggagaccgtgtcattgtccaaaacgtcaagaattatggaaccggagggagtacgtgctcaacatatcattatccagcaaagtgatgaataaagaagattatgtccataaaagcaagaaaaaacacttatgaacttacagttaggtctccctttcattagtgagctccactcgacactttgattcctctttacgaatcatttttttactgaaacaagcacaatagaaactccatactacttaattgggtaaagacaagggtctaacttctaagagtgatctttttatgacatggatcatacattggatccataccaagttagtgaggctgtaaggagtagttaactctagctaggtagcaaaattcccccataagatgcataaaaatggaattctttaaataattggcaccttaatagaaaatcaaggttcatctgcgaaaaatagaaagttggaaacactggcaccttaatttcactgaatcactggttagaaacgcaaattctgatagcacctgcttgaattgcacaaaaactacaggcgatgaataatttggtggtgaacacttcacacattcaccaaaatttcctattcttgttcttgcatatactcaaaacagaccaacctcccaactcaaactaaaatccgactgttaaataaatccaccagatctagctgtatcacaaatacaagaaaatattactaaccttgccagtatcattccttttagcacgaacaatttggtacatctcatcatacacctctgtgatccgccgtctcgttgcacggcacaacagcaggagggggaaaggtgatgtttttgcctcctttttctcgtgaacagacaccacctcacccaagcccttctgcttccccctcctcccccgcctcctctttcctccactctcgctaccaagcggcgtcgaacattgggatgattcaggaggtgaggagtgctggtagggggaatggagaaacgtgttggcgaggatagtaaggaagaaacgaacaagggaagtcctcatggctatgggttccggcagaagatcggaggcgaaccctcaatggtagggccgtaggagccggtcacacaagctatatctagatctatttcgattattttgtttttgtttatttgttcctaggagggcgtggccacgtgggtgcggaggtgggtgggcggtgggcggtgggcggtgggggggaggggttaagatgactccgtttgcttggcacttgtttgagtcaatggtagaggatttggtgctttctaaaaaagaaaatggcttttgcttgctttccttcattaaaagcttcagttctgattagatatgccgtgcacagttaccatgaatgtgtgtcgattgggtcaatgacccggggttgtggagcatggaacagcacttctactactaaaatacataggtggtgtgtcacacatctcatgaatcatacacgtagtaaatgaattcagtatgaattacagaagggcgtgtggtgaatatggtgaatagttcgttgttcaatcttcaactttgagatttatttcctttctaaaaattttcaaggcaagtgaacactttaacagccaatgacaccaataaagttagaaagttgcaccaagaattgacgagcaaaacaaacaaaacattcgctcagcctttgtgctaatctattccagtttatgtgccacccaagaaagcaaaagaggacgcagacctaccagatgaaaccacgccgtgcaatttatacttcacaggaaatggccctctgcctacgtaaaaactacgaaataaaatgaggttttgccaaaccactgtcatgtggcctgagtactgcatagtgccaaagtcatatatgcatttatctagttttaccaacacagcaaaatagaagtctaccactgctctagtttgggttctttttcagcaggtaacagtgacactgtaaccctgaagatatattgctgtcagtgtgaataacactagtgtagtttttttatttctgtcctaaacaaacttgccgcatgtagagtcagcaaaaccattgatttaatacttgccgcactagtgaaaatgtaccaaccaacatcattaaatccataatatcaaaacctaagtctgattctatcttgaaagtctgaaatgaaagcaattagcaaaacaaacaaacaaacaatgaacggcacccagttgtatatatatataagtcaagcatgctactggagtcacatctttatacatccctaattcgagtaatcgcaatgcacaaaatccttgcatctgaagcgacatttgtgatatggaatcagagacgcggcgcactgctgacctgatggatggtgagggagtgggcctggctggcccgcgcgaggtcgtcgtaccgcgcggtgatccgccgctgcagcgcgccggccaccgaggcgagcgggaaccgcggccgccgccgcagcagctgcagctgcagcgcctcgtccccctcgccgcccgccgcgtcgtcgtccccggcgcccttccgctgccgcctcctcgccttccgccgcttcctcctctccctcccgccctcctccccctccgccacccccgcgccggcctccgcctgctcgggcagctgatgagcctcgccctcgcgacagcggcagcgaccgcgcagcagggcgaggaagagcgccgcgagggctacgacgaggaggacgatgagtgctagttggtgcggcggtgagtccatcgccggcgagagctcgtcgtcatccccaggcgggagctgatatatcttttttttttctttttccttttaaaattttattttctctcgctggagtgcggttgggaaatcgaagtgggaagcgtgggaggagaggaaggaaggaaggaagttgcggcgttttaaaagctccgcgcggcacggcgatgctctttcgcttgcttcggtgtttcgagctactctagagtctagactttctagtggtggagctgcaatggaaggtattctacggataaggatgaaacatcaaaggatctgtttcgtttctgttagctactaggtctgagatgtcttttagttcacgctaaaatttagaagtttgattgaaatgatgaaaaagttggtagtttaaagaaaacttttcacatcaaaactctatacacacaaatttccaacttttccgtcacatcgtcacaatttcaatcaaacttccaattttagtatgaactaaatacatcctagtctcttgaatcaatatatcttaaacagtctaattttttatccagatttttaaatcttaataaaagttatagttgtacagactatagaatgaattggaagttaaaaactaaaaattctagttttctagatttttataaagctgacaaccaaccagccgcttctcgtgattttagctctccaaatagacccaaagtatcgatctcggcggctatcgaggtggagaatgaagagaccgatatagggctttactttgggtgtgtttagttcacgctaaaattgaaaatttggttaaaattgaaatgatgtgacggaaaagttaaaagtttatgtgtagaaaagttttgatatgatgtaaaacttgaaagtttgaagaaaaagtttagaactaaactcggtcttcgttggttgcagcctgtagatgagtttgattgaacgtgacgtgtgatgtgttttgtttagtgaacgttcatccactttggttgggttcatttcagcgtttgacacatcctatctttataagcatgtcttgaggttgaattggtcaatatacgcgtttcactgtcaacagatatgtcatcagtattaaataattagacgtaaatacgagtacacgtgctaattctagaacttaaaacctagatatactcatgaacaggttaaaaaaactaaccatttgaattatgttcactttcgctaggtgagagtatattacgtggattgatggtacttagtatttttttctatactttcctttgttataaaagctagcatgtgggtgtatgcttggttacatgcgtccaagttatacagaggctaagagtattccaggtatgaatctttttttcctaattaactgagcacaacaatgcttctattatctaaaaacatcaatagtacattgtctatgagcaccaaatttataccctagcagatgggatcatcgtgtacccacgaccgggggtagattgagactcagtctcaggggtggaccgctatgaggcctcgatgtaaaagcacatgctaccttatttagggggtgtttaggagagagtggggctaccttagggtgtgttcggatgccctttttctcaacccctctcactcgttttccgcgcgcacgcttttcaaactgctaaacaatgcattttttgtaaaatatttctatatgaaagttgcttaaaaatcaaattaatccattttttgaaaaaaaaaagttagctaatacttaattaatcacgtgctaatggattgctccgtttttcgtgcggagggttctggttgggaactagcgaacacactcttagagcaagtttaatattatagctaactactagctccaattcatctatagccaatctaataactcattcatacaatagttacatactacacaattaacacctggtctcacctgttatacacacactgtgtcttggagtccgtgctacatatggctacaaatctatagcccgctgcttttctctctccttatttatcttcttaaaatatatttacagccgacttatagcctgttattatacctgctcttactttcactatgtatttggctgccgaaaggcctagcataaactcttgatcacttcatacccacccacgtctgagtccaccaccatattagctaagttctctccaatctttaatttactgtcatgataagtttattatacaaccagaaaaatacccgtgcgttgcaacgggtgaagactattttaatcttattattattatacggtttagctaaggtgaaatttatcgtggaaattcgcttggatattctttttacaaaatcataagccgcaattaggggtccgatcgtctcaagttagcatgtaaattttttaaagagatttcttatacgactccttctgtatttttaaaaacgaacaaaattaaaaaccgactcaaagatggatttgtatttctaaaaacgattgaacttaaaaacctattaaacacggatgatgtatcaaaagtaccgataaaaatatcttcaattttttataatagcagagatgaggatgttttattatttgtaagagtaaccggtgcaacgtatgatggcgaaaagatttgaacccattggttatcgtgagaaatgcttataagatctcagtcaaagtttgttcaagtgttttcatgtgtgtttgttgtcaaaacggttttttttccaataagatattttttattgacattgtgacttcgtggttttagttatagaacatcgtgaaagatgttatcaaaagttaaatatttgctactggatacagttattactattttgttcattttgtttggtgaagagagggaatacaaggaaatatatctgaaacacccttgaggtacttgcatgtgaaaatttcaacttggacacaattcggaggagtggaggcaacgtacggacggtgatgtaaaagaaggttgtttgctaatcaggacttgtttagttggggaaaatttttaggtttggttgtcacatcggatatacggatatatatttgaagtattaaacgtagtctaataacaaaataaattacagattccaccaggaaactgcgagacgaatttattaagcctaattaatctgtcattagcaaatgtttaatgtagcaccacattgtcaaatcatggcgcaataaggcttaaaagatttgcctcgcaatttacacacaatctgtgtaattgttttttttatctatatttaatattttatgcatgtatctaaacattcaatatgacagcgtgagaatttttgttttgtgaaataaacagagcctatttatattcaccagcttcgcacggtccacggtatgcaaggtttttctccccacccataacaacagtagatcactcttagcatgcttcaacgatgacgagaagggaaagcaaaatagaatatttgtgcatgaaatgttatgtttcgtctgccattcacgagacataggtacaaactgagagaccatagccggaaagtatttttgtggtctcaactctcaaggcagcaaggtgaagaaaggaacatcaacatcatctcctgtaagaaggtgcatgatgcatttgcgcccatagatgtcatcaacgtcggtggccatcacggttacgtctagtaagtcgaaacacatgattggtaaaaacgaactaggataaaaatgtacgggaaaagtacaaattaaccaacccccccccctcaccccacacacaccgggaactatcacggtcgaccgaattacccctctaaacccgaaaatcagacatcgtttaccctatgctttcaataccggataaattaccccatcgacccaatccataatatgtggcagtccagtcaatattctatttataaaaatgtgtgggacccacctgtcatactcctctttcactcttcctctctcttctctctcactctctgtctcactcttcctctctctctcttctctctctcacgggtcggtggcaggcgggggacacagagcggcggtggcggcagggacggggaacgaggaggcagcgtcggcggatgcggccacgacgagcagtcaccccctcggcgcggcttccctcctcctccccccctctctctctatgtgtggcaccgtcgggagagcgggcataatgggggcagtgacatagctcgcggcgcaccccgtcggtggccgaggatgagctcctcctcccctgtcccctcgtcgccgcccccactccactgccaccgcttgcagcgttgttcccctcttctgcttaatagggcgggtgagggatgccaggagggacacaacatcgggctccggcagtgagtccgcggtccgccgcccatccccgagctgcctcagcctcgccgtcctcgacgccccgagcggcctccaccatcgcccgtcgccatcctaccaccccaagctacatctgtcctcgccgccgtcctacctccctcgctcgccgtcgttccactgctgtccgccgctgtcctcgatgccctgagcggcctccgccaccgcccgccgcccccaagctccatccgcccctaccgctgtcctgccgccctcgtcctccaacaccctcctcgacgccgcccgccgctgccgcgtcctccccgcactccaccaccgcccgcacgccgactgcccgtctgacgcgcgccaccggcgcccacacgccgaccgctgtgcgagctttatgcctgagagagagaggggggaggaggtatgacaggtggtatgatcgcctctccgccatggccgccccgtgcgtgccgctactcgccttcgcttccgccttcgttgctggttgcacgagtgcgccatcggcgtccgagcaacctccgcctccgcgcgccaccgccagcgcccgagcatcgccctccactcctccgtcgccattctcaatgctgccatgctggtgagctggtgaggggagggagaagagagagaggggggggattggggatagagagatagaggggtggcgaactgacaggtgggcccactgattttatattaaaagaattgctgactgtactcccacgtttactaaaaccaccgcgaattgggtcgaggggggtaattcgtccggtttgcatagttgggattaaaaaatgtccggttttatggttcggggggtaattcggtcgatcatgatagttgggggggtaattcgtagtttttcaattctactgttatcagtccaaagtcaaaaggctgaaaaataattaaagaaggaagatgaagaaacccataaaccatttatctaggtctaaatttaattaaaatcgaccgcggctcaatcaaaagttcgttttccccatcttgagccgttttaagaagcgaagaaaacaatattttgaaaaaaaaaacaccaagacacagggagtattacgtttttctggtgggttttgtgctttttcagagtacgttttcgacgtcataggctccatcagttctccccacacttttcccctccgcttgaactcgccgccactgaaatgccctccaaatccaaatcctccaaattcgattcgcgtcctccgtttgcttcgcttcttcttctagaacccaccaaactctccggccacgtgcgccccgccctaaaccctagccgcaccccccgcctccctctcgtcgccggcgaccgccgccgccgccatgagccgcttcgacggccgcgccgcggaccccggctcgtaccgcgaccgccgcaggtaaccgctccaccaccgtggttttgatttctaaaccctaagccctaagtgttgggggttctgattgctcgttgggttgggttggggtttggttgcagcgaaggggcgttcgggggcgggacgagggcgttcgccccgacgagcaaggcggactccgcggccgcggccgctgacctggatgggctgccgcggttcgagaagaacttctacgtggagtccccctccgtggccggcatgacggaggaggaggtggaggcctaccggcgccgccgggagatcaccgtggagggccgcgacgtgcccaagccagtgcgcgagttccgcgatgtcggattcccaggtttcgtttgctgcgtgctactgctacccttgtcctgcacttactatagtactatgtatgcaatttagatgaacgtgctccaggaggaattggaatttagatggacgtgcttcaggaggggaatgtataggtctatttgtttcgttagctggttgtgttgtaaactacattgaatcatcaaagaattgaagtatcataacagttatttcacaccacaatttctgctttggcggaatttgttttggctgtaaatactcaaaactatttcaaccttgagccacattgtcacattagtgacatgtaactgcagaaccactctagaatgaggccaaaggttaaacagtaggtggttctaatagtcaatggtcaaaaggtgaactattcgaagttgagggttggaaactggagttaggccatgattaacagttgtaaaatgatttttccaaagaaaaacagccaacagcgataacatgtgcaaccagctcaagtgctgaacactaaatggtgaaagtatcatttggttttctttgaactccgattaggatttgttggtcctctcattaaatcccattatcatcacttcatcagccaattcattcatcaggaggaaaggatatgaatatgtcacttgttattcatttaagatctgttgtgctcttcaaagattattctgcttgcattcttggacttgagccattgataatttatgagcccctttaccttctgaactacattctttattattttgctcttttttaatcttggacatcttacattctatatttcctgatccaagatacttaacttccattgtgcagaatatgttttgcaagaaattacaaaagctgggtttgtagaacctactcctatccagtctcaaggttggccaatggcactgaggggacgtgatcttattggcattgctgaaacaggatcagggaaaacacttgcttaccttttacctgccattgttcatgttaatgctcagccgattctaggtgcgaaatgttgcttatgtttcttaaccgattttcttggatacattctggacttcttttgtggtaatctactaacatttttccgtgtgttattaaagcacctggcgatggtccaattgttctggtgttagcccctacacgtgaacttgctgtgcagatacagcaagaggcaactaagtttggtgcgtcatcaaaaataaaaagtacttgcatatatggtggtgttccaaaaggtcctcaagttcgcgatcttcaaaaaggttctctttctttcttatgctaggaagttcaacaaccagaaggaatcttttgtactgcacgcatgaagtcatgaacaatgtttgaaggacattcagttggtcaataatgaaatgacactgttcaaaaggacatcctattgatctatagcttaaatgatacattcatcctgtgtagtatatttagtttaatttgtcactgtttgcatccaggcgttgaaattgttatagccacgccaggaagactgattgatatgatagaatcacatcatacaaatttgcggagggtcacttaccttgttttannnnnnnnnnnnnnnnnnnnnnnnnnnnnnnnngaacctcagattaagaaaattgtttctcaggtatgcctcttcttctgaatctattattccattctcaacaattttctaataattatgcttgctacatgttacatgcttttacttatacactgtcaacagaatgaaagggtagcatgtatccattagtaatcaatcagatgaagatcaacctataatctctccccaagtttgttgcatcaacctagtcctctcatccctagcagccaacactgcccagccataggcagagttttcctccatgaaccgtgcctacaacataccaacattgttttacatagtgttaagggattaccatctgccttttcagattcgtccagatcgccaaacattatattggagtgctacttggccaaaggaagttgaacagctagcaaggaactttcttttcgacccatacaaggtggttatttttgccaatgcatcattttgcagatgaatttatggcagactacggtatctgcttcatgtgaactcaattgctttttttgtgctgcaggtcataattggttctgaggagttgaaagctaatcatgccatttctcaacatgtggagatattatccgagagtcagaagtacaataagtaggatccgcgtgaccttttctcttcattacacactgaaatgattcattcagaatgcattgatgatgaaattctttgatgttaaggttggttaatctactggaggatataatggatggcagccggatattaatatttatggacacgaagaagggatgtgatcaaatcactagacagcttcggatggatggttggcctgctctgtctatccatggtgacaaaagccaagctgagagggattgggttctttctgaatttaaatcagggaaaagccctatcatgacagcgactgatgtggctgctcgaggcttaggtatacaaaaatcctcccagatcgatgaattatatttatttctgtaaactaatgccacttatatctggaaacagatgttaaggatgttaaatatgtcattaactatgactttccgggatcattggaggattatgttcatcgcattggtcgaactggcagagctggagcaaaaggaacagcttacacgtttttcactgctgctaatgccagatttgccaaggatctgatcaacatactagaagaagctggacaaaaggtcagccctgaattagctaatatgggtcgtggtgcaccacccccttcttcaggcaagctctctgtttatctaactattttcaaattattgtagaagcaagtttacagattctgatttctgcctactttcttttcacctatagtgctgcctaagaatttgaaaattctgaatgtgactgactattgtcacatctttgcaggccaccgtgatagatatagagggtatggaggtggccggtcatggagctgattttcatatgttgttattgcagagagcaatgtttggcctttctttgtggatggctatgtgtatttctggctcactgaatcttttaactaatgatcggtaaaggtagatttatataacttaaacaccatgccccttttatgagatatgactgggtccttctcatccactgtgtcaatagctcaaactgtggcattggcatataatattttgcttacagttattagaacggtttctctatcatatttttttcagtgtgccgactcatactttggatccattaatgttaatatgaagcccttttgatttccatttagaaagatagttaattagaccatcatttaatcatatttgtggtaccgattttgaccagacattgatgaatccttggtttcatgcaatttggtttgattgcctgaacactgatggcataatttcactactattttgtttagcattgtacaatatatgcctactctgcatatcttctccttttcccaatttacacttccttttggttctctgctgtgtggtgatcaactgaaatggctttcttggacagtatgatttttcttgccttctgagttctgaaagccaaaccaacagctcatgatcgccatgtgacaataactgtaggctgtctggtgtggccatgcggtgcggctggtatgaagacagtttaatttttgctctctcccgaacataggatgctcttcatatgtatctatactattcctgcagttatttacagtatttgagaaacatctctgtgcgctgggactgggggtttaggaactttgtcccatagtcagttgtgctgtgcatcataagtcaatgtcctggagtgaaattgcagtctgaaatttctggccctgtagggcgtgtggttccctctgtagtggctgctattgatatatccacatctttgctagtacggccttcagcttcttaccagctttttactgtaccaatccaagataatatggtaaacaaggatctgccagaacaatggatttgtggtccttgctgctgttgcaaatctaatacatctgtcatttggagttatttggcatgatatgatgataaccagaaacctgaattttgtttctatgaagagagacccttttgctgcagtgtggtccatgaatactttgttaacatccacaatttgtatgaatcttatcaccataggtacatcaatccgtaactcttagtgccaattggctatctgttttgaatgtaggtccacagtttgcattctgtttgcgccttaactactttttgcaaaatctgctagttttcattctatgtttcatgacatcactactattcaggcttttctggtgggtagttttttggggcttaaaatcatggctatgaacaaatcattgaatttttgtgtctagctagtggactgatttggactttaagcatcttatctgctttgatgttattgagtccatctgttggttcatgtacatgccttagttcacatgacctgatgtattatttgtgtgtattaaccagtaactatgctaaaattttgcagcttgatatttcgatgttcttttggttctgtggtggtcacgttgagccgtattattattattattatttttttgttgcgattgtactattctgttgcaggaccgtcttgaagcagagctacaataaatctggggatgcatttggttcgctaggagggcttctctggtggtccaagagctgtagctgcaaaccgtacagcttggcaatatggtaagaattcaataatgctaataagagaggggtgtttaaagcttgtgtagttgagcttgctgctgcatatattagcatgttttctgtaatcatctgttgatatgtatggccgcggttttggaaatgtagtggtttccaaaaaagagggagatcctatgcaactttagtttagaaaagcacggtggcaagcatgcacacatgcgggtgggccagaggaaagaaagaaataaacggaggaggcttgtccatggtaattggaccattatgccacaggagagttaatgaaagtaaggagcccatggtaattggaccattaggccacatgagagttaattgaaaaggcagggcagggcaagcgtgtgtgcgtgcctgcctcccttgctccccaaaagctgggctcattagcctctctactgggcataccttggaaggaactgcagaagggaggtccagtccagatattatgttagatcgttgtgctgccgctatttgatcttgggtcacccatattttcgtgccgtaggacatcgagctatcatgcttaccatcatcctcgtgagagaagatgagggttccaatagcatctgacacgaggaagacaaaggcggtgatacatgttcagtggtataaatgttccaaagccgggaaaatctagctcaagaaagggaaacaaacaagtagggcagctgatctgatcttgactcttgagacgaatcattagccacgacgttttatgtttggcaacctgagtttggttcccctaggttgctcttcatttgttgtgtggtgccttaaccatcagccttatgatgaaggcatatctcccaaaaggatccagtggcttttaccccccctgcaagtctgcagctgaaccttgcagaaaagatcacacaaaaagctgggctacatcaagggaaactcaattcaccagtccattctctctttctcctgtcctgtattcgtatgtatactacagtgcagtatgttccatgctggatttctctctctaggccctatatgcttatctcttcttctcttccttcccccactccaaagcaaagcagatgcatgcagccgcagctgcaccacactgccccaggcccccagcttctcagtggtcaaagtcctatcagcttgctgcttgcatagggtcccttttcctgtgcccattgattcatttcacttgctccttgtggaccaatgcctccatgtacacatattaaccctactatagtatgagtggtcaccactaatatagtatgagcaccagcatcaaatcaaaggccaatgagcagtagttctacaatagtagtactgttaattaatcgatcagtagcttatacatcaatacatgttggctaaattaacaaagctgcctcctagctaatgctggcctacccttcctgtataattacaccatacgtaagcacctctatcaatggctagagcaactggccatcttgcagggaccattgctcagagcttgcccctcctgatcatatcccttgctagagtagtactagtacacgtgtgatatatatatatatatatatatatatatatatatatatatatatatatatatatatatatatataggtaggtagcagtatagatcgacatatagatgatatatatgtgcatcttggtgtgtgcaacttggcttgttgcatgcatgtgtcgactcgtgtgggctactcgtactcgaccgaccgatctgcatcgatccatgcatgcatctgatggatctcctctactagttgagtatggtgatcggtatagtagtagtggtggctagtggctagtcgtcgtcctccttggcggtgaccctgatgggcatgccccgcttgagccgcacggtggggaagttgacgatgtggtcctcctccgccacccacctgcatccatggcagcaattagcagtccatttcaatgtccttgtcaggcaacaaccatgcatgcaatggatggatcagcaggtcgattattcagaaagagattgtagataagagatctcataatcataatcatttatcaataacacatgatcgatggtgatgccactgccactccctacttaaggtatttaaccggatgggatcgatatccgatcaaaataccttatattttgagacgaatgaagtgtattctaatataagcattttctatgttatagctagagtcctaaccatcttgtccagatacataccagaaatacttgcatttttagaatgtagtatcatctatcttaagtttgagcaaaccatgcagggagcacctatatgcctgcaactctgaacaagagctttactactatcaatgttgatagttgatttactggcttcatgtggacagtggccagttgctcgcataacacagtaatatgttatatgtaggccagctagctgcttgtgcaaccaatgcaaatgcgtgcagatgcagtgcacgcatgcatgaatctgtgctatgcatgtgccaggttctaaagtccatagtactaaattactggtcaatttattacggaaactggcatgatgatgtagccggattgtctttgtaagacatgtggacccaatgattatcggacccacaatgtcagtgacaaagtcacgtgactttgactgcagaggatcctgatccaatgtagcttagctacataaagcacgagtaatattatgtgatttgcttttttacaagatgttgcaaaacgcttctcttaggatcaattagatagaggtcagcacaagcataatggggaattggaagatggtcaaagaagacagaaaaacacattggactgatggactctccaatctccattgtttaaagtgatatgatgtttttctagcaagtcggattctcttgttggagtttgatttgtttatgggaggagtatagtattgtttgcaggcaggcatgcagcgaccataccctggcacgtgctcctacattgatgcagcgtgtctgacgaccggtcaaagtggcacatctcggccggctagatcagctggatgcgtgcgtgcgtgcgtgcgtgctacagtattatattcgcgttcctgggattcagttcagtcacggaccggacaaggcacaaagtatgcatgcacgcacgcatgtcacccatctcgtctcatctcatccaactgttcgagtcgatagagagcccattccggctgcctaaccatcacacccatgtctccggtctcccccttcttacccccttcgccaattactacaccacgcttcttcccgcctcctttcccaactcaacccgatccggcacattttctaaactactaaacaatacgattttttatataaaaattatttttaaatttatattaacctattctttaagtttttaactaatacttaattaatcatatattaataaatcaccatatttccccgcaaaaaaataaaataaatcaccatattttctacctcccgaacgtaggacgtagccctatacagactccatagctgatggacgactggtaatcaaaatatgatactcgctccgacccaaaatataagtatttttagctataaatatgaataaatatataaatttatagtaaaaaatgcttatatttttttatatggatgtagtatattttcgtgtcaatataggcactatcctgagctaagcacacgcatcgtaacattgcttaatcgaagcgtgcattatagctaagcttatttttttttttttagattagtctgtttgcattggtaagctacatggttgtgagaccatgaaaaaaacaaattaaagttgaattttttttttgacgaaagacgtactgacatgtgagacccaccaccgcccagcgaccacgtctcaaggggaggtgcagcggcggtgggcatgcagggcgtggcgtggtagctgacacgtgcgggcgctgtagctgtagcagcgggcgccgtaagccacgcacgcgtacagcggcgtagtccgcatgcatgcacacatgtgggtgtgggggggaagggatggatatgcgccgcatgtgcgcgcacgtgtggccccacgcgcggaacaacaccccgctctattcgcaatagaggctggaccgacctcccaccttgggtatcttccttgatcttcttctttttcgccccgcgcgccgaaattatttgtcttcctcgtagcttccatttttttctttcacatgaaaaatgacctagtgttcctacgcagtgtaatcctcctcgcgagaagaaataatttactgtatttaagaaaattatagaaatagaatttggtactatctctgtctcttaaaaaaaacaatttctaagcttgaatctagaaataatctatatcttagatttaaaaccagaagttgattttgtaggccgaaagttgtatctcccagtgtgagaggcgaaaataccatactatatctttcgatcagaggtggagacggctccaggtcgaacgaccgtctaggcttcgctgtcggcgtctccactaccaatcaccgttgacgcgtgtaaaaatggattgatcactacaaaacactattagttatccgggctcgacgatgtcgctggcttcaccaccgctttagatacctccttaagcacagtaagatcactccctcaaggaagatgataacagaggaggtataagcatgggagaaagcctcgtgatgctatccctagtgacgtattaggaccagttattatctgacataatttttttcttttttttttatctctggaaagattcggcttgatcttcaaatcctcatgtacgtacccgatctatatacccccccacaattattctgtcaatcaacgcataattcatctactgttccgctcttctattgttctacagagattagttattactaggaacatgaatgtgcatgcgaagagggcatggccaaatgatagggacatgactacatgagatgcatgccattggtgcccggttgcgtgcattatatgatgcaaaggccgtgatttttattccattcattatatgatgtagaggtcgtgatttttattcttttatctagaaaaaaatgctatcggtgccgagcgatcatggaaaattatgcaaaagttgtagtttgtattccattatctagaaagaaaaaaaagctattgttgccaagtgatcatgaaacaaagctaaggagttggaatcaatggctgcactaagaatggccaagattgagatgtggtgatccatacctgaagctggtgaccaagtggtgaaggaagatggaagcttccagcctggccagatccaggcctgggcacagcctctgcccaccaccaaaaggagtgaagctgccattgctcatgtccttctcctgttgagattgattgatttcttgaccaattagcacattattagacttcccaaatcaaatcataatgataggatgcctcaacagtagtacagcaccatcatttgcctagattaattatttgcatatcattttcagagcttacacaaagtacacaatagagggaaaaaaagggtgtgtattcctttcctg

SEQ ID NO: 47619 - DNA, 1675 bp, Oryza sativa
atttcaagttatgcttaaagaacatttaacgataaatcaagtcacaataaaacaaataataattacataaaatttttgaataagataaatgatcaaattaaaaaaatcaacgacgccatatattaaaaaacagaggaagtacgcactatcatgccaatagatatcttttatggatgagcttttatgtagcaggttaaggatctaggctcagttaggctctattcgggagcgagggttgggaaccctgtaaccctaactccccggcacacaaaacgaagcagtgttttagtgcgtgattaattaagttttagctatttttttaaaaaatggattaatatgatttttttaagcaactttcgtatagaaactttttgcaaaaaacgcaccgtttagcagtttaaaaagcgtgcgcgcggaaaacgaagatgaggagttgagaacttgtactaacaaacggagccttagtcgagggatgcataaatctagaccacccaagttttaagttctaattgagataaatttgggtgcatgccctttaattttagggtaagtcgagacatgtgatcgaagcaacaaaaaataatttgagtttttttagtcatgcccaatactccctcaattctaaatcaactttctaacgaatttagaaatatgttatatgcaaattcctatatgaaagttaatttattataggacggatggagtaacttataaccgagatatgagatcgaggcaacggaaaatagttttagaagtcaaatatgacaaagaaaaacttaaaatttaagcttgaggaaaatttgggtactgcatatagatcatatggctgcacatgtctttcccagctctccttgattcgttgttgtccaaacactgtactggtcgcgggcgtatctccatgtgaatctcgcgaggcagatgcatgtcgagcagtcgaggtaaaatagctagctaggtgacgtccctgtccatcaggagcacgtcacggctgtcgttagctaaatctagctggattgtattgctagctcactctttgtcactcagcttgcccgtctttgtctaacctggctaaggccctgtctagattccaacttttttcctcaaacttctaacattttcgtcacatcgaacttttctgcacatacaaacttttaacttttccgtcacatcgtttcaaattctttagacttttaattttggtgtggaactaaacgcagcctaaagttgactcgctagtacttgtaccacatgtgtcgcgcgcgtgcaaactcatcagtgcaattgcaagtgcaaatggcatgtgatttcgtcgtcgtctcgcaccggattggagagggaaagatcttgccaagatcgctgggagatctgtagggcgctctctctctctctctctctgtgtcagggagatcagagatcttgtgacggctcagggtgtcgttaattatatgctataggccacggcgacttgaccgcggccaaggctgactaattagcatgctgtaaatcgtcttgaaaacgaaaggtagttaattagcacgttaatcgtcttgagaagggaagatcgagtcgggcctgcgtgtgctcgtgtgattctttgacggtgttggccggaagaaatcgtcttcacaacgaggatttttttttacttgtagtccttttttgaaaacttaattta

SEQ ID NO: 47620 - DNA, 7502 bp, Oryza sativa
ggtacaagtgaaaaattcctggcttcaatctacctactgattcctgaaagagaaaaaaactccttttaaatcctatacgttccagtcaggattttaaacaactctagttcccaacagagataacctcgtaccatacagaatccatgctgtccattttgcacaccaacagtgatgcatacttgtgcccattgtcacactggacactgcgcttacagataatcactagttcactacagcaggttcacttgaagcagccatgccggtataaacatggcccataataatttttctagtagtactttgtcccacatgttcatgagaagtgctaaatcaccagcttaaaaagtctgctcctaacattactgctacagtacacacatacttgatacaatagatagttaatttggtggtagtagtccataaacacgacactctacctgcgatgatccttcttgatgatcttgcgaagaagtggaagcgagcagagcgcggtgtcaccctcgttcttgagcgcgtagaagtggcacagcgcgcggccggcgaccttccaggcgaagccacacctgctggcgtcgttgctccaccgtgctttctcatacacaatctggtagatcacgcaggcttccgagaacacgtcgtcggggtccctctgtgtctgctcgaattcagatgcatcgtagagcatctgcagcaggttcaagggttcgttaggttaaaacgaaaacggcgagccgccaatttcattgaatagagaagaataaaaccgtacagaaaacaaacatgtacaaacatagggccacagcccgactaagggctaattaccgcgccacccaggcggcgagatagggttcgttaggttaaaaagctagctgtaattaattcgaccattgaaaacgctgttactcaggaaatttggatggatactcacatgcttgtacttctcgtagagttcttggaacttcatgttcctttcttctttatctaccattgcgcgatagagcattgtactgtcagtcaagtactcctcgtagcggtgttgccagaggtgcctggctgctggaggtgcttctctttccatgaaacatgggagcaatgataccccttattattgtaaaaaggaaaagagggaaaaaagtaaggcatactgttagagagaacattcatattatagtactattctcatcaaacatatgaaaccaatttaattgaaaccgtgttctatgccaaaatcatgtctagtgcttctgcagaatggtaactaacctctgcttctctcattgaacaattttgacatctctccctcccattcattttgttttgaaactaggtggaccatatgagtaaaaaattaacggttgagtgcataagtagatagtcttctccataattaaaaacagcagatgattttttttgtaactttttaatacaattttagaaataaatctttccacaacttatttctaggtctgaataagtgtaaactattataatttaagattatccttatgtgcgtaggtaactaattagaatagatgtaattgttcatcatcacttctataaataaattaatatatataaacatgaaactataatggtttattaattactatttccaattaattgactgccttacaattaatcattttttcatgcaatgaatgcaaaccgtttttttttaaaaaatggcatagaccctttccatgataccacatatgtatatactgagaacaacatcacattttctcaatatgcttgccatttggcaataccttaactactgcaagctcagctcataagttatagcctatgtgctacaagcagaacaaataatgtatgtcatctccctactgcagataaaactataaaagaactgaaaaaaggaacctaaataaaacagacaacataccgattggttgaacattacaagatcgcagagattctacatcttctgctttatcatagatttgtccaagtatggatgatgaatggtacgaaaaactgcggcccatgaagtgggggtattgttttaccatcagatcacttggaatattgacctgttgggacagcacataaactgttgaagtgcaatatgcattcccatgtaatgaactttggtcttacaaagcatcaaatataaaataataaagatacacctgcacatttcatctattatctttatcttgtagccctacttgatctcactgcttcatacgttaaacgtattcctgtcaccatgcaactattccaaccaccatggtgccctggacaccgggtagctggtccatttctaacttatattgaactatgttaattacaacattatccaataatcagcttattactatgtactggacacccactgcagctatccgtataaaatattggcagtttatgaatcattgtaatgaatcacgagttgttcagataactacacttggttcatccgttcatgaatcattgtaataaggattcagtactgtgtaaaagcatttgaaactgaagaatgtgtaagcccaagattggaactaaccttgttcccagtcttcggagcatccaaagccaaataatacaggtcaactaactttagcatcttttcctctattagtttcttttcaatttcgtcaagtgaatctgtcaatagtcggtccatatatgctaaccagctatcagctgccgtaccaagtgcaaaactgaaaggagaaaagaactccaaaatcatgttagattgtataaaaccaataaaggttgcatatattgaaatactacaggaggtcaccaaaactagatttttaaaaatgtactgatcaggttcatataaaaagaaattcaagcacttctagaatattgaattcaatcaagtgctgaactcctcaataaattgcctactaaaaactaaatgagattcatgctgctaagttttctttatagtgaaatggttctagttaccattccaaaaaggaaggctggtgacaattattactgtgcatcagaaaaatcaagcttggtattaatacctgggagtaaatcttgttttcaagaactcatgaaatagcagcctttcaagtttggattcattacaatcctgaggtttcttttgcttggtcttttttggtttaatagcttgtacccacggttcagaaggtttgaagtgttctaataactgaaaagaacattttcaggatcagtcagcaataattctttcaaaagttaaagacagaatgtgctgttattatatcagtaccttattatgcaagaattataatttaaagatacagtgaaacaacaatgccaaatttactaatgaatcatgcacagcaaatctgtaatcagtccaagaactagcaagcataattaaaacggataggtcaatattccaacacttttggccactgaacttgggcttcattagcgattggccacctgaaaccattctacattcgggccaagtttaaaaggtgaaaagtgaatggcttcgatagtctaaatttaggaaaagggtccactttttaggtctgaagatcagggttgtaaaatggacactttcctcattaaacatgaaggcatgcaatattatttagtttggtaaccaaattaacccctcatgtctaactggcatcccaaccaagccaacaccttccagctatccacttggcggtgtttatcctctatgaaaccttgcccataacacatgtttggcaaaaggtccaattttgcccttaaggtttaacaagggccacttttcttacaaagaagagagtgtttccaagaagactacatggatagactcaataaatatagaccatagttaaaatagcatcacggccatatggatggaacaactacactatgaacgagggtggaaccaagcaaaacttcactacggattttaatgagaatgaaagataatcaagcacaaaggcacaataaggcaaaatgtcaattagaaattaacaaacctttgggttttttgagacccaataaatgtcaccgtcaaaatcactgttggccatctcatcagccaaagaccgcggcccagaaatagggaagagtatagcatatttagcatatcccacatactccttttctagatccctaatatatgttgctttcaagacatgtatatcaccaaaatgtaacccaggatgtttataaacaagaacatctccagaaaactggccattttcactgttgaacagcagataaagctaataagtaaagaacaaaccagaatgcgatcaaacataagtgatacagtaccaaccaatggatgcaaggaagaaatatgacaaagaacattagttcttaacattgacaaattcaaaaccttttaataatccataatatcttctatttgagattttttttctatttattaaaaacagtcacacagatttcctgatgtctaaaagactacatgttcaagttagtctaaatttgggaaaatgaacttaaaaatgcaattgaagtcctgaagccccaaatacccagatgtatttagtatcataagttactagtctaaacattttctttagccgctgtttaccaacgaacttcacaattgcaatcaaaatcattgccagcaatatataattgtttgaatacaaaaatgcgttctcattgctaaaaggaaattgcaaaaactccatctcaccttgttaaagtgcaaaatttatggtgctaatcagcaagaacttggaagaaagcatggcaattttggtgcatttctactaaacaaaattacaagacattaaagcagttccagtggtgtccatgctggatagtggatattcctatgctatatggtgactggtgaatagtaaactgaggatcactgatacatataaaaaccgctgaaaggatatgcagatgcaaaaggggtaattctgtaactaacagtatcacgcagacttcattaggtctgagtgttccggtagggtctgtagtatccattagataatagcactcatcaattggtatctttccttgcttgattccttttctttcctgttgagccatgaaatccagcctatgttgcaaatatgactcttctagaggaattccagaaagaatcatacgtgctgacattgaatcttccatgtcagcatagctgaatgcaactgtaagaacaacatgagaataatagtccagatcaaacataaacaggtgactgaaaaacataaataaaatggaaatcttatgacaacatgtaaattgcactgaatgcaacaaatgtattttgaacttacttctcagtgcatcttcataatcgtaacatgcattctcagccccttcaattgcactttgcagaagctccaaaaagtactcttctggaactcctccatagcaaagtaatgttatcaagaaccttgatgttaatgtccttctgggtcgattgctgagcaaaaaaaaaaaaaaccatagtactgattgtgaacaaaaatataattgattaattgctgccaataaaaagcttaaacagtggaggaaaaatgtaaagtcctcaacatgctttaccaccctcccctcaaaaaacatgctttaccacccctatctcatcaacctaatcagccccaaccatgaagaacgacatgtgacagcacttggaaccccttaagtaccaccaaccgatgaatgaaatgcaccggacgtctgggctttcatacacaaacaaactcatcccaaaaaaacatgaactattaagcaaaggaaagtaatcccatttatagtacaaaacatgtgtttttgttctgatttccatgctatgccacctcatagaatcagtagcagttaaatgggaaaaagatatcaagtactcccttcctcgggggaactgtgcaaatgatcgtgacaaattcaggaaagagaatggcaaccttgacacaaaaatcaatctatcagccgcaaagtttcaaacagttcattctgctgaaagggaatctcaaaagagagatagaaagctagaattcactgaattttttactatttgtttaacctagcatagtatagattttacattgaattatttttggaatgcccggttatccatgaaccatgcacccatttcttttttttttaccttttgcaccttttcatggccattaatattgtgtccagggttcacctctccgatatggaccaatcccaacccctggcagtacaacagctttcaccaaatttcgctcgaatttactgtttcaaatttgaacttctcaaaaaccattcaaaagtttgctcaaaatctactttcgtcccatgccaaaacctcaatattatgtgaaccctggttggatctctaaggcgatgcacagggggaccagaagggtgggatgcaccggaaaaatatctaaacaaaattaactgttacttttactgcgctggtagaaagccagagcacaaaaaccagagcttaagtactaaaatgtattagtaaccaaggatgctctacatataaaaatagatgtaacaactaacaatgcaactcagatttttggtaccttgtagagactatttcaaaggaattcacggactgaacaccagataaacttttcttggcatttcgtgcagagactatttccgatgagttgacagaccggacaccagataattctggatgagtttctatttttaccattgatggtcggatgagtatagttgcaggaggaagctgcaacagaaagagatctattcttattcttacaaaatacacttgaatgctagggatagtagctaagataagatagcaaaagaaaattatctgtacacaaaattgtgtaaaaattgaatagattgaaaaagacagtgcatgatgtacaacaagaggatatctgaaaagatgacaacaccagcattgaacaaaatgaattaatgatcaacaattattagaaaacagtgaccttgtatgagataacatgtctatcctgaaagtatataaatcatgcaatgatattctgaatattgcttgaatttacacaatcatatagtattagttaaattgccagatccgtaatagaagatccgattgtattgctatcaggatacaaggaaggcacgattgcatagatgcttaagaaactatgaatcaaaattgggaacaagaggtgataacacaagagcaaacaaataacacaaaactaccaaatttcaatgtataagtaatatcatgtcaaaaactcagtacatacccgcctgtcaactaggactgttccctttacagcagatccattatagaacagacggaactgcataagaagaggctaggaaaatagaatagacaagaacagcaaactcattagttgaaaacacagcaaagtcagaaaagagtagatcggaacaacaaggcaatagttaatacagtacatgttcagcggtgagagatcgatgcctcttcaaactgttaggcctcatcactgtttcactttcatcacaagttgcaatgccctgaacaaggcataataaaaaaaaagtatatcagctagctacaagcatggaccaaaacatcacca

SEQ ID NO: 47621 - DNA, 19342 bp, Oryza sativa
tggacagtaggaaaaattcctaccaggcaattgttacagcagtgggcaggccattgcattacttagcactttagcaggtaccaaattaggaataagtcaaataaagtactccctccgtcccaaaatataacaacttttagcccttaaggtttgtcccaaaatataacaacttcttcaccaacattctcttcttaaccaatcacaaccctccaccattcaattttctcacctacctccacttcttaaccaatcacaaccttctatttaattttacctactttcttaatacccatgtccaaccctaaaaattgtagagaatagaatagatgtctcaccaatgtgggggaggtgatctctcatatatatagctgaattacaatgaatgctagtgctgagatacaatcaatactagtgagttacataagaccaaaggtctagaagagtaactatctaggagagtaaaggtctaggagataaacaggcaaacagcctatagattaataaataatcctaataaaaatccttatattctgggacggagggagtaggagattatctcctaacaaggaggtttgttatattagagatcgagagagagagagagaggattggtttaatatttgatattagttccatggaaataaatctctatctctaagccaaaacaggatcagtaaattcctagtgagtgatgaaatgaatcaacaccagtacaaggtaaattaatataagaggtattttggttaggaacaggaaagaaagtcacacagcagtaaactggtattgcaatacaatgtgccaacaattaactgttcgcccatgaaggacaccaagtatggccgtatatatccggttggatttagaggccgggtaaaaaatacccttctctaaaaaaatggacaccaagtatcaatttaattaataagaaggataagacttaaattcgagctttagaggacccaaacttgggtggtgagggtgtacatccacacctcctaccaactaagctcgattcctggtctgcttttctctgcccacatgtttgaaactttatctaaaaatttgtaattatgttgcatagtatctttatgagcaactccacaaattctgctttctgcacattcatgagatgtgtttgtcaaactttattgttggtttgcatctgttcacattataaacaatcaagtaatccgaatttgcttattagtatgtaataacgccttcacaaaaccataaccatcaggggaacacaaacatagaatgtctgaaaggttaatgtatatattttagataatggacttttcattaatccggcctctatatccatcaaggaaatacacagccacaacatacgcgagttcttggagtccaacccacacgcagaggaaaacacataaacacacaaaaaaagaagcttgaagacttagcttaagggaacagaagtcttagattattcattcaaggtgtatggagtgaggataaagcgcacctgtggtttcaaaaattttcccttgaagatactcgtggggcaattgagagccaaatccacagatacaaggccagtcccatcagtatggatcaacggctcctgatctttgtgaacaacattgccatgtctgtcctgaaatgttacaataaagaaaaatgtgattccagaagcaaaaacaagtattggagaggagggaattaccatgcaaggttcatctttaatccgtctgacataaactgctgatagatcagcatcccatgtgatagttttggagagtatcaaagcaaaccttgttacaacagaaaacacaggtttcgtaagtaagagaacaatcacatgcaagcacgctcaagttgagtccaataattgtgtttttctatttagaaagcctaatagttcgatagcagcaataatgaaatgtacatggaaattgaaaatgtaggcaatggacttctggaaaaacaagcttatcttctgactaaataaatcccagcccttctatgcatctccttttgtatctaaaaacgatacgctgctatcatggtagcaaaaccagaattaccagtaaggcagtaactaagcttgacatcgaccagtacatatgcccacattgcatcaatttaattagttgacactactaaacaaagtcataaggaaaaacctggccatatattttgccaaggtgggggcagaacttatgtgcatgaatagttcacgggcctgaccaactgttctcccagagagtatataaggttcatccatgttccacccagactcagtgcgaacaaagtagcacatgacaggtgaagtgcatttgtttttgtcttctatcttctcttgtttcaatttctcctctttccctccatccttgtaaactgaaaggtacatcgatcaatgtaaatccaacaaaaaagcaaccaggaagcatgatgggagcacttggtaactaggatacaacttgtaaagtagaattggtgtctcttagtcaaattgacacgttcagactcttaatggatattgcttccaatttgtgtataactacagtcaatctattttttccagacaccttgcggggaaaacacatctatgccatctcacgcagccacgcaggaatgactggatggacctgttcacacaaccaaataaacccaagtgtgtcttcgaaaatccatgaccattgtttctctgaagccattagagaactttgaccctagtggtgttacatcataaattgcagtaattatgtattacatgcattctccagtctactacttggtaataaattcaaatagattcaatgatgcaagaaaaggaaacttaccgaaaaatcgatatcggcgcaaacccaaaacaataccatcttcagcaaccttatggtaatgttcacaatatgtagagaagtcagtcttggtgtctgacagtttccccataaactttactacaaggacattatcatcaccaacaactttctgtagatgagtccttgtattctcgatatatggtccctacattcagttaaataaggttacaaatttagcattggcacctgaagttccttaaaaaaatatcatgagtacggcatttgttgatatgggtgccttaatttttgttggcattggtcttcatactactactattaaaatcttatttgttggcattggtcttcatactactactattaaaatcttaggtggcctgcaaaggatgcatatgggtgatgtgcacctttatgtgcaagctagataggcaaacagtctgaacagcaatgaacaaattgaacactatacaatcacgattagtagatggtagaacatcaactagtaggccaactaaaaatatcgttattaaacaacgaacatcaataaacgctatcaaaaggctccacaaaccttgaaaattttgactacagtatcccctcttatcgcaacattacaatgatagacttttgtcatgcctggatctgaatcaaggttctgcaacaattaaaatggaggaatggagaatgatttcatcaggctcatgttataatatactatcagaggaaaagaaacagatagcagaaattagaaaaatgaaatgtcagtataatattctcatgatgttattgatagatcttgatgctcaagaatgttccaagttctagggaactgatgaacttacaagaactaggtatcattagcagacagtgtttctaataaggaacttttgaacaagaaaatatgcataagtgcatccctagaagattgtaaaagcatgatgcgttgcagaaaacttattacaggaaatggtttgtgatgttccagcttgctgatgaaccggccacagaaaatcacggtccaaaaggtggttttgctgcatttatcatggaatgccttgctagatgattggtaccgtttctatttgtttttgtagttctgaagtaaattaactcgaaatggaagtcaggaactacaagtcagtagtaccacctgtatggttctgctttcaacagaagcaggcttcttttcagcctttagtcttaaaaaaaagtcaaaagtgcatgtaacatacctagacactaacatcaaaatgaagaaaacatgatacttttaagatattagaagctcagatcagaatgtacaacagagtaagcatgcattatgtcctcgatgcacaagtaaattcaaggagaatgaacatgcataggtgcaaattatatatatttacttatggctccgtttagaattatccaagttctactatgaaatgggatcatcatctttgatcatttttagagatcgtcaatgaaatacaggaaatagaagtactgccattgaaataacctttgctctatccgaagctgcaatatacttgtggccaaatgttctccagatttgtgactcaaattgcgccatggacagaaacttcaaggatctaatatagtccacagacagaacattctctatcttttcactgaaacataaaagagaaaggtgtattagcaacagcaaaacacagacaaaagtcatctgacttaggaaataatgaatgttcaggtacaaaagcagtttttttttgttctccgttctatagaaaagcacaaaaatgaagagaaactaacctggcaaggtaagcaaaaaccataaatatttttctgaaccctaactcttccagcgctagcatctgaggactcgctgcctccctcaatgcattgtctgttgtatggcaagtcgttgtagggttttgcggcatcgccgtaatggggctcggcggacttactgaggggccagccatattctcaatgagtcttgaaatatcctgaacagagctcggggtggaaactcttcttggagtagaaatcatcggctggatggggctgtcaatctctatatagttctgcaggccagatggcatgcaacggcatggactaccaacttgcatcataacatcattaggcaccgcaggagccattgctcgggcaggactgtcaatctacagagccatttggttcaacccaggagaaaccattgcctgggtaggagtcccaacttcaatgcagccttgattctgcgacacagaagatgtatggccacatggactctcaactgtcagctgagcaagctgtggaaccaaacgagcaatttgtctgacagaaccaccattgccatgtaaatggaacggcatctgttggttgggactcccaacctctaccatcccatggtttgagagactagtagccatttcattgctggggctttgatcgtacatctgaacctcgttgtcgaacagttgcgtgtatactgattcctctgtataacagaagcctcgttagtctaacaagcattacagataaatcagatgattaaataactactcctctgtttcatattataagtagttacgatttttttcagtcaaactacttaagtttgacgaaatttatagatggcaacatctacaacatcaaattagtttcattgaacatattttaataatacgtttgttttgtattgaaaatattacttatttttttaataaacttggtcagaagtttgaaaaaagtcacaacttataatatgaaacgaaacggagtgaatactacacttcacaatttggaaaaaaaatgtaacagctacagatctacaacaatctgagcaaagacattagaaagaaacaacatccaagcgaaatgcatatgtaactgcaaaactaaaggggaaacaccatcataataacctgaaccaacgaaggcaaaaccagcaaaatcccaaaaccacgacctcaaccttaaggatggtaaatcaagaacgtgaacgactcatcgacaagcatgaaaaccgaaaaactcggaaggattctcctccaaaatgagaccagaaactgaaagcgcaaacagaaaaatggactgaaaatacaaaagcaaaagagaaatccccttacatagtgtatgaccttgtgattacgagcaagcgcgtgactaccagacgaaacattccccaaatattgtgttactgtatgcgctttgcaatgaaaaaaaaaagaaagaacaagaaaaaaaaacacacacacacacaaccagaggaagcagaacgaagagctatccttccactgcatccagtgccactaaacagcaaaaaaaaaaaacgtgtttttccctcacaaattggtgcaagcaaccctagttaacgagaatggcatcgcaacccaactccagaaaagaaagaaagaaagaaaccgaaaatgtcacgcggcgaactaaaagaaagccctgaccttcccgggaagggccggagatgaacgcgggggcgctgagggcggtggggacgccccgcgcgtcgcgcctcgtgatcgcggcctcccgcttcgccaggtacttgatgaagccggggagcgtccgcacccgccgcgactccgcgaccgcgcgcagcacccgcgccgccccggcctcgccgagcaccgcgaggtggcgccgcgcctccgcgccggcgagctgccgcagcctcccctccagccgctccagctccgcggccaccgccgccgggagctcggccggctcccgcgcctccgcggagccgatggggttgtacatgacgagggttcgggggcttctagcccggcccccccgcgcctctcggcggcggcggcgaggagagccgaggaggaggaggaggcgatcacgttggcgttcgcgttggggcgcgcgatggagggaggaggttgggaaatttgggaggaagacgcgcggaggtgttgaaatggcggtgggtgttccacatggcagtgggaggtggattgtcgattgtgggccatgcggggtgtggggcggggcccaaggaggagtaattcgggtagcttgctcggcaccctacccttcctctgtgcttgactgcggctgtggttgacacggtgcttgtgtgttgtgctgcggtagaatcggtacggggggattgaggattcggattccatttccactgtgtcatacatcgactcatcgaatttaatgttgtgtttagttccgtgtaaagtttggattttggttataattcgagttaatgtagctgaaaagttgtgtgtatgatatgttgatgtgatgaaaaatgcctgaagtttggatctaaactttggatctaaacatagcctaaggtggtgtttggatccgaactttggatctaaacaaagcctaaggtggggtttggatccaggaacttaactttagtctctatatttagacactaatttagaatattaaatatagactacttataaaactaattatataaatgaaagctaatttgtgagataaattttttaagcctaattaatccataattagagaatgtttactatagcatcacataggctaatgctcaatagattcgtctcgtaaattagtccaagattatggataggttttattaatagtctacgtttaatatttataattagtgtccaaacatccgatgtgatagggacttaaaagttttagtcccatctagacagggtctaaggctatgtttagatccaacctttggattcaaacttccaactttttccatcacatcaacctatcatacacatacaacttttcagtcacatcgtaccaatttcaatccaaacttctaactttgaaaggaactaaacacagcctaaagataaagaaggcatagcatgactggggctgtgttagttccctttaaacttgcaattttttcctcatttggagatatatataatagagtattaaatatgtaaaaaaaccaattatacagtttgcatgtaaattgcgagataaattttttagtctaattacgacatgattttacaacgtggtgctgcagtaaagattaaccaaggaggagtagcttgctcggcaccctatccttcctctgtgctcgtgtgttgtgctgccgtagaatcggtacgggggattcggattccatttccactgtgtcatgcatcgactcatcgatggcataggattaagtagctcccaccgtcccaaaatactctatctatcccactctaaatgcaaaatactctatctatcctactctaaatgcaactatgagttttttatccgattttgatcatttgtattattttaaaaaatttataatcagaccctgtttatgatcggtttagatgggctaaaactttttaatccctgtcacatcggatgtttagacgttaatttggagtattaaacatagactaataaaaaactaatttcataaatgatagctaatttgcgagacgaattttttaaacctaattaatccataattatcaaaagtttattgtagcatcacattgtcaaatcatggcgtaattaggctcaaaagattcgtctcgcgaattagtccaaggttatggaatgggttttgtaattagtctatgttttatactctaaattagtatccaaacatccgatgtaaataagtccctgtttcacaatcccccttagattctaatttttttttgaaacttctaacttttccgtcacgtcgaactttcctacaggttagttcccaactttttcttcaaacttccaacttttccatcacatcaattagtacacacaaacttccaacgtttccgtcagatcgttccaatttcaatcaaacttctaattttagcgtgaactaaacacacaaacttttaacttttccatcacatcgttccaatttcttcaaacttccaatttcggcttgaaactaaacacaacctcggttcggtattttttgctgttatgagatgataaaatatgaacggtactttactcgtgaaaaaacgaatctacgactggacgcgatatattctagtataatgaatctagacagagatatgtccagattcgtagtgctataatatgttatatccaatactaggttgagtttttatgggacggatggagtatgtttttaaattttttttcaattttttttaaacaagacagatatccgtgttcaacatttaaccgtatgtcttatttaaaaatttattaaaaataaaaaaaatagtcacgtatataatattattcatgctttatcatctaacaataataaaaatactaaccgtagaaaaaatttcaaataagacgaacggtcaaacgttgaatatggacagtataaaactgcattttgttgaccgagtaaaaaggagtacgcaaggattctttaaaaataaagcagcatatccccgagtatagtttcaaaatatactacccatcctaaaatactactaatatctttaggattcaaattttgttttgaaatcttttcaaaaagaaattgtttcagtatattatcactttgaagtgctagttgccccatcatgcatttcgtttcaaaagttttctcattttaccctcaataaccatttaacttccggtcatgtattattcaataaaaggtattataatatttttttattaaaatcaaatcctgatgtctaaatttatttttagaattcaaatttttatagaacggaggaaatatatattcctgtgagatggcggatagtagcggaaaagggttaaggcatcagaatgtagtctaaaactagttcataagtaataaaatattccattcagccacctaaccacattatggaactagtccatagcaagaaaatagcaaaagccacacataagtatatgggctgcccatatagaataaaatatgttattttctctctctactcctaatactagttgctatctatatacattgtgaagataacaataattatagtccatatatgtgggtcctatctacatggactacttttgctatggcaaaagtagtccatagagatgggacccacgtatatgaactttaattattataacctacacaagtatatggatagcaaatagtattggtaggagaaaagagatagagacaaatgatatattttattctctatggacagcccatatacttatgagtagtttttgttatttctttcctatagttccacaatgttgctaggtggctgaattaaatattatattgcttatggaccacttttggagtacattgtggatacctcttagggcaagtactatgatagatgtggttgctacctccaaatttatttatggcattcaccaataaattaagatgcaagatatacaataagtcacctataatacacaaatatcaatgcctttagtactctcacattcttcttagagtttgtgtggaggctacctcttgatttaggggtggttcatcatctctcctcacttctctccttcatcttatcacctaatcctatgtgttatttttagagacagcacatgaagcactatagcacttgcccttagggcctagtactagcagagaggagggcgggggcatgccatgtcatgtcatcctggcgtggcgtggcgtggcgtggtgtggtgaacttgccagaaagcagaaagcagagagtgcactgattccttcacaaatctggcgactccaccagtctagagaggagtagactagtagtaggagtagtaggcatgctgctgccctgccatggaacagacatgagcagcgccgcgccgcgccacaccaccccacacccactgataccgaaagatatcgtgatcagatccagtgcagttgattcagggctgtttggataaattttagtccaatagaatgtttagcactaattaaaaatattaaatataaactaatgataaaacctagtactccataatcctgggctacatgtgctaattatatattatttaggattaaaaaatttatctcgtgaattagctctcatttatataattagttttattattagtctacatttaataattcgaattaatgttcaaaaatttcagtacctagatccaaacaccacctcagcaccacatgatgagaaatcaatgactcatatcaatgcatatcactgtagtaaaaatattacttttatacatcatatagtaacgaatgtgaatcgttagatcaaaatatggatggctcagattgcttgcagtttttattgtgcagttatactcatcaatccataaggaagtgtttggcaaatgtcaaagggaaatgatttccacccatttttaaatcctaaccattcattcacccttttccatttaatcctaaacttttattcatttctcaatctcaatcccaatgccatcctccattttccattatccaaacgcaccctaaaagtatgatagtagggcagaattaacagtcatacgaaaccgtatatttgggtgccgtaatctgtaatcagctcacatcctcaagcgacaagcttatacccaataaagtccctctcttctttttccaaaaagggaaaaaaaagaaatcagttaatctaaactctcacggtatacatgcattttttttcttttatcttctacaaattaaaagttgtctatacatgagtttttcccttttatctttaacaaattgaataagacttggccaacgggcaaagtgtcccaactgggacgaattcattcgggagaacggcagaagaagtgtgcaatctgctgaacaagtggatcgtggacaacggcacggtagaagccaagccgctacagtgagcgaaattggaacatccattccctccgctgtagcaaagattgaagatacagcacgaatcagcatgcatctacacactacggtatcagctttgatatgctgcagttcatcagatgattcggtgttagaacatgtgccatcacatataaaacacaaccaccaatattaaagtcgtttccactctgaatatgcaagctcttgatatttcatttagacttcacatgtcagtcatgcaagctctgaatgtgcatttgttcagtgatacatgatgcatgcatgcatgctgaaatgattccagagctaacgtagcaatctttagcttgactgcttgtgttcacttcaagcagccatgttaataggcccatcagcttagttataaagtctgtcctgacattttcctactaaaccatcagcttaagaagtccttattagtccgctcctgctcctatattgctgttacaatactacatacgccaaacttcatacaaattaactatccctaaatgcgatgctacttcacttgcggtacttcttggtaaatctgaagttgcggagaagttggagcgagcaaaccacagcgttaccctcattcttgaccgtgtagaaatggcacaatgcacggccggcaactttccaagcgaagccacatctggcgacgttgttggcagaccgtgctttctcatacgcgatctggtagattgcacaggcctcggagaacacgtcgtcgaggtccctcggtgtctcttcaaattcagatgcaccgtagagcaactgaatgttggcaagagcgattgggtcagaactctgaagctgttttccaaccattaggaaaaaaaaagctggtattcaaaagaatacaggacactcacatgcttgtacttttcatagagttcctgaaactttatcttcttttcttcttcatccgcctcttcggcatagagaagtgaactatcagccaagtactcgttatagcggtgttgccagagttgcttgattgctggaggcacgtctctctccgcgaaacatgggagcgatgatataccttattatcaaaaacaaaagagaaaaggaatgtcatgttacagagaacattcataaagtacttgtctcatcaaatatatgaaacctgcttgtgacaccacatcacaattcacatcaaccgtgttctgtgccaaaatcatgagttgttctaaatgttgcgaagcacaccacatcggatggcatggccaaaattttttgcagcgtttgtttttgaaagttaaatagaaaaaaaaagtgatgacatacagcataccatgggttatacacagacaacttattagaatagatgtaattgttctccattaattttacatataaattatacgaatatgatcctatagtctcacaaaactgacctagagtcctaaactctttccatgataacacatactccctccgtttcacaatgtaaaactttctagcattaccaatatactccctctgtcccataatataagggattttgagtttttgtttgtattgtttgaccactcatcttattcaaaaaatttatgcaaatataaaaaacgaaaagttgtgcttaaagtactttggataataaagtaagtcccaaaaaaataaataataattccaaatttttttaataaaatgagtggtcaaacagtgcaagcaaaaactcaaaatcccttatattatgggacggagggagtacatatggatggcaaggaatctaaacacatacacatgtctagattcattagcatctaatgaatgtggacaatgctagaaagtcttacattgtgaaatggaggaaatatatatttattaatatcaacatcctcattgccaccttaactgctgcaagctcaagctaagttgtagcctactatgtgctacaggtagaatagagagaatgtgtggagtatccctactacagataaacaaattgaaaaaagaagggagctaaataaagacaacttactggttggttgaacattatcagatcgcagcggttttggatcacctgctttatcatagatttttccaagtatggacgacgaatggtacgaaggactgcggtccatgaagtgggggtattgttttaccattagatcacgtggaatattgacctgtcgggattggtgggcaaagcttaaattgttaaagcacaatatgcattcaataccctcacattacaaagcttcaaataactaaagatgcaattgcacatttcattttgtatcttgtaattttacttaatctgactgcttcatatgtcaaatgcattcatgtggccatgcatctgtacatataaaaagtaatatataagaaccaaatatgaaataccaacgagttattcccataactaagcatggtacatccattcttaaatcacgctaatataccgagagttaacacatatggttaaaagttcacacaaccacaatcaagacgcaactaatggaacaaagaatcatcatgttatggtatattaatttaataaaagagtgacttcataactatgtacatcaagaccagtgtagtgtatccacagcagatagcaacattcaggtgcatatgactgattttgctataattttgtagtacttactaccagaatagaatataatagcaactaataaccttcacacgcactacccaatagcatatatggattgaattggataggctgacttgtcagcacattcctcagtatgatttcataagtagttcagttcatatgttgacatgtatataagaatagtccaattgatttcactccaaacttaatcaaggtgttattaactaattattactacaaggtcttggttcaatttgtttccttctttccggtgtttatcaaaataccagatgaaagcataagttaataaggatttcagttccatgtaaaagcatttgcaacaaacattgtgtaagcccaagattgaagttaaccttgttccccatctttggagcatccaaagccaaataataaaggtcaactaacttgagcatctttttctcaattagtttcttttcactttcgtcaagtgaaacagttaatagccgatccatatatactaaccagttagtagctgccgtagcacgcgcataactgaaaggagaaaaaagaaatccaaactcatgttagatcgtacaaaacttataaggttgtatatattaaaaagctacagaaaattgtcaccaacattagatatttaaaaatgtactaatcggattcatacaaaaagatacccaagcacttgtagttataaaaatattgaattcggtcaagggatcatcattggcgcatgggaggacatccattgaagtattgaacacctcaataagttgtatatactagaagttaaatgaggtaaatttctttacagtagagaaatggtttcctaatgaaaaatatacattagaaaaactgagcttggtattaatacctaggtgcaaatcttgttttcaagaactcatgaaatagcactctttcaagctcggattcattaaaatcctcgggtcccttttgcttggtcccatttggtgtaatagctggaacccatggtttcgaaggtttaaaatgttctaacagctgaaaagaccatttttattatcagagcagcaataatctttgaaaagctcaaaagagagaatgtgctgttatatatcaaaaccatatacatgcaagaataataagcaaacatatagtgaaacaatgcaaagacacaatgaaacagcgatgcacaattttgcaacaaaaagcaaacatggcataactaaaaaaacagctaccctaggaccctatctaccttaagatggctatggatccacccaaatgggcgttcaaagctattataagaaaagcagaggatttctttggaaaggacaggataaagcaactgtcttttgtcttgggaacatgtttgccggccaatacagtattgtggtcttgacatacataacctagaaaggcttcaaataattgattcttctagaccatgggtcagcttgcctatccaagtatctcacaagtcacaatgttcatgcgctcttctacgtagctacggaaactataattggtaatggggagaacaccaagttctggactgatatatggctgcgcaaaacattggctgaattggaccctaaccttcttgagacaattccccgaagagtaaggaagcaacgcactgtggcaaaggaattggttaataggatatgggtggctgatattaaagaactcacaattcaggttatttgtgagtatctacatatttgggacttggtggatgggataatcttgcaacaagatgttctggatgagcatagatagaagcttacaagttctacacaagtaagtcgcatacaatgcttacttatcaatcaagtttgcaacttgggagcgaatttagagaagttgggttcctccacaacataatttttccttgtgattggcagtcgacaatcgatgttcgacatcagaccgtctagccaagtgtggcttaccacacctggcctatgtcatcaagaggatgaaaccatgaagcatattcttgtctcatgtgtcttttccaggaaaagtatggaccttgatcttaaattgggattggtggatgcggcccctcagcctttcagtatcccatttttcaggatggtggtgaaggttgtcaaggagattcctaaggagcagcgtaaggggttgaactcgttgattatcgtagtagattgggagatttggaaagaccagaatgattacatgttcaatggatcaagtcctctgtaggttgtgagtccaccaccacaaccgaggctagtttgtggtgtctagctggagagcatgcgctccaagagttcctctgtaggttgcttgcctcgggcagctaggttgtccttgaaggtgtggtcgtgcgtcaccttccgtggtgtgttttttgtgggagggttttcgtaaaccctcgtttgtaacttgtaagtgtgttatacttcttcttaatgaaatggattttttttctctcctgcgtttacgagaaaatattttcccaagtggactttactggtcttaaacaccaccctgaacttcaaaaccaatcacctttcaagttcaccccaaatgcagacctgttttggcaacatgacgatgtcacccaaggccgaaccaattttaaactgacttagtaaactatttcaaaacgttctggaaacctctaaccagtacagtggacctagataaagtataactggcccttcaaaaataatgttaaaaaataaatacctacaaatttatataaatgttcgactaatttatccaagttttcaatactcccaacaaccaatcaaaaagaaaatttaagtcatttagttatcataaaaaattcaaaaaccatttatacctggtgtatattttttaacattcagaatcagaaaacacctgaatcagttctggaaaattctcaataatattatggtgtatatatagcctagaaaatttagtacgagaaaaataaagtataagcatctggaaaaaggtgtgttcaaaactaaataagccaattttcatttcactgactaaaatatactctgtttcacttgagactaactatactccaaggtgcgactaaagaatttgtccatattttttatgtcaactcactaattccaaaaattcaaaaataatttcaaccttggcccttactgccaccttaatgaatgtcatgtaaaaacaatccgattcaggctaaggtataaagtgaatgattttgatcgtccagattttgaatagtgtctacttttgaggtttgaggttaatgttgtaaaacaagccttttcctcattaaaacctaagcatactaataactgaattcttctaaaagcaaaggagctatgacatttaatatcatttggtttgggtgcagtgaccaaattagctcctcaggtttggcgaaagagccatttttcctggagttataacatcggacacttctcttataaagaacagatcatttccaagagcattactggataaatacaatcgacatagaccatgggtaaagtagcataactgctgtatgaatggaacaactacgctgtggactaggggcaactgagcaaaactctgtcagggattttgctgaccataaaagataatcaagcacaaaaacaatattaggtgcatctcccaagacgatgatttccaataaacttcacggtaaaatgtcaatcaggaattaacatacctttgggtttaatgagacccagtagatgtcaccatcaaaatcactattggccatctcatcagccaaagaccgttgtccagtagtagggaagagtatcgcatgtttagaatttcccacaaccttctctatgtcgctactatatgttgccttcaagacatgtatatcaccaggatgtaagccaggatatttatacacaagaacatctccagaaacttggccataatcactgtttaaccacatataaagcaaataagtaaagaaagacccaaaacataacaggcacgctacaaattaatacttgtatattgatgcacatttatgcaaggaatatatatagcaaagaacaaagttattatctttggcaaattcaaaccccttttcgtaatccaatatactctccccattttttaatagctgacatcattgacttttggcatgacatttgaccattcttcttttcaaaaaaattatacaagtgtcatttattttgttgcaagttgttttatcattaaaaaaactttaagcatgaattatattttcgttatttacactaaattttttaataagatgaatggtcaaacgttctatcaataatcaatgtcgtcatctattgaaaaacagtagtatctgttggtagaattttttttcctaactattaaaaacaattaaacagatcaaattactgagctaaaaaaggccatatacagatatactcaagaaattcaaaattaggttgaatgaactaaagaatggcattaaagtctcgagggtccaaatacatgacatgtatttatgatcttatgttgtcagttcaatactttctttagactccatttgctgacaaaattcacaattgcaaccaatattgttgccactattttcggatagtttgaataaaaaatacagtccggttgcgaaaagagaatacatgccaaccaatctaacctttgagttgtgattcaaaattgaggattgtaaatagtaagaaaaatggtaatgttggtgcgttacaactaaagaagactgtaagacattaaagtagttccaatgatgcccatggtggataatgatactcctatcttatgtggtaacaaaggatcactgaagcataacaaaaaaacacacactcaaacaccaagaagaagcaaaagagtatttccattactaacagtatcacgcagacttcattaggtccaagttttcctgtagggtctgcagtacccatcaaataatagcagtcatcaattggtatctttccattcttgattccttttctttccagtagagacaagaaatccagcctagattgcaagtacgactcttctagtgggattccggaaagaatcatccgtgctggcattgaatcttccatgtcagcatagttgaatgcaactgcaagaacatgagaatattagtccggatcaaacacggacaggtgactgaaaaatataaagaaaatagtaactctattacaactagtaagatgagtacaggttctacagaatgaagaagcacatatatacaaattgtacagaacacagggggtgcaggaa

SEQ ID NO: 47622 - DNA, 2470 bp, Oryza sativa
atagagagagagagagatacaattccccatttttttaattatttttcttatatattttttgtttccgtcttaatgaaatgaagcacaattctcctgggctttagagaagagagagagagagagagatctacaattcaccaaaatttgtcctctgtgtttatcctagcacatcatggattttaagctgaaatttcgtacatgcctgattatatcatgaattgcaaagccagtgttttccttgtttgcagtttttcatggccatttgcgttgcctaaaagaggatgcactggaaatactcaaaaaaaactaacagcgaccgtaggcaaaactaacatctcaaagtttctggcttcaaccacacttacgaaagatgacacgtgatgcgtgacgtataactaaaaaaacgaaagggatgaaaataatgctacttgatagcataattatactctgcagaggatctaaaaagatgtaggcatgcaatacaaagcattaatatgtgttaagccattattcaccatacctaacatagcaatgcaactcagatatttggcataccttgtagagactatttcaaaagaattcacggactgaaccccagatagacttttcttggcatttcgtgcagagactatgtccaatgagttgacagattggacaccagataattctggataagtttttatttttaacattgatggtcggatatgtatagtcctaggaggaagctgcaacaggagactttattatttcttataaagtacactcaagatataaggtcagtcaagataagatagaaaaaggacatgatctgtacacttcaaaattatgtaaacaatgcatatattggtgaagacagtgaaggccactcggccagtgcaactatgacaataagaggatatcagcaaagattatgtcaacatgaacaaacaaagaaatgatcaggcggtcttaggaaatgatgagatgcaagaaatagcacacctatcctgaatgaagcacggataaatacggctcttcttgtatactacttttacataatcatatattatgaaattctcctgcgtgttctaaaaaataaataaaaaattatgaaattaaattgcaagacccgtactagacaatctccgattgtacggcacaaacatatggaaggcgctaatatatagatgttcaagcaactatgaaccaagattggaataaagaggtaatcctgaagaaattattttgataccaaacctgcttacaaactaattgtcttagaaaacagtgcatacccgcttgtcaactaggactgttccctttacagcagatccattgtagaacaggcggagttgaataagaagaggctagaaaaataaaatagataagaataacaaacatagaaaaaacagaaaaggggtaaatcagaacatcttatagttaatacaatacatattcagtggtgttgttagaccccatcaatttgcttgcagcacaatccacaatgtcctgaaataatgggaaaaattctcagatagcttaaagcgtggaacaaaacattgccattaaggttgaatgaagcacagtaaaataagttaatggcagctgatatttatatctggatttttgaattataagtcagtggcaataacatttgagcccaccctgaagctgaatgcaaaagctgtgcaatagatatgacagcaggaaaattttaggattggcacattcctacctaataatgaaatgaatcaacacaaataaaagttaacataagaggtacttcaattaggaacgagaaataatgtcacaaaacagtatattggtaatgcaaaaacaatgtaccaacagtcatttgcttcccatatgaggggcaacaagaacgaaaatggtatcaatttaattaagcggacaagttagagccaaagatgacccgaactaaggtggtgaggatgtagtggtgtacatccacacttcccaccaactgagctagggttcagttccttctttctgtaactttatcacaaagtcgtaatgatgtttcaggcatgtgtacatatgtatgagcaacaccatgattgttcctttctcttactagtatgctgcactttgatgaattgtgtttgtcaaactttttcactggtgtgcatgtgctcaccttataccttataaacaatcagataatccacaaatgcttctgatttagtaaaaatgcttcacaaaaccataaccctcagagtaaccaaaaaatgtctgacaggttaaaatatactacctccgttttttaatagatgacgccgttgactttttctcacatatttgaccattcgtcttattcaaaaattttatgcaaatgtataagatataaatcacacttaaagtactatgactgataaaacaactcataacaaaataaattataattacataaattttttaaataaaacaaatggtcaaacatgtgagaaaaaggcaatagcgttatctatta

SEQ ID NO: 47623 - DNA, 3007 bp, Oryza sativa
gttacattccagaagcaagaccaaatattggagaggatggagaataccaagcaaggctcatcatcaatgagtttgacaagaacttctgataaatcaacatccaatgtgatagttttggagactatcaaagcaaacctgcaacgttacaacagaagacatgaggtttaatgtaacagaacactcacatgcaagaggtgaaagcagagtccaacagttagttttcttctattaagtgggcccaatagttcgatagcaacaataatgaaaatgaacaataaggtaggcaatggacttgtggaaatacaagcttatctcccagtttaagaaatttcaatccttctaaaatgcacatccttctattttagagaaaattccttatatgccactgaattttcactgttttccttaaatgccataaaaatgagctattcctttctatgccatcgaaataaatttcagtgtcatcttctggcatccacgtcaccatggcactattaagaagagaaataatgccagtattgtcaaaagaatgacaaaatttgcccttggctccctcgtctctatccccactactgtcttccctaaatccacaatatttcccattggtattctccctttgcccaagcaccagcgtcttcccagcccgtcattggcacgtttctccacatgctaccagcatcatcctccctgcaccagcaccccctgctccagtcagcggcagagcggtggggtcccactcccatcatcccaatgccaggcactgttgtcctctgcatgcccattgcccccacagccgcctcccaatgcccattgcacagagacagcattgttgcccctcatgcaccggcgtgatcgtcatcctgcgcacatacaggccatgataattaatcatggtatgctgctccaaatctgaaatatggtatagcccttctgtcctaagatccttgtctcaccgccgccaccgtggatgaggccaacaccaaacaacacaaggaacctcttggcaccagaagctcagctcctccatttcctaggtccagctgatggaattaatgccatggctcagccagaggagtgtatccatatattgctggatgctagaaaagagggaaataaatcatgcccattaaccttaaccttggtttatcgatgctgcctacactacttgcagatacttttgttgagcggagctaatgcagttatacagaaaagcggaccttcaaaatgatcttttttttttgacagaggaaaatgaatccaggagagagaagggtacataaggtgaagaagaaaggcagatctcctgaaaaaaaaaggaaaggaggagagaagggagaagggtgattttgtacttttccttggcaactgaatatcatggtgatgtactgatgtggatagcataagagagcatggaaattctattcgatggctcaccattaatacaatggttaaaaggtagagcttctctacctttcgcgtcaaaaagaataactaattttcgatggcatataaagaaaccggtgaacttcccatggcatataaggagtattttataagaacacatgttgctatcatggtagcaaaaccattttctgcaactaagctcgacatcacccagtaattgcacccatgctgcatagattaactgatattattcaaaagtcaaggaaaaacctgagcatatatttcgccaaggtgagaacagtacggatgtgcatgaataggtcacgagcctgaccaatcgttctgccagagagtatgtaaggttcatccatgttccacccagactcagtgcgaacaaagtagcatctgacagatgaagtacatttcttgttttcttcttctctattctcttctttcattttattctctttcccgccgtccttgtaaactaaaaaaggcacattaatcaatgcagatccaatcatgaaacagtgacaaattaggaaccatgaaacataatggggacacttggtaacaatacaagagtttacaactcagaaaatggcactagtttctcagcaacaaattgacctgttggcaacctcatactggttactggatattgctttctaatttgcatataattacagtactattactagtaatccatttttttccgacaattctaaaaaaagcatgtgtgtcatccccatgccagttaacatgacccaaatcaccctaagttcatgtcttcaaaaaatctgttaccattgtttgtatgaagacattagagaactttgaccctaatggcatatcataaattgcagtaaccatctctacattatgtgtattcatcagcctaccactcgtattaaatccaaatagatccagcattgcaacaaaaggtaacttacggaaaaatcgatagcagcgcaaacccaaaacaataccctcttcagcaaccttatggtagtgttccaaataggtagacaaatcagtctcagtgtctgaagatatctccataaattttactacaaggacgttatcatcaccaagaactttctgaagatgagtcctcctattctcaatatatggtccctgcacccagccaatgttaaaaatataacgatggcaccttaagttccttacaaaataaattatcacagagtgcagcatttgttgattttggcgccttgacctttattgcaattagtctttatattagaacttccagaaaaatcttaggcagcttaagaaggatgcatgggtgatatacacctttatgtgaggggtagattcgcaaacagtcaacagcaatgaacatgaacattacacaatcatgactggtagataggagaacatcaaatagtaggccatctaaaaatatcatggttaaacaatgagcacgtataaaagtatcaaaagcaccacacaccttgaaaattttgacaactgtaccccctcttatctcaacattacaatggtagacttttgacatacctggaccagaatcaaggttctgcaagcattacatggagaataatttcatcaggctcaagttata

SEQ ID NO: 47624 - DNA, 13886 bp, Oryza sativa
tccacggagaggacatcttctatcttactactttttggtgtagataatggaggctttactcctttcttattcctgtaacaaaaagagaaaatggtgtattagcaacagcataacacagataaaagccatattagccttagaaaatagtccatgttctgctataaaaacatctttgttctttattatgtaaaaagcataaaccgaagagaatctaaccaggaaagataagcaaaaatcataaatatcttcctgaactccaactctcccagcgctagcatctgagggctcactacctccctcaacacattggtcgtgtcaggacagattgctggaggaatttgcggcatcacccaaatgggacatggaggacttcctgaggggccagccatattctcgacacatcttgatagatcccgcacagggctcggggtggaaactctttctggagtagaaacgatcggctggatggggctgtcaatctccatatgtctctgcagcccagatggcatgcggtggccagggctaccaacctgcatcataacatcattaggcaaagcatgagccattggttgggtaggaaagttaatctgcacagccacctggttggacgcaggagaaaccattccacgggaaggcgtataaccttcaacgcagttctggttctgcagcagcacagaagatattcgaccatatgggctcccaactgctgggttagcaaggtccggaaccacacgagcaatatgtccgacagaaccgccattgtcatgcaaacggagcggcatctgttggttgggactcccaacctccaccatgtcgttgggtgtttgagcatccatttgaacctcattgtagtacagtggagtggatatagattcctctgtgtaaccacaagacttattagtaagaagtacttcacaatttaggatatgtataacagctacaaagaccttagaaagaaacaacatgcaaaccaaatcaaccataccaaatgggcgaaatgcaaaggtaaaaagaaaaaaaaatagaaaaatgccatcatactaagctgaaccaacgaggctaaaatcaaccggttaccaaaaccacgacttaagggtggcaaaattaaggagaaaaaaaatacgatcgacaagcattgaattcgaaaactgagcgtcaccattacagaatgttgctccctatcacaacttggcaagattctccaaatcgagagcaggaatcgatagcccaactaaaaacaaaaacaaaaaaaggaagatactcccttccgcctacgaaaagtgcattagcattaaacaggggcgtaggcgcaacaaaaaaaaaagagctgaaaaaatctcccaaacagtgcgggttttgcagccaaaaaaacacgctaaaacgcactgccataggaagcacaaacgcagctaatcctcctctgcgaccatccattaagattaaaattcaaaaagggttttcctcacaaaaaaaaaacgaaatgggcggtgaacaaaatattggcctcgcatgagaaaaaaagagtcggtgaacaaaaaatgccaagcagcaaaccccctcaccttcgcggcaggggccggagatgcatgcggcgctgtgggcggtggggatgccccgcgcgttgcgcttcatcctctcctggttcgccatgtgcctgatgaagccggagagcgtacggacctggcgcgcctccccaatcgcccggagcacccgcgccgccgccggctcgccgagctccgcgagctgccgccgcgcctccgcgcaggcgagctggcccagcctcgcctccagccgctccagctccgcgccgaccgccgccgggagcgccggctcgcgcatttggttcccaccgccgtggggattcatggttgagagggtttagggtttaaggcggccacacacacccacccacgccgcgccgcgcctctccgcggcggtggagatcgaacgaggaatcgatcggtttggaggtttggagcgaggaaatttggaaaaggaggagaaggcgcgagcggggtcacgctggggggccaggaggaggaggaggtggtggggggggcccacatggcagtgggtgtgggaggtggattgattgtggggggtgactgggaggcgaggtactcaactgtgactactccctggcacggccacgtgtcgcgcttcggagggcggtgccgaatgtgggacccaggtaccagagagtggaggattgattccttttggttgcttggactggagtatggagtacacttccggcctccctgtgctagtgcgcttctgcggcagaatcggcagatgcagtgacgcgtcaaaagttactagctagccatctcatccgaagttccaaactatagcatccaaagcccttgtgtaggccatgtttttcaaactttttcaaacttagaacttttcatcacattacatcatatccaaaactttcctacacacataaactctaaccttttttttccaaactaccaacttttccaaacttctccctaatttcagaaactaaacacagccttagttccaaactttttttttcaaactttcaacttttacatcacatcaaaactttcatacacataaattttcaacttttttatcatattattccaatttcgaccaaacttctaattttagtttgaacttatctctgtagtggtagtaggaggggtagtactcctagtagtaatgaaaaaaaaaagtaaatttcaaaaaaactacaaccgtaacaaaagtaacattagtaatatatatttcaatttattgtaacgttaatatatgaaaaattatcacaaaactgtaatttttacgtggtatgcaacaataaaatatgtaggtgacaacagtatgcttgtgacatgtaaaaattacaattttatgataaattttcacgctattgttgtaacaaaccgataattttctcactatagttgtcattttctgaaaattactctaatgaaaacaaccaaggatacccgtttgaccgggagttttgtttttgcaatttaaatggcatataaaacaagatatgctatatcgtatgattaataaaatattaattattacaattaaaaatatgtatttgaatttttaaaaactatacaaatttctttaagaaaatgtacattttagcactttaaaaaccgcgctcgtagtaaaaaagaagttgtaaaagctaacaaaactacggaactaatagtctagcagtactagttatttataaccaatctaataactcacctatatataatagtttttttttcaaaatacaggacacagaaaagcataaacaaaaagaaaaggatagaattacatgtgtaaaacagttgtttcgaaaacatacggagggaatagcgacgggattcttatcaaggttgacaccaataatattgacacagtgaccttatacctcaacgtcaatgagattcgctttgagcccacgatctatttctgcaattagtttttagtgattttcacctggagccaccttctattaccaatgttttgctttaaaccatcctttaaccaatgttttactttagattggatacaaatctttgtgccagtttggaccatcctcagctcttttatccatctacacaattatcatatgacaaaaaatggctatttttttcaattttttaggtctttttgaaaacttatttcacgaatagacccttaaaacttatttcgaaaataaacccttttttagaaccaacatcattagcgacgtgatcccatatgaccaccaattacaatggcatcatcccactagcctctccatagaaactaagctagttatgcaaagggtgcaacgtcaatatcattgatgtcgaggacatatgtgaaatatttttttttcaaaaaaagacttatttgtaataaaagaatatttataaataggtcatcggccagtgtcattgacaccgtgggcttatttgtaattttttattggaaacatgtcgttttcttatattttttattagaaatatgccattttcttatctggacagagagtctatctaaaatgcattgtattaggaaatgtctcatccaattttagattattatattttgagacggaagaagtaatccagatacattgtactccctccatctcataatataaggtatggtcaaatttgacacagtcttcaaaactaatgttatatactacaaggtttattgtaacaaaattataaccatctcaaagtaaatttaaatgtcaatacaatgatattaattttagcaaataaaatttaattttatattataataattgttggtcaaatgtttttaaagttgaatcttggaacgtgcgcatgccttatattatgggatagagggagtaataggaaatgtctcacctggtcctagattcttatattttgggacggttcttatatttcgtaacagagggagtaatccagatacattaaggctgagttctttccccaagttcccaactcatctcaatcgttttccacgcgcacgcttttcaaactactaaacggtccgtgttttgcaaaaagtttctatacgaaagtttctttaaaaaaatcatattaatattttttttaattttttataactagcacttaattaatcatgctttattctatcgctttgttttgcgtgcggatgggagggggttctcaacccctccaaaagaacacagtctaaacgttccatttatagattcttatattttgaaacgaaaggagtaacattttaagtaattctgtatggataagccagaaaaacatataaaccgtagtgctgtgtttagttcctaaaattaggaagaaatttagaaaaaagttagtaatttagaaaaaaaaataaaagtttacatgtgtagaaaaattttggatataatgtgatatgatggaaagttgaaagtttaacggaagtttggtgtgccctaggcatggccttataatagacgtccgatccttccgtagttgggtactgaaaactttgaaaaccctaaaagcaggcagcacacgcataccctattgccctggacgggagtaggcacgcattcccaggattcgtgacagcttctgctgttgtgcggagcccgaaagttgtgctgcacatgtcactcaatataggacttgtttagttataaattttttcttcaaactttcaacttttccatcacaacaaaactttcctacacgtaaacttctaacgttttcgtcacatcgttctaatttcaaccaaactttcaattttagcatgaactaaatacacctatactcccaattactcctactccactctacttgctctaggggtgtgtttagttcacgctaaaattaaaagtttggttgaaattaaaacgatgtgatgaaaaagttaaaaatttatgtgtagaaaaattttgatgtgatgaaaaaattaaaagtttaaagaaaaagtttgtaactaaacaagatatctcactataccaaatcgctgccagtattgcaaaaggagatagaaagaagtactcctagggtgtgtttggttcaattttttgtttggtttgcatgatatggcgatccaatttcttttgtgttggaggatatagcatggatggaaaaagacaaaagttagtgagactcatttgtcatatatatatttttttatcaaaatataatcatccgagatcttgttttaaagatttaattgtaacaaatataatggtgtaatcaaatcataaattagataaacggtttaggagaaaaaatcatttggagcttgcttaacagaaaatcaaaccaaccacgaccaatcagaacaagacacatcacccagaccaaaactggatggcttcatccagcaaaatcagccggatacactcatccagcatattgagggaatattccctattctgggccgccccatccaccctgccatccaaccaaacaccacagaaaatcgggcagctatctcccatccaggctcatccacccaaccaaatacacccctaatgttcaaggaaaacctggattactggagcatttgctactgcggcaattaataaaccattgatctgaatgtgttaagccatacagccgcactgacagaaatttgttaaccacgtttagatcagataagtagtagtactccactacttaccagttaccactaagcaagctacagcgatgaagtgtcatagcagtccacaagaataaatagtcggaaatcagattatcattagataagagagcaaaatcaacagtcatgcctaccgcatatttgggtgcggtaatcagctcacctcctcaagcttactactcctactcaataaggtccatctcttttttttttctctccaaaatttaccaagtctaaaacctaatctcacggtacagaatcactaagtttgtctatacatgtgagcaatgcagttttgttttttcttttcttttacatattgaataatttatgcacaataaatcagtaatggaaatggttctgcactcattatacaaaaacaaaattagtctttcatcatattaacgttagctttggttagttaggatagttagtttatatttttgaaggctacgagtaagttaaagtttgcacttcaaaatccccccattatcttgtcacaaaaccggttgttcatattattagatcttaatcttacaaaggaccagctcgggaaaatgcacttcacgacactgatcttccatagcatatggagcctaaataaagattttttgcccatttttcctgcaaatagatttatcagatttatttgttatgtggagttcaaacaaggcacaagaagaaggtatagtcacctttacatgctggccaggaaaagcagatgttctcagtgtctcctgtgtttcatcgttaggctttcttctaggtatgctcaagatcaaagccacctggtcacatgtggctgctgttgcagttatgcgataaccactatcccagcgttgatggattccttcactcggatataagaaatcaagttctactacctacaaaagagatatgcgagataataaaatctcaagacttttacatattcaattgatagtcagtgtagcttgctgctaaaatgaattcaattttacaaggctcttggacactccaaacgtacctgatgtgtgaaaccagcgttccgggacataaccacagcccatcggcttcctgctgtggccaaggcagtgacatagaacccctccttccactttttgtttatccatttgaagggaaatgaatcacttactttgtaggattgctgtgcatatggcgttcctgagaagcattcaagtcagttcttggcttcttgctcataataaataccaacagtaaacattacaagacacccaagtgtttgcgctgtgaatggcttctcactacacatattaacggtggtactttctgaatactttgatgcatcaacatttaacaaatttcacctcaacagtaaacattacaggatacccaagtgtttgcgctgtgaatggcttctcactacacatattaacggtggtactttctgaatactttgatgcatcaacatttaacaaatttcacctcatccagtattatcttggtcaaggtaacaatattaagtggtatgtttatccaaatgttgtctagcagtttatagtgatttcatcatagctaggggcaaaagattgacagcctcatcggttgcccatatttcctaataagccaaaatgatttattagaaaataaaaattaatttataggtaaaaaattgtatatgtgttcttagcaacttaaaagccaatattaaaaaaactatgttcaaaatatcttaaaattaacttcaaaattaagtttgaaaattcaaattttggcttttgctttggcttattaggccaaccaatgaaaccttgattttatatattaaacccatgtcatgtactaatgttatcaactatatgctgcttagcatagtgttgatttaccccaaagagaacatttgtttgagaatttttctttattaaaatcaaatatttatcatggttttgattaatatccagttcttttagtattcgattacgtgtttcagtacacatttgatgagtttactgtagttcttctctgagatgaatcgttgcgcttgttacataatgatcctggcaccgaacatgcaaattcaggactaaaggcatcaaaatgaaactgtatacctgttgacatgatcaccaccgagcttccattatttgaaccagccaaagaagtaatatagtaatttctctcccactgctccattatccattcctatcaaagcgcacagttaaagttgtgattatacatttatctcagtgttctaaaagtcagctccaggcgccggttagccgccgcgattaggcattagatggtgcattaagaggctgaactaacttgggtggtgtttccttgctattttagtgttatatagtcttgtttttatgcaatatgcttgctaatttcttggatttgactagttagcctaacctaggcgccccccagccgccggactagtgcctggcaccttgttgtcccaaaatataggcaattctagagttcttcagggggttaaggagaggtgaaattaaaacagggatggttgtgattggttgagatgaggaagtagatggagaaattaaataagagatggcggtgattagttgagatgatggaatgggtgaagtagcaacattttgagacaaattttgaatgcaagaagttactatattttgggacggagggagtagaaaacaataccatgagatggcaattaggatagagctgagtatgcttgattagtaaccaaccacagataggaaaaaaaatacatactcaatagtaggatgacacgcaattatttaccttgtgaagaaagtaatgggagagttcatgtacttgggcggtaaaaccagtgccagcatccataattaaagcccacagatctgaacaggatgaaactgaacttataaacaaaccatcttcatttcctttttgaatatgtggtgctaatctatcatctgctacattgtagtggtatctgaaaaataaatgtggtcagacaatagagtattattttactgctaccaagcagattactgtgccatacctctgtttcattggccgacgggcattgtacacactaatccactgggtcgctggcattcccattctaatctttttcttaggttgctcctcatcttcagccgctgtgaggcggcctctcttctgaccaacctgatatacaagctggcagcaatccaacaaagcattatgcaggtagcccgctattacataaagaaataaggaattatttaatatgtcactagattttgccagttaactattttaccaccaaaatacatttgatattgaatatgtcactgtctctaaagaccaatctgatcatgtggtcttaatggcaggacattgactatgttttagtctatgcaggtcatactcgttatttggtgtttcatattacagaaagctaggacaggaagttcaaaggcaggttcacaattgagttgtttcatagtgggacatagatttccttcactaaaacctaaaagcacaaggttggcattgaactaattggaattcttgggaaataatattagttataacactagtgatgactctcaagcccaaggatagaatcaggtaactttaattatttactagtgctttgaattttgatccgagaaatagggaattggaactgagattcctacacgatcattttttctgacagatgatacagacgcagattaaaatggttgaaggaataatgtaccttctgggcaccatcggtgtttaatggtcttccatctggatttggaccaacaatgccatcaaaaagagcaatgcactttgcatagtttggctcttcgtcgaacttcaagttcacaacatactcaacaaattgacgaaatggtggtggaccaatgccacataaagattctggagaggttgccatctttttcttgcaaacaagaaaacctttattctctccctaagttcattcatgaattacaaaacgaaattagtgcatgtagcaacaaaaaagtcataaaatcaatcaaaattaacctggaatccttgccaaggcaggcggccacggagaaggaaaataagtgtgtatgcaagggattcaaggtcatctctcctgcatccagttcttcccaagtgggcatgcacactagcataacgaacagtacccctgtttacagtagcagacaaacaggaagagcgcatcaataaagtaatgtgcaaaatgataggcatcgtaataaactttctattcaaacctaaagatatcaggtctctggtcatattcaacatgctttcctgtaccagcatctttccatttagtagctgcattggaacaaaacaagttcataaggaagcaacataaataattacatgacaacaaattgacacaatataaagataaaagttgattaagaattacctagtccaagatcaacaagaaaaagtttcttcccttcaggggtatctggaggaccaagcaaaaagttctcaggtttcacatcaccatggacgtacctgtcataaacaaaatttattagctaaaacttcagagacgccatgtgaaacactcttacggaacatctgaagagcaggtcgagttaccctttagcatgcatcttctctagtatggagatggcctctatacctatacaagcaaccatctcaacagacatcctgtaaaagaaggccacaaattaaaaaattgaaaaggctgcattgaactgtcaagattaattaggaagagtcaaaagatgcccacgagtgggaattgttattccaaacatcccacaggctcggtcccaacatatccataacctgcatgaaaaatgtgtatggttagaaaaaacgtagttgataattcttaagagaaaaagaaaccaatcaaaccataaaccggaaagcaaaaaaaaaaaaaaatctagttcatgctccattaccatgatgtaaaacccgccctgctttcctttgtagtgtacccgtgggacaccatgatttccactaagagtactgcaagagaaggtttatcataagtaatcaatgtaaacgtatccaaataatttggtattcacaaagaaaaacttacacagtagagagccagaagaagaaatacttacttgtagacttgccattcatagggagctccatagctgcaacctttgctggttcgatgttcgaattttagcgcaacctgacagaaatgaacatgagtactgacgcaagtacgaatagtctcagttccaactacttcaatcattcaaggagatacactgacctctaatgcatttgcaccagaatttctgttaccatgagtaggagaggaaatacgccggccaacgtatacttgtccaaatcctccctttccaagcttcctctcaagcttatacgttggtgaatttccgatttgtacctggtccaagcacacaaccgcccaaaataaatatatggttatgataacatgatgtaaaatcctataaacatgtgaaaaaggagacaggtcagctattccatgcgtaataaaatgatacaaaatttcatcatcagaacagccattgcaacatttctgatcttttgtgagctaaacaggtttcaagcagtcaactctgagtgcaggtgacatgaggcaccttcattcttgcaacaaatcctgtataatgactaatcctgctttgatctaatggaaagctaccattatcctaaagaatgcctatacagtagcatctacaatatggctcaacatagtgcgcaataaaattaaggcactttagattctcccgttcctaggcagatcttttatctgcatgatggtagctaatcctaacagaccgatgctcaatcaaatctccgcttggaatttaacacaaacactcagcatgtgaattcaacaaatgttaggaataaaacaggaacagagaatacatgaaacagtaacaacactcagctaaccaattgaatttcgtatacatggcagaaatgaacataattaagcaaccgacaagatctacgttcagtaaaaacacacaccaaacaccagaaatggtatattcatggcacactaattataagtgccatcaaatgctagagattaactagatggagtctagaactcaagatgttagctatctcatcagttttctgcttgaaatgcacaataagcttctggtcaacatcacccgtactgatgctatcctagatttacacaataagcattcttcattcacatttagtcaaaagttctaatttagttccacacaattctctacaaaatcagttctgtgcagctgctatttgtaatcaatacatctgctatcctccccttctcttgtcaccagttggatcagagttaattgaaagtaagctaagaatccagaacaactagtagttattttgccacaagcgtaaaactccaccatcccatcccgcgtgtacagtttgcatagatcaatcagttcatctacaccagcggcagcgtctattcaatcaatagaaccctaaaccaaaaaaacaaaacgccccctaaaaaaaaatcgacagccatatctaggtcacgcagcgggggagccaaggggggatagataatccgcgattaccgtctccgggagcggcgcggggctcccgtcgtcgccggcgccccccttgtcggacccttccatccccttccgctcctcctcccgctgcttcccctccggctgcctcgcgtccgctgggcccgtcggcggcggcggcggctgctgctgcttccgctttccacggcctcggcgcgctggcatgcttcagcggcgcacgcccatcggctcgccgggggatcgaggcgatcggccgcgctggggctagggcttggcctccgcgccggcggcgacgggtggggggtgagccggcggcggtgacgacgacgagacgggaggagggggagattgcgaggtagggcgcgtggtgaaaaaaatcctggtaccacagccgtgttgtgtagtaagtggggattacgccgccgactcgagcttacgtactgtgtagaatacgccttctctcgaacacatgcggatcataccacactggcgtgtagttgtaagtatgatggcttcagaagttcagattcgtcctatcaaaaaaggaaaaaaaataaaaagaagttcagattcgtttcaagaaagatcatatactactcgtcatgtttgggttagcttgtatccatgtggggattttgtttcttacatctcttgccactaaagattatactcatattccttcgagaaagattatattcctacttgagttcttttttcgaaggaccaaaaatcttttgtgactcatcattttaatctctagtatactgcatcattggtttcatattataacccttggccctgttcctttctccaacaaaagtcggataaaattttaaatactcgtgtcacatttttcaaaccgctaaatgatatgtttcatgcgaaatctttatatacgaaatttgctttaaaatatcatattaatctatttttcaagtttgtaataattaaaactcaattaactatacattaatatcaccttattttacgaaaaaaaacttaatcttcatcttcatgagaaaataacaccaccctagtactttgattattttcctattgaagcccttttatgttctaatattttttaaaaaaacaatttaacaacatctacaataccaaattaatttcattatatgtaacattaaatgtattttgataggatgtttgttttgtattgaaaacaatttgatcaaagttataaaagtttaactaacaggaagttaaagcgatttataatataaaccgagggagtatgtactacagtgg

SEQ ID NO: 47625 - DNA, 5567 bp, Oryza sativa
  unsure (1)..(5567): unsure at all n locations
tttgggagaaaacaaaatttagtttactcgcatgctcaattgttgtgaaatatcgcgaaaagaaaaaatctttatgaactagagtcccgctccggtgcttttctacttagagtagaaattaatccgaaccgttgatcgtatttaatcatatggttgagatcgagttctactcccaccaaattttatgggagtagaaatgtggagggatatatttgtccaaaggtaataattcgcgtagggtattatcgtaatttgtttttatctaactcttcaccctctctctctatcctatcctaatcgatgccattctcctccatccccgcctccgtcggtgtccatctccttcgccgcctccgtcgccggtccttctccctctccacctccgtcgcctccagcgccatcggcatctccttcccctccagcaccgtcgcctcccccggcctcaccgccttctccgccccctccatcgccgtccgtatcccccgccgtcgccgccttgtccgcctcctctttcaccgtccgtctcctccgcccgcgtcgccttcttcggccccctctgtcgccgtccgcctcccccgccctcgccgcctcctttgacgccattctgggcctcccgttcacctctatcgtcgcctccgtcgcccgtccatctccctcgccgcgttcatcgcctccagcgccctcgcggccctctgccccatccaccttctctacctccagcgacctgtggcggctgcggcgtacgtgctcggcgcctcggcaagggcggcggatccacgatgtgctgcttgtatggcagtccggcggaggagaggctgatgatgcaacgtcgccctcatcttgatgttgccgttgattgttcatcccatctcttcggctgctactggttcgagaacaggtaacgtcctgtcccattttctcccatcacttcctgataaatgatacagtaatgttgtaggatcactattagatcctccaaaagtagcagcctgacgcgagcaaaattcagttttaacaccaagtagtacttcataagcacaacctgctagatttctactgaggttgttgtcccaactatacaaatttgaaatgtgtctgacaaatgttatcaaatcaccacatagataattcttctgtgaccattagcgagagatgatttccgcttgtgcttcattctattttagttgatgagcagccgacaacggtttaaatggttatgattttgcttcagtaaaattctagtactaattctggagttctctatacttcgtaaattacacacagatcgatttttatttgattcgttgcttgtagaaatagttccactccctgtgctacatcacataagtcaaatttcagaagatactactagtttatagtggttacggccagcatggaacagttaaggtccataattttgtaaggctctgcagatcattttattttggaggctttccaatgtgtataattttcttttcattttttcagccatgcagtggagctccaatggtgagtttgcctttcattgtcttgttggagattgcacgttggaattactggcaaaagtcatgcttcttgcattcaagagttgtatcctgttctgcgagtatgatctagcagcatggtatggggctgatattttataaaggacaacgaccaatgtctgaattgatatatatatatatatatatatatatatatatatatatatatatatatatatatatatatatatatatatatatatatatatatatatatatatatattgtactcgccataatttaatgtctatcacagaagcagtaatatactcccttgcgatatatcccacgtggttttctttggtagacagtgttcgtgttttaaaacaaatgaataggcaaagatgatatatatttgcacttgggagttgccgtggatggttactgcaagatgctttaattttgtccatgtcgcgaggggtcaatcccagtaccacaccacttctttttttcaatcatctaacataactgcaactatcttttttatcttcacctaacagaaattaatctgcaatcaccacggttaatatatcctgaaacttggcttgatagagctttattttttgctaattacacccctgacctccacatttacatgcatatcacttaagaagtatataatcatctgaacaaagtctctgatacaacaaaataaaaggctgaagaaacgtcagtggtccatccccaaccttcaattgtgttgatgcttcttacatgctccctctcatagctccggcttgaggattacttcacaagttgcaaacatgttcaggaaagtgaacaattctgtgatacaagtgaatctgacagtcgcggctgctttaaaatctcatctcataatgaaaatattctagcagttaaagaatatatatcatgatgatttatgagaatgcttgtggacatacatggacaaattagtaattaacactataagttagtaactatatggaactgctccctaaaaaaacaactcaggaactgagtttctaattcagaaatgttccctcagataaaaactcaggaactgtgtcaacgatcctaaaattgtgagtattttcttttcaaacaatacttttagatttttagaaatataccataacagaaattaacagtcaaaatagtattttatacatactcaagttcagagattcagttgaattgtattttattcaaataatattataatagctagcacattacatcttcagaattaatatatactccaatatattgcatccagcccgaatcaaaattcagcatccatccatatcaaagtcacatccgataaatcgaattggaacttgtatacaacgctatacatgcaatctagtagcaatagcattagcatgttcctcttcttgtgcggttcgtttcaaaaaagcaggttcctcttcttatcaacaacgaagaaatcaaattcgattgagagcaaacgcacaagtaccatgataatcgaaaataaatactagctgttagcttgttcagtgggaggaggagatcaacgcggatgtgaacgcggtcgtcagggccgaagaaatcggcatggccgtggtcgatagggaggagatcggtgcagtgcagatgcgcgtggtcgccagcaacggaggttggcacggccgtggtggctagacagggatcagcgacatcgacggcgggaataccaggggtggaggatggcaggataatcgaggtcaccgacggggagataaaacggcggcggcaggatgaacgccggctgatcgaaatgggcgccaccaccggaatcgagctgtgcaggaacggacggcggatggatgcggcgagacggtcggagcaatacgagacttaaaagaaaaggaaaacacaaatacccaaattacccttaagcacataattagtaagtactaatatacccttccaaacagatggttcagatcatttctactggtagtagaatactacgagtagaaagcaccgtagtcaagctcaatgaactaacgttcaaagttataagactgtccgggtaaccaacaaaaacagtttggggaacctgactgcccatgctcctccccttcgtgcaaataccggctcactctttgaaggatctttggttttacagtacagtacagttttaccataagtaatgcaaatgctactaagatagttagctgtagctacctgtggaactccaaggtagttcaggtgagggctccaataaacatcatcaaataagtgagaactcatgaaaatcatatttaaaagtcttataaatttatgaaaaaaaatttaaagataaatataccaaatcttaagtccaaactcaactttatttgagaaaaacaaaaaagacaaatttcagatgaatagtgttatattactattcgagtaaaatgcgttgcaggtactacaacttgcaaggtgggtacaatttagtcacccatcttgtaatttgctcaaataaatcactcaacttgtttggaggtgcaaatataataaaaaacgtgtcacgcgtattatttttgccaaggtggacgatacgatggcagacgtgacgatgagttggcgaaagtaatacagttttgtagaaaaacccttctactatattactctttgctaatttaattggtctatttagatatgttatgcccgtgtgctaagccatgatcgtaggtttttttgttggcgtgcgcacgggataggacggcgccagatctagcgagtcgcggtgatagcctgcgtggctgcgtatgaatccatcatcggcgaaattatcaacgctagccacgagcgctcctatttaatccatgaatatgatgtcaaattaccacattgaagagtgcatataaaaattggttttagcacaaggaacaaaccgctttatttcccaatataaagacaaacatatatccttgtacatcaggcaagattcagtactggcagcaaatcacgtattgaagatttggagtatcaaacaaacatatgtactcaaacgaaaaattgaaacaatataagggctaatttgcatctttgttccttgcatacaaggtgaacctgtcatgctgacgtggcgtccaccttggtacaaataatattgcacctctaaacaagttgagtgactttttttttagataatggaagttgagtgacttatttgagcaaattacaagatgggtgactaaattgcacacaccttgcaagttgtggtacctgcaacgcattttactcttactattcactcaaaagttatctcttttttccctctataatagagttgagtctaaacttaaaatttagtgagaatgtatttcatacttgcatctatctacagtattcttctcatgaatttatacactttttaggtctagtctcatgggttttcacttatctaatagtcttcattggatatgtcgccgttctgattagctcacatcaacttctcctttctgcaaagctaaaaaaaaagggacctatcaagtcttgattataactttgtacagcaacctgtggcggtgcgtacgatgatcacatcatcgcgattcactcatctttttccgtatagccatattccttggatgttgtcacgatagcacgagtgacaaaacaaactcggcaaaaaaaaaaaaagttcccattttagttcaccatcgatttcgaccgtggattttcttcgtgggtcatgacacacatcataaaaaaagaaaagaaaaagaaaaagatgaggtcgtatgcgtaatgcgttcactaatcactcgtcgaaatcaatggctagtggtaacaggctaacagatagtgccggccgctatctgaaaagattatannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 47626 - DNA, 12255 bp, Oryza sativa
catgcttacatgtgatttaaaataggctagaatagtactaattgcgaagatcgatgtggcatgcttacatgagattttaaatgggctagaatagtcattactagtgagtgatgatgtgacatgcttatatgttgagctttagcttctaataattgttagtgggtatcaactatatagaatgtatagataagtaggtttgtaggttgacccgcttgggtccctactaacggaagtccttcagaaaataaaatgcaattttcagattcgcctgctagctgttcacctatatattctgtccaaagatgcaacagagatagcatccttgttccagaatatctaatctattttgtatttgagagggtgcaaaaatggtactacagtttagcaagatacttcccattttgatccattatccaaaaaaaaaaagcatcccattttgatgagtgtgattgagagagttaaaaacaaagtggagttctgatgagaagtatatatgggattggaagctgttgggattcaattgacgactcaatcaacggaagaccatagcaagggagaaaataaacaggccgggagaagcaaatcacagaacattgaaacgaaaccagacaaataatcaacgcccattcgaaattcgccaggattttagaagcgatgggagctgaaatattttttatgtgtaatgaacacagcgccacatcatatgatgcgtgcccctctgttctcctgttctttgttagttttaaaaaacacaccttgtcatctgtgatgggccaagactctcagctgtgacgggttagaacctcgtcacatataagtggtcactaatgactctgagtcatctgtgactggcgaagacccgtgagaggaaagagttagctttgatgggccgcaaccaaaacccatcacaggtaaccttcgtttgtgatggctaatcattttaacctatcattggtggcctttatctatgatggacacacctttcactactaaaaaacgatttttcgtgacgtcgtcctataattttcattggcggtcatatgcaaaaattgccactaaaaatgtgaccaggggtgagggactacggattgccagcgaaaatcggttttcgctggcggccacgctaagacgcccgtcataaaaaatagctctattttcgctggcagcggctctaaaaggcccaccataaaaatccgggttttcgctggtgctcaattttcgctggatgcagataacagcaccgtcagtgaaataaaatttgacgctataaaagcaccgcccccacaccagtgaaaacccagttctctccgccacgtccttatcctatctcctcctcctccatccactccctctctccctccaatcctcgctccctccaaatccataggcacgggcaacggaggagtgcgctcgtgaaggcggtggcgaggcacgggcggggagggctgattcgccaccgctgggccgcgggaagggcagatccgccgccggaccacggggagggcggcaccgaccttgatgccgtcgaccgtgctgcccgactccctcctcttcgacctcaacgccgtcgaccgtgctgcccgtctccctcctctccgaccgtgctgctagatgtgaattttttttgtgcatgttgttccagatgatgcacatgttttcagctgtgtaaatgatgtttgatctgtggacatatttcattttcaaatttcctctgcgcaccagtgggcatattcatttttgcttttcaaatttcctcttcactagcagctagggcagctgcatgggtttgatttttgcttgcggtcgatttaacacagctgccagcgaaaatgaattatcactggcggtcggtgtaagacaaccgccagcaaaaatggatctttgttgacggctggcttaagacgaccgccagcgaaaatgaattatcgctggcggtcggtgtaagacaaccgccagcaaaaatggatctttgttggctgctggcttaagacgaccgccagcataaatgaattatcactggcggtcgataaccgccagcaaagatcttgatctacactggcctttgctttgtggtggctccaaattctgccagcgaaaacctaaaatggcaaccacgaaagatggttttcgtagaagtgttttgaccaacttttatttgtgatgggacataattgggatccgtcagatacaagaaaaatagggaaaaaattaaaaaaaaaagctatctggttagctagtcacaaactttcatctgggaatccaaaataaaaaattcataataatcacattcacattcatctaggcacaaaacaaaatcacagtcacattcacattcatcttggcacaaaatagaatcataaaaaaaaaatatagacactggaatggaaagcttatgctgttgatggacttcactgcggtggtgcatctcttgccatgcttgacgctggaggaggagtgggtcgatggccatcatcgtagccgccaccgcggcctctgaactcgaggagttcagatcttgtgctcacgagaggtggcagcgactgcatccaaaggggaagggggagaagaatctgtcatgtagctatggtagagctcatccggctgttcttctggtagagctcgagtggatctggaaggagtagaaactagtggagatctgctcgttgttcaccaccaccagatttggctatcggtggttggatccgcccaaaaggcggttcggggtgttcagatcccaaggccggcccagcactagctgcggaggcagagaatgggtctatgatgctgtggagttgtgcccctccaaagctcgtcactatccacgccagaggagaggtcaacagctgcacaaccacggacgcttccatcaccggtccccatggtggatggccaaatctagctaccatgaactctgggaaaagcttgatcccacaatggtcggcccgagagtggagatggaggtggcagccggcactccgtggcaaaaaaatgcagcctctagtgcgtggttaaagacgtatgtagaggcgtccgtcgagctagggttgcaagcgcttggtgaatcaaaagagagatgatgttggggaatcaaggttaggcacagtcagcaggagcaaatagataagattgaacttgttaatagtgatgggtaaataaaaataaaaagttgtttgaggggaatcaaggtttggtagtattttcaatccgttagagataatagtgctcatatgtgataggtaataattcaacatccgtcacagatgaatcttcacctatgaaccgaaagatagcatcaatgtcaggtctacacattaactcgtcaaagataacgtaacacctatgacgggatgtatcatccagcctcatctacaataggttttattttagcccgtcaatgataaagtcctgtgtgacggggcaatctggttcgtcacagatgggctgtcataaatgagtggacgcgctgtcctttaattttgatcactgtatatgataaaactgtaaggctgcaaccatcctttcctcttaactatttcctgagcaaaaacaaaattttggcccttccactatgaaatcacacaatgacagtggatataaatagaggctaaaagagatccctgtgtgttgagactacgtataagagaacgatatgcatcttgcagcctccatcgtatatcaagttaacaactgcgataaatcatcatatgtgatccgaacccatcttgattctctttcttatatcatctatgaattaatggaaatggaagtcatcaggaaccaaagcataacaccgttgctatccatgccaaccagaaattctctccagtggagccatcatctaggacgccgccgaaacaccgggccacttttcacggtcgacaagtcaggctgctacggtgatcagcgttggaggaggttaatctggtttacgatcatgctgtcgtcgctaattctctcctgtagcactactacagaaagcgtttttgcatacgggcggaatcaattttcacatgcggttggccggcccgcatgcgtgaaatggtctgcaaagatcaccatttgcgtatgcggccgtcgcagccgcatgcgaagatcgatcttcgcatgcggtcacttaagacggccgcatgcgaaaatagatcttcgcatgcggtccatctaagaagccgcatgcgaagatatattttcccatgcggtcaacctaacaagaccgcatgcgaagatctattttcgcatgcgggcgtcttaagtagaccgcatgcgaaattcaatttccgaatagctaaaataatatttattctagccttttagtgagatgtgtctcgtaattaatattaaattattgagggatttattatcgtatttcggagtagtaagcatataagataagacaagtgccgcagtaacaaacatgtaatacataaccattaattcaatcgtaatttacatacgaaatatataatacaagtggcacagttttttcatcatatgtataagtagtgtacatgttattgcatatgttctttctcccactctctgagaggtttaaatttgtcgtccattgcgagttcactctggctgtcgtagaagagacctcttgcgtcccagtcagcctgcgatatatgtccataatccgtaaatggtgggagcttcttctgaacataatcccgatttagatcggacttccactgtcgccatcgatctcccatctttttaagtgcgtaatctctccccctgacctctgatctaggagggaatacaaaatacttctgcaactcattccagagaagtgtctttatgttgtcgtctaccgtttcccacaactttacattaatgggacaacacgtcctgactagagtgccacaggcgttgctgaacttggaccgcactatcggtggctcgacgggcttcccatcctgatcgagagcaatcacgttgtaagtttccttgggtaatttattcttgcttctctcaccacgtctttttttcccactcccgcctgcacttgtagatgtctccgtacgttcaggtgcagacgtagcggtatccatctcaacttcttgctctgtcctgttcctcccggctttacgtttcgagcggcgtcggactaccatctgcacagaattggtaactctatacaccattaggttcatgtcacatcatagttagggaataatacatggctaacgattttcagcacttacgccctgttcgataggtatgtagtccggatcatcatcgtggggggcgacttgtgttatttccattggaaacgggtcacttggtgtgcgccacgtttcttcactacaaaagtctagctgcttattgctaccggaattttgaggagcgttaccttcttgaggcgctattggtgagttcgatggaaccttttcgttcgacatcttccaacttgacgtaaaaaaatttgacataagtcccaattttactaagtcccaatttaacgcaatgtcacataagtctcaatttgacataagtcccaatttaacataagtcccaaatatacataaatctcaatttaacataagtcccaattatacataaatctcaatttaacataggtcacaatttaacttattttcacataagtcccaataacttaatttcacataagtcccaatttaacataattctcaatttaacataagtcccaatttaaacataagtcacaatttaacataggtcccaatttagcatcagtcacaattaaacggaaatctccatttgacataggtgccaatttaacaaaagtcccaattatacataaatcccaatttaacataagtctcaatttaaacatcaatctccatttaacaatctacaattaaaccttctcaaaattaaacaatcaacaattgcacatatcacaatccacgatgcacaattaaacaatccacaatccacaattgcacatttcactttttttttaaagtaaatgttaccgagcgacagcgagggggtagaagtcctggcagcggcgtcggcgacggcgagggacggggacgacctggcggcggcgatggcgacggcgaggggggagaggtccgtgcggcggcgacggcgacgacgaggaggtagaggtcctggcggcggcatcggcgacggcgaggggcagggcgacttcggggaggagccggcggtggcggggacgacttggcggcggggacgacttggcggcggctacggcaacagcgaggggggagaggtccgtgcggcggcgactgccacctggcggcggcgacggcgacggcgaggggggagaggtcctggcggcggcagcggcgacggcgtggggcggggcgactttggggaggagccggcggtggcggggactacttggcggcggtgacgacggcgacggcgacttgggaaattttggcagcctggcggctagggtttcgcgggcgccaggacttagaaaattttggctccccgcgctccctatatataggcgcagatcatcgcatgcgggcggcttaagggaccgcatggaaaaaatatctttccatgcggtcgacatatgccggccgcatgcgaaaattatctttccatgcgggctattaagccagccgcatgcgaaaaagatatttccgtgcgggccataaagccggccgcatgcgaaaaagatctttccatccggttggcttaagtcgtccgcatggaaagatctttttaccaaaaaaactcatatttttttatttcctctaagtaaactgtacatatatatttttttcccaatatttcgccacaattatacattccaaatgtttttggcactaagaaaactcatgaaaattgctcaaaactcgtaaccaaatgttacatgctaatgattacaacataagggggacctaaattcatgcacgtacatttggaacacaatgagaactaaaggttacgaaataactatgacttaataaccttggcaacaccatctgctcgaacgtacgacatattcacttcatcgattgttcgctcaaccttcttaattcgcataggaagatcagtaaacaatggtacatcgtcgaactggttgtaatcattggggtcttcgatgttgtcgatgccgacgatctgttgctttccggatatgacaatagtttttctttcatctgaagggtccttcacataaaacacttgagccacacgctctgctaaaacccatggatcatccttgtggcctattttactgtgatcgactatcgttagcccgtagtcatcaacggaaacccctgttgtgtctttaacccattcacaacggagcacagggatctggatgtttaggccatagtccagttcccatatttcttgaatggtcccataatacgacctcttttctccactcgtgtcaatcgcttcgacacggatcccactgttttatgcggtgcttttcatgtctttcgtagtcgtactcaaggtaaatccaatgatgtcgtaaccttgccatgaattgacaatacttgaaggcccacatgccagtctttgtagagtaagttcctccacagaatcaccaactggtaggtttagatctttcaaccccagaggaaagcgacgcttgtgctctcttgatacccaatcattggaccgccctgggaagcaggctttgatttcttctaggtgtcgctcaatgaatggctcaacgatagcgagctgttgaagaacgctgttgtgtgctgcggacacctttttgtaatcattatcgaagaactgcttcctaccaacaataccccttccagacaatctaccttcatgtcaatgaacaggaatgccaatggcattagcatcctttatgtagtccatacaacactcgactgtctcttcagttgtgtatccctctatcattgatccttccgggtgagcgcgattgcgtacatagcctttgaggatcgacatgtaacgctcataggcccacatctgatgtaagtataatggaccaagttcaataatctgagggacgatgtgaacgatcaaatgctccatcatatctaaaaatgatggtgggaaatacatctcaagctggcatacagtctcgacggcaaatgtctgaagcggacctaattccagaggatcaaataccttctgcgaaattcgattgaaaaagtcatggactggtttgttataaccacctttgtatggactggtttgactgcccttatagcaattggtaggaataccgttagcagcctatgacagtcatgcgcattgtatcccgaaatggtcaaatccttcatggatactagcttcctgatgttcgatgcgaaaccagtaggcactctaaccccttgtaaacatttacagaaggcttttttctcttcaagtgtcaacgagtaacaagcaggaggaatctcggtcttcccatttggcagcactactgggtgaaggtcatgccgtatggacaaatctacaaggtcattacgtgacttcaatccatccttcgttttactcgggatgtccagcaatgtgccaacggtgctatcaaacacgttcttctcgaggtgcataacatcaattgcatgtcgaatctctaggtccttccagtaatctaagtatttaaagaaaattgagtgcttcttgaaaggcgacgcagtaccgttgtcaccatcagctttcttccactttactgtcttcttctttccctttccatatacaaccttaatcttctttgttatctcatacatgtatgtaccacctcttgctactggggcagtgtcattctccactgtattatcgaacaatctagccatcttacggtacctatgtctttgtggtaggaaccgtcgatgtcgcatgtacactgtcttcaaagacgacgtcaggtatttgtacgaagttttctccagacatatcagacatccagtcttccctttaatctgcccagataatgaaaagtttgcaggtaggtcattgatggtaacgaatatgatcgcacgtagattgaagtgctcccacttaaactcatcccatagtcgtaacccctctttccaaagctcctccatgtcctccatcaaaggcttaaggaaaacatctatgtcgattccaggttggtttggaccttgtatgaggatagtgagaagaatgtactttcgtttctgacatatccatgttggaagattatacattgtgagaaggactggccatgtgctgtgcgagctgcttaagtcaccaaacgggttcattccatcagtgctcaacgcaaaccttacattcctaggatccttagcaaattctgggtgttttgcatcaaatgtcttccactggcaagcgtcggcaggatgtcgaatcataccatctattttccagctctcttgaggccatctcatcaactcagcatcagtcgggtttgagtacagacgcttcaggcggtccttaattggtaggtaccacgtcaccattgaaggaatcttcccgcgcttacccttatcagaatctggatcagtacactctgaatctacgggcccattccccgttttataccgacttgtgccacacgttgggcaacattccaagtccgcgtattctttacggtataatatacagtggttcttacaagcatgaatcttttctacaccaagagataaaggacatatgagtttcttcgcttgatacatgttcgatggtacaaagttaggcttaggaagcaacacacgcaataaactcttcagatcattaaaacttgtgtccgaccatccatgtttagccttcaatctcagaagttcaagcactgaacgcaagactgtgaaatccttatcacatcccttcgtttcatcgtaaagaagatccttcgatgccttctctaatgcctgccaattctccaatcctcgtgacctgcccgctagcacctctggttcaacatggcgtagcatatcctctaaatcaaaaccaccatcgaaatcatcactatcggtggaaacatcgacatccattctttcacgcgacatgtcttcgattataaaattctctgcctcatttatctcaaaacttaactcttcatcgtcatcttccggattggcgaattccccatgataggtccaaaccttgtagttggcggtaaatccgtactccattatgtgacccaatatttcaccaggatctaccaacaatttctgattcttgcaatgacggcacggacaaaagatctttgtcatattctccctcaaagcatgcgccttagcctgatcaataaatttagatgcttccttaataaatatcggttgcgttctccgcatctcatacatccatgacgaccgatccatctaattatataaaggcaaaaaagttacagataaaaaaatagaccgcaggtatttcatacaaaagtttaaatgcatttgtctcccaaaaaaaattacaacaatacatgtaactagtatgtacaagtgattacatgcaaaatttgcccatcaaaacaaatattttgaagctagattttgcaaaaaatagttagaacaaaccttgtcaaaatattaaaaaaactccactttccaccaacgaaatataacaaaaatggagccaaatgaaggaggatagagagttcttcacctttcgtatagagttcaagcaaaaatttcgagttgaaaacctccccccctaattggtgcttgctttaggagagagaaagcttcgttttcaaatggtcaagctcgggcctggaggagcatatatggccgatcatcgcatgcggctaatcgacccgcccctgggggggcggtttttgcaggcgccgccacaagcggcccgcatggaacctaccgaccccctcgtacagaaaaacgaattttgtagtagtgtcgtctgcacttcatctcatataccaaattcgcacctagatcttggatttgagaatcaccatacggcctgcttggagttcaggagattcctaacttctattgttacaaaacgaatcgatgagggataaaccctgtgtatatatgctgtagaagaaccggcacgtgctcaaactctgttctgagttcaatcaaaatgacagatgcttgaaatctgaaactgtaattctgaagaaattcaaagaaacaaaaatatcagcagtagtcataaatattagtctgtactatggagtttggaccttgacaaaatgggtttgtttattgcattgttgatcaaagagattagactataacatagaatacgtattgaccatggatatcccaaccaatcaaaacatatcgaatacaatacaaacttatcaaaactgtcctggcctatctttttcgggtatcatatccattcaatgtttcatataagagtttcattgtccatcagaaagcaccagtgatacgtactaaactctatactaaactaaatgttttggtaccttgagatatatagtatcttaccaaattttacattagaaaatatggtaactgatcctgatacgatctcaaggactatcaaagtactcttacttgtaagataacatgcctattcaatgccaatcagaatatatattggacgcaacaaccgacatatgtgagcatatgaatgctcagagatggacaagaaagtgcaggctctcgctaccagaaaagagcaacatctatatgtcgtgcaaggacacaagcacatacagtgtgggaatcgaaggcatcagaactacaggacagtataacatagtgcgagacatctttgctttaaaacttcgcgatattctctcgcgtcgccctccccaccggcgacacaagaggcgacgccgccgccgtcttcttcctcctccccccctccttctctgcctcgccgccacctgagcgggtgccggcaaagccgcgcggccgcggggacggcggcggcggggcttttgcccagcacgcgctcggcggcccggggagctggccgggcggcgacggtagcaaaccgtccggatctgcacccgcccggccggatccggcggggtggcgcttggtggcggggcggagtggtggcggcggcggctggaggtgcgtggtggtggtggacagggccggcggcggcggaaacccccgcccagatccgcgccgttttggccggatctggtggggctaacgccgggcgacggcgggcggcgaggaaacaggcgtgctggcggtggggaagaggtggcggcggcgacggttgcgcgggtggcgcagctgggcgaggtcgcggcgcggccgggcgcgtgtgagcgtcgccaggcggcgattgaggccgttgcccggaggccatgaggatggcgatggtggccagaggtggatcccccccccc

SEQ ID NO: 47627 - DNA, 4022 bp, Oryza sativa
  unsure (1)..(4022): unsure at all n locations
tggcaacggcgcgtgagcacggggcgccggcgacggtggcaatggtatggatttcatggcgacgatggcagcagcggcttgtcggcggcgaaagcacggtggctggttgacggcattggcggctgtcggctactatggcattgcggccctcgcggcgaaggcagcggcacggaactcgtggcgacggttacggtagcggctggacaacggtgatggggctgtggctggccgacagcgaggtggtgtcggcagcagcggctgtggtggtggtgggaggtggcatggtggcctcggtcggctagctgagggtgtggcatacggttgtatctggccagcgcgggagagtacggaggtggggtcggagattggcttggcgcagagaggcgcagccgatggcagcggaggccgactcggtgcaagaggcgcgggcggcggagatggaggccgatggagggaggccggattggcgcgagaggcgcgtcccgtggaggaggccggtttggcgcgagaggcgtggccggcggtggaggaggcgaccctggtgcgaggaggagatgccggtgggtgtggcgctatcttcggcgcacgaagcctagccggcggggggcaccagtgcagggttccccatgtcggcagaggctgagtggtggtggagcatcggtgcgttagccctggattcgcaagcgtgagcggcgggtgaaaacccagcctggccttggtcgggccgacaacaatggttttccccctcctgatggcgttgtcgtgctgtctcacccctcaagggcggttgctgggcataagcccagtcctggctcttttgagccccgacggacggcggcggtggttttccatcgcttttcttcttgaagatgtcgttttggcaccccctagctgtagggcgatctcgtctatgttcctttattggtctagcggcggccggtccgatgctagcctcctcctggtcatgtgtgttggcgctgtcggtgtgtgggaggcggtatattttttctttttcctggttatgaccctccagggttgtaatcttgtaattttttactgctttatcaatagaacttcacaccgtacttcacaccgtctcgtgcgagtcgttcaaaaaaaaaagaactacaggacagtcattccggctaaatttgttttgtgcgtcatctgcgggatgtccaagagcttcctttgttttaatcgtgtccgtagattagtcgttggattatacgaaaattgatacaattctcgtctcaataaatttagtagatttatctatgcatttccacaatttataggacacctctgagtatttgtcatcagtatcaaagtaaattgaaaaggagcactttcatgaattttattaggagtcaatatatgttttaattaggattgaaacttcatgtatcagtggataagtcgagatgatacaatcacagtgaacaaaacaaaaatttgcaataacataagatcattaaataattgattctgtagttagtataattatcgtttattaatatttcttctattgtcaagtagtagtagcgccaaagaaatcattttttaagaaaatataatgcaattttcacgttcacctactttcagaatatttctctatttgtatagtaccttctaagttccattctttgctaatcccttctgtacttgagacggagaaaagatagtactgtaacgtttaggatgttacttgccactttgatgtttgtgaatttagacagctaagaacgaagttgagtactgatgagaagaatgaatgcatgtatgactattttttttaacttatactccctcgtatttattttaatgtatgacgcgttgacttttttatcaacgtttgaccaatcatcttatttaaaatttttgtacaaatatagaaacattcatgtcatactgaaaaacatttaatgataaatcaagtcataataaaataaataataattacataatttttttaataagacaaatggtcaaacgttggtcaaaaaaccaacggcatcttacattaaaatacggagggagtacttttttatatggttttgaagttattaggattcaaatgatgactgcatatcagaagattttagcaagtggaaactaaactggatttacaggtggccaagcatcccttgacggggaagcaagagggacataagactggaatcaaagtacacaaataattaaggcccgttcaacctagaattttagaaataatgggagctcaaataatgttttatgtcaaatgagcacaactatttagaaaaggtagtgagtgtatcattaggaatcaagagtaagaaaactagtacatgatgcaactacatatcatgtattattaggagaatcaagactaagaaaactagtacatgatgcacagtgcatcattgatcactgcaaaatcactgtccatcagaagactatatcaattcagactcaatcatcttttattttgaggaaatcaaaatcatctttgaaggtgaacaagattatgtcttttgacccatgccggccagcatccccacccacatttccatggatcaaatgcaacttaggttgtgagcattttgcacgttttgacttctcttatgcgttagtttcttcatataacattttgatttttttttgcttgcataaacacataaacgcataaatgcatgtcgtttatactacctccatcccaaattatatatcattttgaatttttgcgtgcaacatttgaccgtttgtcttatttaaaaagttagtgtaaatataaaaaaggataagtcatacgtaaagtactttttgataataaagcaagtcacaaacaaaataaataataattccataattatttgaataagacgaatgatcaaactgttacagacaaaaactcaaacgacaattattttgagatggacgtagtactaccaaaaaataaaaaagaagaatagagcacatgacatgaccgccatatatacatgaccctttcttcctttttttttatctcatatcaaacataggtattggtttcttttttccttttcattatgaagaagagccagccaaccatttcttgtttttaattttctgagaaaaacacatggtccttgcatattgataaataacattgggatataaatagaagccagatcacccgtgttcagatagagttgaaggatcgaggagaggatgatgcatgctgcagagcttccattaatcaagcacggcaatcattaaacatctcacttggttgatttctctcacctactatatgaatgaaagtcatcaggaacactactactgcttctggagcagatcaaggctgatgaagtcaatgaagaagtctgtgactttactcagtcataatgtcatcagcaacactactataagctcatgtccagattcataatattaaaaatatcccatccatccaaaatcccttatattgtaggatggaggaggtatattgtccaatcgtgtacatgctttttgcgagaagaacgtcaacattgtctaactcttattcgagtacaatcaaattcagcaagaccactacactgtgcactgcggcttcaactctgaatgctaattattcgaaactgcaatactggagaaatcgacgggaaaaaccaggtgaaatcttgtttaaatcatcaatatgggtccaggactccaggcctcagaaaaaaaaaagagtttgtttattgcattattgagaaaatccacttttgaagttcataagtaatatcgggcaaagtcatcaaaatgctcaacatctccctcttctcacaagcatgtccattccatggtaatggtacatatatgtgtttttcagcgagagtataactccatatactctgtacataatacacacttacacctgattgtgttcttcacataagcataaaaatatattgttggaggcatggataattctaaaatgattgggaactagtgccacgatcttatttcacctcattatttgcctnnnnnnnnnnnnnnnnnnnnnnnnnnnnnnnnnn

SEQ ID NO: 47628 - DNA, 10150 bp, Oryza sativa
agaataggaataagaaataagagagggaacagaggaggaagagaggaggcatacgggtccaagtacgtacgtatacctactacgactccacgtaggtacaatactgatagggactggaggattattttttctttatagattgatctaatggttaaaaatatcgggtccaccagattaaatgaaaatcaatggttgggtgttgtctttttttttagaattttaagaatttctataatttatcatagtgccaagtggcagcttgggagcgtttgtagggtacacgtggcagtttgggagcatttgtaggaagtttaatggacttttattatataatagaagatagataatagatagataactacatctattgccagtaacaatgcaaatccatattaaaaaaaaatagtaacggcactttattccgttctagtcaatgctggctgtatttaccccacaatcccattctaacccatctatcatggacctgttgagttttggccccttctgtaaatttttgtaaataactctttttctttataaaagttatattgctcagcaaatgccatgcaacgcagtaattcatctaaaaaaacatggacctcgcaaaaacccagaatactgttctagccaagtacatttgtgagcccccttgtttctgttttggcctaacttggacatattatattggctggattatgtattatattgacatattataccggtatctcgaggtactttttgctgaaccggagcaaatctcttagaaaatactaattgtataataaatcagggttacatattatttataatacattgggatgagtctctattatcattgatttttgcttgatctctgcattgtcttccaacaatgacagaaaagctagcattagtagtccgatactcctttctttggctatgtcctgctatcaaacacgtaagaattgtttgaaactaacgacaactagagctatgtcaacaagcttaccaacgtaaataggtagtggcgttcatactaagtacaaggataatcgttgcaacaattctaactaaataaaaaaatggagtccttattgcctagaagcacattcacatcatcgtcacaaaataaagttctttgatataattatagttagcatagaacacttgtcaaatttaagaagaaatcaacttgttccaactaattcagtggagcagaaagactgaaatttgaataaaaaaaaggaatgtagaaatcctaaatttgaaaaaaaaattggggggcccaaatttttgggagccttgtgcgatcgcacagcaagcacatgcccagggaccctttcccttcctatggcaatcacactagctacaaagacaacagacacaagatatacggtagagctctctcttatactaggtaatatatgttaaacatgatagaaattatgtgttgagatattgtgaaaataatgcgatgaagatgattcgacatactggtatgttgagctctatttatattctagattatgtgtaatagttgcatgagatttaagatactctataaattgttagtggatatatcatacttgcatgttacgttttagcatgtaataattgctagtgggtaccaactatctataaggccattcccaatccaatgattaggatggtgtctatatcattaaataggctgccacctaggataaaaaatgatatggcaagtgaataaatgagaaaagagaaggaaaccatgtcttgcaatgagatataggttctacacaatattcaagacatcatgtgagataagtagcattaaatttaagtaaagatagtggtgtttgcattggaagagtagtgtctagtactaatttcttgatgacgtggagtttatggaaactatgtctagtgtcttgggttgggaatggcctaaggtatagatatggtcaaatattatggcatggctataaataaaggctaaaagagatcacctatgctgctgtctgctgaggtgaagttgaaggatggaggagagaatggtgccctttttacctagctttccataaatgacggcaaccttcctatcaactagcttgcttttatttctttcctatatatgaatgtatgaatggaagtcatcagaaatgaaagcataacatcttcgggatgtatgttgaaacaaattcatattgaagggaggttgcaaccagattgtcggctgcagaacaaatcacattccgcggtgcagaattcaagttgctatgctgcagcagctgcaggaagacgttcagtccagcagtgtgcagcagcttggtctctgtcgtcgtttgcatttcggcgtgcggccgtccttctgtttggggaattggcgatagaaacgatcgaccgtcctccttaattggccttgccaacgattacttaattaccctctcacctaaattatgcaaatgactaaaatgactgtagaaatcaacggtgagatttattcctactacactactatcacctcctagtgaaaggtacaggttgggacagactttctgtccattgattgatattttttttgaacgactcaccgccatcgccaccagctgtgaacgctgtcaccggtcaccatcccgccagatccaggctcagatctggtagtctcctccacggccgccacacctccacacgccacctgcagcaccgccagtcaccgccgccccaccgctcgaccccgctgccggctgcctccccaccagatccggccgggaggcacggatctgggagatttccgccaccccaagcagcacccctctgcccgagtgtggcgcgaagatgaagcctcaccgccgccgtccttgtggccgcgcggctttagggaacgtgcgccggcgggggcgtcgcctcccgtgtcgcctaagggggaggggcgatgcgagagtctagcagcagctggctggttatatatattcaccaatctgttatagtagccattgattgatatggtcagagataatatatcaacagcgcatgactttgcaaaaaggagctttattaattattaacaattcctcgaggtctcccatattgggtgaccttcccttgttacatccaatccaaatataggaatgtaaggcatcagctaaagttatagcagatgctgatgttagtcacgccgctccttctctgttctttagaggaaagaacattgaattggactgctgtagtctgggtccatgatctacttgttcattgcgcacaaagatattcgatcatggaggacaggttttttgtcatttgttttcactgcatgcatgctgtacatcttagttacaagacagttgtagtgtaaatacttagtaatatcattacatgtcttgtgccctctagaactctaaacggcagttctatggtcttgatttccagctaagttaggtatgggaggcatcaagaaattgagaatgaatggccactcaaggatgatgaataagaaccccccatactagtagtcagcttggtgcatgttttcggttgcaaacatcttacctgtagcttgcatgctggatgttgctatattggcctctttggtaggctgaatcactagcagaaatacatgaatataatggatgcatgcaagggaaatgttatttcctcactatgcaaatgagcgatgctcaagcaatgcaggtgttcacgtacaaacagtgagacacaatgcaggaacattctgggtcactctcctttccatatgcatctcccactttctccattccccttcttgccttctctttgttcacgatgtcaccaactagaaaacctattggttgtctgccttttggtagatgccggagatgtaaatcattttctatttttcattagataagtattaaggaactgttccattgatgtgattgacgcagcttgcaattggagagttagttttcctgcatgatcttacctacagtgtgcagtcacgcaaagtgagcttttgtccaatctggacataatctgattggttctaaaacattaaggcatgttgcagtacagaggttttctttggcaatcttccctgggtctcttgttttttatgtttcacattactggttctgataagcattctacctaaataaattggactccgtaagtcagaacatgtatatcagcatgtgggaagagcacccctgaccattgcctgatcctaccaatctaccatagccatcggaaagctcttctggtgtttaccatggaaatggaagacatgaggaattctcatcatacaaattggataagatcgtccgcatctgctaagggaagacaagagatctaaaacgctgcgatgattgtagcagtgcgagtagcagcgagcctgagactcgagaggatatctgctcctccattgctccatcgccttatttccaaaatggattggttcacttgtgcatcttgttgctccttggttcttcctccatttttttttgctacagaatggttcattgtttttcttcctattattagtttactacaagatgttgcttatcacaggttgtatggagtaacttatttttcttttgaagaaggaagtaactttatttccaagaggtcaattttgtgctgagatgccttgggaggaagatgatcagctggaatttgactgggttgaaagggcatcctcttgtacctttgactgagttgcatgtgcaaccggcttgttagcactccgaataagtcattgcacaatagagtacactaatcgagcaaatcttaaaattatgttatcaaaccatatgcagctgtagacaaacatagcgccgctgtagatgaacaataataggacagaactgagaagtaaatgttcaacctttggaatctctaatagttgctctgattcgacttttggtagcatacattttgactaaaattataaattagagatcacaagaactaagagaacttcacatagactacagcccatagctatcaaatgcatatcagccccaatcatgcgaggggtgatgtttactgtacaatagaaagtaggaacataagtcaaacgcgcacacgcttcgcttgtgttccaaaaaaaggaacacacacacgcgcgaatgcctcgctcgcttggctcgggctggagtggcatgcgtacgcaatttgtgcgtgaatggtttgtaaaaattggctcctcatgcttgcataaatgcagcttccttttacagttttattttgttgcaaaatttggtgctcatttttggaaacacaccaagtcatctggtgcgtggagcggtgtggagtccggttaggttacatgcgatctctctagttcggttacacgttatggagaacgtctaggcgtcttgaatcacattttctattatttctatataaaccgagccaccttcttctagcatcacacacgaaaacaatctagggtttgcctcctcctccgaaatgtgccatcactcgtagtccactctatccagctagacagcatgcactcgcgatcacgagagcaggtctccagaaactttgccttcgacgtcctacatcgggagaagatgctaataaggttttcggaaagcactttgcaggactggtcactggtcttccacaacggctcatcttcctctatgtttaagggctacacgtagacaacaaaaccctgcacctcgcgttgttcttgcggtgcgggctgctccccgtcaagtcgatcctattctgcattcaccatgtgctacaaagccaatctgttcatgttcttctgtttagtttatatgtttaaatcacatgatatggttatgtttatttacatgttcaatgtcatgatttattgaataaattaaatctacacgtgcttatattttcatcagtgtcgtcgttatccctactgcataatggtgtctacgatatctgtgtctaaaaatcaaggttcgatcattgccggcagctgttctaatgatcaccattcataattaatggagaaagcactctaactgtccaaaagcttgattcagtacaaacgctttaagcatcctgtatttctcagctgaattcaatttcaaataatatattaatggcatatgtgctacaagtacaacaataagaaagacaatatgaagaaaaattaagccatcttagattgatcactaaagtagagttaggtaggacaatttggcctcttcagatggccaccatgtgcaaaagaaaaaaaattgagaaatacataatgcacaagcagtgaagcatagcccatgcttatttgtaaaatttgtatgtgtctcagaccactagtaaaaaggtaggtcaggaaaaaaaaagtgaaacaacatacaggggtcagtataaaaagtgatggaagaaagatctcgggctctcatgttctgtaaaacacaacacaatgaaacggtaccctagattcatcgctttcggttatgtatgatataggaatgattggaatcaggaatactgcttgaatttggttatcaatttatgcatgtttatcaaagattaccctgcctagcgagtataatctcccttgctcaacttcttccaagaggatatgatctcccttcttggatttctgcgtctttggacgatgcgtcaagaaggctagcatgcttactttatgtgcctgtccagctgattacccaacgaagatgtttagatgttggacattagtgtcaatttattgtaattgtaagcgttaactactcttttccttggggagttaagagaaatactaccgcctctgaatatactttcttttacacaagcgttttgctgcgccaattgaagagttatttttctatagcctggtgttaaattgcagtgcagtcgatcagagtctgcttctgttcactttggatagaactaataagcacatgatgaaacatcaaggcataagtacagacatgtttgacagtattggcacttgatatgaatattattacattaatgttgcagtatacagaggttcctttcacaaccttccttctgcctaaggctgagggtcttatttaaaaagttttgtgaaatatataaaactatatgcatacatgaaaatatatttaacaatgaatcaaatgatagaaaaataattaataattacctaattttttttaataagacgaatggtcaaacatgtgctaaaaagtcaatggtgtcaaacatttcgaaacggagggagtatgtgtgtgtgtgtatatatattcagtttgatttataattaaactgtacaaaaaatttgacaatttgacccttgaggaaacttgtttcaaaaatgcaccacgagtaaaactttttttaaaaaatgaatcgggaattcagcgtggtgttgagattagaccgctcggagccaggtcaactggcgctgaatgatgtgtcctcgtggtgcggatgctaactcagcctaccgacgtggcaaaggtcagctcaacctgccacagtgctgatgggcccgccatcagcgctaggcttgttgtcgccgatgtaggaaacttttatccccaccctacaatctttcgtatagcaatatgagcaaagagaaccctacatcccaaatcaatagtattaagaaaaattaacatcattgagaaagtatctccaagaaatccacacaaaatctgtgcaacagataggaaatacttttgcaacaggaattcagatacctttgcaaccacatttgaaattcagatatttcgctatcaaaaccatgttcataattagtgttgtagatctcataattgctctggctattgtttttgccaatatacattcagaaagaaatcacaaattggacaccagaactgagaacttcacatagacagaaattgcctccatctagcaaagtacatgagccccctgtcattcaagaggtgatgtttacagtaggaatagaagtcatctggaatgctagcgatgcatctgaagtctgaaccatttccaagcaatcctattattcaggtgccttgatttaaacattcagtggaaaagagtttttactataaaacagtcagttaattcttccatgaataataacggttcagttctaaatcttggatatgaacttacatatatatctatccaaaaattaaacaacccggtcttttctacctatatctcatgcagaacttgatctatttcaggtgtatcgaaccagcgtggagcagagtgcctcaatcctggctcacaactctagctgtgaaggttattaatgatcaagagaataaacatttggcaagatattagaagcactagaagactaaataagttttgataactgttgaacacagtcacttaaaaccaatttatacagggatcagaacgtaatttaatttgctatgacaagcatagtaagtttcaatagtctgagactttgagtagacagttcaatgcagtcttctttttctttctttgtgacaaattggaccgaatatcttgttttcagtaactgcaatgatttgcagggacattcatggagcaactggtgtgtaatatagatgaatgaattcacagtatatggaatgttcaaaaggccgaggtcattggtggatgaactgggaagcggttgaccaactcaactaggatggtagtgcctgatggaaaaggctatactactttttttctcgcaaaactcttattaccactgggccaaattatttcaggactgaattcctttttcattccacatgactgttgtagatatcaaattcatttgcttcaaaatgtgccgcataaacatagaaataaaacatttttgttaattccccttcaacacatgctatggtgccacagacaggaaggtaggtctgcattattcattatgctgaaagtagaagctaataaattccagtgttatatatataacatggtagcttttgtcaaccagattcgctaatactccctccgtttcgaaatgtttgacaccgttgactatctagtacatgtttgaccgttcgtcttatttaaaaacttttgtgaaatatgtaaaattatatgcctacatgaaaatatatttaacaatgaatcaaatgataggaaaagaattaataattatttaaatttttgaataagacgaacggttaaatatgtgctaaaaagtcaacggcgtcaaacatttcgaaacggagggagtatattctattgacagataacatgactagaaatagaggccaaaagagatatcacttgctgagagttgcagttgaagttggaggagaggattccatcatgcatgtatcagatcaaagttatcaagtagtagcatatatacacccaatttgccgtggtttctttccagtcggacatacgaatggaagtcatcagaaacaattctattgcacacagggtcactgacagaaagagcgttggtttagcagcatctgcgttggtcaactgcacagacgtttcatctcctcttccatttccagagatttcctccgtggattcccaaagctataaaatcttggccaacttcgtattaagggagaggttaagctcacaatgtcagggatttgaggggctctgcatgcagtcaatactcaatactgatgtagccatatcacaacaggcaaaagtgtttgttgcataggaatttcatggtctaactatagtttcataccctagctagttagatcaaaattttacgctcacagctcattgaagatagtgagcaccagatcgatcagtgccacggttggtcttcagttcttcaaaaatacgaacagaaggagcacctatcctttttagtaatgggaataatttcataaataattgctcagctaaaattttacggcaatttacattcagatagaaattataaaatggagactagaagagggatctttcacataggcacaatgcaatttcccccatctagcagcgcacgtcatcccccgatcattcatgtggtggtgtttaccgtaggaataaaagtcatctggaatgataggtcatacttcacagctcttcattgctgaggtgtatgatttaagaattcaaattgcatataacctttttactgtaaaatagtaatcttaattctgtgagtagtaacacttcggtgcttgctctgacatgagttcaatcttaatgtagcatgaccactgcattacgcaacgaagcttgaagtctgaatttcaattcaaaactgtaatatcggagatatcggcaggaaagttcatgtgcatcatcaatt

SEQ ID NO: 47629 - DNA, 1779 bp, Oryza sativa
caataacattcgagcccaatgcatatgggtctccatgctgctattaaggcccaactgagatatatatgggccaaaatatttaagacgtgtgcggtggattcgttatgggtcttgtaggtccaaatgtaaagacttttgtctttgtcctatccaataaaagatagttcagatggtacattaatacttgttttctcaaaacacaaaaaatgatacatactaaaacaattttttacccttgaacactagtgcaacaaatacaagttaggacatgttacctcttcaatttccatgtggaaagcaggacacaccataatttaattctagttatattgctagacatatgctctttaaagcaaaagtgaataagtgatcagtgatcagctaatataaattcaactggtaaataattaaacaacatggctataaatactgcaacatatcctatgcacacacttatccttgtgcactcatgcactcgatcactctagaccataggatctcaaagaggtcatctctactgctgaagagaagttgaaggatcaaagagtagatgcatgcttcagcttccatcaatcaatcactacaaccatcttcaccaacaggctgttcatttctttcctatgtgatataccactactatagaaatggtttttgcagacagccaaaaacggtcttcatatgcgaaaaggtctgcgaaaatcgagtttttcgcatgcggatcctacgaatggtagtcattaggaaggaaagcacaacatatggagtatgatggggtaaacaactgcgtcatggagggaggcatcagccagatcctcgccggcagcgcaaaccaaattccccgctgaagatttgaagttgctacgccccacaagtcaggaggagcttctgtttagcagcatgctttctccggctctcttccatcgattgcattattcatcaactcctccaagctcattgatacattccaagagggttaacaaaggtctcggaagattgtttagctagggccctctcaacagttcaggagatgtaataatatccgtatgaatataatttggaggcgatggatgtgattgtatgatctgtgggagtcggacaagaattaatgtgtgtgatcttgctcaggatttgcattttcgatttcggccaaaatttcggtgatttcggttggaccaaaatttacgaaatttcgtgatttttggcactttttggaccgaaattttttaaaatttaacaattttttactgtatttgaataaagtttggctaaattcaaaaaacatttgagaaattctgaaatttttggtcgatatattgatttgccggtggggtccgaaaattcaaaccgaaattacaatcactgatgttgctaccagaagagagcaaggttttttcagtattggcaccatattttttttttatagatccggctccttggtcggatgagttatgtctaacaatagttgacacctaaaatgggtgaaaatcatatttaacatcgagattagcacaagtagcagctgcagtagattttgaggcgttttgagaaaaacaccttctaatgacaataatattgaaggcatgaattaaatttgccttgtaattaattttttttaataaatggctccaacaatatgccttcaaaatctcatccatcctgtagtgacatgggctcattgtcagcatgccaaaagtatttgaggcctgagaggatgaaagtataatatattatgcccaaatttgtagatggatcagaatttcgaccggagcctctggaatt

SEQ ID NO: 47630 - DNA, 12924 bp, Oryza sativa
  unsure (1)..(12924): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggcccgggtttagaaaaggaattttttttcttgaaaattaatctaatagttgtaaataatgggtccaccaaatttaatgaaaatatgattattttagaattttaagaatatttcactaatttattagagcatcacatggtaacttagaagcgtttgtaggatgtcgtaggacgaattaggagtatttttggaagtttaatggacttttagacatctaatataatgttctaaaacatcaattgggtcccaatttaaatgaaaatcgacggtgatatttatgtaaagttatagagtacgatgttttaactttttctatatgtacgtgtaagtatatatatatatatatatatatatatatatatatatatatatatatatatatgtgtgtgtgtgtgtgtgtgtgttctttcggtgtttctctgatcatgtattaagtacgtataggagtatgttctttcgggtttatctgatcgtgctatactcacgtatgtactcgcatgtctttttttttcggttaaagagtagcttaataataggattagaaaaaggagggaaaccggggatcgatggaaggggaggttcaacgaaaaatttaatctaatggtgtaaagtatcgggtccaccaatttaagtgaaaatcaacggttagatttgacagagccacgtggcggcataggagcgtttgtaggagccccacgtggcggcttgagagcgtttataggaagttttatggacttttagtatataatagaagatagataaactttaattactgtccaggtgcttaaaattctaccgaagctccattatcttagattgacaaacttttttatagaggaaaaaaaagccaggagctcctatttactgaaaacaaaatcgcggtacacatgttagtgttacaatttgaacgtgttgggtggtaaaatattctgctatctttgaattaattgttatgtacaaagagaccccatgactacacaccattcctgctataaaaaggagccacatatgttagttctttgctttatcgtcattgcaagcaatgcatccaacaattctggaacttactttatgcagctggaggttaattataggaatggaagtcactaggaaatcctgcttgtaacgccacataccgtagttctctttatgggtctctgtaggttgtgtcatcaatcttattagtgtccgaaatccccttcttccgcagattggggagcatgcaaaatgctcctctctgcgatcgtgatctggtcctagagaaatgcccaagtcctcttttgctaatgagcgatatccgagcatggtagctagcggaaatttacatggacggtgcaaaatgaagagtacgaggaacatattttgttcaaacagttcctatatattttttaagtacgaattatccccctaaaccataaaaccagatattttacaccctcaagttttcataccgaacaaataaccctcctgagcactgttttgaacggttttggcttgagcttgtacacgtggtaccaatgtgacaatctagttagcaaagaaaataaaaaaattcccggggcccacatgtcatacatatcccaccgcaccatcttgcatgttctttctgtcgctcaggtagctggcagcaaaggtggacctcgctcgacgggcggtggcagcagcagagcaagctcgagtggccggagttggagacagaagtgaaggcggagctagctcgggtagtcgcagtggaggcgacgggctcaggcgaccccttgtgcacgcgcgcgctctctctctcactcaggtggcctgcggcagaggtggacctcgctcgggcgggcgatggtagcggcagagcgaacgccgccggcgacacgcagaggccgatgaggaagtagatgcttgggagctccaactcgaacgtcggcagcgtctcggtggtggaggtgaggaggaaggttagcgtgaaggcgaacagccccagccgcttgtgcgcgctggcctcgccgtagccggcgttgatgtagatggtctcgagcagtgtcctcacgagaacatactccaggaagttggtcagcagcagctgcttgcttcggtacaccaccttccacgcccgcttgtacaggaccaccacctcgtatatcctcgagcacggcgaggttgacgacgacgacttcgaggacgtgacggtggcgagctcctccgtcgtcttggtgttaggaaacgataagccaacaaacgataaaaaacaatagatcaattacaaaagacacgagatttaacgtggaaaaccctcctaaaacaggagagaaaaaccacgggtgtcagccagcaaaatatctccactctatctggggtgaggttacataacagtacccccagctaaaagatgtatataatggagaaaccatagaaaagatgatgatccgtttatatgaaagtttcagcccccgcacccgcgggcgtccccaggtgcacggcccaatgggccagcttcagcctccgctccactacggtagaagttggccttcattaagtgcaaatgaatttggatcacaactcaacaaactctaccttgagacaaattccttcttgtagcataaaacaatccttcaccctgaacacaacaaagaccaaaacactttcggcgccaaatagcctcttgggctaaaccattataccaactaagcttgagcaaggctcaaacttagcaacaggaacaggctttgtcatcatatcagcaggattatcttaagtacttatcttgcataccttcagcttaccttgcgcgactacatcgtgaacataatggtacttgatatcaatgtgctttgtcctctcatgaaacatctgatctttagtgaggcatatagcactttgactgtcacaaaacaagttaatgcaagaatcaactccacaaagctcagcaaacaatgctttcaaccaaactgattctttacatgcttcagcaatagccatgtaatctgcttcagtggtagactgggcaacaacaggatacaatgttgccttccaactcacaacacaactaccaatagtaaacacataacctgtgagtgaccttcttttatccaaatctgcagcaaaatcagaatccacatatccaacaagccccttatcagtcctgccaaacttcaagcaagcattagctgtgcctctgaggtacctaaaaatccactgaacagctttccagtgttctttactaggattagccatgtatctactaaccaaactcatagcatgagataaatctggacaggagcaaaccatggcatacatcaaagaaccaacaacactagaatatggaactctagacatgtattctacatcctcatcagtactagcacattgtaaagcttataatttaaaatgaggtgcaataggagtactaacaggctttgcatcatgcatgttaaaacgctgaagaaccttcttaatgtagctttgctgactaagaaataacaaaccagaatttctgtctctagtgatttccatacctagaattttcttagcagcaccaagatcctccatatcaaactcactactcaactgtttcttcaatgtagtgatttgttccttgctcttggcagcaatcagcatgtcatcaacatataacagcaagtatataggtgatccattaacaaatttaatatacacacagctatcaaattcagacctcttaaagccatgtgacaacataaatgaatcaaaccttttataccattgacgaggagactgttttaaaccatacaatgatcttttcaacttgcaaacataatcctccttaccaggtactatgaacccttctagctggtcaatgtatatctcctcctcaagctctccatgtaaaaatgttgtcttcacacctaactgctcaagctcaagatcatgcatagcaacaatactgaagaatgtgcgaattaaactatgctttacaactggagagaacacatcattataatcaataccagcaatttgactgaaaccttttgctactaaccttgccttaaacctcggaggctcgctaggacataaaccctcctttctcttgaagatccatttacaacgaacatgctttttctgttttggcaagtgcacaagctcccatgtgccattcttctcaagagactgcatctcctcctgcatagctgagatcgacttctcacggtctccagaaacaatagcttcagtgtatgtggctggctcaagagtattctccacctgttcagcacaactaaaagcataataaaccatatcacatttctcaataaggcggactggagctccacaactcctctttgttctgcgatgtgcaataggttcatcttgtggtgcaaacaggaggtgagtgctgaacaatatcattaatatcgttaccaacaatttcagtttcctgatcatccacgtgctccacctgcacgctaacatattgctgttcctcatcagaaccacctggtatgacatctgtgggcaagctgtcattaaacataatagattcaatgtaaacaacactcctgctcatgaatgtcttattagtttgaggattccataacttatatccttttactcctgaaccataattaagaaacagacacttaatagctctaggctctaattttccattatcaacatgagcataagcagtgcatccaaaaactctccactgtgtataatcagcaggcataccagaccatacctcaatgggagttttcttattaagtgggatagaaggcgacctgttgatcaagtagcaggcggtgttagcagcctctgcccaaaaacgcttgttcatgcgagcattggacagcaaacaacgagcctcggagatgaggttctgttcatgcgcttagccacaccattctgctgtggagtgtacgggatggtgtgatgcctaaggatgccttccttcctgcagtaatcatcaaaagcatctgaacaaaattcaccaccattgtcagtgcgaagtacttttacctccttttaagtttgcctttctatcatgactttccactctttaaaagcagcaaatgtatcatctttatgtttcaggaaataaggccacacttttctagagtaatcatcaataatggtaagcatataacgagcaccaccaagagagggcttacgagaaggcccccacaaatcaacatgtatataatcaagtatacctttggtgcaatgaattgaggtattgaattttacccttttgtgcttaccaaaaacacagtgctcacagaacttcatgttaccctgagtgcagccatccagcaggttcctcttcatcaattctgctataccaagttcactcatatgtccaagacgcatatgccataggttagtcctactagcttcatctttagaaacagcagcagcggtaacagaaccatgtaatgtacttcctctcaggacatataagtttgtagaattcatatcaccaatcatataaacgagagaacctttcgatacctttacaactccactgaaccggagtatttgtatccttctgcatcaagtgtgctgagagagatgagatttctcgccatccctggtatgtgtctcacatatttcagcgtgcgtgtcatgccatcatgtgtcttgatctgaacggagccaatgcccatgatcacacgtgggttatcatctcccatgcgcacaacatctccattctgcacagacttgtaagaactaaaccaatctctgttaatgcagatatgaaacgaacatgcagtatcaagtatccattcatcatgattagcaacacaaccagcaaaaacgacaagacaatctcctgaatcagagttatcagcactggtaacaacagaggccttaccatcagatttccttttctccttattctgcagattccaacattcttcaatgaagtgatttttctttttgcaatacttacataattttttacctctactctggctcttgtcatgatcattgctgtcgttgtaggttctccgctcaaatctgcctctgacctgcaatgcttcgcccttagaggacgatgcatcagattgaaccatacctttcatcttctccctgttttggagcgcctcatagacttccgctagggttagttcatcatggcttaaaagtatggtgtcgcgaaaatttgcatatgaactaggcagtgagcataacagtaaaagacctaaatcttcatcatcaaactgtacctccatcgacactaggtcggcaacgatctccttgaagaccgatatgtggttcaatacagaaccactctcctacaacttgtgtgagaacaacttcatcttgatatgcatcttactggttagatctttagacatgcagatcgattccagtttgagccaaagttctgcagcagtcttttcctgcaacacttcttgcaaaatatcattagatagatgaagttggatcagcgacagagccttacgatctttccgcttctcctcagcggttcattaagtcgatttcttcttcccgaagctttccagcacctcatcaagatccaaagtttgcgccagaacagcccgcatcttgacttgccatagcgagaatctcgtcttgtagtctagcagcggtagatcatacttcatcgacaccatcgcgaaaccctaatgtgggaacaagctctgataccacttgttaggaaacgataagcgaacaaacgataaagaacaatagatcaatcatagaagacacgagatttaacgtggaaaaccctcctaaaacaggagagaaaaaaccacgggcgccagccagcaaaatatcttcactatatctggggtgaggttacatcgccgcacggcggcttacaagaggtatatatatggtggaaccctaaaagggatgacgacccgctacggtagaagctggccttcattaagtgcaaatgaatttggatcacaactcaacacttgggctcaggggaggaggccgaaaggtagggcagctggtcaagcacctagcggatttaactaggagaggagcacggcgtcgagggagtcaatggagcagtggtgcatgacggcccagcaggagaggaggaggaggagggagtccacggcggagaggaggcgcgagctcggctggtggatggagagcactaccgtcatgccacgcgcggctgcgatggcgcgcaggcagccgacgacgacgtgcggggggaggaggagacaaggagtcgaggccagaggtgggctcgacgaggactccgacgtgcaccacatccgcctcccaaacttccctgcgcggcgtggaggcgttcgagcagctggcggccaagttctgcaacggcgtcaagcttgacctcacgccgatcaccgctgcgccgctccgctgcgccgccgagcgcctcggcatgtccgatgaccactccgacaacaacctcatctccattctcccgcgccgacaggttcatgtcccacaccgtcctgaggaaccccagggacgccatccgtgccctttggtcatgtgagggcctccttcccctcgccgacgacctcggcctcgtgtcacgctgcgtcgacgccattgccgccaaggccgccgcgtccactcccaccgccctgttcggctggcccatcaccgatgccgctgccggcgaccgtcccgcgctgccgccgcctccgcatcctgcggcgccgcccaccgtcattcacagtgagagagagagaggtagagagaaaagagagagagagtggaaaaggagtacgataggtgggtcctacattttttttaaataaaatgctgactggattgccatgtgtacactacgtacgacagaaccgctttggattggatcgaggggggtaattttgtcaagtattgaaagtttagggtgaacgatgtctggttttcgggttcaggggtgtatttcggtcgaccgggatagttccgggggggggggggtaattcgtacttttctttttttttattacatcgaaggggacagcattttaattaccaacaaagatgttgaatatgctttgttttacacaagtcttatatatatgctgagtaatcggagagttaatttttcagcctaatcttacctgcagtgcagccgatctgtggatagagtgagataagcaccgaaacatcaaggcatgagtacagacaagtttgataatattgacacttatgtggtattattacattgatattattgtacaaaggatcctttcataatcttccatgtacgtaaggctgaggagctcttttttttttgtttcacaatattggagcaatatatatatgaattcaaacattcactttgaaattataaattggacagtcgaataacaaacttcggctagaagtatgagggacgagcgctctgtgttcatggcaattacctatcctagcgataggaatgatcttcacaaatttgtcatggaaatggaaggcatgaggaattcaatttcatcgtacaaacggagaagattgtccgcgtttgctacaggaaggggagtcacttaaaatcatggaatgattctagccaggtgggttcagatgtcttgcaagaggatgctcatccatggccaaatcatctcagatctgaaatgttttagttcgctcgcgcgccttcttgctcctagtttgctctttttctttcacaagatatcgtattaattagtgtactgtattctaattagcatcgcagattgtatgctatacggaacatctcgacacatttgtatttttcgatggattaactttatttctttggggttaaattcgatgctgaatttgccttaagaggaaaagtagctacaggaatttgactacatatataatgctgtcatgtttggagtgattaacacaggccaagttaaatccataggaagagataatgatcgtcagcaatattgttgccacaagcattgggaaaaaaaacgtgcataaatcatatgagcaactgagaagaaatattttgtctctctgaattgcttggaggaagcgctctcacatgcactcactattttatcttcactaagatgtttcttgattgtattcagagtcttaatgctctgtttttgactgacaaaatatgaacacatgcctcggacaatcttattatatcacgtctttgcttcaaaattttgttttcaattcaacaaaaaacactccaattctattttgtgtctgctcgacaagcccaagcggccaaacagggttgctgggcggtggatccatccctgactatatgggtacccaatagtctgttataattcaactaaattagttcaaactcatatttttttttgttggaatacaaagtgaattgttcgcttttttcctcatcagcttaatcttttgggttgaactggtcggtgcacgcaactcaatatggtatcggagccgaaactctcgagttcgaatcctggctggcgtgcaattaaataaaaagtgcagccccttgaggtggcctcacgtgagggggagtgttggaatataaagtgaattgtccgactttccttatcagtttaaacatgttataaaaccagccccgaaatcacatcagaaaccaaaccgtggaagaaaacaccataggagatccaaacgcgatgacagcaccgaggcacgatatttgataaaggagttcagctgaggcctacatctccggggcactgattacggatgctcctccccgatccagcatattacagcgtctcagagttacaacgactgacgaccggacgctgccggcagtcgctccctctcgctatgctaagttgccatgcggttacaacaggcacatctctctatttatgagagatcataggacagagtccgaatcttactctagtcctaatacctattataactccaagttctaaactgtaaccgactacgtacacatattcgacacaaactcacacatatttgacacaaactctaacacgatcgttgtatctagcaatgcacatcctatccagctagatttaacaatcgaaaatgatttgttagcgtgttgtactggtatctcgaggttccttttagtgtaccggagcaaaatctcttataaattggacatcagaactcagaatttcacatagccacaattttgtctttgcaagcatagcacatcaggaacaatcattcaggtggtgatttaccataggaatagaagtcatcggaaatgctagcgatgctacacaaccacatccgagcaacccgattgtccaggtgctttgattaaattcaccatggcatagctaacgtttttattacaaatagtaagcttctgccgtgaataattttaataataacttaacttctctagatcttacagatgaactatctatccacaattaaacaatctgtcatttctaccattatctcacggagaagctctgtcttttttttttctataggatggcgcctcccagcagaattatgcctcatctgttttcaggttgggtcaggctacaactcagcaaatcgcccacccatcaaattggcctccaatcactcgatcatcgtctctaatatgcattgtgctcctatgtcgggatattgaccttcagcaaagaagtcaaattaatctcttataccgattcctaatctgatatctgaaacggatggttgggtctacaacattacaaagaaatacaagttctaatgccgagtttagttccaaaatttttcttcaaacttccaacatttccatcacatcaaaactttcctacacacacaaactttcagcttttccatcacatccttccaattttaaccaaactttcaattttgacgtgaactaaacacaccctaagttaaagattatgctctattttataacatgtagtagtagatttgttgtatcaatgcatgaaaaagtaccattttcaaacgaaaaatatacagatgaatagcaaaaataaagcaaaagaagatttaagcaccttatatagattcaagaggcctcctcactgtgctagattatcagtcacaaatcccaacgtaaaagtttggcatcaaacaaaacatcacatgacttttgtttctctcaaaattgtagcattacaatatggtagttaattgaaccaacggaaaatatttattagtaaaaaaaagggctaatcaacaaagaaaaaacaaatcaaatgaccatacaaaagaaattaaatcacaaatcaatatagaaaatatattttattataaattagatacacgatgttctgctctagctatgagctttggcattattaaatattggtgtggtagaaaccaaccaaaaagatttgtcgttacaaaaatgctcctagaataaataataataaaaaaaatcaaataacaatacaaacggaatttaatcagaaatcaatatagaaatcaaaatagaatgacggacttttacaatttacacagatggttgtgtgctctataagctgatccatgcctttgcgtgttctcaaatttctgtcatgccctaaacaatgttgacaaaaacaatggatttataattatctactaggggttaaaaaatatttaattttcttcagttacacaaacgggctaactaaaataaggcgcatcaaatgacacgccaattttctagttaaatctgaaattaaggtgagtaagtccaattatgtcttcaggaatagaaatgaaattaatatgttccaacatattcctaatgtggtacaacactgaaaagttgatagagatctactctggtccaacagtatgtatatcgagatactggtacctcacggtactaaatcgtttccgatcgttggatctagctgggtaggatatacattgttagatcaaaccttctgagcacaatgcgcaaatcttctttgtctcttcttgtctaatgatacggatagtccttatctatataaattaaaacaaagatttacgcaatttcaattcagcactagaattaatatgatggatgtgaatgaagcatattctcaaaatccaattagctcaacttgtgtagttaagggactcagaatgagagtgtgcttaagtgcagatcatcagaagccgtatttatgtgatcactgctctaacaatcacaatatttattgcatagctatttcaaggtctaactgtggtttcatagttatcaattgaggatttaactacattaattttgaagatagagtaggtatccgactgacccattttatctgcacccagtaccaggggaaggaacatttatctctgcacccagaatgggactgtccacatctacagactgtgcagtgtgcacccaaaatgctccctaggaataccaatgtcgtccatctttttgctaatgatcattgatatctaagcaacagatgatggattgatgtggtttcatgcatattccaggacttcaacctggtccccggctcctatttccattcatgtttatctccccgttaacattgtcacggccagataaactttacttggatgatgtaaaaatgaacatagagttgaaaatgcttctatggtgaacgaaacatagatgataaataaatgtcaatttcgatcagacacaactgttacatttgttcgatagcatccaaggaggtaacagtgtaccaacaaagatgtcgagatgttggatattaatgtcaataggtactaattgtaagctatagctactcttttccttgtggagttgaagacaagctacaggttctctgaatacactctgtatgtttgtaggtgttc

SEQ ID NO: 47631 - DNA, 8943 bp, Oryza sativa
aagaattcagttttcttttgtttcttttgagtcttctcatgttttttactttgccttctgtaattcaccttcttttcagctctttctctctttttaccttttatccttcttcttcccctgtactgtttccttcctctttctggtttgccaggtttatctggtattgaccaccattaatggttataaggtagagtctctctaccttttgcgtaaaaaaaaaatcatcatacgcttgaccagaacgagtgacctaaagaaccataggttacagggtgtcttgcaacaggattctgaaatctgaaatgcttggttcacttatgctccctgattctctgtatgaaaaatcatgaatatagggaaaatcatgggaagagataacaaccatcaagaatattgttattgtctcggttctatttgcaacaagcatttgtaaataaaattgcataatcgatatcagaaattggaaaatctttttttttaatcgattacatggaagaagagctctcacacaccacacacatacactgatacacacctccgagtatgtcatttaattaagacacgtacaaataggatgatgactgccctggatccatatacagcgtaaagtcctgcgagtatgcaagtttcagagctttgttattcttccatttggctgttttgcatggaattgtaattctccgctatgccttgcgcagaatttttgcgagttcttgccagtaattagtataggtaatagatcatctcgactgaattactatgaaattcagggcttgcagctcaaattcaagtggttcagtctcacttttatgatccgttggcatgataggcttcggaaatactagcagtacatgtagctttaatcgatccaccgaacttgagaaatcatggtaggttggaatggaacagagtgaatttctggatcctgctttgatggccatggatgatcatgaaccttctgagcactaatgtatgcccgaataatctgtctctcttcttgtggaatgatatggacagtccttatctatatcaaagtaaaacgaggacttacgcaattttagttttgcactactattataatatgatggatgtgaatgcagcatattcttgaaatccaacttgctcaacttatgtagttaagggactttgaatgatgagtgtggttaagtccagattatcagaagctgtatatatgtcatcactgctctaataatcacaacagggcagtagtacccagggcttaatatttcagtttcaggtttcctatcggtggtggccgaaataccgaaattatatgaatttttgaataaaacttgatcaaatctgaacaaaatattaccaaattcacgaaaaaaatgaaaattttttaataatttcggctgaaatttccaaattcactgtttcagccgaagtttataggaatattgcctataaatttcaaggcctctgcatgtggtttgattgttcttagctgagaatttaactacatttattttgaagatagagtgagcatgattttgtcacatgtgatcactcaatacaagcgaaggaatgtttacataggacagaactgagaggtaggggctcacttttggtaatctgcgaggttcataaagccgtctgcccgtatatctctaacaactgctctgtatcatattttaaccaacataattcagacagaaactataaattggaggtcatccaaactgagaacttcagatatcccattgtccctagctaacagaacaaattggctcacagtcatgcaagtggagttgtttactgtaggaataggagtcatctggattagtgatcaaggccggttaatctattcttgtagtgatgctgtaacgctttgcttttcgtgaggcgttaaaaactaattcggcgaaaccctaattgcgaaaatttcgttctttgtgtgcgagtctaagtcgtgccgtggatctcaattcaaatcctgttgttctctctcatcgaaatcaaaatcatcctcctcaaaatcatcatccttctcaattcaagtctccaaatcaaatttcgaaaattcaatccctctcttttgaatcctcgccaaataattgtccccgtcctaaaaatatcaaattccctttttgaatcctgttgtcgactcctccctctgatccaaatcccaattccgaaagtcaacctcttccttgaactcgttgccaactctttctctcgagttcgagagaattaatcctcatccgaatcatttccttgactccaccctatgttcccgagaacaaatacccaagttttccttttgaatcttttccttgacttctccttgagcctcccttgatacatccctaaacactcgagttcgaatatcaaatttgaattcgaatcgaaaccctaaatcctctccaaatcaatcccttcaccagaagtctattttacctccttcttggtcgattgggccgtttttcccttccctcggcccacttccccatcggtccacgccctggcacgtgagccgcgcgtgaccatcaaggaggagagcgccgttccttctctttctcccctgcgcgcgcgctctctctctcatcaccatcgtcaccacgagctctgccgttccatgccgcatgcatccaaacccgggagaccgagctcgcgtttccctctctctctctctctctctctctctctgtgtctctctctctctctcccgacgaactccccccggcgccgattcccgtcgccgccttttcgattttcgccgcgccctcgctcgtgcgtggccgaccgcccggttgccaccgcgtcagccctggccgcctgcaccgcgcagcagcccatgccgccctgccactcgctccaccagtgcgcgcgtgcgtccaagacgtggaggcagagcctcggctcccctctctcacgtgctctccctcctccctctgctcatccaaatcggcaaggagccgagctcctttcccctcccctttttgctttttccctctcagcccggccgcccgtgaccacctccactgctgccgcttggccgctagctctgagcacgaccgccagccgagctcccttgaccacctaagtcggtttcctcccccaaaactgacttcccgtgcctataaaacccaagccgagctcctcctcctctctatccctctcgtcatcgcctgccgtgccttgtcgccctgctcggctcgcaccgtcgccattcgtcgccaagcaccagggaggccagtgcatgagtggacgtgtgacgaggagctccgggcacctcttcttccccttccctggccgctcccggagagcttgctcccgcgccgccgccgctcgtcacggcgccctgtcccgacgcggtagccctccgttcctcttcctcactcgccctcctcctcctttaactcgcgtggtagctcggttagccttccggtggttcgtaggcgccgccccaagccccgccgccgctcgccatggccttgccaccgtcggcgcccgctcccggaggccgcctctcgtcgccggacctccacggcgcctccccaccacatccgatcctagaaacgaaacccttgagccccggagatgctcccatccctttgaatggaaccctcgtcgtctcgtcgtcgtttccccctttgctcgccaccggttgccgccgccgcgattcgccgtcaccggctaccctccggcgaatctgagccgttggctcactctctcttgtcctccttgtcgttccaatgtgctccccgtcgccctcgccgttgcatggtgtccaggtgaaagtgccgtcgtccgccgtccatctcgccctccccttcttcctcctcccgccggcccgcgtggctgccacgtaggcgccacgtcagcgccacctcaactttgaccgagccgagccggtcagccgcctcctccctccaccaccctcgcgcgcgcggtccacggtgcgccaaccggctgcgtgtgggcccgccgcatccctggtccatccggtgcacgcacgtgaaccgcgctcacccgaaaccctagcaccaccctcatgcgccgctcccacggtgagccgcgccaccgacaagcgggccccactcgggaccctggaaggtggactcggcccaccagccctctctctccctcactctccccgcgcccccttgggccgcctctccgggccggccggcccattagttcggccaagccgtgcctctcctctcgggccgtacccaagccgcccgaggaagtctaaatcatatccctccttcaatttctttccaaaaagggtttaataaattattaaatcctttttcctttagacagaaattccttattccttagaaaatccatatcttctcaaccgctcatccgattgaccccgttccacttctagtaattccgtaaaattgagatctatttaatggcactattatttagtctaaatagggtatttttctttgtcttttgtctaggttttcgattgtttgcgtatagttgcggttaccagatttccgtcaaccgcgggttttctcgaagattcgtgaagcttcgtgaagactttgagcaaggcaagtcaccctttgatcaattgctcctataattggaaaatcattattattttgtttgcaactcgcattattagaatcacatacttaacttgcttggcctcggtttgtgtgccaaaccgacggacctacccagtagtcacactaattcctgtaggctgtactaccctgattccttgtcgctccacccttgtggtacttcggtatccgtgctctctgagcgcgtatacctaatatcccacatacaccgttgattgtcgaaaacttgggaaatgggtttgtgaagccttcaaaacccgacatgtggtgtcggtgtgttcgaaaataaaataaattgtgaaaactcgcgatgcgggggttgtgcctatgtggcactgtcccgtatttgtatataaggaccgattcctgtgggaaactcatcgaacataatcaaagtgcaaccacaaggtggaatgggacaccctggctaattaactagtcggttcagggaaacctcgcatgccaatagttgggaacgccggggcggggtcggacaaaccgggttcctggtaaggcaaggacaataagcttgctcacttaccgatcaaggtggctggaattaatttgtgaatgcctaaaatggcctatagttacgtgaggatttgatccttctatgtggcatgaggtaaccctgggtcggcttgggaaaggctttgtcacgaacctctgacaccagccagtgtctagagtaagttcgtgtcttgtgggtaaagtgtacccctctgcagaggttaactaactattcgaacagccgtgcccacggtcatgggcggatgtgaggtggttcccgttgtgtagatttgtttgcctgtgctttgtgaaaagttattgtggattgggaatcgtaaccagaatcagcctatgtggcagatggatgacctgagtggtcagaaacgaacctgtgtgattcgggatgtctgcgggcatcatagactaggcttctcgagtggaagcagattgctttgctgctgggcagctggactatgggagtccgcaaaaatgaaaaaggctctgggagctgcctaatcaaatgaaaaaagctctgggagctacttaatcaagtgaaatggctctggaagccgataagtaatgatctgacccggggggtcggtacattaccatttgagttgttgaaaagcatctcttaagtcgaatcgagacgcaagtctccttttcgacccaaacttaaaaagaaataaatcacttagtgatttcaaaaatgatttcaaacaaaggatttgcaaaacaaccttgcctctcttccaagcttgcattaaacacctaagttcctgtgacttgctgagtacgaaagtactcacccttgctctatataaatatatgtagttcctccgtcctgaagctgaagatgaagtgaattgaagaatagggtttcgtcctggttcccagccgtcgcctgtggtgttgggtgttagaccgttggttccgctactgttgctgttgctggtgttttctcgtctgtgtcttcggttgtattctcaggttgtcctgagctgcaacctaagttaaggtaaataagtcatctatttattttaaggatttgcaatgattcatatttgtcaccgtgggtaccagcactatgtcctgggactggtactgagatcgcggtttcgtaggaagcggttcgcgccgttattcctacgacacgctcctgtcaggtgccgttgtacggcggtgccggattggggtgtgatagatgctcattccttaatactatgatttagggaatatcatccacaggtgatagacctgtagaacatatgggacaccagcagtcacgaagcggttttccggagtaggttgtaggagtgagtatgtatgcattgtgagcgcctgcctttatacctttcttctcaaagaaaaatgaaacagctttctggcgacggagaatgtagatggtagtcaagaatgaaaactagatttacatgtagtcaaatgttccatgtgaaatggacgattgaattgaaaattgaccaggttttagagaagcaacagaagattaattaagattttgtgacagctgaacaatcacgcttaaaacaagcagtcagtacagggatcaaaatgtaataacacggtgacaaagagtaataagagtagatttctgtaatttgagtatgtacggacttgtttgctatttattgttcatgaattatctctttcttcatgacatattctacttaatatcatcttttcagtaatcttacatgattttcagcgacattcatggtttcctggagcaacgagtgggtaacagaaatttacactagatgccatgtgcaaagggcccaggtcattgtgatccctcattcttatatattgcaggcatgaacaacatgatgtcgatacttttgcaacaaaaagttatgaaccatatttccagtcaagttagctatctcttagagtatactacatgaatgggagtcaccgggaatgctatgaatacaaaattaatttgtgttcctggcctggtcaaggacaaacttgtgtcttaattggacaaggagacatatgggacgatcaactaggtttttaggtgcccaatcgtcaatttggatgggtattttacaccttctgctcaagcattaatataggcatttgaccctaaaaaaatactagtatttgacttccgttctcaaataatcattcatggaccatatctctcgccaatcagagtcaataagtcagtagtgccgctggttggcttgccgccactggggaaccaatgctttacatgcaacatgaaggaatgagcacgccttgttcctgtatcatctgtggtgttggggagaaggattgcgaccttgcaccattcacccccgttggctccagggggcctccgccgggaggcctgccaccaacgcccggtggagtccatctccgtaggaaaggcccttatcggaggcctaggaagccgacggaagttcggagccaagcaaagtgccccggggacctcagagcccagtctagggccctgaaggccacggagctggctcaagggccccggaggattcggagctggctcaaggggctccaaagctcttaccaggagtttggggccggagcctagggaggacaccgggaatgagcatgggccgccattaaagcgcattacttatcctccaaccaccaccgatgtcacgacacgactggcgatgtgaaggccaatgctagctattgcctgggtaaaagctactactatgatggcaccataccggcccccttaatgggcgcagccgtctcccggtcaggcgaatggacccccgagccgttggccagcccacctatcagccacctcgaggtaactacagtgataggggtagatttgtaacttcctttgtatgtaacctagtataaatatgtaaatactaccctcagaaggggtacgagagaaatagacagaaacttgaacactcgtaagttctgttccaacatgttgattaatttcaattacgcatgcatgcagatcaaatttgattgtattaacaagaaacaacctttctcagggaagccaaaaaaagcaggagacatggttgccaaaatccaatcagggacggtcaatgaaacttgcaaatttatttaactctttagataatggaagctttattgaaactcagtcaactacatcgagataatacaaccaagctgagctcacttctggcctctgcataaagatacataaagccggaaggacaccaacagcaaacccataaagaggatagccattcttgtgctatcatccacaaacgagaacttcggaacactattgcagtggtctctcaatagttggaccatgtggtactggaattttttatcaggagcaattaaactatatgtttacggatgctctagttgatgctgctacttgttgagtataaatatgatgcctatgaatattgttgcctcccaagtttcattgttgtcctcatgttcactcaaatcgtcaatgacatatcatgtaggcttggtaagcattaggaacaccaaatctaaggtaactccacttgctcgcctttatttagttaagaatgttgcgagccctacacctacatagtatgtgctcgtttgcaggggacagggttagatccaaagaaccactgtcttcattttgcatcctgcctgagccatgtgttgtcatttccttatgaacaaatgcaaataaaacaaggatagaaatccaaattgtgcttgtaatttccggatgttttgcctgaacggcttgatgttttaggagttggacagtactgtaatttcagatccatgcaactctcatttgaacaaagtactgctagtcccatctcaattatacacgcttgtctagaccaccaaatgcttcccaaactggtgt

SEQ ID NO: 47632 - DNA, 1698 bp, Oryza sativa
ttacaaagattaattaagaaagcatagatgaatatagtatatatagcctggtcgaacatatcctatatacttagttcatccacactaagtgtagctaatgctatttctctctattttcattaagctacatcaccttggaaatcagtgatgataaagtgatacaagagttgcagtataaaggtgaagccaggaaagagtttggaccttcatgctccctcaaacagaaaatgaacacctctaaaactcatcgcctccatcaaatatacattgtaggcttgggaggcactggaaatactgttggcgagtggtgtcgtattacctgcccttataggacatgatgcatcatgcatgcattatggctgggagcatgatatgatacctctagtatgtaaactaataattagtagcaggttatcttgagtgaaaagtcatggttaaattggactaaattagagaagtacatcagaattggtgtatctgattatatatgcaacttgtttttttctggtaaaaatccagcatgattgaaacaagtgcatacaaaatacctaaattctatagtagctgattcgcccataacataggtgatgaagtactgaatgtgcagtaggttggatcatatccttggcctctttctattggtctttcatctcttcagatatcaagggatagggattacggattatcatatttggaaccgtttttcagtctgcccacccaacttgaaatatttgacacacacacactctctctctttttttgtgaaaacatagttgtgttttcaatgaccatatgtggacatagcaagataaaccatgctagcaactgattacaaatttaaacaatgctagtatatttcactttcttttgccgctagcaactgattacaaatttaaacaatgctagtatatttcactttcttttgccgaatcatatgttgtcttttgcaccagaatattgtggctcgcaaattgttagctcatatcttgtacgacgcgcaaaattttagcattgtatagggggaggtgtggcatatatatatgacaatgaaggctacatggtgtcaagggaagaaacattcctctttaatttcagttatatatgtggatcattgcaatgtttgatgaattgaaggtgcttaactgcaaaactcaatttagcacagggcattgagttatgtggcattttattatgtctttatacagtttactaaaatcaaaaggagatgcgaataagcactataaactatagaggaggtggaagagaccattgcagatgatgcttggtcgagctggcaaatgtcactaatgctccacaggtttgagaatgggtggcctctgcaaaacatcttggacagagatcttgatcagttgcctggtctcactgccccactgcaaatctacaacacctttttgttaaattattgataaatgaggtcgacaatactgtaggatattgcaatattagcatagcatcgtggttactagaatacctgtgtaagggtgcaagtagatcagccgacagacctagttataagcaaataagtgggtaaccgcaggtcaacccacttaattagcaatctattaataggtttgcatgtcgatccacttgtacccttacgcctgtcatctaacatcaacattggatccttgccatgttcttattcattggagaaatgacataatctgtgatcgagca

SEQ ID NO: 47633 - DNA, 4516 bp, Oryza sativa
cagtggtttttggatgttcactaataagcctgcactactaggatgggagaggctccctagtgtcgaaaacactcggtaacaatgccaggacgctaggtaactacttcaaacacccagtaataatgttgcagagtggtacagcacgcccgggagtgatacgaggttcccgtgctgtctttcggtgtgttttctgaaaaaacactccgtaacagttgggaggttacggagtgtctacaatacactctgcaaagttccactaacggcatgatgactatccaaacggagacactgagcttcccgagttttatatattgacacgtggacataacgggtatagccacgtcaacagcacgttacggtgtgttcttagctgccactctgtaatatcaaaaatcattaccgcgtgtccttttgcttgcaccactcgggaagcactaatagaaccattttttaaaaaatatatgcatttgctagttgagggacactaacagtgtgtagatgaaatcttaatcaacttgcaataaacctgttagagcataaatacattcaacaaggtaaagtattccatcagtatgttatattgattgacatgcaaatgtaataaaaagaagaaatattcaacatacatctcgatctaagcatgaaacaatgtactagtcctacagaatcctaagaaaaccgcaaaaaacagcttaagctcttcatagttgaagcaccatcctgaactctatcaagaatgcaacacacaagaatcatgatcaagttggcttgttggagtcttggagaccataacccactgagatccaagggcaatcacctaaaataatatataatggtaaagttgcatcaagtatcatatataaccaaccagcagtaactgcttataacctaatctaagaacaaaatggtatgtttcaaaatagacaataataagtaaccattattcatagtacaaggattaaagaacacgattgagaaatagggtggagtatcctaaatagttgtcactgtgtcaacaacaaacttcactatttattcatctaacgagaattgacaaacatgctgatgttatgatttggaacaatcttaaccagttaacggttgaacggttgagccagccaaccttgatttgtgctacttatagggtagatagcacaaaaagtgcaacacaacaaatattgaagttcagactttgagagatgtactaactaaaactttaagagatgttgtaaaactactaagttctctatacgttcttacctaaatttatccattggggaagctcccataagcctcacgttgatcatatctgaaatcatgagaagacacttaaaaatttgtgaccaggagaatggctagagtaaataaaactagtggaccataatgtttgttattgagagtagaggatttttttaacctcgcagcagtaaacatcatagaggatacacaatgacggagaatgcatcattacctttgaatttgtgaacaagttcagccctactaagtatagatatgcttgaacctacagaagtatgcttccaggagcaaactgctgcatcaacaatgaaatgcatatatttagcatgtacattagcatcagattattgtctaaagtttagagtttaaaccacataaaatacaacattcttaacaaattttaaattcccttgcataaggccttgttcactttggagggtactaaagatgattggagggaaataattccacaccccagtaggtgtggaataaatcccctcaaatccctccttgggattaactgaacaaggcctaaaatgagccaggattcttgctataaggccatgaaatactattattaatagcttttcaaccaaaatgagacataattcttgcttttgaataatttgcatataataattaaaatagctactcttcagggttacgataagttcatcctaaatgaacaatatcccttggtaccacgtttaagaatgatgtacaacaaccacttgaatgattttagattagcattgtaagtagggatagcattgtaagtagcgcactaggcatcagtcatatccactgcaagcacatgataatcacaggatgcagagtccgaaattatgtactcaccttgtttttcccaaatcactgcatcatcccagagctcaggctttggcaccaccctctgctgcacggctaagaatgctcggctactaccgtggatccacctgtctatgcaagcgcattaaagcttgtgcccaagccactaattgagtcaactaataatctccaataacctgtcaggtaaaaaaaaacatcacagaagtacatcataagaagtattttcttaattttattaggcagtcaacttataatacagggactatttgaagaccattatgaagcaatttcactacactacaagccatccagctcattgttgataccaatgtaagtagttagacaaattattttaatgtggcttgagatgccaaagaggactggtcgctaattgacttgctaagcaggtcttgctactgctggtggctaatgatgccgcagctataatgcaaatggcgggggaggaaaaggtcttaccttgcatggccaggaggcgaccatggcggatctcggttgggttgcttgatgagggggccggtcgcggtagatccatggcatccggcttgaggaggagccacggcggaggttcaggccatccgacttgacgaggggacggccgcgcaacagatctaggatcccaggttgagggaaaaggacgcggaccggtgctacaccggcgttggttggggaaaagaggaggaggcaccggcgtcgatgccggccacagctatagctcgagaaggtggcgtaggcgttggtcctcgttgcagcttgaggagcggcgagcgggaggaggctgcggtggttcgggagagcaggcgaatgggggtggcggctgagagtgggaggagaaaggggttggtgagggtgctagggttcggaatttatatatgaaagggcaagcaaatttagatcgttggatctccatccgatgtacacaattaactggcaggtgggccccggtttcttcacatgttcatatcgaatggttcccgagttcctttatatgatgagactcggtaagttttccctcaccgctagtcccactggtcaacgtgctgcatcggatggatggcgtctgacgttccctggtgtaactcaccaacacacggtaattctccttgttacggggtgcctacatggaacacccggtaagactgtagtgttacctagtgccgtccatttacacccggcaacttacctagtgtcatagaaagcactatgtaaccttggaagagactagggagagtctcccgatctagtagtgctacctgggagttgaagagatgtaataataaaattaggccggtaactaattaattcttgttataaaacatatggtcgagggcgaaacccagtgttcttaagtgtagaagtgcttccacatgttcaaactctggttggagttcaatcaaaatttgagtgagcactgcattttgaaccgatgcttgaaatttggaactgtaataccggagaattgacaggaaaattcagttaaaaatcataaatactggtctagatcgacctcatcaaaatgaatttgtttatagcacttctcatgaaagagttttagactggaatgaacaatacaaaatggccatggatgtcctggtgcaccgaaacatatgtgacacaacaagaattcgtcaaaacaatcctataccgaatctcttccgaataccacatccattttatacttttttgtaggataacatctccattcaatgctaatcaccatataaactcaaggctacaggcaacagatcttaacatatgaattgtgagagctaagaggcacttgatagtgcagtggtaatgggtatgtggtttcaactttgaggtcccgtgttcaatcccaacacgctcacaattcctcgaaatctctcttttttctttaatcgtgagagttgatcaagaatgtgcagaatcttgctaccagcaaagagcagcagctatctatgatgcatggaaacaaacacaaacagtgtgggcatggagggcatcaaaactactatacggtcaagctgtttacttcatcctgtgtgatatctgcccatctcccggatgtgtagagcttcccctatttgaatcatgaccaaagattagttgttgaattttatggaaattgatgtgattgacatctcagtacatctagtagttttatctttgcatatcctcaatttataggacatatatataagtatgtgcaattgccatcgctatcaaatgtaacttgaaaaaggacagatattttaagtaacttttatttgtgatggtcataattaggatccgtcacagacagtaaaatgagtaaaataaagatgtcgtctgcttagctagtcacggacctttatatgggcattcacaattaaaaaaatatatctaagcacagtcacattcatttgggcatgaa

SEQ ID NO: 47634 - DNA, 1695 bp, Oryza sativa
acttagggcccgatggagatatggaatgttatctcaatcgagtctaaactacggcccgacacagataggagtcatccttgacgggcctgagtattatgcctatctaacatgtctgtgcgaccatatctcaatggggtgcttttttggcccgattaagatgactttcttgtgacgcccagctaattccaggcatgttagaggacatcacggatggaaggttctgtattagtgaccctacccctatgagcaccttcggaagactgggccggcatatcttgggattgacgaagtcatcacgggcgtcttgctattgacggatacgtcgcctactatgaaagaataattagccgtatgtctaacaatagttgacacctaaaattgagtgaaaagtatatttaacatcgagattagcacaagtagcagtagcagtagattttgaggcgttttgagaaaaacacctactaatgacagtaatattgaaggaatgaattaaatttgcctggtaattaatattttttaagaaatggctccaacaagagatgccttcaaatctcatccatcctgtagtgacgtgggctcattggaagcatgccaaaagtatttcaggcccgagggggtgaaattatattatgcccaaatttgtagatgtatcagaatttcgggagaacatatcctatgcacattagctttccgtgcacaccaactaacaaatgtcatataaaattctagaaaaaattaggcacgtacttccaatagtatacaccaacgtgtgaaacgttatctttaaattcattatattttagccgtaacaaaaaaagacaaaattctgacatatttttaccctaaaaaatgtcaaatttttcaccgttttattacggctaaaatataataaatttgaatacaacaccttgcagatatgtctaatactattggaagcatgtgtccatttttttctagaattctctgtgatatttgctagctagttggtatgcatgaagtgtgcacaggaagcttgtatgcataggatatgttcccgaatttcggacccactggaattgatgctcacacatctgtttgtcagcccattaactcaaacaacgacgcccaattggccacacatgatgatgatgatcaaatggcaaattaaagtatgtttcttgttagtcgttatttcctcgttacttctgccatatgtacaacatgcatggattgatgcatgccatttcatcgttgaaaagcagtaacagaaagtgaagaacacagctagcatatgacacgatcactgttgtacaatgacgtcctttctccttcttttttcttttatgaaaaatacatattgccaagtgttggaattaatgaatgggccttagcccactcgaaaattaattctttggaaaatcacaaaagcccacctcatgggatggcatgcatgtggagtttagtaccaccttgcttattctaggagagggggaccttattaaaagggaggatgccctcctagtcacttgaagcatgtgtggtggagagaagaggggaaacacacgcgcgcgctcgctcgcctcgcctggcagggcaggcggcgcgcgtgcacgacgtacgcgtcgaatggtccgaaaaattggctcctcacccttgcgcagatgcagcctccttttgcagttttgttttgctgcaaattcggattcgtttttgttt

SEQ ID NO: 47635 - DNA, 2405 bp, Oryza sativa
cgatcgggagagcaggtctccggaacctctgtctttgacgtcctgcaccgggagaaggcggcaataaggtttttgggaagcgcttcgcgcgactgctccctgttcgttcgcgacggctcgccttcctcttcgctcgcgtgtttcgtgccttcgtagacacctgcgaaaagttcgaccagcagccggtcttttcgtcaccttggtacgtgttcaatatgttgcgcatatttgatctgttcatgttatactgtgtagtttacatgtgtagatctaatgatgcgttcatgctagttttcatctgtaatgtcatgatttatttatggaatagattaaatcattatatgtctataatctcaacaatccaaaaaccttattataggcactgtgattttactttggctggttttgccgatgcactgaggccggataaattcaccggtgtgcattttaagagatggcagatcagggtcactctgtggctgacagttatgaaatgcttctgggtgagtactggcaaacctgaaggagttcttactgctgaacagcagaagcaattcgaggaagccactactctctttgtgggatgcattcttagcgttcttggcgatcgtctggtcaggtgtatatgcatatgaccgacgctaaggagttgtgggatgcactgaatactaaattcggtgctactgatgctagcaatgatctgtatatcatggagcagtttcatgactacaaaatggctgacaaccgttctgtagtcgaacaggctcatgagatacaaaccatggctaaggaactcgaactccttaagtgtgttttacccgacaaatttgtggccgggtgcattattgcaaaactacctccatcttggaggagtttcggtactgcactcaaacacaagagacaggaatactccgttgaggggttgattgcgtctcttgatgttgaggagaaagctcgggaaaaagatgccgcgtctaagggcgatggtgggcagtccagtgccaatgttgtgcacaaggcccagaacaagagcaaggggaaatacaaagctcagcagaccaccaacttcaagaagcagaagaagaacaacaacaatcctaatcaggatgagaggacttgctttgtgtgtggccaagttggtcatctggctaggaagtgtccacagcgcaaggggatgaaggcacctgcagggcagacttctaagtctgctaatgtgaccattggcaacactggagatggaagcgggtatggtaatttacctgctgttttttcagttaatcaatctactaattggtgggttgatactggggccaatgtacatgtttgtgctgacatctcattgttttcttcttatcaggtcgcacggggttccaccgtcctaatggggaatgggtcacatgcttctgttcatggtgttggcacggtagatctgaagtttacttcgggaaagatcgtgcagctgaagaacgtgcagcatgtcccttctatcgacaggaatcttgttagtggctcccgtctgactagagacggatttaagttggtttttgagtctaataaagtagtcgtgtctaaacatggatattttattggtaaaggttatgagtgcggaggcctgttccgcttttccctttctgatttctgcaataagtctgtgaaccatatttgtggcagtgtggatgatgaggctaatgtttggcattcacgtttatgtcatattaattttggcttgatgtctcggctttccagcatgtgtttaattcctaagttttccattgtcaaaggttctaagtgccatagttgtgtgcaatcaaagcaacctcgcaagcctcacaaggctgccgaggagagaaacttggcaccactggaactcctacattcagatctttgtgaaatgaatggggtgttgacgaagggtggaaaacgatatttcatgacattcattgatgatgctactagattttgctatgtgtacttgttgaaaacgaaagacgaggctctagactattttaaaatttataaggcagaagttgaaaatcaacttgacagaaagataaaaaggcttaggtctgatcgtggtggagagtttttctcgaacgagtttgacttattctgtgaggaacatggcatcatacatgagatgacgcctccctattctcccgagtctaatgggattgctgaaaggaagaatcgcacactgactgacttggtgaatgccatgttggacaccgcgggactgcctaaggcatggtggggggaggcattgttgacctcaaatcatgtgttaaacagagttcctaacagaaataaggacaaaacaccatatgagatatggattggtagaaaaccatcactttcttatttgcgcacatgggggtgcttggcgaaagtcaatgtaccaataacga

SEQ ID NO: 47636 - DNA, 12190 bp, Oryza sativa
cacatgtgggtgcttggcgaaagtcaatgtaccaataacgaagaagcgcaaacttggacctaagactgtggactgtgtttttctgggatatgctcatcatagcattgcctatagatttttaatagttaaatccgaggtaccggacatgcatgttggtacaattatggagtctcgtgatgctatcttctttgagagctttttcccaatgaaggatacacatagtggttcgaaccaaccatctgaaataattcccagttcaatcacaccaccagaacaaactgaacatacacatgaacttgtctctgaggaggatgtcagtgaagctcctcgaaggagtaagagacaaaggacggctaagtcttttggtgatgatttcactgtgtacctcgtggatgacactcctaagtcaatttcagaagcatatgcatctcctgatgcagactactggaaggaggctgtccgtagtgaaatggattccattatcgctaacgggacttgggaggtgacagagcgaccctatgggtgtaaacctgtggggtgcaagtgggtgttcaagaagaagcttaggcctgacggtactattgaaaagtacaaggctcggcttgttgctaagggctatactcagaaagaaggcgaagatttctttgacacttactcacctgttgctagattgaccacaattcgtgtgctactttccctagcaacctcacatggtcttctcgttcatcaaatggacgttaagacagcttttcttaatggagagctggatgaggagatctatatggatcaacctgatgggtttgtaggtgaaggtcaagaaggcaaagtgtgcaaattgttgaagtctttgtatggtctaaaacaagctcctaagcaatggcatgagaaatttgacaaaacattgacatctgcaggctttgcagtcaatgaggcagataaatgtgtgtactatcgccatggtgggggtgagggagttattttgtgcttgtatgttgacgacatactgatatttgggacaaaccttgaggtgataaatgaggttaaatcattcttgtctcaaaattttgatatgaaggatttgggagtagctgatgttatcttaaacattaagctaattagaggtgagaatgggattacactcttgcagtcccattatgtggagaagattttgaatcgctttggctacattgatagtaagccttctccaacaccttataaacctagcttgttgcttcgcaagaacaagagaattgctaggaatcaactggaatactcccaaatcattggctcgttgatgtacctggctagtgcaactaggactgatatctcctttgctgtgagcaagttgagccgatttacctttaatccgggagatgatcactggcgtgcgcttgagcgagtaatgcgctatctgaaaggtactgtggaattggggcttcactatactgggtatcctgcggtactggagggttatagtgattctaactggatctctgatgtggatgagatcaaagccactagtggatatgttttcacactgggtggtggtgctgtttcatggaggtcttgcaaacagaccattttgacgaggtcaaccatggaagcagagctaacggcactggatactgctactgttgaggcagaatggctgcgtgatctattaatggatctgcctgttgttgaaaaaccggtgccggctatccttatgaactgtgacaatcaaacggtaattgtcaaagtgaatagttctaaggataatatgaaatcgtctagacatgtgaaaagacgattgaagtctgtcaggaaattaagaaactccggagttataacgttggattacatccaaacagcgagaaacctggcagatcccttcacgaagggactatcacgaaatgtgatagacaatgcatcgaaggagatgggtttgagacccatatgagttatactatggtggtaacccagtctatgtgatcggagatcccgtgaattagatcctgggaagaacaaaccattagtaaactagaggagagtatcaatatatataccctctccaagtgaagatgcatgtactctcctgagctgcaaggcaggttggctatgccttaatgagttctgttgactttaattagcaaagatgttgtcctgcagagcattcttgaaagaactcacctttgtgagcttgactgttggtcgcagtctatgaagattttgggtgaatcttctaggaagcttactaaagacctaggagtatgacttatacgctccacccgaggggtagtctacagacggtctagtaccagataagactttgagtgaaacttgcttgcacaagacttgcaattcaaggcgtagtccattgttcaagttgtgagtaagtgtagcttggaattctaggtggatgttcaaccttaattggtctccatcgaaccgctggtatataaacagtacattggaaaaggcaaatctcagtgggattttgagatttggtggaggattgttggaattaatgaatgggccttagcccactcgaagattaattctttggaaaatcacaaaagcccacctcataggatggcatgcatgtggagtttagtaccaccttgcttattctaggagagggggaccttatgaaaagggaggatgccctcctagtcacttgaagcatgtgtggtggagagaagaggggaaacacacgcgcgcgctcgctcgcctcgcctcgcctggcctggcagggcaggcggcgcgcgtgcacgacgtacgcgtcgaaaggtccgaaaaattggctcctcacccttgcgcagatgcagcctccttttgcagttttgttttgctgcaaattcggattcgtttttgttttggaaacgttccgaaaaatccggtgcgtgcaaacggcgtggagtccggataagttacgcgcgacttatccggttcggttacgtgcagtagagatcgtgcgggcgccctgatcaagcgacccttctctatataaaccgacctgccgtcttcacgcagcacacgcaaaatcaatctagggtttgcctcctactctgtactgcgccgtcgctcgtagactactccatcccgctcgccggcgtgcaccagcgatcgagagagcaggtctccgaaacctctgtctttgacgtcctgcaccgggagaaggcggcaataaggtttttgggaagcgcttcgcgcgactgctccctgttcgttcgcgacggctcgccttcctcttcgctcgcgtgtttcgtgccttcgtagacacctgcgaaaagtttcgaccaagcagctggtcttttcgtcaccttggtacgtgttcaatatgttgcgcatatttgatctgttcatgttatactgtgtagtttacatgtgtagatctaatgatgcgttcatgctagtttttatttataatgtcatgatttatttatggaatagattaaattattatatgtctataatctcaacaccaagtacgtaggtcttggggcatttaattttgatcgctatgaacaaccagctgcaaggctgcaaccaccctttttattattctgtttttaactatttcctgaaaaaaaaatgaattcttggaccaaccattatgaaatgacattataacagctgctataaatggaggctaaaacagatcaccagtggtgctgaggtacggttcggttgattgatgagagagcgatgcatcatgcatgttgcagcttccatcgagatcttgtatcaaccgtggcaaaccaatcatatatgtgtaatctgactcgacttgatctctttctgatgccatctacgaatggaaatggaagccatcaggaaccaaagcacaataggattccaatcaaccagatcgtcgcccacagatggcggtagagaacgcagtttgctatggtacttatgcatcagtgggaggatgttcggtttagcagcaatgctctcactgagatgctcttccccactctgcacttcatctgctctattcaagctcgttcgatttctagtatttttagttatgcatggccagcttggcagtttaggagatgtgataaaattatgccggtaacttataaattctctcgttacaaaacatgtttaaaccctgtattgagttgagtcaaatttaccacgagaactgcattatgctctgctgcttgaaatttgaaactataatattcgagaaattgacataaatatctagttaaagtcataaatattgtctggaactcgtcagaatgagttttgtgttattcatcaaaaagcttagaccggaacatccaatacaaattaaccaattgaccatcgatatccaggcctatttaaacactcctggcctctctcttatccaggcctatttaatgaatgtgaattgagggagttgagaactccgtaactttactcttattgcgcgtatatgggattagaagctgttgggattcaaatgacgagcaaatcaacaaaagaccatagcaagtgagagataaacaggtgaccaaacttcccttgacagcaaaagcaaggcacaaaagattgaaacaaaaccagacaaagaatcaacgcccactcgaaagttgccaaatttttagaagcaatgggagctgaaatatttttttatttgtaataaacacagcaccacatcatatgatgcatgaccctctgttctcatgtcctttcttagagttaacgaacacaccttgcacatgatttatgcactaacctttttttcttctttcactacgttggcccagggtatttgttatgggccaagactctcagctgtgacgggaggccctcgtcatagataagtggtaactaatgagtttgagttatctgtgtcagttgaagacctgtcacagaggaaagagtttgcttggatgggccgtaaccaaaacccgtcacagttaatataacattcatctgtgacgggtagtcattttaacctatcattgatgacctttatctatgatggacacactttttaactaacttgtatttgtgatgtgacataattttgggacctatcacagacatgaaaattgtaaaagaattaaaaaaatgctgcctgcaaaccttcatctgggcattcacaaatcacggaaatgtttacaatatcacaattactttcacattcatctgggcacagaacaacatcacaaccacattcacattcatctttgcacaaaacagaatcacaaaaataatctggacactagaatcgaaaactcttgccattgatggacttcgttgctgtactggtgcatcgatctcttttgccatgctcgacactagtggaggagtgggccgaaaaggggcaaacaaaaatgcatagccacattactaaaagacgtacccaagtttaacttttgattaattctgccttttccgagcagttcacagtgtatattgaaagcagaactcatcccaaatcagctacttaattccagctatatataacactgtagctcttaatgcattgcccatgtgtgttgtcgaacgaaaactgcgtcacgtcgaagaacgtggaacttggatggaggctttgagcagtaaagtagtattgacttcatagaatttttgtggatccccccatttcatggtcctagggggctatttataaccctagtacatactaatatcctctagggttgagttattacgaggaaaattacatggttacccttatgatagggacattacagtgggtatacaaggtcttgttttacattcgtgggctctgagatggtcttcctgggccggcctattaggtggcgaagggccccccatggaccaccgagctcctcgagccctatgaccgaaggccttcttcattcggggcttcggcttcatggaatgcttgacgtccttcgcccttggtgagcctttgtccggttgttgggctttgtggcgaacctcttgatcaggcttcgcctggtgctcgatggtgaatcccttggtcttcgtccttcggcttcgcacataggacttggccgatgttccgatagcctagatggcttgggtgggttggctggatgccctcatgacatacctccaacaatgtgcaatgcagaagtgatcatcaatcagctcagctaatgtatctcactgatcatgtgcattgactagaggagagatcaccggtgctgaggtgaagttgaaggagatatgtagtgcatatacaccatgtcaccatatattccatcaagcatggctaccatccgactaactttgatttctttccaataggaatggaagtcattaggaaccaaagctgaacagccttaggttcacatgtcacacagtttagtcatgatggattgcagcagctggagcatctctggaagtgggaactagtacacattatggttgaggagacaagatgctacactggtatagcagcatggacagcttgggtctacagcacctgatcacgacttttcgaccgtcgtctgcatttcgttctctctttcaagttcttccatatattcctacagtccgagaaaggtcttggtaaatcactaattagagcttgcattaacattaactcgtttaccatgatagcagtgcaagcagaatatgcaatgtggaagttcagactatgattatttcagctaatcttaatttagcatgactactgcactatgagctgaagcttgaaggtcgatttcaaattcaaaacgattagtaaattgtgttcatggtacatgaacttgcatggtgggtgcaaatatatatacaactaacttattactcttttcgatacaatacttacctagtccaagcgaacctgagctaaaacaatctctacaagcaaaattgatctaatgtgacacatatcgacgagtaattttattatacatcaaaatttagaccgataaaatgtgcaattattatttgctagatattttaaagatttagattgacaaaaagtgagacaataaaatatgcacaaccatgaaaataaacttttaaaatatgttttcggtgaaacagagtatctgacaatgaaaattaaaataactgtacatataagcgtatctgagcatggccagaattttcttggtcctgacgtataagtgtacattataaaagttatatagtgttgaggaatgcagttccaatcctacgataagtattgataactctggatttggtagaatcttgacacattcaattgggtttccgatcaacacgatccaaaccctacattcatagcatcatgtcttctctggttatcaatcgttagctactcggttaacctcgccgagaaggctgctctctacaagcgaatcaaagaacacaaataagaagaaggtagattgtaatttgcatgtaaatgattaagcacttgaagttgggattccacgaaccatactaacgggaaaacatatataaataatctaagcaaagaccaactcttaatgattacgactacaaaaataatatgatttcgaatgtcctaggcactactacacaaaagattttccaggactagaacttcccattttcccgtgcggagctttttcgcatgcgtatgtaaaaatcggtctcctattttcatgtgtgggccttctattttcacgtgcggatccttaagaggcccacacacaaaaatcgattttcacatgcggccctctaaacagacccgcaaagaaaaatacacaattttcgcatacaggcctcctaatccactctcacaggaaaatatccattccctctcaacctattcgaaaaaattcaaatttccttctgtctctccccccggccccatatgtcctctctctccccttttaattatcttatcctcactttccctctctgtgtctcccctggcccccttctctcctctctctctcgcaccttctccttcttctgtggcgccgcatccttctccttctgctccggtgcgatgggagccgcgggctaggctgcgggctagttcggggcggtgggtgcgaccgggagcagtgggctgggtggctgcgaccgggctcgtggcggtgggtgcgtccgggagtggtggggtgggcagcgggtgaacaggagtggcaggctcagcgatgggtttgcagcggcgggcgactgcccccccacccggatccggtggcggcggccgtcccactcccggatccgtgcgcggtggcggcggcacgacggtggtggcggtgggtgggctcgacggctttggttgcggcggccgagagcggcgagctctggtggcggcggtcggctacggcgacgggcgtttctagggttagggttagggtttatttatttattcattattttttatgtttggatttttttgttgcgtgtgggcggtataatttgaccgcacgggataatcgtttatcccgtgcggtccacttaactcgaccgcacgagaagattattatcctgtgcggttgggccgtccgcacgtgaaaatatttattttcacaaacacttggctacagacggacaaaacctccacacggaaaaaatatttttttgaccgcatgaaaaaatccttcttgtagtagcgagggttgcaattacaatgctcaaggctcaaatcagactcggatcggactagatagggtatgtggcttgttttgttgatttctaccagcattgtagaaattttgacgtgggatcagaaccatttgaaagtagacttcataagttttccaacaagtattcatggccccgaattccttctagatcagcagctaggtttatttgaagttgatgctgttaggagacccgaatccaaatccaaaatgtgtagaacttcatctcatatcttctatggaccgaaagtgatgtggtgatgtaggaataggcttggggaagatcttggtttggttcccaatcaatttctttgatcatccaagcacttcgtgagcccgcactccttttgttcatccacgcaaatatttttgccaacgaaaagatagaaaactcatagcgcaataacgattgttcaaatatataataagtaaatgcaatatagaatatatgcacctttaccttgttgatgtgtaacataagcatgattatatccacatcctaaagagcataaaatttttccaagacatgaaataaattatgtcctatatatggaaaatgaacttttgcacatctggtagctcttttttggattccaaataagatctccaaaacatggtcatacatgtaagctaccttgccatcagtttgcgatgctacaacgattttatttgtattgataatttcggcatgattcgcatggactagcaagttactgcaccagaatgagcaatttgcaacttgttgtatgttttttcacccaccagcaagttcttgtactgtgaacgcaatttactcaagaactattaataatatcaacttagtgatgagaatatttttattaataattaagcaacacccagtaaacactttgcaacagaaacattaaaatcaaggctttactgattttgttaggtacggtcagaactcagaagtaaaggttccattttgcgatctgcaatgctcataattgctctgctaaaatgttatgccaatattcataccgatcgatagaaactataaattgaagaccagaccctagaaccacacatagccacaattgcccccatctagcaaagcacgccatctcccagtcattcaagtggtggtgtttacgtatataccattggaatagaagtcatctggaatgacagtgatactacgcagctttctctcggcaatcctgttgcagaggtgtttggtttaagaatttacattacatagcgcctttttagtactataaaattgtcatcttaattctgtgaatagtaacacttcagttctagctcttacatgtgagctatgtagctatatatccatagttataacgatcagtcatttctacctctacctcattcagaaattgtatttttttacaggtgtagacgcacagtaaagaagggcgcctaaatcatgcttcaccactgtctggatcacgagttaaaggagtgcaggtatatatgggccttgctgaacatgccccatgttacagtgcattaaagcccaactgaaacgtccgggctgaattttgggccgaagtatcagtcatgtgattgcgaaatcatcttcactaatgatcaactagaagatgcacattatgttgtaaacgtctgtgtttgtaatgtgttttaaaagaaaaaatagaaatgcgcatatgatgcacacaccacccttttagcacacgctcaacatattatggtatcactaaatttctttcaaatgtgcacctatatttgttaaaaggggcaaacaaatttgtagcccttacacgaagaacaagcaccatttctctggacaattgtttaacaataacaatttgtttggagagatgccgcatgaatgttataataaaatagtttagtggggttatggattaatcaatggcctctctggagcctgacttgaaggaggaactactctgttcaaaaaagacaaatctttgctacgaatctggacacatatttgttcatgcttgtagcgaggattgaattttttttggacggaggggtacactcgtaggtatttacgtgtttgattttgtggtgtgctcacgtgtccaacattatataactgcaaagaaaataattgttccctcttagagcaccaatcaacaataaggtggacatatttttttaaaaaatggattgaacatgcatgtttattagaggataatatttgatccaccctctatttctctgtgtttttggtgatgttaataatgtcattaatcaagtaattaattccagtgatatactcgctccattccaaaatatcaagcacaacccttaacccaaaggtcacgaaacaattattatcatcttctcatctggatcacctaataaatgaaatgtatgcatctaatagaattaatgatctcaggaatgaatgattttaaaaattaataatttagtgaggaggaggtgttagttaattcatgcatgcatgcatgccttgtataatgaaacatctagaaaggtagttgtgtcttatattttagaatgaagtacttcttccgtttcaaaatgtttgacactgttgactttttagcacatgtttgaccgttcatcttattcaaaaaattttatgaaatatataaaattatatgtgtacatgaaagtatatttaacaatgaatcaaatgatatgaaaagaataaataattacttaaattttttgaataagacgaatggtcaaacacgtactaaaaagtcaacggtgtcaaacattttgaaacggagggagtatataacatggtagctagctctgcaggcatgcattggccatgtagaaactagacatgatcattgagatggagttcgaggagaagataacattggaataaagagtgactgaaagagatcacttgtgctagggcttcaatcaaacatggtgttaaatatgtgatcgaattttaggcccacgatatattcggattagtttcctagtaggagtcctattaggtgtctttctattatcccctatatatactcttgtaagccgtacgggaaggggtgacgttcccattgtgattcccctacgtttgtaatcatctcctctatagtgatcattgccggtcggcgcccgtggttttttcccgcaagtgttttccacgtaaaaattcgtgtctccgttgtgcatctattttcataacaagtggtatcagagcattggagatcgatctactgcagtcccggctaccggcgatttttcccgatcgaagaaatcgatctaatcggtggcacgcgtcgtcgtgttcgtcgttccgtcgaatcaatttgttcggccccctacctgtcgactccgagtcggcctcgtcccacgcctgcgcgagaagaaaaggcagcaccgcagcagcagccgttcaggcgtcgtgagaggagtactacaagcagcgcacgcgtcacgaggattaaaataatcagccgagagcttggctgttctgttcaggctttttgccaaggaggaaattgctaagcgcaccaaagcttgtgtaccaggaaatctacatacttcgctttgtgcacacaggaagtgcaccgaggtttcgcgtttttgctagtttaccctaatttcttaccagcaaattcaggattaattcccatggcgagtttgaagtatgatctaccgcttttggaccgagacacaag

SEQ ID NO: 47637 - DNA, 2003 bp, Oryza sativa
catatgcaaacttcagggatactatactttatagccgtgatactctaactttgaaagaagtttatgatactttgcatgccaaagaaaagatgaagaagatggtaccctctgaaggttcaaattcacaagcagaaggcttggttgttcggggcaggcaacaggagaagaacacaaatagcaaatcaagagataaaagttcaagtagttaccgtgggagatcaaagtccagaggcaagtataagtcatacaaatactacaagagagatagacatgatatctctgagtgttggaagctacaggataaagacaagagaaccggaaaatatgtaccaaaaggtaagaaagaaaaggaaggtaaagccgtagttgttactgatgggaagtctgatgcagaattgcttgttgcttatgctggttgtgcacaaactagtgaccagtggattcttgatactgcatgcaccaatcacatgtgcccgaatagggattggtttgccacctatgaagctttgcaaggtggtactgtttttatgggtgatgatacaccatgcgaggttgcagacattggaacagttcagatcaagatgtttgatggctgtatcagaacattgtcagatgtgtggcatattccaaatttgaagagaagtctcatctctttatgtactcttgatcgcaaagggtacaaatattccggtggagacggaattttgaaggtaactaaaggctctcttgttgtgatgaaagctgatattaaatctgccaacctgtaccatctgtgaggtacaactatattaggtaatgttgctgcagtttttgattcattatctaattccgatgctactaatctttggcatatgcgtcttgggcatatgagtgaaattggtttggcagaattgagcaagcgaggattgctagatggacaaagcatcgggaagctcaaattttgtgagcattgcatatttggcaagcataagagggtgaagttcaacacatctacacatactactgaaggtattcttgattatgtgcattctgatttatgggggcctgctcgtaagacatcttttggaggtgctcgttacataatgactatcgttgatgattattcgcgaaaagtttggccttatttcttgaagcacaaatatcaagcttttgatgtgtttaaagagtggaaaactatggttgaaagacaaactgaaagaaaggtgaaaatccttcgtactgacaatgggatggagttctgttctaagatatttaaatcatattgcaagtctgaaggcattgtgcgtcactacaccgttcctcacacacctcaacaaaacggcgtactgagcgtatgaacaagaccattatatcaaaggcccgttgtatgttgtctaatgcaagtttgcctaaacagttttgggcggaagctgtttccactgcttgttatcttgtcaatcgatcacccagttatgccattgataagaagactccaattgaggtatggtctggttccccagcaaattattcagacttaagagtatttggttgtactgcttatgctcatgttgataatggtaaattgtagcctagagctattaagtgcatttttcttggttatccgtctggtgtgaaaggctataagttatggtgtcctgaaaccaaaaaggttgtgattagtagaaatgttgtcttccatgaatcagttatattacatgacaaaccttctactaatgttcctgttgagagtcaggagaaaacaagtgtgcaggtggagcacttgatcagttcagggcatgcaccagaaaaagaagatgttgctattaaccaagatgcacctgttattcaagattcagattcttctattgttcatcagtctcccaaacgttctattgcaaaagataagcccaaaagaaatattaaaccacctcgaagatatattgaagaagcgaacatagttgcttatgctttgagtgtggcagaagaaattgaaggtaatgccgaaccttctatggggcgcagga

SEQ ID NO: 47638 - DNA, 2075 bp, Oryza sativa
aagacatgatcttttcatgatgctactgatgtaatttactgtcaattttatttagatgatgatgacacattcgttcttggcttgttacttttgtccaggagctatagctcaagtaaccaactttggctgggctttttgttgaggattagttgtccaatccctttcaaaggtgcagctattacaaaccttgtgcctgtgtgattataatggtatgattactccattcggttggtagctctccagcgaggccgtgggtttctttcatagaatcgggcatgagaagcaatttctgcgtcacaattatggattttgcaaggctgtacagtatgctattagattcggtagtgggctttgggatgttgtgcgtgcagggcagggtatcacaggatgtcgacctgtttcaggttctgaattgtgtccttggggagaggcatatgcagcatttctgtcatgtctaaaaatcaccatttaacaagtgaatgttgatttggacaaatttggatgcttcgtcttttcaatgagcaactgtgctcattttggtgttatgatcgaaaaaagaattgtccgtgcatatctgtatttagaaaagaaaaggtgagggagggaaaagacagacctgtcactcatgccaaagtgtacggcagtatagatctgtctgcctgttttgttctttttatatctctgaaccactgtagtagtttgtccatgaaacttgaaaattaataaaacggaatcttgatcattctggttggtgctggctgctccctttgtttatctcctacagcaacaatcatcaatggtaaatactggtggagttggtagtagcagttgataattactcaaccagatacaactcatagttgatcaagcattcataagaaggcccctagcctaaaaagagaaaaggccctagtaaatcacaacagttggaatgtgtccctctatccagaacggatgagttacctaggacattctgccctctagtcagtgatatgtggacctgttgattatggggctcacatgtcactcacttaaaattaaagaatagtacgttacaggatcaggttcacccagaacatatatctcatccccgtgcaaaatgcaacagcagataaagaaagaagtaactaaccacatgcctgtgaaaccaagatctgctggcttgacgtggacactgagcacagtggaggtcaataaccaataataatgcggcggtgtggctccagtggcaactcatgtcgactcggcgcttaactgccgaagcacaacacatggggcactcttttattgcacttcaaaccggcaagctgtgaagtgaagggacccggttaactgatgtaccagtaggaatccatgtgagatgtgacaagcatcacgagctgatcaatgtactaggcttgattatgatctcatcctgcagttgttctatcaaacaagaagatattagggcttgtggaaacaaggatgtaagtcagaagaagacacaaaatgaaacgtacaggtgcaatagtgcatagatctatatttgataagtcctatatgtgcatatatggtgtgtcccatactctcattctatatctccccgtcccagcacaaacaaactaactgatggtcccatgaatgaacaaaataaacgattcttcaagtagacagatcaatctccagacatactaccagttaggactccttagtccttaccaatctgatgaatcgactgtttccaagcttgagtttcccgcaaatcacagtactgttgagacatcacagcgaaggcagcgactactgagggttttagatgtaatgctactcacctaactatctgtactgatgatggttgagtggactgtccagtgaaccatgaaaccatgatatctgcagaacacctgaaactgagcaaattagcaaagccagatgaatgttgaaaacgacaaataattacttagcctttattgcattttctttgaaagtacaccatgcaactcaatatgtctacaaattcttttttcaaaataaacctggatgcattttcccggaatgtgtttgttcagcaagactcaccttcaggcttcaacagt

SEQ ID NO: 47639 - DNA, 4060 bp, Oryza sativa
  unsure (1)..(4060): unsure at all n locations
tgtaaacatgtctcatagcttgaaagtaatattgtccagcttccagtaggcccccatggttacatgcagaaagaagagcaacaaaggttatctcatcaggggggaaggcatcaaataccatagatctgaagaacattagtgcatcctgtgcacgtccatgcatcgctagcgccccaataatcgcattccatgagataacatttttactaggcatttcactgaacaagcttatggcagtgtctacctgaccacaccttgcatacatgtcaagaagtgaattaaatagagcaacacctggattatggaagttatctctgatacagtcatgtatcatctttccagaagccaaatcgccaagttgcccacaggcagagaggacagcagccaaggtaaactcgtctggagcgaggcctagcaatttcatacggttataaagatccagcgcttcatggaatcggccaccttgaacatagcaagagatcatggcattccaagatattatgctcttctctggtatctgttcaaaccaatctcttgcggcatcaatagacgcacgtttggccagagcacaaagcatagatgtccatgaaacagcattcttgaagggcatcatgtcaaagcatgtatgagccatcaacaaatccccacacttaccatacatgtccaccaaagcattggcaaggatcaaatcaatccgacatcctctaaccagcaaatgagagtgcacaagcttaccaaattcaagatttccctccgctgagcaggcaaaaagcaggctgaccagcgtgaactcatcagccaagagtccctgacgtctcatcccctcaaacaaggagcacgcctccctagtatttccagcctgcgcatatccgttgatcattgagttccatgacaccacattcctgtccaccatctcatcaaagaaccggcgagaatcccccagtgacccggccgaagcataagaatgcagaagagcattccccacaaacacctgccccacaaatcccagcttaacaaccacgccatgggtgaccatcacatgctcccacgcctgtaccctcgcgcacgccttgaggaggaatggcagcgtgaactcgttcggcaggatgcctcgccggatcatgccacgaagaagaggcagcgcttcttgggggcaatggctattgcagtaggctctgataagactgttgtaaacgaacctgtccggatcaggaattctgtcgaacagttggcgggcataccacaccccaccaccagccggtagcgcgcagtaggacgcgaggatctgagaggtgacgtcgtccacgccgtggacgacgaggtgggcgtggagctggttgagacggtgcacggagccgcaccgccgcaggagctcccgaacatggcgggcggaggaggcgccgccggccgatggcgcgagcatcggagaggagactcgaagcgcaacctcccaacgggccgggccaagctagaggaaaggcccatgggctttcacctgctcgcgcatatggagagatcgagagaggggaaagcgagaagagaagacgcggccacgcaggcggaggcaggaggatgagggtgttgggcaagcacgtcttcccgaggcaggtggcgctgctcgccgcagggtaggtggcgccgccttgcatcctccggcctcgattctcctcgtcggcggcggcggcggcatgacgcggtgtgtgatttttgtagggtcgtgttcctcggggcgacgacgtacgacgtgcaccggtcgatcaagaacaacgagcagccgccgaccaaggagcagatggaagccctccaggactacatcaactccaagaagcaaaactagtagctagaaataatcatccatggttcccaataatccgatcaatgcggatcagcttgtgtgtgttcgtctgtaatctgaacagaattggagatgagaccaaaggtggatgggtggaggaggtggggcgcgcacgccatgtgttcggcgaaattcccctgaggactccactgcgtgtaagtgtatctgtaaatggcttgcttggtacaggtatgttagtacagttacgaacgtgtaagcttaactatgtccataaataattccattgtgtagaacatgattcatcttatcataaactccaaactgtattgtgctcactgcatcatggtccattcccaaccccttccaagaaccaagatgatttcggcttgtgtgcagtccgccgagcagcagatgtgtgcagtattctgcaggttgctggcagtgtcccagaagattccattatgcacagtattattacagcaacaagggaaccaacagtgatcgatctcaatcagagtttcttggtgcgttatgagcgcataaacaatggcggccgacggtgtgcatcacaacacgtacagctcggcaccggcatccagacttcagataatgtagtatatcatctgaatatgacgggcacaagatctctggtttgctatcctccacgcagaacgcataaacaattttcagttcaactgaaagaagaacaggtacgcgatctctcccctcttcaacaggtcaaacaaaaagaaaagctgggagaaagaagcacgcaatgttccaacaagattcatgtgaccttatgctataataggcatgtagccaagctggtatacaagttaaactactacttgtgcactgctagatatagtgactagttaactaccagctactttaattattctttttattagcataaactgaatttagtagtgacaggttcaagattttgctgagctcatgctaatgatccttcataaaaaggtgacacctgtacaccaatgttctataaaaaaaacgttgctgtttttgactaatagattggaaatctttgtgggggtacatacccatcttacatccatgctgataagactaatatttcatatagatagttaggtactttcacaacctagctgattgactgaagcaatgagtgataagctgacagcattatgcaagagtagtatgacctatgaaatatggtcatatatacactactctgtttcatagaaacttccctatatatacacaatgttaaagtgtacatatatttgcagatactgcaatactttgtacattgcaagacttgaatacaagataaattgtaacaacaataccacaagctgatcatgatgatgttaggctagagcagtgcctcactgaagaggggagcatgagtgatctgtagtaagctttaggcagagccacaatcttctttgcctttgggacgtaggccctcttggtgaagttgttgtaatcgttggcctcgatctcgtcaaggatttgtcggtacagaagtagagaagcccaaacctgcaacaacaacctaatggtcattcatacgtgtgaaccaacttaacataattaagaatgttcagatggaaattttaaaggatatgtagttgtcatttctcaccggccatcggctctcctgattgagctcgctggcgccttcttcggcctgtctgaaaaacgccctcgctctcgtgatctgatccctcataaaacatctccatctgtccgtgacgcggccgtcgaagatgtcatcttcagagagtccggccatctcgagctcgtccattgggagatagatcctgcctcttcttgcactgcaaattaacaagcatatatcaggacccattagagatggctgtaactaatcaagaaataatcgcatagatgatgatctctgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 47640 - DNA, 3752 bp, Oryza sativa
gagcacagtcgccggaagcggaagggaaagacaaaggataaagacaaagagaaagatcagcaagaaaggaggaggcgaactgggaggccatggcgccggttggtctccctccaggctttagatttcatccaactgatgagagcttgtgaactactacctcaagaggaaggtccatggcctcagcatcgacctcgacataatcccagaagtagacctctacaaatgtgagccctgggaattggaaggtaatccgaaaacttaattgctcatccatgttctcacttctcatcatcactcctgaatcctgattcggctcgagatgttttatttgtcttcttgttttgaaagagaaatccttcctgcctagtaaagactccgagtggtacttctttgggccaagggatagaaagtatcccaatggatgccgcacaaaccgtgcaaccagagcaggatactggaaatcgacggggaaagatcggcggatcaactaccagaacaggtcaattggtatgaagaagacactagtctactacaaaggtcgagctcctcaggggattagaaccagttgggtgatgcatgagtaccgcatcgaggaaagcgaatgcgagaacgccatggggattcaggttattcatccatcctcctcaccagctgttagtctcagttaaatcattttgagttgtatctgctatacttggttagctgaggctgcatttcagagtatcaagcatagccaatcttctcagttagcaggatttgtatgtatttatgttatgcaatagtgatcatatttcataatatgcaatatttgagatatgtgcctgctaaaacaaaattggcaatagaaacatacagaagaaacaactagggcatatttgctagttcagggaacctacgttctttatgcatggagtgcatgaaaagttagggctcttctctcttcttttcccccatatccatcagtgatagccataaagtattccttgcttccatggaccatagctactttacaaagtacattagaaggttttctcagttctctaatgggtcacacatggttcacttttctaggtgctcttgataagacaaatttaacatccaattcttggttcatgtcgcgatgatgtgaaatcctacaacatgattgtacaggggttaggtgcgtcatcgtttcatgatgcagagtataaaaatctaggtcagttgcatgttgatgctaccttaaagcttagacatccttcagtgtggccctgtgtagtgtcggtggctttacactttattctccccgtcaacctccaactttactcactagtgaaaaccataactgaacatgaggactgatcccatgtttattgtaaattagatcaaagtgcacatagtgatacatattgtatgtccactcttaaatttacattagtcgtgttcgaagactctgcattagttgaactgttgacatttatattaagtaaacatagagttcaaccaaaaccattggtgactgaaacatagtccgatttcaaacaagtggaatcttgaaatagcaattcagcaactaccttaataaaaactgctcaaaagttatggggttgttcagattgatgctattttcaaccataccattttttggtaaagttaccaaaaaaaatgtctacgtttagtttgttgctaaatttggtaaatacataagaaaattttggcaatattgtcatcttgccattgccaaaatttggtaaggtttattttggttacaatctaaacaagccctatgattgatggtctaagagaaatcaatagcagcataaattcaagttgcaatttttatactgttccctgccgaacttgaagttgaatcctcaagaattttactctaaatttgtttagtactgataatgaacattcaatccaaattgaaaatatgcacatgtaaattagcaaacaacaagcgtagaatgtagaagcatataatccattaactttgtaagattacagctgtatattatcagtaaacagaaaattaaagaagcaccttacttcggttcactagtgcgctgaaataatttttcatccacattgttgaacttgaaatctccccatgattccaatgtagaaaagtccaacctgtgcaaaaggaaataaagtaatttagatcatttattcattttcatcattttagttacaggactcctatgcgctatgtcggattttcaagaagaatgtggtgttgggtgaatttgacaagaaaggggagtgcagttcatcacaggctaaaggaaatgaagaagttacagatttcggggatgctggacaatcctcgggagcaaatgagaatgataaagacaattcatggatgcaattcatagcagaggatctatggtgcaccaacaaactaaagtgaactagaaaactgagagaaaacagcttgttaacttcatctaaccagatatttcggtattagttatactgcgtgtatcttctgtatatgtttgataaggacacttctcactttgcataggaggaccactttaagtttggatgctggttcttaaattaggtttatacttttgttcctttagtactggataatatatctaaaattgtgctactttgtacttcaatcttcaattaacatgtacctatcatctaatgaaatgatacaaaaggagaaatccaattttatatatccaccatgtattctatggatatatgtgcaatgtgaccaatatggattaagcaatcaccatatatcactaataaaagaaagttaaggatggttcagttttgaaaaatcaattgattttgatattccggctaacaaaattttacggtattattaatggcaaattccatcaatgtaataatgtttatgtttcaaggttcttaagttgcacaaattagtataagaatgtggcaaccatgctcacatctaacagctgctaggacctattcagcctaagcctgatacaatttccatgtagttttctagtttttttttttttgacgcgatacagttttctagttgcaggctgtaagtatctgtttgggcgatcttttattctcagagtttaatttagatcaccttttacccaaaaatcttttcactttggactaactaatattgcgactaccccaactctattctcgagccagagactgcaataagtatgggtaactaaacccagatatataagcctaacctttcggactccagcccagtactacagtgttttaatcatatatgtttgaagatgcccacttagcatttctgatgttttttttttcgcgaatgcagcatttctgatgttgcattcaaccaaagaaaatcagctgcttcaagtttttatcccaactaatttaaagttgcagtaatttcctcaaaattagtgtgtgctttcagggattagagtccaatcagtagagcatacatcaattccagtcacgaattaaagggtaatcatatcaagctttagaaaaagacccaaatctagcgtgagaaagtcacaaagcaaggcaaagcagatcaataccggagggaccagccgcacgaattccggcccaagggtgaggactcggactcgagcagcccaaggattgcagctcgtcgcggccacgcccaatgcctcctcctcctccaggcgccgcagcacgatcacacgcttctctcccgtagtctcatcccagaggcgaatacctgaggcaaccacgaatgttcatcagaagcggtgcatttggtggatgcgcagcggcggcggcaa

SEQ ID NO: 47641 - DNA, 10392 bp, Oryza sativa
gcggctgctctcccttccctccgctcccatggcgagagatccgtgctttcgacttgtctccttccccttcatctgcgctctgtggcgacgagtcggtgggttggaatttggaaaccgactcgctgacccgcggtctcttcctcttcccctttgaataattttgaaaataatgggtcctctttcgaaattaaattttaaaccaccttcaaataatctgaaactgagtttaggtgttccaaaattcaaactccaaaacccaagcgggaaatcataaatttagcgctcgggatggttccaaatttccgatcgcgcgcactgaatttggaccccgcgtcaaccacattgcaagatacctcatcacctcaggagattcctacatgaatatgggcatttccgcggttccgccccccaaatcgcagcgggaaatcacaaattcagtgctcgcgatggccgatggttcgaatcaggtagccaatactgaaaatcggaccgtgaaaatccaaatagggagcaaatcagaaactgctcgtgctcttgaaatttcaaaatcgctcaaaacaaattgggcaatacaggtcaaccagtgtcaccaactagaacaatgcaggttgcaaaacgttcacatagcacggcaagagattgcaactgaatttagagggtaaatcactgcagatttcctattccattcgaacgaacgaaccagtagttcatacatccctaattaatgaaggaacaggagacgagatgaaacaacagctacaggagaagaggctaggctactacgacgaactgaagaacatggcactaatcgaatccctatccaatcgcgtggcctcgcatcgcctcgcctagccgccgaatccgtagagggtgcggccctggcgcttgagcgcgtagacgacgtccatggcggtgacggtcttgcggcgggcgtgctccgtgtaggtgacggcgtcgcggatgacgttctcgaggaagatcttgagcacgccgcgggtctcctcgtagatcagcccggagatgcgcttcacgccgcccctcctcgccagcctccggatcgccggcttcgtgatcccctggatgttgtcgcgcagcaccttcctgtgcctcttcgcgccgcccttcccgagccccttgccgcccttgcctctcccagacatcgccgccgccgccgctcgccgccggtcgcgaggaagaaactttgacttggtgaggagtggttggcggcggtggtgatgaggtggggaggagaaggcgtgtgggggcggggctttatagaggcgtgggtttaggggaagcgatggggggcacgatccgcgtgctgctggttttccgcccgttggatgggagatggacggcggggagtgggggaaggtgggggttgcgcggatcggtgacgtggcgtggtggtgagggggaggtgtgtttcttttgtgaggatgtggcgggggtgcgggaattcgagcggggagtgggctcgtgttgggtggatggcaggtgggccccgggtttttgggtggcgggtctgcgcgcggtctagaaatttcggatgggttctatctatgacaagtgggcccatagttgggtgccatgaggttagtaaaatacgtttctgtagtttgaaggcgtaaaaggctttgagccaaaattatttgtgagatgaattaagctggccatgttaggtactcctatttaactatgtaagtcaaccaaattaaatttctgaagacttgcaaaagcttcacaatgcatttgtgactgtaaacaatcgtgttctcttctctgacaaaaggttacaggtaataagacacgtataaaattgtaaaaggacggcacgaaagaataatttgcatatgccaaatgagcgtagctctactcatcatgtttcttttcctgaaaccatcccacccgacatctacgctaggggcctgttcactttcatgcccgacatctacactatgtcaaaattttagtatgatttcttatatagttgtcaaaaattagctacaaaataaatgtagcaacttttttggcaactttaccaaaatttgataaggtttaaaatagcatcaaaatgaacaggccctaggtgtatcattgtcactcctacttataatcggtgttttaaataacgagataagatatttagtagttgaccttcccaaacaactatagcgggttaaatgaagttatagcggctaaattatacatgggagcaaatggttaggacccttctcaaacgactatagtcggagatagcggtaattatatttttgtatggtatttcatgtatggaaaatgcagggattaaatagcacaaattataaagtacgttgattttttaaaaaataaaaattataaatgcgaggctagtccagttggtacgtgctgatgcactaagatacagactttgcatatgtagtttaaatattctaacttgattaagatatggattttaacttggttttcgttagcatgactttcgaaatgctaacgttgtattccgtgtaaaaactttctacatataaattgctttaaaatatcaaatgaacatatttttaagttaaaaaaaataaaacttaactaaccctgtgctaatggttttctcgtttgtgtggcatcacttaatatctattttcatcagatttaaacagggttaaccaagcatgacgaaccgatgaggtcaacaaaatataatgtttaagagcctgggaagcatatctacgataacccataagaaaaaaaaaacgtgaccttattcctaggcaaaggatggttcacatcaggtggtctagtgcaaaccgcttccttttacaaggaatagaatgttggagaattaggctatgtttgaaatgatgtgataataacttgtgattaactgaattttaattattacaaaattaaaaaaaaatggattaatctgatattttagaataattttcatatagaaaatttttgcacgaaacacaccgtttagcagtttaaaatacgtgccatgaaaaactaaaacttttatctcgaacagggccttaatgcacatgcttcctatggagtactcccttcgtcccacacagggacggacttaggcctcaggccacgtggcccaggaaagaaacattatcaggcccaacaaattctcaaacttgggccaaaatgccatgtgctagcccgggtctcgtgagaaatctggatatgtccctggtccaaaaaaacgaatcttgataagtttctgtctagatttgttttactatgatatatcacactcagttataggtttgttttctgtgagacggagggagtaagttctaaatgtggtatcttttttttaaaaaaaaaacaaaaccatgtatgtatttaatagaaagctattataactccgatgtagacttcacagtgtttgatttgtttgtacccttaaataattatcatataatcattcatctatttgaaacggtaattatacccttgaacttgattaaaagttcatgtagcacccaaaactttaaaaacatccatccaacctcccaaattttattccattcatattcatataatccactatggtggttttgcaaagtgtttttttttctaaattacatatatattttttaggagtttaactacatgatatacacattggtatcccattttgcaaagtagtcctttttgtctaaattgcatatccatttttcctacctccatcccatattatagctacttatatcatttagattttgtcagatgatatagctacttttctatccaaaccaatcacaagcctccctcattttaatatcaccatgttacttaatttcttcaaaatagcattcataagtcactataaaaatgagacaaagggagtacatcagttctgttaacatgcatacaaacatgtgtataagtgaatcaaacatcgccctcacgccaatttcactacaaaattcctacgacactctttggcatgcaacgtgtagccttcaaagaaatatccatcggtatcactcgacatcgtccattgttttttctatccaaagagaatttattcgaagtgttggtaagatagctacctacttcattcaaccatcatggatccaacataaaaggtgaccaagataatatcactttttttgaaacctaagataatatgactctccattgcacaaaagaaatgcacgattaattccttccaattttgaacatgacacttgtgctcagctgtactggtgtatcaacaaactcacatgtaatgatcatggtagcatcacagaaaaggagactccgatctttcggccatgcatcggtaatttgtcacatcctggtcaaaaatagtcaatccacacggccacaagttgctcttgcctctgtgtttgtgtataagcatgctaaagattgcatttcccagtgttgtcgacattgacaaaagaatggcatttgtgacaagaaatgccaatattgatacttaaaaggaaatgaaaaggacacccactacaatttttttctttgaaatgaaccgcacgagacagtgcgagatttcgtatcaaagaatatagcaaagatgaactgcaccaatatgggttccatgagtttgccggtcatgtttagcaatgacatgggccacatggcccatctctcacccggaacaagaacaaattcaaccaagtatcacaggagagaagggcagcaatcttgttcttgtcatcagctgggatcaaggaagaagagggcattgtgctcaaatgcttggaatattgggaatggaattgccacgataatgtctataggtgagtacacttgtctgaataatctttcactttagttgattgtttgcatcaatcagacatgattctccacatgagattgtgaacaataatcaacgcctaaactccgccaacttcttggttcatcttgtgctgtcagattagtattttttcctcttgcgactaaacatagctttcagatcagatgcaccgacagactgataacatgtgctttgtgcaaccattatgcaataatttaagtgcaaattgacagctgagcaagcgaggcgaggatgccatgtctgaacttcaaagcagctcaaccggggtacagtacttgcttgcaatgcaaacctgaaaagcatcgtaaaatcgaaattaattcttaatggcgaaagatcagtagcaacaaacacaatgaaaatacagaaacttctcaaaaattaagcgatcagttatgcagggatcaccgaaccgaggagcaagcaggaagatgcttcggagaaacaaaccactgcatcttcagagttcagagaacaagagatgaccagctctgttgcctcctgatcgaactgtgtggtttcgttgaattcggggagaccgatttgagagtggcgtgctgtccttctctctgaaataccttaacgaactttttaattctcatgagatgtcgtaagacattgacagtatttccaaattaacgcctaatgtttcaattccaggacccagattcagatcacaaatccaaccacaatacaccaatctgaattcgactttacttgctttttcttcaaaaacaaccagcttataatcatgattagaaacagaaagagagttaattacacagacggccacacgaggcacgcagcccaatgacacgctgtcagcaacagacttgcaacagcttgcgccgttccgtccgtctgcgatcacgacgccgacggtgccggcgcccgcagccaaaagttagacggcgacggtaacggccgtcaccgtcccccgcccgccacgtgtccgggatccaccctaacgccgtcacggccgcggcacatcccggaacattccgtcacggcgtgtgggcgacgggacggaatcccgcggcgccctataagaaacccgcgcttgcattttcctcgcacacacacaacgctcgcactcctctcctctcatctgacatatctcctcccgtcctttcgaagcctctcgaatcgcatcgccgagccggatggcggtcaccgccgacgtgaagctcgagggcctccgcgccgccaccgacaagctcgaccagatcaggtgcgagttcatcccactccacttccactggatctacccgcgcgatcgtttcgtccccattttttttgtgctgattttttctgtgtgtgtgttttttttgctgttgtttttgttgcagcgagaacgagaagtccgggttcatcagcctcgtttcgcgctacctcaggtgagatcccgtagtgtttgcttcgattgatttgctgcttccgcggtgggttttgatggtgatggtggtggtggtttttgcagcggcgaggcggagcagatcgagtggagtaagatccagaccccgaccgacgaggtggtggttccctacgacacgctctcggctgctcccgaaggtactagcgtctcgttgtgaattgggtgatctgagatgctcgtgtggtggttttttccgaaccgatccgaggttcagtgactgtgtgtgaacactgatcatgtggtgatgtgtggatgtggtgcagatctcaacgagacgaagaagctgctcgacaaactcgtcgtgctcaagctcaatggaggcctcgggacgaccatgggctgcactggtcccaagtgagcacaattccatcccatcctgtttagaacttccagttggattgattagatcgtatatggccgtcatgctattcatagccagtataaactaagtcttacaaagcaaactagattttctcctgcttgtggcgtttacaatgatactatagtatggttgcctgctttgagtgatgttgatattgtactttgttaatttggtaactataaggcttgctcacgcatatgcaccaatttgccaaaaccatttcaaagttgttcagtgtgtttgatcagatcgtgggaaagtgtgaattatgtgttggttttaatgccacttgcccctttttaaattctacatgttattatattatatgtatgctcttctgtctatgtctcttagtggagttctcaatgttaacgatatggaaggactcaatattgtaaaattcttgttgttgctttcaagagctcttgcttttctgtgttgcagctccaaaaaatagtgtatagagtcctctgcgtttaatgtacaggcactaataatggagcaaatttatatttgctaggcatgctcattctcattgcaacatgccaacatcctcaatatgttgatacaaacatgcaattcagtgaaattgtttctctgatcagtctgttatgtcttatggttctctcttttctttgttttagatccacaattaccatcgtagttcagggcaccatatagcttacaaggatatgcattatctgcttgctgtgtggactgatctattgagtcatctatggcatattaatttttaaaggagctgatagcaacaagcattaaggctattgatgatgtcattgctgtgtgattttgtttgccccagtttgctgttactgaacttctgtgagcttgcaccctgttgcacatgaatctagtacatatgttgcaacttaccgcattgggatgatttgaatcttatattttctgctctactttgagttttttactgtttgcaagcggttaacatatctcactgtgcccctcaggtctgtcattgaagtccgcaatggctttacgtttctagaccttattgtgattcaaattgaggtacacttattttaactgacgagtttttgttgacaaatggaaatcatatgttatataacacatgccttacaagttttacctctgtgcagtccctgaacaagaagtatggatgcaatgtccctttgcttctaatgaactcattcaacactcatgatgacacacagaaggttgttatttctcttcaattttttttagatgtactaggattttagtatttgggccaacttgcatgctaacggctttttattttttctgaagattgttgagaagtactccaactccaacattgaaattcacactttcaaccaggtatagagctgcttctgtgctatgtttctgatttgtcgcatttttgcaccatggtgattgttaattaacataatcgtgtttcatgcagagccaatatcctcgcattgttactgaagacttcttgccacttccaagcaaggggaagactggcaaggatggctggttagtattctcagattattccaaaatggctttggtttatacatttgactataaccacttatagtagcagatcaaacctccctaaatctgaataaccagtttttgaatgtgcaggtatcccccaggccatggtgatgtgttcccctccttgaataacagtggaaaacttgataccttgttggcacaggttagctaaagtgctttgacctttcatgttggcattgttgttagcatcactacttgattcaaattggttgtaaacatgcgcacatagtcatgcaccacactccaaagatacagacactgagctgtgtgatgtgtgcttatgcttattcatcacacggacagcttctttgccatttcacgtttggtgaaactgcattaatcttgttgcttgagaaaattagaggaataaaaacatgttttccaaagaaatagtaaccaaactatgacatcaccttttggggctaacaatcataaaaaatgaatgcaatactatgactaaaaatatgtgagttctttattgcatattgatactcgtgtgcttacctattttcccattcttctcagggcaaggagtatgtctttgtcgcgaactcggacaacttgggtgctattgttgacatcagtatcctaatatgaagaccaaaatcacatgttttttcccatgtttttatcacttattaatgcacttcatcttccatcagagtttgaatccttaaccatcacagagatcttaaaccacctgatccataaccagaacgagtactgtatggaggtatgcagcaatagttactatactattgttattgaatatgcacaacatgaaaattaactcctgtatttattccaggttactcctaaaacattggctgatgttaaaggtggtaccctcatctcttacgaagggagagttcaggtacttgtttgttctcaacttggtgtcataatttaattgtctgctaagaattgtatccagaaattactatgtaactagcaaaatgcaatgttaaaattgaaacaaaccactctattatcttgttcctattattttcagttagtgtctgttcctgttaattccagtcatatatatcactaagctttgaatggtatcatgtattttttttgtgtgcagctgttggagattgctcaagtccctgatgagcatgtatgtaccctccactatatcgttttatttggattaatgagcggcaagtgctgatgattatttttcttgtcttcttttttcccaggtgaatgaattcaagtcaattgagaagttcaagatcttcaataccaacaacctgtaaggaagttatgctgtctgtctatctgtctttgattaggaatttctcgcttgctaacagcttctggtaacaggtgggtgaacttgaaggccatcaagaggctggtagaagctgaagcacttaagatggaaatcattcctaaccctaaggtatgccatctatggttctgcgtgtatctgccccgttctattctgtccattggcatttaccaaagcagttggtattcacaggaagttgatggtgtgaaagttctgcaactcgaaactgcagctggagcagccattcgggtatttaactcttctagaaacatgatgggttgctgctccatttttgtatcatttaaatgctgtgctctaacacctttgctttatctagttctttgaaaaagcaattggcattaatgttccccgctcgagatttctgccagtcaaggctacatctgatttgttgcttgtacaggtatatctaaattcctcaccatgcttttgttgatttgatgtcatgattcagctgtgctaagctcattttcgtcctccagtctgatttgtacaccttggtcgatggctttgtcatccgcaacccagccagaacaaacccatcaaacccttcgattgagcttggacctgagttcaagaaggtaaatcagtttgtattcgaaacttttaaggcagcattaactagaaaagaaaagcaaatcaggaaagcagtgactagtgaaagctgagttgtgatcataactttcctgttctggatgactataggttgccaatttcctggcccggtttaagtcaatccccagcattgtcgagcttgacaccttgaaggtctctggtgatgtctggttcggctctggagttacactcaaggtaaacctactctagtgatttgatgacacttcttgagatactgtgacgctaataaaaacatgctg

SEQ ID NO: 47642 - DNA, 13574 bp, Oryza sativa
ccgccaagtcagggaagttggagatcccagatggagccgtgcttgagaacaaggtaacatacccatacctcttaaataaacctgactttcgcaactgcttagctcccctttgtgaattgtgatgctcgacctgacaaagtgtccattggataactttcaggacatcaacggtccggaggatctttgaggctgctcacggaaaccttccagatatatttagctgagcgttttgtaattgtcgtgtgcattcggcagccagggctcgatgatcccattacagaataattgtaatcatcttggcacatccgtacttctgttttttggtgtgccaagggcgttgtatttcatttacttaaatgatctcgtaataccatagttttgcatgcactgtagctgggagctcgtagtttactggtaattctattcagagtttactactgattgccacttcgtcagcttggcagtcgatgtgcgacgagtcgcacattacgacacggcctattgcgcggttgagctgaaattcgcaatcgcaatctaaccatactagtcagtctgccagcgaccatggtttccttgtcgcctgagcaggctggcagctgctcgtgctttcctctgcctgatgctacatgcctagtccatccgtagttctgtgtgattcagaaggatatgagattgcataattctacataaatatcttgatactttgtgaatgatacttccgtgagattcagaagggcacagaacgcataatgattcagaagggcacagaacgcacaattctgcatcagtttgatgatttgatatttcatttcattcttgggcacccacggaatggaaatatggagtgaaaccgagagacgctcagaacgaacggtcatctgagcggtcgagcagcaggcagaatggcaagagagtatagtaacatgttgcaggaaatactcgctttgcaactggaataaaccatccacatcgcgcaggatcactcaatccaagctgtgaaattcccagcatatgccacgttacaacctctggtccttccacaaaaattgaaaaagaaaaaaaaagcaacatctctagaaggctaaaataaacacttcaagaaaccgaacatttacaattccagcgcctagaatctattccagtgtggcgagatgccatgcaaggcttgaacagagattcgacactcagacaacagttccaaatccatgaccgatgcgatcgctgtgttgattatgactgctgtatatcccgaaattaatctcatcatgcaacatgattagtcaccagacttctcaagttcacacagccaagtggttgtcaatatcaaaactgcgaagatctgaagcaccagttcctatcctgaaacatagtaacacaagttggattttaggtacaatcgagatgccatgagattgcttccgttgtagaactccaagcatgcaagataatccattttctgctaattactaacacacacacacacacaaaaaaaaaacagaaatgatctgatagcagttcataacataatggccagttggctacgagactacaactaaattattgcatgcttgaagagatggcaggtaaatcaactaaagcaagattctgagtttagcaaacttgcaagttgcaatagccatcaggattgtcagacatggtaatgacaagtgggtagtggtcgtaccttttgtttatagtgcagtagtggaatttgatatttccggacttgacatcttcaagatactgcaacaaccaaaattcatctcatgagcttgtggtgccaaaatcagaagaagacaaaaaaaaatgaagaatgaacagaaagatttgagtatgggaaggcgggtttaccatcctcaaggtgacaatgatcgaagaaaatgctagagaatcaaatggtatgtcatccaaggcaaaaagtgcacattctagcgattcaggtccaggtgagaagttgggggtcttcaatcttgctcggaaaataatgtaactctactgcatgtcatcataacaaacaagatcaacttagtagagtattgagctatcatggagactctgacaatgctaatttcactcacttggccaatcagtggaatatccaactgagcaaaaggtgaaagtatctctacatctgcacaagcttcctccaatgtttcccgggaggctccttccgctgcagactctccaacctccaaataaccagcaggaagagtcctgttgatgcaaccttgattaggattatggaccaaacaacaagcaccaaaattgactgggaatgactgcctatgctttacaaatgactgggaagagacaaaagcaatctcaacattgttgcattagaaaaataggaaaaaggaacaccgttttacatactagaatcatatcagtcaccagtcgatgtgctaaacataaaaaagaagtgtatttaaactggattggcaagagtgaaacaaaaactaacactataatgtaaagaactgtacagttttaaactgaattggatacagcgtgcatgtactaaattgattttgattattatattcatactcaaaataaagcttgtacagtaaaattggagcatggtaagactgctagttctctagtatagtagtatcacaacaccagtaaagtagaaccgtttaagaaaatgcatggagttgataaaagtagcttaccaaaggccataagctggttcgatctttcttctgcaaaggagtactttgttatcatgttccacaagacagccaacaacctatcaatatgacataggttaatggcaaaatggaagacgaaagccaagtcatactattaaacatatatacgccttcaacaaagatatatgtgtgtagtaaaaaaaacagagcagatatgcacagaagaactccgaaggagctggaactctatttgaatcaagcaagttacagtggctaaattctcaagtctaaatgcatatgcatcttcgaagatggtctttggtcctaaatttcgttctacagttcgtaccattttggggttctcatagtgaactcttccacaagaagagcagacagccctcatcttttcatctccatctggaatagccagtttcgtcgggcttccacaagatgggcaaaagcgtatctttgacttgggcacctgtagaagggaaacttaggtgagatcaaatgtgtatgtaacaacatgacaacttaacacttaaatcagtacaataactggaaatcgatacaacgatgccatccagtgttacatttattatgataaaacactagctgaataaccaagcaaagagccaggctaagcacaaaaggccaatttccaacaccaatagtgcagaaggcacagtgccaacatcgttttgaccttatacacagctaattagagctggcacaggaataggatttccgagtggattggttagctgatcaattgcactctttgttgcttcccactactgtgcacccgtaccgtaaaatgttcaatctaaataaagtcatcagtattcctggttgctttataaaaagaattgcacaaggtagatgcatgattcaatcagagaacactgcaattctacaaattgtttgcagaggatgcgattatagaggctcagtaagcgctcctcgctaggcaattggtaaaggtaattaggtcactggattagagtcaacgccctaggtgaccacgcacagcagcaaaattctgggtgcggcacccgcccaagcaatcccaatctcactccctcagcccgatgactgcagcgcggacacgagatagagcgcgcgggggctcaccacggggggaggcggcgagggggcgggggagctggcgttggaggaggaggccgacgacatgcgtggcgggcggagcctactggccgcggaggcggcgcgggggagcggcggcgggtggcggaggaggaggcggtggaggcgcggggagaggcgggcggcgtggtggtggcggtggaggaggaggtggtgggatctgacgaggagcatggcgatggtggattttagtagtaggcgagaggaggggagggttggtgggcggagcggaggagaggaggagagatggaatggcgaggacggcgtccgtccgggcccgggtcaggtcggcgaggtgggggccccggggggtgaggtaggtcggtcggtcgacacgcatcgcgtcgccgccaatggggtcgacacggagaaaactatggtcggcctgacgtggcaggtttatcaatggttttttttaagagcaagtttaaaaggacagtctactactggctccaaatcatctataaccaatattatagccaattcatataatagttgcttactatactattaatacttggtcccacctgtcatacacacattatgtcttggagtccatactgcagctggctacagatatgtagcccgctgcttttctctcttttttttatctctttaaaatatgtttatagctggctcatagcctgctattgtacttacactaagaaaggacttctttagttcccaaaacaaaatcaatgacacagtttacgtgtaaattgcgagacaaatcttttaagcctaattgcgccatgatttgataatgtagtgctacagtaaacatttgctaatgacgaattaattgggtttaataaattcatctcgcagttttctggcggaatctatatttttttgttattatactacgtttaatacttgaaatatgtgtctgtatatccgatatgataatcaaacctaatttttttcctaactaaaacaacatgcgattaccgaaagaatctttgaatcgggcagccgatcttaaaaaaaaatcgatcggtcaaatgttgcaattgaccactggtgaaacattgagttatatatggtgaaaaaaaatcacggaaacatttaacttggacttgtgaaggggtagaaacattatatcgcgtgcgtggctaggtcaataacaatcaaagcggacagaaaacgatcaagaattaatggaagtgttaaaatgggagggaggtgaactttagatgctattaaagtgaacttttgatgctataaccaattttgcctaaattttacggcatagctaaaaaccagagagactaaagaattagaaaacttacaaattcaactataatatattagtaatataactacatcttcactcataattatattaccacacgtaatagtaatatataaataaaatataattacattgtaacttagaaaaatattatcacatgcaattgtaatataaaaaaataattacattgtaacctaggaaaaaatggtatcgctatgcgttgctactttttctctctccaactgacgtcatctcagatctaatctaatctaaaagtggaaaattagtaagttttgctctctgatttctgtcgacggaaatttagctgttccgcatgttatagtcgagtgtaaaaaacgtacctaactaaacgggtggcattagaaaaaaaaactaatataaaaaaattagaggaggtgacttcaggtgccggggctttcatcaaacaggtggcattggcaacggtggccgcgacgtcacctcccggaagatggccagtgacttggcgagggcgtcgtgtgccctcgcgcgctcccggagatggtacaaggccttgtacgccattatcagcacgaggaaggccacggcgacacacatcacgaccctgtcgctggtgctgcagtcgcagacgagatgtggtagaacgacgaggaggacgaagacggcggcggccgccgcccccacgccggcgacgtgaacctgaggacgaattcagcgtcgatcatgtcgcgtaccagcgcgtccgcgtcgtcttccgacatgcccgacgccaccagcggcaggtacttctccatgtacgccctctcgagcttgctgtcgtccagcaagcccagcggcgccgccgcctccagcaaggccagcagcgccgccgtcgccgccgcgctcgtcacggcgcccgacgccaccatctcgttgtggcgcgccgcgcaccagtctctcctcttgaggaagtggctttgcgggccttgcggcagccatccgacgtgcaagtacttccagacgtcgtcgttgctgctggccgcgtttttcggtggcgccgccgtgttcatcatggccgaccggtttgatgcgctctttctttttagaaaaagaagaaaaatcacggcacgaaaccaccagcaagtgccggtctggctggctggaatcctgcatcgtatccggattttatttcgtcgttgtaccgatccgattcggatctgtattgtatctgcatcgtatctggattttgtttctgtattgttttttgggtttttttatacataatttatattgttgattgatatataccacctttttgttatgagtgatggttattcaagatgcatggtgaaatcaattaatcaatcaaaaggcggtcctcccgtgcggacgcacgcattatggtcaaagataatccttaatttgaaccgatcggttcgttacttaagaggctaatcagtaacggaattatctccggatccgaaactaattatcaggccgaccggatttgggttttcgctgaataaaaagcaaacgacgacgcagagaatcagagaaagaaaaaacgaagaagaagaagaagaagagcggccatgagcgacctagcggcggagaggcggtacaaggaggagcaccggaagctgatggcgtacgggatggcggacgggtgggcgtacgggatggcggacgggtgggcgcgcgacctgatggacaaggcgaccgaggctcggtggagggtggacctggggtcgtcggtgtgggtgatcctgctctgcgtcgccgcctgcctggcgctcggcgtcggcttcccgctcgtcgacttcctcgtgctgcccagctccgagaacgccggcaggatcatgctgctcgtgtgggcgctcatcggcgccctgatcatggcgtactacgcctggagccattaccggaagcgcgcggcggcgcaggacgtcctcgccaaggcgcaggacgtcttcaaccaggctggggtgtcgtggccactcccagtttattgttttaagaaacccagtacaaacttataccccgacaatatgggtccaatcacaatcagattaactgtaccctctgtagacacctacaatacgagtacagtcacctcctatgtagccaccgacaatacgagtacaatcacctcctctacaattgtacacccgcacaccctcccactttagcatatgttgttcacccagtttgttattctttgtacagtggaaggacatgtcacatagacgttgtagtgacttaactagcacacccaagatagttcaaatcttcatatgagcaaaaattcataatctaaaaaggccgtatatatcgggttggatgtagatgccgggtaaaaaatacccttttctaaagaaaaactatactatgtactaatattacttttggggaatttgctaaaattatggtgtcatttttcttacgtaatttcattcatttttttcctatgtgattgcgttgccaaaaattatgtatttgtgtacttttagggctctaagatttttttcatatgaggtattcctccatccttggaggggcatatacctccctattattttagtgatacaaattaaaaaaaatgaaaatcttagagccctaaaaccacacaaatacacaatttttggtagcgcaatcacatatgaaaaaaatgaatgaaattatgtaagaaaaatggcatgataatcttaacagattccccaaatactacccaaatactattttttttcctatgtgatagcgctgccaaaaaaactctgtactaatattacttttattcagtttttttatttctctcaaatcagtccaatggttaaaaatttgtaagatattagtagaagttttctatcaaatgaggagtagacagtcacagtcccaattaattaacgttgcctgcacaaaccaaacacgacatatcacaccgcctcatttttacggcttagtgagggagatgacgattcatcctttgagaacaaaatcactcgtaatcttacatatcatgtaaataatatttttttaacaaataataataaacagtaatataagaaatatcactccacgaatatgcgaggtaaaattctgagttctataagttataacaaaatgaacaaaactaaaccacgggaagttaaattttaagttgcatgctgtggagtgtggagtgccaattactatagagatgaacccaatccagaatatgaaccgtaaaagaaaacacctattaaaccaatcacagcaataccggttacagtacctatcagccaaagaggaattcttccagtagtatcggccatttcccctactttcctccacattttatcaagtggtcatgctagagacaaaaacagtcatggatagttataaggatggtatccttccaaatggggataagagaattcttactactctctttctttctctcaattgaagaagtaattggaaaataaaacagcaagtacaaaaatgagtaataaaccccagtatagactggtacgattcaattcaacattttgttcattcgggtttgattgtgtcatagttctatagttggaatttggtttatcgttggatgaactgcattgctgatattgatcccaagaaaaaaacagtaggtacagctagtccgtgaacagccagccatcgcactgtaaaaataggataggttcgatctatggtcattgagggcctcctaaaaggatctactaaattcatcgagttgttctaaagaatcaaaacggtcggttattaacggaattccttgtcggatatactttatatttatctaccttatcattttatttccaaacgttttaataaccacttaggtgacataaaaataaaaatgaggggatttcacttttcactcgttgagagcgaagctagccatcggccccaccaaaaaaaaaaatccacaatacgcgcggcggcttctttcctctttcgctccccacacccttcttttgtcgcgctgatccccagacgccggcggctactgcgtttgcgatgcccgccgccgccgccgccgccgcgccgcccaatcccaacgttctgcagctagccccacgcctccgaggcctcgtctccttcccctcctcatactcctcctcatcgccgttctccaaccgcctccgcctccgcctcccccgcgccgcctccatgtccgccgaggcgcgggtgcccgtggcgccgccggcccaccccacctacgacctcaaggccgtcatcaacctcgccctatccgaggacgccggcgaccgaggtacgcaacgtagatagcagtcgtgtatgccgtgacaccacaagcaaatcctgttcctgtagtggtgtagtgtagtgtaggcacaattaagtactaacatttgttttttggtattcatttctggtctgtaagatcactttgttaaggctctctttgtttaggcttataagccaacttataagctgaaaagtctaagcctaaacaaacaagcggcttattcatttgacttttctaaagttataagccactctaacattattaaaccaaaaactaggttggagaagttttttttgacctatttgagatagatgtatgactccaccactaaatttagcacattaaatccaccagcttataaaccataaaagccaataagctgacttaaaagtctaaactaataagcctaagcttaaacaaagagggcctaagtttcgcggtggtctgtaaattgcaatcccatatatgcaatcaatttgtttggggtacatttatatctgttgttttttctcttcagttctttaacagttactagcatagtcatgaacgtagacactgcggttgtattagcaaaataagtttatcatcattggagattcctacaaatatgattaactctattggagctaaaggaacatattcaggtgggctgctctgctttagccctctgtagtctcctaaatagtactagtaacaatctagtatggtaatgctacttaagttcttctatctttgacattgaactattgctgtgctttgaacttatttgcagttctcatctttcagtatgagtctgacactcttggcatcatatttacaccttcaggggatgtatcttgcttggcaaccataccttctgacgtgaaagctgaagccacctttattgcaaaggaggatggtgttgtcgctggaataagcctagcagatatgatatttaagcaagttgatccatcattgaaggtatatcagcttcatagtttcattttgctgtttggcagggcatgattctgcacatttcatatatggcattgataataccattttgggggccattttacaggttgaatggtttgaaagtgatggaaattatgtccataagggattgcaatttgggagagtatatggtattctgcctaaaacaacttattgtatttggtagtgcctaagttcttgaattgtgttaacctggtaggtctaacacacttttcacattttcatcatttgtatttaggttgtgctcgcaacattattgttgctgaaagagttgtgctcaatttcatgcaaagaatgagtggaattgctacaatgacaaaggtgattggtgaccttagttgatagctaagatgttcgtctttttcgcagatgaagtgaaacataggcaactgtttatggactttggacatgtttcactattcaaacagccactctagttgctccttacatattttcctgataggtacatgcataccactttccagatttgatgataatcagccaaggctgattctcccgatctgatttttcagtaaaccactttgatgtcttgcttttcccagatcaagtatgattaaacctggtgggctgtgtacatatgatttggatgtaaaagctgggttttaatctatgttctaaaaattaatataattataccctgttgtgtgttatgtgagaatgaatttcatgcaacatacttttttattacattcaggccatggccgacgctgctcatccagcatgcatactggaaacaaggaaaacagctccaggtttacgcctcgttgacaagtgggcagtaagatacctgtctctctttttttttttgccactttaacacttgtggcttatttttcattccttctgttgcaactttaatcgtgcttgtacaagcataggtactaattggtggtggaaagaatcacagaattggcttatttgatatggttatgataaaggataatcatatttctgttgctgggggcataacaaatgcaatgaaatttgttgatcgattcttggcgaaggaaaagcttgcacttcctgttgaggtatcatctagtgattacatatatcacatctaaacgatgcacttatgtttgcatgtgattctgttttagctttacatttttctctccaggctctttagttagaaatgtgcttacgttcttgtttaaaaaaaaaaagctaaaatgagaatgtgcatatgttgacagtgattacattttatgaatcaggttgagacaagaacacttcaggaagtaaaagatttattggagtatgctgctgagaacaatacctctttaactcgtataatgttggataatatggttgtccctcttggtaacggtgatattgatgtatcaatgctcaaggatgccgtggagttgataaatggtagatttgagactgaggtgtggcaggtttaactttgcaaagcatacatttcctgcagtgttatttacataacatgggtgggggaagtgacaatttacttttattgatccttataatctgatgatgtcttgaactgctgttattattctatattgcttatttatactcattattaacttggggaatttagggtaaatatgatgtaacggtagactgcagggcttattgcatagtgaattcccttgtttaactgacgaattacaatgaaatgtgactgttgcttcaggcatctggaaatgtgactattgacacagtgaagaaaattggagaaacgggggttacctatatttcaaggtatcggcatcttgtttctattaactgctactaattatttccatttgtcaactgatatcatgtgcactgccttctgtttgagttgagatatgtttgcttttcagagcaattttgtaatacgactttaattgccagctctttgtttttgtttgctgttttactgtagaagaacaacctgatatcttgaacttccaaatcatttatttcaacaatttcttgattttcttttcagtggagcattaacacattctgtaaaggcacttgatatatctcttaagatagacactgaactcgctctccaagttggaaggcgcacaaatcgcgcctgactctacagaactaatgtaaccttgcaagatctgcaggtacgtttagttccccatatacaacttgacctttattttcctgcttctctaagctaactctttggagccatcagggtgtttctgtggcgtggcttgccagtctatcaatccatgcccttctcatcaacttgtaagcgttgagtgtacaacaaagaatgtgttttcccatatttatgggatataaaccaacaccacataatacagcaaaataataacattaccttgtaggcttgcctaccgtcctagcatttgtatttggtagaaaaaaaactgcagattgcggcaagttatcgaattttactcaggtattaataagactttttgcaccatgaaaaattagcaagctggacactgtaaatgggatgtgcgcggcattgaacttgcagttctgcacttgtgtttgaccaaacaaacactataaaatggtgatgtttgtgatctacaaaagaaaaggaagtctaacacagcagtgcattctttttcagattccatgtactcgtattgaattcatgttctcaattatagtatactagtatcattcaaccgtcttgtctgcgtactcgctcaagggggaaaaatatataaggtcaacttttttttccattaacaacagcattctgtggtccttctggacacatgttaacctatcgctacttttaccgcatccataactcttcatgatttaacccttctgaagattgcatccacaaacaagccttgcctgcagcgagacattcagaatgttttgctcacagagttattaccaccatcattatgttctatgcagctatcaagagggataaggggaaaaagaaaaaactttatatccgaaaatgcataaccatggtggtgtagcccactggttttgtcaatttgctacgtcacgctccccggaatcgacaagtgaattaatcaaaatcaaatcaactggagaaggtggctgtgtacgcctgtaataagtggggctgcggctggagtagccgctagtcggatccgttggttcaaccagcgcgattacgcgagcttgaaagttgaagccccagtgcggtcgcactcatgcgctcagcgctcgtagatgagtccgaaatgatatcattcgtacaggaacgattttaagttggcaagcactttttttt

SEQ ID NO: 47643 - DNA, 2440 bp, Oryza sativa
aattgagacattcaaattttatatataactaaaaaatttaaaacgattggaaaccatacttaggttgtgttggttgggagtgggttgggaatgaatcctcttgtacgtaaaacggaacaactcattattgcaggatcaattaagtattaattaaaaaattctgaaaataaatcaatatgaatttttaaagcgattttcatataatttttttttaaaaaaaacagcatcgtttagcagtggctctgtttctgtggtaagatttagtatagcatttggttacactttataacttccatcctactacccttttcctatgcggttgggtcaactcatttcgggccaaaacccaaggcctcaccgaatgcgttttgccgccatgggatgggaccgtgtcaccacgggtgttcggttcgttcgggtgtgttcttgcttgcagggtctcgagatgtgagaaagaaatcaagaatcttcgtggctaaacacaaagggggcagcagagctgcttaaagagacagaggagaggaatattcaaaggtttttcctttaaatgaaaaaataaagagagaaattccgatagcacacaaaagagatcatactacagtagcaaggaagggtcctagatcggtcagagctttcagcatcttcctcaaaaccacgctttcccagatgctatattctcctcctctctatagagctaagcaacgaaggctagctactagccatggagtttatggtatgtttggagtagcttctggtaactatatcttcttctacaatgtccagctgccatgaactttctcaaacaattcaaatattcactcagattcaaaatctatagttgtagaatataaacaataaactagaagctaaaagtttttattagcttctctaaattttcaccatctaatttctctttagctgcttcacgtaatcttaatttctctttatctgcttcacataattttaagctttccgaaaaagtttctcttctcctcggagtctcccacagcccaaacccagcaacgcgaaatgccaaatgcttcccatctcgcaagctgccaaccctgcagcagtgcagctgcacgtctgcgcggcacaattcggcacagaaatggagctatccgggacagggcctgaccaaccgaacggcattaaacaccatcacttgtagttgtagtacaggagtcggtctctcttccacgcaagagagatttcgatttctcaattcaattcaacaagtaccaaacacacaaacgcgagaacgccgaggaacaaagaggagggattcttttgattggcttctgtcaccggttttgctcatctcctacctatcaccaactaaaacattttcttaggtgcccacagaacagcaatgaacaaactaaacaaacactttggatttgaaattcatagcatacaccgagcaggttactgaatatcttttggtactaacatcatactctaagataatagtctatctatctaggagactaggagagtagttgatgagggatctacaggagcagaagaagaacacccacatcttgtgttcttgcctgcctacccaatttcatcatcatcatcatccattggctgatttgattctacaagaagaaatggaaccgaactagtactacaaagagatgatcaagctgctgctaaacaagtaataacaaaaatcaagattaaaccacaggaaggatgcaaagaagaagagtaatttctaagctaaagctgcttctgcctactcttcacatcaacatctgcacaggggaaacccggaaacctatgtacagttgagtagtacaagcccttgtctgcttcacgctttcatggcgtccgccgccgtgtcaccgtcgtcgtctccgactccggcgaggtcggcgccggcgacgctctcggagagcaccgtctcctcggcgacgacgccggcagcgtccaccacgcagccgtcgcggtggcggtcgcggcagagggtttccacggcgaggaggcggcggcggaggtcgtccatgtcgcgctccatcaggaacagccgctcgcgcagggtcaggttctcctcctccagccgcgcggtgcgggcctcgtcgccgtcgtcgtcgtcttcgtcgtcctcgcagtcgccggccgcgacggggagctgcaccatctcgaagcggctgaggtcgtggtcgaggcggcgctccacctcgacgtgctcctccacgtcgctctcgccggatccggagtcctcgccggggaggccaccggcgtcggcggcctgggagcggaggcggatgaggcccttcatggagccgtacccgtcgacgccccacttctccttggccatctccaccaccacctcgcgcgccggcgacagctgcggcgtcggcagcacggccggcgtgacggggcacggcgacaccagcgacgccacgccccccgcccgcttggcccggat

SEQ ID NO: 47644 - DNA, 45140 bp, Oryza sativa
  unsure (1)..(45140): unsure at all n locations
gccgccttccgctgcttccaccccggctgcctcgccacccgcttccacgccggcctcaccggcttcaccccgacgaacaccaccggcaactccatcaccggcggcggcggcggcggccacatctggtactgcagcggcggctgctgcgccggtggccgcatcatggggtcattcatggatggatttggggactaatcgtccagatccgaaaccctaaccctagattaacacccaaaaaaaacaatccaacaaaaaccacacgattagctccccaaaacgggatcgatcgaagccgtctcgtgttaagctctcttcgaatccgttcgcttcgtgtgtgtttttatgagattaatttacgaattttgttcgatccgatttgggggagaaaagcgaagcgagagaggaagagagagagagagcgaggagagaaggtgtggggtgggaaggggtacgagggtatttattggggaggtgggtaagggatggacggctggattggcggtttcggatacggacggtggagatctcctggcgccggttgcgtgtctcggatggacagcacggattgtaccgccattggacgcctctggttgtgatctggatgcgaactggcggttttctgttttttcttactttcttctcgtccataaaaaaatgtctactgtgagatgaattgcaatgctcatttgttagtaacatagtaggagtatgtgttactacgaaactaatgatattagaactaataatagggtttatcttggataaatcccaccagaaattaatttcgctagcatgactcaatcgggatgtttattaatattaatgttaacataaaaggtttactgatttttgcaggtgctagatttatgtagaaatgtcggtcatatcctactaaaaacttgcataaattttgcttcatatagggagtaagtgcctccaactacaataattgttttctttcagagttataccaataacgaataaaagaagaatgttttccgaagatatgtaaagttatattcggatgtatcaattcttaacttacttcctcgtttttcacatgcgcatttcccaaactgcttacatggcgcttttttatgaaaaaaagttctatagggaagttattttttttaaaaatgatactaatcagttttcaagtttattttagctaattattaattgatcatgtgctaatggattgctctattttacgctgaggaggttgagttcccaacctcaacctcctaacacagcctattatcaattaatactacacgtgtggttgcgctttagtaagaattcaacaagggcatggatttttaccattgagcgtatattaatagatacacactcacaaacgtgtgatttacgtgcatggcatgtatttttcacacaatctaaaaaaacatcacatatgcgtgtacacaccacctatggctatagcttagattacgagacgcatgtaaaacaaagcttcttaaacaagctaatagtttatacagggtgtcatttgacatactttaacaaagaaaaaggaacttaaaatcaatgtccatagccctttaaaaaaacctacggcgtttctacaaatatcttttgaaaagcttcatgtcctctccttttatttctgctactatcagctctgttttgtccgtaagatgttacctttgctcttaccgacaacaaggaggaaaagaaaagaacatctaggtgtgtttagaaacttgcgatacaattaatataccaaattccatcatatctcaccgaaatagaaacacgaaaataagaggaagcataacacgtaggtgcacatgacttggctctctttttgacccaaaaccaacaaaaataaaagcacaacatattaacgattcaagcacacgcgtttgtcaccggtcaaagcaacgaatccttggacgcccccctcccaccgatgagccacgccacggtagcttccgctcgtcgtcccggtctctcaccccgcgcaggccgccgccaccaccaccgactcgctcggtgcacgcgccccacgtccaccggtgctcgcggatgcagtaccctgtctctgtgtgtgtacgtaattttttttattttatctattcaaatattttaaaaaacaatattttcaaagtattacatgtatatatatacactcctcttaaagaatgtcatcttagagaatattttacttatgacatggcacgtaaccattgcacgtatgctaacggctacgtgaaggagaactgactattttgtagacaacctccttaccattctactagagttaggctgcacgactgttataacgcgtgcaatgtcataaacaaatatacaatcctcccaacaacggccattaggggtagatctgcaatactttttgaaaaacaattactttctaaatattttagtaaataaaaattaaaaaaaatctgtatgtacgccttcacgctgggccgcaagcagcgcggtcacggcccaaagcggaagaaaggcaacaaagctgcgaacagctggcccattagtgaagttgggccttggatccgagcggatgaatttttttcggttttagatttttttaaaaaaatatttacagaaataatctatcgcccaaaaaaattacaaaaatagaccctgccgcccacctctggggcggcaagctgacgtggcaaacgggggaggaacgggcggtgacggagggagggttttttgcaggaaaacccttgccgccctctggtggggcggcaaggggcccgaatgcaaaaaagccagtcggggccggctattttgcaggcggccccttgccgccctctggccgggcggcaggcctcgctgcctataaagggcctgctgcccagcccccagccctcattcttctctcctcaattccagtgaaaaaaaaagaagagaggggaggagaagagaagaaggggcgaagccctgccggattcagacgccaatttcaggtaatattcatagatcctatatgtgactattgagttaaatagtgtgtattctttaaaaatttgtttgaataaatgcattatatttttagggttttagttgtactaatctagaagtgcgtattgtaaatatcggtaactacgtagatctgctagtttggaatcaatacattaccgttgcattggcttacacaataagatattatgttgtagatgtttattgcatgaaagagtaatatgatttgataataagatgcttattttctcacaacatttattaactttgcttgctttacatctattctttcctcccaggaaccaccaaggagatgtcaatacagagaatggatagacaccagaagggttctaactccacctagccgtgttgtgtagcttgaactaccagagcaatacagggttactaaagtgcggtttgagagaggagagggatcctcactgacggagcgtggggctcctcaccgggagaccgcgcaggcccccctttgccggttcggccgggggcgctaagtgaggttcttcgccctcgatctgaggaacgtcagcgagagaggaaatgcacaagacacgggcgacgtagacaggttcgggccactgagaagcgtaacaccctactcctgtgttctggtggatctgtgcgtgaaggaatacagagaggcggagagcgagagagagttcaggctctagaaaccattcgccagagtcccaatccccctctcccctaggcctgggcctcctttttatctggttaggggtcaccacatgggcctctcgctgcctaagaagggaaacatgctttttacaatgagggctagtctatagccggaagtgacctctgacaagcagagcacacgcctcctgccccactcgcccgcttttccggtggacgcccatttcaaccttcatttaatggccagcgacttccttgccatacttgcgttgaagcctggaatggatctgaccgggactgacataccaactccaggagttagcacgccggctccggctagggacgagagccaggaagctctcatcattccgacgggacggggcgaggcgtgtgacaggccgcctattgccacctaacccgcgatctgaccggtctgtgaccggtcacacaccgcgaccggtcacggatcggataagcatgcgctgcgccgcattaaatgcggcgtggtgcacttcgtccaacctgctataaatgcggttaggtgagccccgctgtgctcacctaacccacacacgtggcgccaaaaccacagggggtcggggcaccccagccctcggggccgaaacgggagcggcccgacccctcggggagacagagggaggggtggccacgtcaccttcgggcccgacccccccgaggaggtcaggccacgtgggtgaccgcggctacccaagcctctagtcacgatacccccggccccatgtcaccgacactcacgtaggggttagctattattggacaacttggcatattgaaatttctactgtcatgcttccttgtcccattactacatcgtcgttgtgttcaactattgcactacctccctcctagttcgaatctaatatcatctatgtaaccgcaatgcaaatagtcatatcatgttcaaattgtactactatttcttcatgttacataattctccttgtttaagtccatataatgtttctacgacccagactgcgataggcctatataaattatccgagtactaatacgtcgaataaggtacaaaaataatacctcacttaacatatgaaattgcacaacaaccaacttcaatacatttttataacaatattaacaagttttaccaataaatacttctttatttattattaacataacatagaaaaatcttttggccgtactttttttatctgggtgaaggcggcaagggatccagatgaaaaagtacggccgcaagctctttatgggcggccaaaattgcaattagccccttgccgccctctgtatgggcggcaagtgcctaatcgcaattttggccgacggcggcagacggcgcggtcgacccaccgtctgccacgtcagcttgccgcccaccattagggcggcaggggctatttctgcaattttttttggtcgatagattatttctgtaaatattaaaaaaaaatctaaaaactaaaaaaattcccaagcggatcaccccaaaacgggtcctgatcggtgacacctcacgccctttttttatgtttttttttctctctctcgtgtaggctaatcaggggaagccaagagccaggcaaatctcgagcccaacctgctgcacgcaagaacagagaacgagcagcttcggcggggaagaggaatcgaaagagaaggaaattttgatggcggaggaggcgaagccggacacgcagctgttccagctcctctccgacctgctccagcaggtacaagcgccgccgccctctcgatctgttgtcgatttcttgtttttggattaggggtggttcatgatttcgccgacatggatcttcgcttcgtgcggatgttgttacttttgcggatctagtatcacatatcaatctcggttgataccattatttatgtaaacctagttaatttgttttggggatagatgcaacatggcctatggcctgggattcgacctcaacgacatggctgggagagaagcaaaatagcagcatagtgcataggctcagagttgatgtagttaatctctttctggtggattccttgctttatgttactatgcactgcgcgccctgctgtgtaatgtttacgaatctgaaagagtgaaacatgggctattgatttgggtcattgggtgattgaaggtcaatgccaactatcaatctactggtgattggctgggattgattccttctcgttctagcaatcaaacaaaatttcctatctaaatcaagctgatctatatcagcccctgtttcaaaactctgaactctatcaactacacccattgcaacctggaggtgtgaaactctttttcttttattttcatatattcatatttttcaagctatgacaagacaaaacaacaacaatagaatcccttttctttttgctgtatttcccatagaaccacagaatcagcggcatgatcatgtatattagggccaataacctcacttgaaacaactagtgaccattcaccggtatctgaaactcaacagtttaccctatgagtgataggaacaatatacaaaatgctgaatcagtactacaaacttttttttttcatgagtgtagtcttattcttataaactgcatggtaatctgagtgtggaaccatgaaaacattcatagacatgatcacttaactgaacacttacttctcggtgacaagtgaaatgccatacaggattagttcattttagccctctccatgagggttctacttaacattgtatctgcaaggtattgtagtctattggaccttggtacccccatcactgactgtcctgtttgtaggcgtgtctacatttttgcatagcatgtaatgttttgtcattattggggcatctgaatctgtatagttcattgattatagcattggaagtttggatcctcattatatgcaggattgcatgtggttgttactttacattcatttctcgcagttcctcaggatatttctgatttcttactattcaacatcatatctttttgtgatttggataagacgacaattgtcttttgatgcttgactatgatcattgagaaagtaactagtatttgattattcaaatgcaggtggagtcaatgagcaaccaggaagaagtagaattgcgtgctaagatcgaagcactaggactagaagttaccaaggtaccagagcagacacctaagcagcttgatgaggtaactgcaacaacctctgtttaatcccctttccgcgaatttatttacattttctcatctcatttgttttcgttcaacgctatctttagttagagatcgcagcagagctggacaaactatcagcgaggcttgataatgttgacaagatgatatcttctgccatggcctcggatccagaggtgaaatcccttttgagtaccactgctgatatctggatgcccgtcatcaccgcctctgccgatgaaaggcggggatttgcaggaacaagtggtgaaagcaaccaagaagagcaggagagttccaaacaatagcctcctacatgtaccttcacatgagtatttcttgaccatgtatcaacatttgtagacaaaacaagcaataagcacacattcatgagatggtaaataaatctgataacttgtggtggccattttgtacatcaattcttgagtcttcagtttgttatttttcagtttcgattctcaaagttgcgcctgcagagtgcagctgtttgtagctagcaaccacaacatttttatctggaaatgcatcaattttgtgtatgatgttgattggagtctgataacttgtcactggatgacatgattattttgtcttgctcctgctgcatattgttcatctggcgagccacgtcgattgttacataacagccactaattatttctgaaatatttgctcgctgtaatgcaacatagaaaatccaactatccgtttggattaatccataccaagagttcaagagagcagctggagaagaccttcttggcgccaaaccaacggccgcaagaacaccacagaattcaagaagagagaaacctcacaaatcgttcgtctcctcccctcctcaatcccaatcccgccaaaactgtcgccattcatggcgacatggcgccatcagcggcctcccttccctcgccatacacttcgccctcgccacctcctcctcttatctgcttctttctttagcttgctagctactagtactagtaattgtagtggtgagtcgttgccggcgaggtcggagcagcagcagaagcagccatggcggacgacggcaagagcagtaaccagatcctccaggagctcgacgcgctcagccacacgctgtaccaggcgcacaccaaccgccggaccgcgtcgctcgcgctgcctcgctcggcctccgaggtcaatggcggcggcgccgatgtcgtccgggccgagtcgcgcccgcggtcgcggcggctgtccctgtcgccgttccgctcgaggcctaagcaggacaagaacgcgatcgtcgacgacgacgacgacgacgacggcgacgacgatggcgacaagggggcacgccgcgcgccgtccaagagccagagcttcgcggcggtgacgaccccgggcggcgaggcggcggcggtggcgggagagaagaaggggatatggggctggaagccgatccgcgcgctgtcgcacatcggcatgaaccggctcggctgcctcttctccgtcgaggtggtggcggcgcagggcctgccgccgtccatgaacgggctgcgcctcgccgtcgccgtgcgcaagaaggagacgcgcgacggcgccatgcagaccatgccgtcgcgcgtgcagcagggcgccgccgacttcgaggagacgctcttcgtgcgctgccacctctactgcagcggcggcgccggcaccggcaagccgctcaggttcgagccccggccgttcctcctgtcggcggtggccgtggaagcccccgagctcgactttggccggagcgccgtcgacctgagcctcctcgtgaaggagtccacggacaagagccagcaaggggagcgtgtccggcaatgggacatggcgttgccgctcgccgggaaggcgaagggcggcgagctcgtcgtcaaactgtcgttccagatcatggacgacggcggcgtcgggctgttcaaccagaccggagcagcaaccaagattaactcgtcgtcgtcgtcttcttccttgtttgcacggaagcagagcaagctatccttcagcatcacgagcccgaaggtgtcgcggtcggagccgaagctgacgccgacaaagggctcgccgtcgccggacttgcgaggcattgacgacttcaagctcgacgagcccagtttgccatcgctggcagaggccaagcaagagcagaaggagccagagccgccggagccggaggagaaggtcgatgactcggagttcccggagttcgacgtagtggacaaaggagtggaagggcaagaagagaacgtcgttgaagcgaaaggcgcggcggaagaagaagccaaggaggagaaggcggcggcggaggaggcgcccacgtcggccgccggcgacgaggtcgtgaaggaggtggtgcacgacagcgcgcacgcgtggcgcatcaacgagctggaggcgatcaccaaccagatcaaggctctcgagtcaatgatgctcggcgacgcgccggccgccggcaagacggaggatacgcgggacggcgacgcggcggcgctggacaccgacgaggaggaggtgaccagggagttcttgcagctgctggagcaaggagacggcaaggccaccctcgccaagtcggtgtcatcgctcaagtccggcgcgaagcgggacaccggcggcgccgccgacgcgtcggcggcgtgctacatctccgacctcggcaaggggctcggccccatcgtgcagaccagggacggcggctacctggcggcgaccaacccgttcgacatccccgtggagaggaaggagctccccaagctcgccatgcagctgtccaagccggtcatcctccgcgaccagaggctccccggcggcggcgccgagctgttccagcagctgtgcgccggcggctgcgaggccctgttcgagaagctggcggcgctcgtcgggacggacgaggtggtcggcaagacggcggagcagatcgccttcgagggcatggcgacggcgatcatcagcgcgcggagcgcggcgctcggcgcgagctccagcgcggcgcagaccgtgtcgctgcttcggacgatgtcgtcggcgatgagcgacgggcggcaggagaggatcgacaccggcatctggaacgcccacgagacgccggtgaccgtcgacgagatcctggcgttctcgctgcagaagatcgaggccatggccatcaaggcgctcaaggtgcaggccgacatggccgacgagcagtcgccgttcgacgtgtcaccggccagcgacaagcggggcggcggccacctcctcgacgccgccgtgccaccggaggattgggcgctcgcctgcgtcggcgccgacacggtgaccatgctgctcgtcgcccagctaagggatcccctgcgccggtacgaggcggtcggcgcgccgtcgatcgtgatcatccaggccgtcagaatcgccggcaacgacgacgacgacgagccgaagttcaaggtggcgaacatgcacgtcggcggcctccggctgaagtcggccgaccggcgtaacgtctgggacggcgagaagcagcggctgacggcgatgcactggctcgtcgcctacgggctcggcaaggccggcaggaaggggaggacggcggcggcggcggggaaatccggccatgacgtgctctggagcatgtcgtcgagggtgatggccgacatgtggctcaagccgttgcgcaaccctgacgtgaagatccctctcaagtagatgctgcattgctgcctctgtgcttctctgatgctgaaaaaaaaagaacatattcaagcccggttctctttatattcttctgaattttgaaagctcaagattgtaatttatacttggttcctgcattgtgattgtattgtaatgaggaaatgtgagtgtctaagaattagattccaacactgtttattgtgttgtaagtattcatgtcatgtactgaaagaggcataatactgtttctgtaagttcacaaagcttagttcaaaatgtacaaaaattttgaacaaggttacttatgacttatgagtcatacgagtaaggattatggaagctattgttgccactgcagctgaacacaactactgtgcaaggccatttcataagttagctacaataacaacacagataaaataagatcttagctttcatccttgccaataatatgcacagtggaggatcatgtgtgtacatgagcacattttgtcatacaacaatcttcaaaatagagctactacagaacatccgcaaacactagtgttccttgagaagtgctgatctactggagcttatgttgattgctttaaggtgtagggcatacagttataatgccagatttgccgtacatatagtatgcagtgtatttggctcagttggttgcttcctgaaactatcaattgtagtctttccaatagtcggtcagaatcatgcgccgatacttctctgtgattaaacgaaaatgtactaacaaaaaacgcttgtaaaactggtcaggtcatatgttaaacttcttccagttcacgaggaagccctccactcgttggcctgaaataaacagattgggactcatcagaagaaacctatcaggattctacaccgatacaagatgccagggcgccatgtcaaatttttaatggacattagctaaaacactaccatagaatcagaacaccaccctaaagggcaggagagtaccacacaagtatcagttgtacaaacgacaaatttaaggagtgaatttgtgtgattgtcaacaggaaaaggacatcacatataacaccttcagaacaattttagcatcagtgtatatttgaaacaccattgaagacattagcattgaaatgccacttgcagaaagagaacatggctttctttgtcaccataaatccactacaaatgcataactaaacacaatggggagacacgttcatatgtcgtgaaaaaaaaaacatttgcctatgatcttattgcattacaatcacttctgcatacaaacacactttgtattggttatacatagccaatccatgattttattttacctatgcatgttctcctctctactagatgattaagaaatatactacagtcacatattatgcaataaagattgatgtaccctaagaaaaatatcagcataaatgcaatcgaaaacccagcgtggagaaccgcagataagcttggttaagattttaaaccatatttgttaaataaataaacaaaataggatatcattgagaaattacactgcatacttacaatccagtcaatatcttaattgtatcatagaagaaccattgcatggttatgacaggcccaacaagagtgattcgaacaggtaggcttcttgtgaacaaaccacgaaacccaatacttttcacagcctgcaagagtaggatgcaaatattagatcattgggatggtgagagtttgaattattattataagctggagacacaaaatcatatccttacatctatgatatttttagcctttttgttgtatagagatgagacaatgttatctgcaggattggaaacaacagtaccaactgcaccagatatgtagccagccagacaagtagccccaagctgctgcattgttgaacaatcctcctttttcttctgaatgacattccgatataggatgtccacagtatgctcaaatgttgaaaacattagcatagaaactgcacgaatagaacaaatggtgataagatatacctgaacagaaaaaacatttatactttagaaaccaaaagatccactaatgaactgacacacttaaggcgaaattgcgcaaatgtttccaaacatcaaatacaggataaaaggaacttctgaaataggcagatagatgttgcttgttgccatatgtgcagatttaaaagctcagagttgactgagcagaaagaaatatgatccccacaagacaataacaaatcagaattacgcatacagatacagcttagttcttgccccttacaattaagtacttcacacctagagttttgttgtcagcgatgtgacttgtgcagttgtacctatttttgtaccacataagtgaaaacattttcgcaaaagaacacgcttagatcataacttaatcaaaattatttaagagttgcgaaatgagctcatttaactatgtcgcacattactacaaatgatccagaagcatttcaagcatatcatacagacggaggtactacatacatggaagattccgtccccaaagtggtaaaaggcccttgtaaaacctgcaataaacaaataagctagaggtaagaggaattgcagtggtatctcagatatacaatagggcaccaaccaacaagcaaagctaagaatatgtagtatcttacttgaagcttacccggacaagccttcagtggcatacacccttgggaagccatcaatcaagccttttgcaaacataggttgtgtctgcacacggactttcaccgattcaaaggggcagagggcaacatcagctatgatttgagcagaggcactgctaataaagtaaatggtgctcttatttctgtccactagcacatcagagtacttcttcttgaaatactcataaagaccaaacttgcagccaccttggaaaccatagccaaagaatttccctgcccaacccctccaaagagatgaagctccctcttcttttacaagaatgttcagtcccgaaaatatgctattgtacttcatgggattcacctgccaaaacaattaaagggaagtagtaactattataaaaccgaaggtgccctgtggatcatttatgaattagtaatgattatgtattctaaccatatgaaatgaaagattccaaaccttccatttgatatggtatacaactgagcatttgacattgctaatttaatatgaacaatatcagaggcagtttaatccttagactgcaagagtctagtaatgtggtcaaattcgcaactcacaaaaaagaactcgctcttctgcaatggagcaaagcaggcaaccacagccacaccgctctcctgcaataatagcatacctgcatgttgaccgtgaggacgtcgagcggggtgatggcgaggtgggtggcgcccgccgccagcatcccgccgccggtgcacagcgcgtagtactcgggcgagaacagcctcatccctcccgttcctcctcctccaccaccattggccaccctcgccgcccccgcctcgcccccacgcgcgcccatttccggcattccgacggacggatcggccgcccgcgaaggaggggaaggggaagacgacgaagccgaaccgcgccgaggccgaggagagaagaagaagaagaagaggaagaagaaggttcgattccggcgttgtgggagactggaccggaaatggaccacgtagcgaggccccgggccttcccctttccccctctctctcggggccacgttgacttgtcaacgcggcagcgcttgccttaaaccctagtagcgtggtccacctgtcagtgtcgtggtcgtggagaggagattttcttgggccgtcgtttcgtgggctctagttgggccatgaacagcagatggcccaggccggccgctcgttccatcgtgagctatgctgggccaggccgtagtgatgggccataagcccataaagatgttgctgtctttttcgctgcttttttgggatgaccaaagaaaatgtcgtccaaaacattgttaagagtgggagaaaaaaagttactgtacaagaaatactatcatcatctaaagaagactgtggatgttggcttgtataccgcagtgcacatctagaaatcacgtaccaatcacataaaacatgtcattaagaacggggcctaacaccaaagctaaggcccgactaccatgagctagcaatgagctgggctccaccaagcgcatgcaacgattcaccaataaattaatgcctaattaccttactaattactccctactttctaaattgatcttcacataatagaatacaaagggcctgttcggctatattgtacagcgctgtttcacagccacgttatagcttgttgctgcagcaagaggactgggtgcaggctgcagggcaacgctgtacacgacagccaaacacgcccaaaatttctcaaattgatcatgatatgaccgcatggacactgatttcattagaatataattaatgcagcatgtgagaatgtgtgcatgctaaggtgtaattggcatggtgttttaatcgatgtatccattgtggtagaatgtgtgcatggtgttttgattgacgtggtttaaattattcttgattttggtgtataaatttatatgatgatcaatttgggaacaagggagtacttttcttagccaccaatagtgcgtatgaaacaacaacacagcagcaaacgtacttacataaatttttaaagcaaatactcacacaaatgataattgaattatatagatttgcccaaactatcaaaattttaataatctgccactaaaacagaccaccgctatgtgtgatcgtcgccggacctagaacatcaccccaaagcagagtcataaaaaacgacgtcttcacggaggtgttgctacgtcaaggacgtgtcagtcactcgttcaagaaaacgggacgtggtttttaacttaagagattcgatctcgccaagacgtacaaaatctggagttcctgctactttttcgctgctcggccgacactattgacaaaggcaaagtttattctgagagtttttttaccgtacagcagaccaaagcggtaccaaatcgtcaccgttgagtagataggatccaacggctgtcatcgctgggtaccgcgaggtaccaactcgtccttgtggtggcactgtattaggatgtggaggtggaagggtatttctgtattttcgcatggctgattcggtcttatccacttcgatcgtttcgtccgacgccgcctctctctccatctccatctccgcaccggtgaatttttccccacggcgaccgccagcgtggagaagagaagtgtgcagctgacggccccggatgaccgcgtcgagaacgacaagctcggcgccgccgaggaggagctcgtctccaaggcggaagcggcagcgactgatgtcggagcgtccattgaaaaagtcggcgccgcgtccgccgttgagaacacctctggcgtcaagggtgctgacggcaaggccgtcaaggcgaagggctcacggtgaacacacacacaaaactcacgtcgccggcaagaacacacacacaaaactcccgtgaacataggaatgaacaccatcttgtttggtgctgctaactaggcagctttttcccaattcttgtattgcttaaatatgcgattacaaggaaaggaaattatagcctccaatcagaccgaaacatgcatgatcacacgatggatgtgtaactaaccaaataaaacaaacactaatctagcacacaaggattaatctcaacagtcgatgacgagaagcgcggcggcaccgaggaccagatggcttgagagcgtcgaggaaagccggaccccttcgcgtacaggttgacggggcctcctcttctccccgtcccccggctgctgcgccgtcgacgagcagggcaacaacgatggcgacggtgcatctccacgggatgaatcagcggagtcacaccgcacgatgctgcgcttcggggaagagagaaaggaaaacgctcgagaggattggttgtacacgcggtgcaggagcggtgtgtttccacatgttcccatcatgccccttgcgagcgaacgacagggatgatttcggtaccgtgcggtaccagtaccgcaaggtactatctgatggaccagagcaaacctcttattctgaaagatgatcaaagtcgctctagaacttctgttccggattcagccaaacttgaaagtaacttgagatcgtatatacgaattacagcgagaaatctacaatggtagccaacttttacagataactgtgagtctgtgatctcgaatgaagacgatcaccgggcaaaaaatatctgcattttgtcgcatatatgtgtgtaaacaaggcagttttttggaagttctatgtctgtgcattggcacttactattatctaactgaagatagatggagttgagtgtacgtttcaagcaacacggccgtcgattcacacgcatttgttggtttttggccgcgtttggcgaagaaagaggaaagagtagaattgccggccggccgccagaagcagctaaaccccaaacacagctgaacggctaaagcatctctctgcaaacatcaaaaaaagggcatcaaacctctcacatcaaactctaatcactcctgcttaaatcatgagcctgatcgtggccgtctattcagagattagagtgaagcccgaatttctcttccgcgtggattgataagcttgaaagaactgcaatcgaagtgaaagatgaaaagaaaggtggcaatcaaagtgaagatgaaaaaaaggtggccacgcctgccggcacctcctgatttcagtagcaacatgtcactgtgccatcataatgacaaaccaacgaaccaggacatgtttagtactcgtttattcgtgcttcggttctgttcgagagatctcaagacgttaagaaacagtcaagcatctgttgagaatctgaaaattctgaatttttcagcttctagcttctgaattatatctgttgagatataatcagcatataaatgacacggtttctatcccgaatgcataaaaaaattaacatataaatgacacggtttctatcccgaatgcataaaaaaattaacatataaatgacacggtttctatccgaaatacgtaaaaaaagacataaatattagagaataatataatatcaaataattagaactttagaaaaggtaaggcttctaacccagatcatctaacccactactttgtagaactttagaagaggtaaggctttcaatccagatcatctaacccaccaccttgtagagatagctggaagaaccatatgcgtatagaggagaggagagacgatgagtttgtttggcaatggtgcaatcaaactgtacggcaaagtacgtgagctgtacgcagtcggcatattctttccccagatggggcagatcaattttttaccaggtcacgacgacgtccgtactatcagggcgaacgaacaaacagttacgcgtgcgaaaatatcccaacccaacccgcgcggcgggcagcaggcagtgcccccatgccggccacgatgtgaccggcggcctccccccgccgccatgaatgatcgctccactcgtccacttgaccaccaaaagcgacacaaatctgatgcctttttctccttttttccatcccaacctcagcttactggtcacatatctctttactattgctactctagctgtgtactatagcatcagtactaaggaagaagaaaatgacggttaattatcgttcgaaaaagaagggaaaatgatggttaattaacagagatgtgtacatgcatgtatttacagaacacatgtatctactacagttgcattgctgcgtagtacaagaaaaaatctctcggaacacgtatctactattcacgtttttgctaggtgtgtgtgtatgtacaatcgaatgatgcacgtacgcgagcgagagagagctggagctctacggcaccgatgtccggcagccgccgcggtcgctggcgccggtgggttgcggtggctgtgacgacgcctgtgccgcgtcggcggcgcagcacggcggcggggggtcggtggcggcggcggtgactgcaggcgacggcgccgcgaggacgacgatggcgcggcggcaggaggggcaggtggaggtggacacgagccagacgtcgacgcaggcggcgtggaagccgtggccgcacggcgggagcacgcggacctcgtcgccgcgcgcgaactcggcgaggcagatggcgcactccggccgctcctcctcctcctccgccgccgccgcctcggcgaacgacacggtcggcagcgacagcagcgccttcctcttgagccccttgcatggcgccgggggcattgcctcctccgcctcgacggcgaacgacgacgggttgcacagccgcgagcaccgcgccaccagcgccagcccgacgacgcagagcaggaagcagagcacggcggcgaggatgaggaacgtgtccgtgtggacgccccggccgcccgacgccgccgccgtcgccgtcgcggcggtcaggtgctccgacgactgcagcaagtgacgcatggtaggtgaaggtgagactgagagcactgccaaccactgtgccgacgaggggccagttaagcaatacactgacctaaaaatggtgaaaaatggagaaggcaatgcaagagttaggcgctgggagggtgcatttttatagtgtgaagtgaaggtgatttgtgctggtttaagtgattaattaaattcatgagctcttaagtgaagtgtcactgtcctgtccaccaattcttctaggaattattatttttttggttttttgtcacagacgtgtgctgctgccttggagctgaattctcctgtgctgatacagcagctttggtgcgtttgtccctttttatcctaaatctgtggcgtttgatgacttgatcgatccagatttatgcaggcacgaggtcctaaattatgttgccttttacttaatttattattactactggcagaattaaagcaaagcacattgcgacggtggtagtagctagctttgtccaatctgcacgttgtagcggagaaagtcgacgtggcgatgagcgtgaaagtgcatgcaatgcagtttacggaaaaaagtgtgattattccatgatcaagcgctaaaaaacaaagcagtattcgcggacgtagcatagcaggagagaggagaccgaccagggccatgcgtagggttcatgagccacgtcggatacatgtcaaagcacaagtactcgtacgtactccctccgtccaaaaaaacaaactctaattttcgtgtcaaatgtttaactgtccgttttatttaaaaaaattatgaaaaaaattaaaaagataagtcacgcataaaatattcatcatgttttattatctaacaacaataaaaatactaattataaaaaaatttcatataagacgaacagtcaaacgttggcacgtaaattcgcggtttgtctttttttttttaaggagggagggagtactactgcaagatctggataacataggctattaattagttagtcgtcgccaccgtaccaacctttgaggaaaaagaaaataaatggtgtaccctgactccgatccatcctgatcttctgtgattaactccatccatcagtaaccagtgtcgttttctgcatcaaactaatctggtgtttaaatcttctgaaaataaagatgaaaattaagtgttttacgtaaaacgaggtggtaatatcgtgtgattaattgagttttaattgttacaaacttgaaaaatggattaatctggaattttagagcaactttcatatagaaaattttcgcacgaaacacactgtttagcagtttgaaaagcgtgctatgagcatctaaaatttaatccaagtcttgttggagaagcgaacgcagcctaattcataatcacatagtattcaccttgtgcagttttgcctgtaaacttgtctaagttcagttctcaaaacaacttgtctaggttcaatgcacgatctcgatgtaatctatcgttaattctatgatttaatttctatcccggccaaacacaggcgaggttaccggtcgcattattttagctgatccaggacaggatagacggcacaattgtggaggtccattggaacacctcccatatacatttccctgtgccgtaaaggttggcgcacgccacgccacgccacggcgcgtaccgggcgccaacacgtgctcgccgcggcctaaaaccctcactacctcgtggccccagcgcgcgcgcccgcgcactcgccgagccatcgcgccgcgcgacgtgcgtgcgaaacgccgagaattttcggggtttttctcttctcgtaattggacgcgacgcgacgcgacgagaggccgggggggcgacgagtgcgcggccgtccccagcagcagcaacagcaaagcaagggctcacatcaagaacgggccgctctctctctacccaagttgcgacaatatgcgttctatctcgcacgtttctttctatcttcagggcactctgctatgtaatctagattcgcgatctttgatagaggcaaatcatttcacgttgatttacaagcccaaagtgcatctaaagacgggataaagtgcaagaggagtgaagtactgatcacctaaaccaaaccgatggacggatggataagtttcatcagaacggtggtataggcttttcgatgggccaaagtgctcaggtacaggtacggatcgagcaggagaggtcaagccaacactcgagggagagtgagcgagtttggtggcacgtcatgcgatcgcacgttgcctccatcggtcaaaacggcacatcattcgggtagacgccaggtggggatggggacgggtgcgtgcgagcttttctgctgtcctgccggcgtcgggagctagtagtggcggccgccgtgctccgatggggatgcctcggtctccggccaacgacgtacggctgcctgcgcaatgctacaatgctagtacatgcccatgcggttttgaaaggtcagtgttatgtttgtgtcgtctggtacgaagagagttggggacctggggtttgtttggttcggtttattgtcatcatttattaataaaagtcgttacccttgcctaaattcgtgtgctctaaaattttatcgcactttgcacaagtctaaataagaaatattgtcacattttcttcaagttattgatgcttgggacctatttgatacactacaagaaaacagctatacctaatttgaacaaacttgaaaaaccttagacgtgttaaactttgcaaggtgtggctgcaaatcaaaatcaaacatttgtgctgttgaagatgaaagggaacttggatctagcagccaagtaatggtatgactcggctgggcatactggtaacgagaggattcagagatcacgagtcatggtgtcactagtagacacaatactactgaatattcaggtacaaatgagataagtgacagtgtggttgaacggggggaatgggggcaaaggatgagaggagaggagacagggacaagtggcagcagaaccataggaacagtagagctgcgcagttggtgttcttatcttgttcctttgttccagctgagctgagtgtctatgttcttatctggtttgctgttctgtctcctcttgtacgagtagtagggtgtaaattgtttccagttgccaccttgggctaagttgggccgtgactcggtcggtgactctagtggcccatagtgcgaacgagacacagaatcggcaaccacagcccacgtagacttgcaaattgcaacgcgagtgaaaccacgtgctgtcacccctaattatgtgggcctaactgggctacagaagatttaggtgctatcgtcggacctcgaattggaaacaagttcactttacatcccttatcgaaggatggagttccaaccgcgaatgtcaaccacaaaaccaagtataacgtatctctcatgttgcaaaactaacgtaaacgagatcacaaggtagtattgacccgggtttcggccactgagagacaaatgtatacatttgcttccttcgagtgcacacgaccagtcccacttcgtgattggaggcgaccttcgtgacctcacgttcaccggtgtcgctcgacgagctatcctaaatcgatgagctaggtgccatccaccgtgagctatccccaagccgtgttccggcgaggaggctcctacttgtgatcaacgatggggcggtagcaggcaaatgccgcggcgatgtcgatgtcgatgttggtgaagagggaacggacggggacatgtgacgaggaggaggagagtgtcttggggatgggagagagggaggggggtgtgggcgtgtggcagaggagaaaacgtgacacgaatgggagtgggaaggacaacgaggggaagggtggacagcatggacgacgcgaaggtggcacattggagttgtgtttagcagtcgttctcttttcctttttctttagttttttttctctatggtataagccaatctggctgattgcggtgtgtaatcattttttttaatatattgacgtataattcttttgcgtgttcgtgaaaaatgcgaaggtggcgttgatgtcggcaccggctggcatgttgcaagcctgcttgacagtcgacgctgccctgccgggcttgatcaactagaaatttgctagggtccggaactcggatcagtcttggaggtaggggtgggtagaaaaggaccgaaccgaaaaaaccgaaatcgagaaattcggtcctagatagtgaaataccgaatttcgttcggtcaattcggttagtcaccttggttaaccgaatagactaaaaagaccgaattaataaaaaaatatctaaatgaaacctacaatctactaagttcaataggattaaactctaattttcacatccctgcttcttctaggcatgtaatctaataagagtctttactcatatgcgcttacgatttttttgttgaaaatttccattatttctttgcatatatgaaaatgttgctgaatttcggtcaggaccgagactgagacggaaaagatcaagaccgaatttatcggtcctgatattttttgtgttgaaattcggtcttcactttttaaagacagaaatgaccgaaagaccgaagaccgagaccgaaattttcggttagaccgaatgcccacccttacttggaggcccatggaccaataacgaatccaattgggggaacacagttacacaggtgctgaaacacattgcggcgtacgtcatggctgactcaaactaggcagagcatgcagcaaatgattggattttgggggcagtgtcattgctgactgcgattcgcatgttgttcatctccccgtagcttctctccggtccatccaaccgtgtcaacatcgtttaggcatacatgatacagcattacacaacgatcgctcgccggagtccggcagtcacatgctgctaatgctgttggtcccccctacttgaccgcgatcggccggttcttcctctgcctaaatggctaattttaaacgcctacatatatatatactcctactatacacatgtggttgatgattccgtcctgttgaaccaacccctgatctatcacgcattattggatcttgttggtgcattattgcagctgcgatatatcaatgtgtggtctcgtgcgttccctccagaaatgtagcgatctgagagacaggttcggatggccacaggctgctgcagctgtctgcacagctgcacagttttgaaattgaagggattattgcagtgtaaatacatgtattagggaatgacctaatatcaaataattaggagtgagacttgaatccggatcgactacccatcaccttgtgaagctagccggaagatctctttacgtttctcggattattgcagtgtactggcgtacattggcattgtcgatcgatgaccatctgccaggtgaaaacgtgcgtgaatcttgagtgtaaattcgaaggagtcttcctagcagcgcatagaaatggagagtgaatactctttgctgctgatggatgatcgatcgatcaacgctgcatttgatcatccgccaggtgcgtgcgtgtgaaaaatagagattaattatagtagattttgttaacctagctagaaactatcaacatcgcaattagcgtgcatacatgcacatggctgacaagtagtagttatacaagtggtttgcaagagcagtctgagttgatctctttcttctcgatcgaaggcgagctttgagtcaaaagtccaatttgtctacgttgaacgcccaggattatcatcaggtcctgacttaaactcgtcgccgcatagacctacgtatcagatgaatctgtcgacaaatgtacccccttgatgagatgaaacagtaaaaggataatcagagcagcagtgccagtagagtatcccattcagagacctccacgtcaccacggtgccaaaaggaaggaaaaggtagaaaaagggatataccgataggaacatgcgtggtcaatagagttatagagagataagagaagaggtaataataaaacttaaggatggctgcttgcatggagtagaaaattacaagggccaatcaatcaatcaatgatggctcgtgcaaattgtacagggtagcgacagggcgcgcggaattaggaaggaaacagcagcatttgcatttgcaattgcaacatgcagcggcgaagacgatcgatcactgatgacgactgggacagagagatgacaaggacggatgctggctgagttggctggctccccgggggtggatgcggtgtaggcctcatcttctcccttctctcgcagcagccgcagcggctgcgtgtttgaacacgctctctctcctagctagctctcctcttctctcctacgtatataagcggcttccttcccaactaattataatgcatttcaggtggatcgattgattccattacccaacctcaagctagctagctctccaccgtctgcgcccattcaggtcagcttctgctttctgactgactttgagttcttcccatgttttgtcctctgtctcgcgttctccttgattttgggagctggtagaaagctaagctagattttagcttagctccgattgccatggagatcgtctggagcatgattcgtctgccctcctgcttctttggaggaagctagctagttatgttttcttgtgcatttttttctcttcttctttcttcttcctcgctttgcctcgttgatttggtgttgcctagtcttgcaattagttctcaaactttgcttcctgtcgagcaacttgaggcaatgagctggctgttttgagctgcatgatgtttccagctacgagtactgaagatgcagtttctggtaactgctgtcagattaggactgcaattaacggctggctttgcattagcattctttcctttttcttttttttttctttttgaaaccaagccattctttcctttttcttgtttacatgaatgcgtgcgttcttttttcttttttgaacttgtcattgttcttgtaaatctgctaaagtgctaatttgacagctaggttcctgctaaaatggtttctatatacatgaacgaagtataaagaaacttccagctctatacggttctatcgctggcctgagaataaaaaattgtagttcaatgcctcatcagtggacaacaatattctctgatatttaagtttccattttctttcttttttgggaccttgcaatcattccgtaaaaggaggtgttgtgcccagcaacattgacttgttcagtgtgctcgagcttcacgtctttcaccctcttgtaggagacgatgaccaagaacagtgcaagcaatgtggatatgtcattttcaaattaactaacacatgctagaagatggaagaaaaaaatataaataaaaatggaatattaataactgtattagtagtactcaattgcgttcctgaagttctcatacggttcccatactccttttctttttctttttttaaataaaaaaaataactaatgtatgtgactaagaaatctaaacgtttcatttctttattgatcgattatcttagcagggtgtacgagccctgaagaactttgaatcatcttttttttattatttttttagagaagggtattttttacccggcctctatatctaaccggatatatacggccattgaaatagggaatttaaccccgcaaacaacccaatctgaaattcgcaccataagagatttgaattcaggaccttaggatactactcatgtcactgtaacctctaactttgaatcatctcctgaggactaatcacaagacatctgaaacatttccagaaaaggagagtttaatccaacatcagaaaagatgggcttcttgtcattgcttcttgtggcttctatgccaatcgttcaggtcctactcataggtgttattggagcttttctcgcttctggttacagcaaaattctaacctcaagcgctctaagggatatgaacaaggcgagctctcattagcacatcactgttcaatgcaaattaatctggtattgtctctggctaaacctgttgagatttctaacaggttgttttcactgtcttcacaccatccctgatgtttgctagcctggctaagacggtcacactttctgacgtcatttcttggtgagtttatactttatatatatatgcggttactacaaagcagctcagtcagacttttctgaattttttgaagtgtggactcttctgaattttaaaagaattcctgtttgaaatgacatagtactagactactagtacctttagaacactaaacaatgttacacaagtcatcttttcattcagaggcagggcatataagatctagcttcagtttctgtttgcagggtaacccaactggactaacagaagccttttatcatgcaggtggtttatgccagttaatataggaatcacattcattgttggtggcactctaggctggatagcatgtaaaatactgaaaccaccacagcatttccgaggaatgatcattgccttctgttcagcaggttcagtttcctatccggattgcatctttcttttgttcatactccggagatacataatactccctccgtttcgaaatatttgacaccgttgactttttagcacatgtttgaccgttcgtcttatgcaaaaacttttgtgaaatatgtaaaattatatgcctacatgaaaatatatttatcaatgaatcaaatggtagaaaaagaattaataattanttaatttttttaataagangaacggtcaaatatgtgntaaaaagtcaacggcgtcgaatatttcgaaacggagggagtagtatttacagtgcttcaactaacaaaaataaaacgcaggaaatcttggcaacttgctcttgatcattgttccagcagtctgtgacgaagacggcaacccgttcggaaaagaccggagcctttgccgctctcgtgggctctcctactcatcattatccatggctgtaagcaaaattatatttctgcatctcacattcactgaattatcgtgtgcctttttcattcagttgaataacagaattgatcgttcactctgtatctgcagcttggtggcttattcatatggacacatacatacagcctcatgcagaaggcaggcaaaatgtaccacaagatgcagtccaaaagcatccagtgcccggccgacagcgatgaagagcatcatcctgcacaaggtcatgatcaagtaaaattagacggtgaaactgcttacgctgatgaggaggcggctcttctggtgtcagctaaactggctcctgaacacaatgaagagaaccaaatggtaagtcgactaattaatggtcagtccagtgcaccattgtctggttcgttccatgcaaatcttcagagaaaactgatttgtcagaaatgcaggaagctccacttctgacttgcgagagagagattgctaacaaaggaggattctggacaaacctgaaggaaaccgtccaccaggttgtcgaggagctgatggcaccaccaactgtatctgcagtatgttcctgccaaaaccagttacaccattttcatcacatcaagttgatatcaatgctcattgctcatattggcagtgtcaactgattgcactgaagttgtctttgtgttgttgtttcagatacttggatttgttgttggcctagtcccatggttgaaatctcttgtcatcggcaatggcgccccactgagagtcatccaggagtccctccaactaatggggtgagtgagcatttacatgttaggtttctccatttctgtctgccttaaacagcatatttcaagtgtttcctcagcctttactcacggttcgtttgtctttcagcaatggcacgattccttgcatcaccctaatcctaggggggaatctgacacaaggtaggtgttaattactcatgaactaatgatatggaaattaactgcatcatcttgtgagttttctgaacttctctgaatgtatgtgcatgcagggctacggaagtcggtgctgaagcgtacggtgatcatcacgatcgtctgcatacgctacgtgatccaacccttgatcgggatggcggttgtccatgctgcctatggggttggattcttgccacacgatccattgtaccgctacgtgctgatgatgcagttcgcgctgccacctgcaatgaacatcggtagcccctgaatcccatgcagtttcattctgatttctgaagtttcttctgtccatgcttctaggaagatcttgatcacctgatcatgtgtcttgtgtgtgtgtgatctgttcgatccaggaaccatggctcagctgtttgatgttggtcaagaggaatgctcagtgatcttcttgtggacttacctgattgctgccattgcactcacgacgtggtcgacgatattcatgtccatcctgtcttgaggttgagggtgacaagaagaaccaactttgtggcaatattggtttagctggaatgattcagctcacggataaaatgtaaagaagccggagacaatgagcctctccgaaagagccgaaactgaggcttgcccatgagcaccacacgtccacacgtgtatagaaattgaagcagtatttttttagataatgaaaaatagcatggtggcccgcgtagataactataatttttttaacatattaaaaaatatttttatttttttcagttatttcaaaattgtattttttatatggactctatactctactcccaatcatcctcactttattaaatttctaattttgtagttcgaaattttgttatttctaaattatactcttcttatatggacttaatagtctatcgtcttctctaaatattctttttttatttgaaattttacttatttctaaactgtactcctatatggacttagactggtgtaacgcacatcagtcgtggcgttggtaggaaatacttaacaattcaataaaaaccctaattttcgaaactcgttctttggttgtggtcctgttgtgtctgtgtgcgccaagatctcactctctatctctctatcccaattccgaatccgaaatcaaatcctactctataaaccctccaaatcaaattttccttgtaaaagtctattacaccccttcttggtcattgggccgaatctcccttgctcggcccatttttccctttcggcctattcccctcacgttcccgctcgaagggagagctctctctctctctctctctctcgccgcgcgttgccgccggtgccttttttatttttcgccgtcgccgctgactcccgcgcgtgagcgtcgtggccgaccgcccggtcgccgccgccgccgtatgtctccgctcggcaccgagccagccaccctcccttttgccatcatcacttgcatcatctacccggccccgcactctgccgcatccatccaaaaaaacgggagtagcagccacagctctccacctcctcctcctccctctcccttttccccaatatggcaagggaccaagctgctttccctcggatgcaactagagatcgggcgcccgattttttggcaaaaatcgggcgctgttctaccaagtagatcggaaatatttcactaagtagatcgaagatgtttcaatcttgtaaaaactgaaacacaaccaaatcatctcattaaacattttgctacaacgtatgaaacaacggtttccaaaaaaaatcgggcgttgtttcaccctatataaaaacaatgtttcagcaaataacgaaaggatgtttcaattcactgcaacatttgatccatacatactgaaatatcacaagtacatttattgaaacattgttggtggtacaaaaaataaaacggatttccttaataaagcgcttccgtaatatgcgggtgattcgttgcaacgacacgtgtggtggggcgcgtggtggggatggcgcgggagcgcgcgggcgccagacgcgaagaaatttcgctttccctcaccgtctccttttccttttcctgactactgctcgcgtcacctctatcactcttggctcctagcgccaacgtgccgcgcgcctccaccgcctatctacgaactgtcgtccccgttccaccgtcatacaacgcctataaaacccacgcctctcctctcgttcggccgcttcccttttcgcagccgagctccagcaccaaaatccgccgccgtcactcccacgccgtcgtccgccatcgtcaagtgcgccggaggagccaatgctcttggaggcgcttgacacggacttcggccactcctctccttccccttccctgacccgaggccgaggcgatcacaccccgcgccttcagccctcttcgcagcgccacccctctcggtacccctcgccgctccgactcccttttccctctctcctttaggtgttaattagcccaccgccggccgccgcagctcgccgttgctagcctcccttggcgccacgtctctccccgcgattagccgccctcggtcctcggtcatgggtggatgtgaggtgattccttagcgtagttttgattcgattactgcttgtgaaattgctatggtgtgctggaacacgttgcttttgactgtggctgatgtgatcagctgggccagggaggccatccaaatcgtttggctgggggccaactcttgatctgttaaagattgatacattgtactagtccgaccgggcatggtgcactgtcgtgtccgcgttgttgagaagcactctcttagaaacatttgaaaaagttttaaacaaaatcgtatgcaaaaacaaacaatctttctatgaagcttgcaataaacacttaatttcgatgacttgctgagtataccctgtactcacccttgctctacataaataatccggttcttccaggagcagtctggcttcaagcaattttgacgaggtgttcccaagtcatgcttgtggccgtggggcagtcttcatttccgctttctcttttgtaatacacttgtgagctcgaggtctacccgtagcctcaacatgactgtaaaactactcttaattaagagaccactgatgttgtgatattctatcttcctatgataccagcgtggttttttgggactggtattggcttaccggttaatttggagcttctcacggtagttcccgtctggagctagtttggggcgtgacaattcgacttttagaattttatacctacacagactcttgtctactctttcaattttttatttcttaattctgattttctgttatttcttattgtatttttatatgaactctaaaacttatctttaaatatatattttttaattttaaattttagttatttctaaattgtactcctaatcatatatggactcttaactcttctttgcaatattcatttttctatttcgaattttagttatttctaaattatatttctgtatggactctaacctctagttttttcatgttttttaattccgaatttcacttagttctaaattgtattcagactctatttttctcttccaatattctttttttttaattttgaatttctgttaattctaattggtttttttatatagactctagctcatcttttaatatttctttttaattccgtatttaagttatttatggactctaaactcttcttccaatattttttattttgaattttagttatttcgaaattatatttttatatgaactctaaactctagttttagtttttctttttttaattccgaattttagttagttctaaattatattcttgtatggactctattttcctcttccaataattctttttttatttccggatttcagctattttaaaattatatttgtacatggactcttatttttctttttctccgattaatatgaaaatttctaggtgctgagagcgaacatggaggcttctttttctattgctttaataatataataaatagatagattcaaggattatagactgggcataggtcctcatacacacaaaaagaaaagattgggtacatgattatttatgtatcccaagtttttggtccatttggtttgcaactgaaaatacaagtggcaaaaccataggaacagtaaagcagcaattcgtgtcagtctcccactccagcgtgcgcatgctttcgtcggcggccggccgcgcgcgggtcttgttggcaagcgggaggagcggcgacgccgcggccaggcacccacgcgcgtcgccccgtggtacagcctccggcgactccgacgatgatgccgctcctccccatccgctccggcgccgcctcctatgccgctgctgaacggggtaggttgacacggcggaggtggcgcggcgctggcgttcgtggtggcgagcctcgggaagggcgggtggcggcgctgttccggcgggggttggcggagtggtcgtcgctgcgtcgggtgttcggtgtcgatgccgtcgagagcgacagcttccccttccgcctccgcgacgtctgcgcagccacgtgctcgggcggacggccgcacagccatcaccgcggcttccggcagggtggcggccatgggcaactccaccgatgacccacatgctccacaacaagcaggagttcccccttgccactggcgccgtacgtcgtcgattcggattcggattcggtgagcaccgcgcattcatgattataacaggctcacagcatatagaaatacactcaaaagtctagtaaaattttaagtacaaagactgtaaacagctagacttaaaagcaaagcactagaaggaagatcgaagagcttgtttcggcataacatacacagtatcacagattttaacagcacccaagctactatctcagatgatttcacacataccctttattcaattcctgccatccctttattcacaataaaagcacacaaatagatcacttcttattactaaccgatatgttaaatagcactatttgctactccctccgtttcataatatttgacaccgttgactttttagcacgtgtttaaccgttcgtcttattaaaaaaaattgtgaaatatgtaaaactgtatgtgtacatgaaagcatatttaacaatgaatcaaatgatatgaaaaaaatagataattacttaaattttttgaataagacgaatggtcaaacacgtactaaaaattcaacggtgtcaaatattttaaaatagagggagtacttaacaatcgattacatagggatgtatggaaatgtatgccagataaatggcactgtttagtaattgcttggagggttttctagatcacgcgtttcggttggggcagtgatcagaagcgatcccttcgagcttctggctagcttcacaagttagtgggctagccggtctgaatttgaagcctcactgcttctttttatttgatattagatttttccctaatattcgtgtttttagctgagcacggccgcacaagagatgacaggtgatgagggacttcaacttcttgaaactgtcccaaatgtgaaccttatatccctctttgtcaccaagcatcctgaattcctcctcgatatcatttatgtaacgcagtcggatgtcgtcaggtaccttaaatttctggaagtaggcctgctggaagtactcaggtacatctaatttgtcaactatgttcataaaatcctgaatatatctctcctccatatcttgcagtgcctttgtcttcttcgctgcccgtttatcagccatcatctcaatccgaaactgctgtgttttctcccaagcccggatcttgagttgcatttcgtggttacgcatctcgaatttctcctcgacatcattcctgaacttaagtagggtatcttcatgtaacttacaatccgtgaggtagtactcctggatatgctcaggtatgcctttcctggcataaccaagcttgataaattgttgcttgaacctctcttccatatcttgtagggcttgtgtcttcttctccgttgccgcctcctcaatccaaaacttctctgcttctttccgagcctggaccttaagctcccccttgtgatcaagtatcctggaatttcccttgaaaacggcagttatgaacttgacccggagattgtcaggcaccttgtagtcattgcagtgttgctcctgggagacccagcctgatgtgctcaggtaggtcataacacttgagaatccttgcagtctgttggttgaatttgtactccaaatcttgtaaggcctgcgccttcaacttgttgtaatcctccgaaatgtaacccttaggtggttcctcttcatcatcaggcatcctcctgaatttaatctccacatggtttatgtaacgcagccggagatcatcaggtaccttgtatttctggaagtaggcctgttggacgtagtcaggtatgtctattttgtctaatatgttcatgaaacgctgaatgtgtgccttttccagatcttgcaaggcgtgcagcttcttcgctgcccaataatcggccattgtcttgatccgaaactgctgcgattcctcccaagctcggacccggagtcttgtttcgtgattacatatcccgaatttcttctccacatggttcttgaacatcagctcctcgtcatctagcttgatttccctgatgtaggcctccttgatgcgctcaggtatgccttctatgtcaaaagcatgattaacaagtaattgcatgtaccactctttcatgtcttgcagggcttgcgccttgttcgccgcccccgccgcctccgtccaaaacttgtctgcttctttgcgagcctgggccttgagcttctcttcgtgatcaagcatcctgggattgccctcgaaaacggcattcacgaacttgagcctgagatcgtcaggcaccatgtagtcattgcggtgctgctcatggagatccagcctgaggtgcttaggtagttggtaacaggtgagaatctttgcagtttgttggttgaattcctcctccaaatcttgcagtgcctgagccttctccagcgcccacttgtcggccaccatctccaccgcccgcaactcgatcgctcaagatttttccaagattgcggtgggaagctgtgccaatgtgaagaccgaccagctttaaatcaggggggaaccgtggagagcgcttccgaagcgaaacggagacggaaaccaaccaacctgatgatcctcgctcgctcctcccctcttgcgcgcgcggttgctccccgaatccgaatcaacgatgggatcggtccaaagccaccgccgccgggggaatgtatccgcaactagaatatgcattcttcattttcagctgttaagttggatttttttttcctcgaacgattttcagctgctggattaaacgtggacgaacgggattgatcgctacagtaatcaacagtaaatcaatgccataaaatgtcgcatcgaatgtttgacacacagatgtagtattaaatatagaaaaaaactaattacacagaatgcgtgtaaattgcgagacgaattttttaagcctaattagtacatgatttgacaatgtggtgctataatgaacatgtgcatgcagggctgaagcgtacggtgatcatcacgatcgtctgcatccgctacgtgatccaacccttgatcgggatggcggttgtccatgctgcctatggggttggattattgccacacgatccattgtaccgctacgtgctgatgatgctgttcgcactgccacctgcaatgaacatcggtagtccctgaatcccatgcagtttcactcttgatttctgaagtttctgtccatgcttctaggaagatcttgatcacctgatcatgtgtcttgtgtgtgtgtgatctgttcgatccaggaaccatggctcagtttgtggacttacctgattgctgccattgcgcttacgacgtggtcgacgatattcatgtccatcctgtcttgaggttgagggtgacaatcaagaagaaccgaatttgtggtaatattcagctcacggatagcacgtaaagaggctggagacgacgagcctctcgattctcgaacgagtcgtacttaggcttgtcagcaccacatgtgtgtaggaattgaagcaatattttttagataatgaaaattcaaggagtatagactggacatagctccttacacaaacaaaaagaaaagattgggtatatatgattctttctgtatccaaaattgttgcccaattaaacttgtaactgaaatacaagtggcagaaccataggaacaacaagatgcaattcgtgtccctatattcctctttcttttcttttcttttcttttttccttttttgagctgtgtcattgcctggtttgctgtcccttctccttttttgacgcgttgggaacttggggattcgttgggtcatggctcggtcagtggctgtgacggaagaaaatttggtagaacggcggtccttcccctatccgtagaacggccgtcctacgaaattttctttcggctgtgtcgaaactgaaattcggcaatataaaagaaatagcgcaaaagaaaatagatatatgcggagacaagaatttagacatggttcagaccatctcaataagagataatactcaactccaatttcgggaattttatcctcaagttgtgtattgatctaatgatctggttgtgaatacccaaaggggtgtcctgccctccttatataggcaaatgagtagtattacaagatagaaatttatccccatacgttttaagtttacttaatcaacaactagctgggtggcccgcgcaattgcgcggctagcacccaaacaaaatcatatattttttagtataattttacttaaaatttattaaatagctatcttattgtcttaagactttgaaagaccaaaccttatcatcctcgtgtttctaattatatagtttttaaaagtcacacctgttgctaccccttatatcatttccttctttatttgcttgcttgatctaccactatttctattcattcttcttggaacctttaaaaattggattttatatttttagagtttattgtcacgttgggtttcatttttataatttctaggtgtcccgtcaaacgttgccattatactcctctatggcccatccactgtctcttctctttattgtcattgagattttaaaaatcgaacataattatcgtcttggttcagttttactttctagaagtcccgtcaaaccgtcagcggctttgccattgtactcctctacgtctcacccactgcctcccttctttattgtcattgagattttaaaatcgaacatgattatcattgttttttttttactttttagaagttctgaacctttaaaaattagacttgtagtttcattttttataatttttagaagtcccatcaaacgatgccactatacccctctacagcccgttcgtcgcctactcttattattggaattcatttcttattttctagaagtcccatcaaccgtcggcggctctgaaactatactcttatacaccccgcccgctggttcacctttttattgccgttgagattttaaaaatcgaatatgattatcaacggagatttttttttactttctagatgtcccggcaaccgccttacaagtttgcttcacggcctgcctgacgtccgtccttttaatcgtcattaggattctgtttggtgtattaacggtttttatatatcgtatcaaccgcctccaccctactcctttataggccagtttcttaatttatctcatcatgtgttttagatggtcttttctttcgataatctttatttttatcacaaattttagttatttataaattgtattcctaattgaaatcttatttttctttcttctatttttagaattttttttttaaaaaagtcaataccgtattgtgttcttttaatgtttttattttttattttcaatttaagttgtttcaaaaatgtattcctacttgaactctcttttaatttttctaattttggatattattttaatttttattctaaattttaattaatctcgtattgttttcttttatggattcttattttaatattgcttatttttaattccgaatttcaggtaattttaaattgtattcctacttgaactcttcttttattttcttttgctaattttggatttatttatttttattctgaattttaattaatctcgtattgggttcttatatggactcttcttttaaaattccttatttttaattccgaattttacctatttttaaattgtatttctacttggactctcattttcttttttcaattttggattttattttatttttatttttaattttgattaatctcgtattgggtttttatatagaaacttctttcaatattgctttttttaattccgaatttcagctatttttaaattgtatttctacttggactctcctttccttttctaattttagattttattttatttttatttcgaattttgattcatctcgtattgggttcttatgtggaaacttctttcaatgttgcctatttttaattccgaatttctgctattcttaaattgtgcttctacttggactctccttttgttttttttctttttctccgattaatgtgggaatttctagctcccacagcgaacatggtgcctcttttcaaagctgttttaataatataatagatagatagatagataatagatagatcttaatagacaaggactataggccgttccttgatacacaagtcataatcttatacatattctatatacataatctatcccctataactagtcggatagcccagccatatggcacctgatacccataatctccacaagagattgttgggcgtcatcgtcatcaccgactggccgcctcgtccgccgctaactagtgtcttcgcctttacggttggcctattacgctgtcattgttgggtgtcctcgtcatcacccaccggcttgccttcgtcgccgccaactaatgtctccgtcttcacggttggcctattatgccaccgctcatggacgtcctcgttttcaccatcattccatttcttcacaaaacatcgttaataaaaagtgacccaaagtaaaatttactctatcaatgatttttataggtaaattaaaatgtaacatttgtcatgaatctaatggtcataatgcactttaaataacttcactatcttcaaatgcatattttttttgttagataattaaaattaaagatacatttataactagttagttttaaaacatttaaaatgtaacatttgtcacgaatctagtggtcataatgcactttaaataacttcactatcttcaaatgcatatatatttttgttagataattaaaattaaagatacatttataactagttagttttaatacaaataaataaatgtgatgtaaaatatgaaaatgtcataaatcgttgtataaataatagatttgtaaaaacatatgtaatttttgggttttgttttgttgggtttattggtattgaaattaaactttgttagtgataatatatttttatatatttacaataaaatattttataatgttttaagtactatgaaaaaattataaaggaaacatattatttatcatgggatggatatgacgatttgttttgtttaaaccacatattaaaataagaggaagtgaaacgttgcagagaagaagtagcaataaaccaaaatctactacacgcatctctttctgctttctgctgtgtggttaaatattttctaaaaaaatactacaaagtataaatatagagactttgtcttatttttctcgcactcatactatgcgtaacattctctttgtggttatatttatgttaaaaaaatattgtgagggatggagataaacaaaaaaaatggatagaaggttttgctaactgaatttgtgtattgcaagtatcgtatcgatgatttattggagttagatgttaatcatatatttgaatgggctagtataaccttgcatgtcatatccggtttgttttttacctcacatgtcatgtccggattcgtattcgagggtttgtgtgatactcaaatgagagaggttttgttatttcaacggtattagctaattgtatcgcattgttagtggatatattattgtcttcctgtttcatgtaaaattttaaacaaattgttttttatctaaatttaatatatgtaaattacttttaggctttactaaatttacttttatatgtctaagaagtaacttagtgaaatctaaaagtaatttagatatattataaaagtaatttacaatttttcatcaaaatataatcgtgtgagatcttgcaagaaagatttaattgttacgaacgcaacggtgtaatcggatcgtagatcaaatgagtagtttaagagaaaattttatttgaaatataggtggataggatctctcatagatggagtggtagctggtttagacaaacgagctaccgctagctgtgtagccatgtccaattgatatatataactcatgaagcacagggtcatgtgtatacatgcacatacataaatctgaatctgtagtacatacttcagatatatgtacaattatcgaaatttctattgagtgattgatcgctggcggtgatcttttttttttcttttttttcttttcctctttggtaagtttatacatctaaagtttacatatctaacgtttatccacctaaagtttataaagtaaatgtttataagtcaaaagttgtatatacccaattcaaataattcaaatttaaattcgaattcaaatattttatattttttctcttttagtaagtttatacacttaaagtttacacatctaaaatttatccacctaaaatttgtagagcgaatgtttataagtcaagagtttatatacctgattcaaattcaaattcgaatttaaatattttatatttttcctcttttagtaagtttatacacctaaagtttacacatctaaagtttatccacctaaagtttgtagagcgaatgtttataagtcaatagtttatatacccgattcaaattcaaattcagatttaaatattttatatatataatatttctatacataaagtttatgcatgtaaagtttacggtataaaatctatgtaaatgaatgagagtattataattttttttctttttttaactaaaatttgtgtttttttaaaaaattttatgatggaagaaaagaagagaggggtaagggggagggggaggggcggcgatcaaccgcccgttagcatcacccgtgcaattatacggtagggtgtactgtgggatttcggttggtgccgcggtaagcgaatgaattagtggctggctgggtctacacgtacgaacacgtattctttcccgtgtactacctgttatacgaacacgtacgagtacgtacgccggccatgcttccatggaccgaagtgcgcgacaaaccaaccactcagactctcagagataagcccggccggccggagacgaaggccacgacaccgcattgtccatgacgatctcattctcatctagtactccctacttattttaatgtattttaatgtacgatatcgttgattttttaatcaacgtttgaccatttgttttaagatagcaccatatatcgacaccgtacggcgcagcacagaaaaccatcggcggcgtacgtgacgcacgcaggcggcggccggggcagccagccagccagcccatcggcggcgtgaggcttagctcgagcggcgtcgttcccatcttgctcaatctgctttcaagagctctctacctttccccttctctctctcttctctctcccatatgtagtgtgaacccctttcccaactcacccctctttttctacacgcgtttttaaaactactaaatggtgcttttttataaaaaaaaatttctataagaaagttgcttaaaaatcatattgatccatttttagaaaaaaataaatagttaatacttagttaattatgtgttaatagaccgttccgttttccgtgtggaaaagtttagttccaacctccccaccagcgaacacgggtgcaaaagattccactaatctgacaagaaaaaataaaacaagaagaaatttcattttagaatatatagatgaaaggcaaaacaagagagaggagaaactgagaaaggccttgtctagtttccaaaataaaaacttttcacccatcacatcgaatgtttggacacatgtatggagtattaaatatagaaaaaaaaccaattacatagtttacgtgtaaattgcgaaacgaatcatttaagcctaattacgccatgatttgacagtgtggtgctacaataaatatttgctaatgatggattaattaggcttaataaatttatcgtgcagtttcctggcagaatctctaattgtttttgttattagactacttttaatatttcaaatgtgtgtccgtatatccgatgacaatcaaactaaaaaaaaaattcaactaaacaagtccaaagtatagcacagaacgaagtaattcataccttgaatgaacccggagttgcatgttgagttgttgactgaaatgatccagttgtggctatattttccagctttgaagatcccgtcaacgagaccaaggaggagtggcagggccaactggaagtacccctcgtacaccgaacgatcactctgagccgagcacaccacaggtgacatcactgttaccacgcgaggaagagcaataaaatttatcaaaaatttcgtcattttgtgtcctgctcctcgccgccagcacagtacgtaactagctctgttctgcctcttttccgatctgcttctgcctgattcgatgaatacatatatagtgtcacgttgctagaagcacggcccttttcactattggtcgtcgttgtttgcattattgcattgcaaatgcagctatagctttcgtacgtctcccctgtccagaaatgtggccaaaccggagaggttagctatagtacaaattggaaagttaataatcctacgtgatcatatctccatttaagacctcgctcattaaagcgaaatcacgataaaatcaactgtttataattaattagcgttatactaacgtaaatgtgacgtatgatctcttacgattatacagtgtttaccgtgtgtccttaccgataaaaaaaatgttatcgtaccctaatggtaaagctcggtaaccgtgataaccatgtggttacccgtcaaatgcggaggaaaaaaaatgcaagcctaagattgaatttttcaatttttgttagacttattttttttataaaaaaaatatctacatctctataggattaattacttaaatggagttttggagctaagcataggactcaagctctagttaccataggcctaactgtgcccctgttatcccggtgaacaactataaaaggatagggaccctttgaatcgaaggaataaaaataatgtagaaatagaaaaaaacgtagaattctgacaggaacatacgtgtaaaacaaaagattacaaaacatagaaaaaaaaagaatgattgtttgattgaaccgcagaaattggacgagagagatagattcaaatgaatttttctaagaggttagagcttttcctaatgtttttctaatatatatatatatatatatatatatatatgcaatgagccattgcatagaaatttcatagaatttaaaaagctccaattctttgtaccaaaaaccaaataaaagaattcctgtaggattggaatcatatgaatttcctacttgaatcttttgattgaagggtccctaaaatttatcaacaatctaaatttccgtttaattcttttaaaagaattggtggggttacggatatttaacgttactgtacaaacataattgctacacgtgctaaatttttcttactaacaattatctcaaccgtttgatttaggtaaataaaagttatgtcttttcctaaaatatatagaagcaatatacacaggttatcaattatac

SEQ ID NO: 47645 - DNA, 3592 bp, Oryza sativa
  unsure (1)..(3592): unsure at all n locations
cactacggattagagtgttgacattaatttgtagcgttccagtactatgaacatcacacaattagcgtgcgtagtgtacgtacgcacatggctgtaaaatgataagtactataacacatgttggcaatagcagtctgatcgagagttgaattctttcccgatccaaggcaagtttgagcgtccaaacgccgtttttttttttacggagtatacgtacttgtaaacgattagctacctaggattaaggccgagttagtgcgcgtcacatgaataatgtacgtacctgataattaaaaactagtactaaaaggcaatcatgctatgcatgttgataccggatgcatgcacggaggagaggaaatggaggccaggccaaccagtcagtgcaaggtatagccacaggagcggagaataattaggaaggaattagcagcagcaaattaaaacaagtttaacagtataatcaactgtaactaaaattgattagctaatttaatagcttaatcatacaatgctatagttgagtaattttatagtatatcattattttctgtcttacctcacatacacaatttttgaaagccgcgttatagttgaattataaatctacagttcgttttcttttctctttcctctccgatctcctctatcaaagcacaaatttagtatatcaatttttaagtctgtttgtaacagttattgtgctcattttaaacaagatgacactgacgacgtctaggacagatgatcacaaggatgcacctaagctaggtgttgatgcatgcgttgtactcctttcgtaaaaaaaaaacaatctagaattaggataaaacataatctagtataatgaattgggatgagtctgttcagatttgttgtactagattctatctatactaattttaggttagtttttttttatgaagagagtagtatattgttttcagcaattctatcaccgtgacataaatcaacaaagctttcattattaagaaaaagtggtaggtatagctagcctatataaaccgtgtagtactcctagctagttaggcgtggcatctagctagctttccttcccacgaccagctacagacgcagtagatcgatcgatcaaccactctccaactctccattcgttctgttacatactcatcctacatcgacaacgtctccagtgcctgcgcgacattgatattcaggtcagcttctgcatgcagctagcacacacgcacaattcctgctacttcatgcatcgtttgtatttcgtgtacactaggttgtatcttgaatttgggagagcttaattagctgattaattgatgccatgatggagagatcatatatataatctggtgtatgattcgtcggaacagtacgtctcgaatggattaaagaaacagatgaacgactagcttcagcgctggctaattctgtgatcttgcttcctctgcctgcttgaatttgtctggaactgaatattgcatggcgtcacgatcgattttgtcatttcgtttcatgttttccttagaggaagccgcgtgcatttcgtgtgtttgtcttcttcttccttgcttgcttcgctccgttggttcttggttgtagtactccactgtgtatagatctacaggaatttaacctttgctctctcgatcgagtagcttgatgcaaatgtgttttggtttgatgtttacctgccacactacggatgcagttaggtttctgctaactgctcttacagatttcggtgttatatataattagtactacattaaaaggagaatcattaattctcctcctttcatcaaacccccctcccttgaaatttttaaaaaaaaacannatattcggaaaggnnataattggatccatgctactataaaaatatgtttgtttttttttttgcgggggaagggagatctattactcagataaagcatccacatcaacaagatgtgtaattaaattacagctctcatccggccaaaacttggacaaagtttcagcacgggccttattagctagaaaataactaatggaattctgagaacgctgaattttcttgaggacaatctcccggtctccagacatcagaatcccgatgtctttaacaacgtgagcaagcgctgacatttccttccgcgcatcttgaatcatattaacagccgtcaggcaatcagtctctacaattatcgacagtaaggtccattgaagcgccatattgagcccctctttgcaggccagaagttcagactccagggggctagtacaacgctcaataaaaccacaggcagagaaaataacctggccgctggtattcctgagcaccacacccacacttcctgtgcttgttacagagtcaaaggaaccatcaacatttagcttcatccatcgctcctgcggtttctcccacctgggtagagcctctgaacaatcctgatgaattttcaggccctgtcttggtctgcattgaaccacatgtttccctgtaacgacgtttgcttgcggatattgtttgatctctaagagcgaggtgatatagctctgtagaaacctttgcgatacatccactggaggcggcactttgtcgtgaacaatctcattatgcacaaaccaaatgtgccataacaacataaacagcataggtctttcctcttttggtgttagctcaacttgttcaaacagccaggaggatcctgtagaatttccgacaatgccgactgacaagttgcctgaatacagcaaggcagaccatagtcgctttgcatgtgggcaccttcccagtgcatggccaacatcttctcttacagtaccacaaatgcaacatatttctgactgttctagtttccttctctttttattctccatagtggctaggctgtttgtagcagctttccacatgaagattttaaccttttgtggcacttcacacttccagattaaatcccacatcttcctggacttgtcatctgacgagctggagctttcatccatattggccagagacattgccagtttataagcactcctgacatagaaacgtcccatcttgtccagatgccaagccaaaaaatcctcatcctgcctcattgaagtccgaatcctcagtatttcttcagcatcacagggaaggaaaacccgattaactttctgaacgtcccacacaccgtcaggtcccaatagctcggacacccatttcatcctgcaattacctttccttgctattggccgtcgagaatggtcccttggaatccagggatcacgccatatgcgaactgactgaccatttccaactctccatatacaacctgtagcgcccgttccgtcgtggcgcctagcgggaaaattatctcttaaaaaccctatttgcgaaatttgtttccttgcttgttgtctagtgtccgtgctatctcaagatctcaatccccgatctatcgtcgagatcaattctgaatccaaacccttccaaaatcattttcctccgcaaaagtctattttgcctcccccgaggtcgatgggccaaatctcgctcggcccatctccccctctcccccggccctctcctctctctcccgggcgatctctctctctctct

SEQ ID NO: 47646 - DNA, 16654 bp, Oryza sativa
agttttagggtttcggcctagttcccaagtcgcgcctgtgatgtttggtccaagtcctggcttccgtttcccttttgtaatgcagttgtgagctcgggatctgtccgtagcccaacatgactgtacttctactctataataaagagacctctgttgctatgatattctgtctccctgtgataccagcactgtttcctgggactggtatcgattaacaggctaaattggagcgtcacgggccagttccggtcgggactagttcggggcgtgacaagagatggtatcagagcacaggcttggccctagggcgaaacccgacgcttaggacaaccctaaggatactaagttcaaaactacttgcgaaaagctaaggtttcttttattttctttattttctacagtttgtttccaaaatggttactgatcttttcttcctctttcaaaattgtagatggcagtgaatgccagcttcagttcccacggttttggtgagggtcaccacgtcgctcagcttcgtgacctcgcccatttccttggcttctcgtgtcccgagtacacggggtactccgtggaccgtgttccccctcactgtgagctctctgtgtacctttacccccgtggaggtatacacggagctggccttcgcccacaccacttcaccgtggccaggcccactctccagatcgcgtaccaggatctctcctggactgcgcttcgtcgcctggcccatgactacagccaccgtctcggaggctccgccttccggcagcttccacgccttccttctggccactcagacgctaggtacccttgtccgtacagcgagcctcagccagtgctgactcgcatggttgagctttcggaggctcaggccactcagcacgacctactccttgaggcttaccgctcccttgcccgccgctacgccgccttggaggcccgtctggccgaggagggtgtcacctcagttgacactatctcctgggactcaggccgcctctgccacgccagccacctgtcctcccacagctcccgcggctctacccgcactcccagtggcccgcgctcccccagctcgcgtgcgccgtactcaccagtgtactcgccctacccacacccagttagcccttcctacaccccaggacacaccccagttgcttcctcccgccgtggcccacgctttatccgcactgcgcggaagcgtgttgttggttctgccaccgtgttccgtttccactacccagctcccctaccgccagcggcccgtgctgctgccggccctcgacaggttccgccggtcccttcgcgccagccgatcgacgtttcttcgactcaggagccgactacaagaggcagccaggccgacgaggagtagaggaggcagtcttcagcagccgtccgtgtgataggcccttttgttccgccgccaactcttttggagtcatggcgaggtagtgcgtgcatgtgttagttgtgggtgttgtttggtagtctggttctcctaggtggtgtgcgcacagtcaagctcggcgtagctctgtgacttgtccacacccattgtatcaggtgtttttatgatttgaaaaatccagtttatgcctagtgtgtgctatctgagttgctatttgctttgctccttgccctcctaagtgcttatctgactcttaccccgcccttttctgggagtttagatggctagccgcccccgccgtgcagctcgtgcaccagcccactttggttttgaagatggtagagttgagccagaagaaaatcatgagtcggctaatgagcagtctcaccgcagcaaccgttcgcatcgtacagcttcccgtaatgcagaaatggaacagtcccaccgctctcaccacactgtcagtcacaattctggagaagaacgcctcccttccccacctcatgtggaaaacaacatgcaacacttaatggcagttcagacacaaatcttgcaaggtttagccgcagccgtagccggttttcagcataatgcgcatggaaatggccaccctcacatgagcaacaatagatccaagctgacaaactttctgaggtctcgtccgccagagttctctcagaccgtcgagcccgtcgaggctgacgattggctgaaagatgtggatagaaaactcaacttagtgcagtgtactccggttgagaagacgctctacgcctctcaccagctaagaggacctgccgcagattggtgggagaattactgcaatgcacaccctgaacccactaacattgcttgggatgagtttgctacggccttccgtgcagctcatgtgccggaaagcactattgacatgaagaaagaagaattcaacagacttaagcaaggcaacagcagtgtcaatgagtacctaagtatgttcaacaagttggctcggtacgcccctgaggaagtggacacagacaagaagaagatcaggaagttcttgaagggaatcgcagttggaatgagactccagttgcttgctcatgacttccccacttttcaacatatgatcaacaaagcacttctacttgaggatgccagaaaagaggctaccgaagaatacaagaaacgcaagtctaaccatcagggaaattctttccgaggcgcacctcgccctcgctacggtcaacccatgcaatatcaccagtcggtaactcaggctaaccgccagccaggctacgcccctcgtcctcagatgaaccatccggcacctcagccacagcagcgtgcccctagtggcaatactgcgccaaacagtgttacctctttcaagtcaccacagggaccgtcagcagttcagtgtttccggtgcaaccagatgggacactatgccagacagtgtcctcagaatcctaccaacaacaactcagggcatgctaatggcagcactgccagaactcctactccagcggcagctcagtctcgtcctagctctcaggcaagtggacaaggttctcgtgcgtccaacaactttggtcgaggacgtgtgaatcacattcaagctgaaaccgctcaggatgctctagacgttgtaatgggtatgttctctgtcaactccgtacccgcaatagttctatttgattcaggagcttcccattctttcatatcacaagcttttgtgaaaagaaatggttggaaaacccaaaatttgcgtgtaccaatgatagtacattcccctggaaggaatataagggcaactcaaatatgtccggaagttaaccttagaattgaggaagttgacttcctagccaaacagatagtcctagactcgcaaaacttggacatcattctagggatggattggttggctaagcacaaaggatagatagattgtgccgaaaagtccatcaccttgcaaggacctggaggaaagcaagtccgctttacccctaacacccctaccgcaagtcggtctatcctaacctgtttacaagtcacctccttggagtcggtgcccatagtctgtgaatatcccgacgtatttccggaagaattaacgagaatgccaccagaccgagagatcgagttcgccatagaactggcaccaggcacagctccaattgcaaaaagaccctaccgaatggcagctaatgagttagcagaagttaaaagcaaattgaagaactggaaagtaaaggttatgtgcgacctagctcatccccttggggagccccagtgcttctggttaagaaaaaggatggctctgagagaatggtaatcgactatagagccctgaatgaagtaactataaagaacaagtacccgttgccacggattgacgacttattcgatcaacttaaaggagcaagagttttctcaaaaattgacttgaggtcaggttaccaccaactgaaaatcagatctgaagatatcccgaagaccgctttctcaacgcgttatggtctatatgagttcacagttatgtccttcggactcaccaatgctccagcattcttcatgaacttaatgaacaaaatcttcatggaatacctggaccagtttgtcgtggtgttcatcgatgacatcctgatatactccaagaacaaggaagaacatgctgaacacctgaggctgataatggaaaagctcagagatcatcaactattcgctaaattctcgaaatgcgaattctggttggaccgagtagcatttcttggacacgtgatttcctccaacggtgtcgaagtagatcccagcaaggttgaagctgtacttgcttggaacccgcccaagaacgtgtcagagatccgcagtttccttggcttagcgggatattatcgaagattcattgaaggattctctaagctagccagacctatgaccgagctgttaaagaaggagaagaaatttcaatggtctgcagcctgtgaagacagctttcaagaaatgaagaaaaggttgaccactgcaccagttctcaccttgccagatatccgaaaagatttcgagatcttctgtaacgcatcaagacaaggcttaggatgtgtcctaatgcaagaacgaaaggttgtggcctatgcatccaggcagctcaggcctcatgaagtcaattatcccacccatgatctcgagttggcagccgtggttcatgcacttaagatctggaggcactatttaatcgggaacagatgtgaagtatacaccgatcacaaaagtcttaaatatatcttcacacagaccgagttaaatatgaggcagagaagatggttggaactaatcaaggattacgatcttggaatccactatcatcctggtaaagccaacgtggtcgctgatgcgctaagtcgcaaggcctattgcaatgtagctcaaatacggcctgaccaagatcatctgtacagagaattggataagttaaggctgaccgtggtacagtcaggagtccctgccagcttgacagtacagcctaccctagaatcgcaaatccgggaggctcagaaagatgacgaagggataaaagagttaataaaaagaatacaggagaagaaagacgctaatttctccatagacgatcaaggcacagtttggtgcggtccacgcatctgtgtaccggccaagaaggagttaagagatctcatcctaaaagaagctcatgagtccgcctactccattcatccaggaagtacgaagatgtaccaagatatcaaggcatacttctggtgggctggaatgaagcgagatgtcgcagaatacatagccttgtgtgacatttgccaaagagtcaaggcagagcatcagaggccagctggtctgctgcaacccctaccgatccccgggtggaaatgggaagagatcggaatggatttcatcaccggtttgccaagaacccctagcgggtacgactccatctgggtaatcgtggatcgactcacgaaatcagctcatttcgtgccagtgaaaaccacctatgatggaaggaaactagcagagctctacataacccatgtcgtatgtaggtttggttgtcccaagaaaatagtgtcggatcgaggcactcagttcacctcaaggttctggaagcagttgcatgaagctctcggaactgatctaaattttagtacagcctaccatccgcagaccgatggtcagacagaaagggtaaaccaaatcctagaagacatgctgcgagcgtgtgccttggatttcgaaggcacttgggatcgttgtttgccgtatgctgagttctcatacaacaacagttatcaggccagcattcagatgtcgccgaatgaggcaatgtttggaagaaagtgccgcactcccttgtgctggaatgaggtgggcgaagcgctggtattcggtcctgacatactcaagtcagcagaagaacaagttaagctaatccgagaacgattaaagacagcgcagaaccgttagaagaattacgctgacaatcggaggcgtgaccttgagttcgaaaaaggagatcatgtatacctgcgggtatcacccctccgtggtatgaagaggtttgggatgtccggcaagttagcaccccgctacatcggcccctacctcataaccgccagacgtggcgaagtggcatatcagcttgagctacctgaaggtctcgcagacgtgcataacgtgtttcacgtatcccagttaaagaaatgtcttcgagttccagaagagcaagtccccctgggtaatatcgaactggaaaagaatctgacctacaaggaaagaccgatcaaggttctggaagaggcagaacgtcagactcgaaggaagaccatcaagttctacaaagtccagtggagcaatcattctgaagatgaggcaacctgggagcgagaagatcttctccgcgccgagttcccggagctgctcccttaggtgctgaatctcggggtcgagattcttgttaggggggttggtctgtagcgcccgttccgtcgtggcgcctagcgggaaaattatctcttaaaaaccctatttgcgaaatttgtttccttgcttgttgtctagtgtccgtgccatctcaagatctcaatccccgatctatcgtcgagttcaattctgaatccaaacccttccaaaatcattttcctccgcaaaagtctattttgcctcccccgaggtcgatgggccgaatctcgctcggcccatctccccctctcccccggccctctcctctctctcccgggcgctctctctctctctctctctctctctctctcgctccctcccctctccggcgcgctctcccccccccgctcagccccgctcagcctcgcccgcacgctgctcgcgcgtacgagagccgccccgagcgcctctctccccgctcccccctccgccccgcccgcgcgccgcgcgcgcgtgcgcgggagtcgcccgcgccgagcgcccctcccctcgcgcgagctcccctctcgcaaagacgcttcccgcgcgccgtgtttgcgtgcgcgcgcccgcgcggacgccgcccgttgtttcccgcgcgcgcgcgccgagtggccgaccgcccggtcgccgccgtcgtcagcgtctgccgcgcctgtcgccagtgtcgccgctccgctccaaaccgcccgccgtcatcgccgtcatcaccgcccggcccccgccactccgcgcgcaagccgccaagggaaggaggccgcgcccctcttctctctgccgcgtcgcccccgctccccttcccctttttcccgaatcggcaaaggggcaagccccctttctctccctccttttcccctttttcctcctcgccggcgtcatcctccctgtcgccgctttggccgcgaccgccgagcgccagctcgcgcccttgaccgccctaagtcggttcccaaaccgacattgccatcctataaacccaagcctccccctttcccttcctctcccattcgcctcctcaccgttgccgccgcccccgtgctctgtctcgcctccgccgtccttcgccaagcgccgggagagccggtgcgttcgaggacgcggaaggggacttcggccgcgccctctccttcctcttccccggcccgaggccggagagattactcccgcgccgccggcctcttgtcacagcgcccctcctcttctcggtgatgtctctctccgttcttcctcctcgctccatctcctccccctagctttcggtagtagctagagtagcctccccgtagttagccggcgccgccccgaccattgccgtcgctcgccgtgtgttcgccgccgtcgccgctcgagctccgtagcacccgctcgttgctggcctcgctcggcgtagttccgcccaatccgacgctagcgtcgagttcccgaagccgcatagatgctctcaccgccgggaatcgacctctcgtgacctcgtcgccgtttccctcttctcccgccgccggttgccgccgccgcaatccgccgccatcgagcaacctccggcgaatccgagccgttggctcgtctccccttgtcacgtgcaaccgcccggtgtgcacgcttttgcccgtatcgccgtggttcgctccgccgctcgccgccgccgcccgccgtccattcgcggccggatcgtcgtctacctcccgccagcccacgtggccgccacgtaggcgccacgtcggcgccagctcagcctagaccggatcgagccgaccccggtcagtccctccccgtgcgcgcgttccaccgcgagccgtgaggctgcgcgtgggcccgccgcacctgcgtccaccacggaccgcgcgcgtgcaccgcgtcctttccccgcccgcgcgcatgagccacgtactccctccgcacggtgagccgagccgctgacaagcgggtcccacccgggaccgcgcgtggtgagcccggtccaccggactctctctcctccctcccccgcgcgcgcgcttgggccgtcttgggccggccggcccgttaagctcggccgagctgctccatttaccttgggccgcgccctagccgcccgaggaaaagtctgatttccatccctcttttcttttcttttcttttccaaaaaggatttaattaaatccttttcctttagaccaaaaatccaataatcttagaaattcaatatcttcccaaccgtaaatccgtttgactccgttcaacttccaaaattcctcaaatctcgagatctatctaatggcacgcttagaggtcattaatagggctttattttcgccgtttgttgagttgttccgtttcgcgtgtagttccggagcccgaagacccgcagtgcgaggatttcgaggatcaagctccagatctcgagcaaggcaagccacctttgaacatcttgagcctatatttgaaatttaattatgttgcttgcaaaatattatgcattgataggatcgcacttaatctgtttgtcccgtctgcaaggcagattggcggacctacctaatttgtcgcatttgatccttcctttgttaattgctataccatgtccccttataaccacccagttgcgcctcgatacttgtgcactctgtgcaagtatcgacggtcgccttcaaacttaaaatctgagtaacaacttgggtaaaactggagttttacaaaagacttggaaaacccgacacctgggtcggtgcttgcgaactaaatgaatttccaaaaccgcggaccggggaacgtaccgggtgtacggtttcccgctcttgcacataaggaccgtttccttggaatttcatccgaacataagacaagtacgaccacatgggtggaatgggacgcccttggctgagtaaattgctaatcgggggagccttgatgccgagagacatgtggattcgccggggtggtgtcggggaggacccctgggcttcctggcacagtatggtctgggacctaacctgttgttggtctgggacccctctcgtcggcatatggtaaacctgtgtcggctttcgaaatgccttgtcatgaaagcttggaggtctcccgacgtggctgatccccacgggctgggtgacccgggttagtaatgtcgtgtgggtaaagtgtaccccctctgcagaggttaacaaactgttcgaacagccgtgcccatggacatgggcggatgtgaggtgattcctagcgtagttttgtctgtctactgcttgtgaaattgctgttttgaaaaggggttcgatgtttgaaaaatctgcagctgatgggatcagctaggcccgggtggccgtttgaaaagttgttggcccgggtggccgtttaaaaagctgttggccgggtgccaaccgtgttgcaatcctaaagattgatacattgcacatactccgaccggacgagacgcactgtctcatccgtgtcgtttgagaagcacttagttgttttcagaaaagagttcaaataaaatcaattgcaaaaacaacagcctttccttgaagcctgcattaaacccttatttcccctggcttgctgagtactcccgtactcacccttgctctatataaatatcccccccagttgctgaagaagatgaagcggatcctgctgatgaggagttcttctaggagcaagccggctacgatgagttttagggtttcggcctagttcccaagtcgcgcctgtgatgtttggtccaagtcctggcttccgtttcccttttgtaatgcagttgtgagctcgggatctgtccgcagcccaacatgactgtacttctactctataataaagagacctctgttgctgtgatattctgtctccctgtgataccagcactgtttcctgggactggtatcgattaacaggctaaattggagcgtcacgggccagttccggtcgggactagttcggggcgtgacacaacccttcttaatcaattccaaaccgaattagattgctctccagccaggtgaagcattcccactaaagcaagtatcaacaagagttccatttggaaagtactttgctttcagcactctcgcacacaaactatccgggttcacaataaggcgccaggcttgtctagctagcagtgcttgattgaacaatttaaaatccttgaatcccaagcctccatactgtttggccttcgtcaaatacttccatgccctccaatgtgttttcctttttccctgttccgcaccccaccagaaattccgagccaacttgtttaaatcttcacaagtcgagtccggtaacttgaagatactcataacatacaccgggatagcttgtatgactgcttttagcatgatttctttgcctccactagagagatagttttctccccacataattattctcttccaaatcttctcctgaagactttggaacttgcctttgttcattctcccctccggggttggaaaacccaaatatttatcttcaaaaccattgccgacgatttggagtgtacttctgatttcagcatggacactagcgggagtaatatcatcaatcagcatggagcactttgctagattaataaactggccagttcctacagcatagtcgtcaaggacttctcggatcacatttgcctggccattatcagccttgaaaaagagtagagtatcatccgcaaacagaaggtgggagattccaggcgcccgccgacaaacttgcactggggtgattgccccttgaagtaccttttcatccagcaggagtgatagcccatcagcaacaaaaagaaacaagaacggagaaagcggatcaccctggcgaaggccgcgagaaggagcaaatgtactcagtaaggttccattgagtttgactgaatatctcaccgaggtcaagcacgtcattatccaactgacccaccgatgagcgaaacctaacttatacattgattgctccaaaaacgactagtcaacccgatcatacgctttagagagatcaagcttgtaggcacaagcagcttttccagggctcttgttcctttggatggaatgaaagcattcaaaagctaacagggcattgtctgtaatcatccttcctggcacgaaagcactttgattctgagaaatcaaatcatccaggataggcctcagcctatttactaagcatttggagacaatcttgtaaatcacgttacataggtttataggcctgaactctttcaactccattggttgattaaccttcggaataagcacaattgcagtctcattgataccatctggcatgatcccagtgtggaagaattccttgacaaccctaaccacatcactcttgatcaggccccaatttcgttggtagaagcgagccggaaaaccatctggcccatgcgccttaagtggaccaatctgaaacaaagcatctgcgatttcttcatcagagaaattcctgcatagggaatcattcatttcggcagttactttctgctggaacagccttgtgactctagaatgatcaacagtagggtctgctgtgaacatatcattgaaataatccgtggcaagattctcaaggtcttttgtcgcactgtaaacagtgccatccgggcctcttaacttggagattttatttttcttcgctctccatcttgctctgttatgaaaaaagcgagtattccgatcaccctctttcagccagctaattcgcgagcgttgtaaccaaagcatctcctctctatacagcaattcattcatatggtctgacgcaatgcgaatttctctgcggtctgcatccctttctactaattcagcaagcttctttctggccttctctagacatctaccaacatttatgaattttgttctactccaagtttgcaaggccgacattaccttcctcaaagcacaattgatatcacccaaatgttgtttctccccaacttctagccatgaatcaccaatcacttctgttgatgcaggttcacgttcccaacatatttcataatgcagacacttcttgcgattcgcatgagaagtatccctggtaaacctgacaagaatgggacaatgatccgagcatggagaggtcatatggacaacctgtgaattgctaaaaatatctcgccaactgttatctgctagtacccgatccaaacgcactttcacattgtttctaccctcccttctgttgtcataggtataaggaacccctgaaaagcctagatcgaataattcacaagtgcttaggatatccctaaaagcgtgcatttgggattcacttctgcgtttctcagaaaagtgctcaaactgccataatgtttcattgaagtcacctataaccaaccagggaagagaggaagtttgctttaaatctttgatcgcagaccacatatactgcctattttcaactctcggttcaccataaacaaaggtagcatgccacaaaggatcatccggagacaaacgcacgtatgcatcaatatatctgtcatttagagatttaatatccatataaacagactcgtgccaaaacaaagcaagaccaccactcatacccacactattaacccccacaaaaccttttaggcctagtctatttcggagccaacttaatctttccactttctgtctagtctcactaaggaaaacgatatgggaacctgcctccttcaccaaggcacagagatcacgaactgtcgtagcgttcccgataccacgacagttccaagctagacaactcattgctcctgacgggatcctaaagcagatcccgtcagtttaccagcggctccctggctggttgcctccaaattgtccacctcctgctctccatccgccctcctagacctctttagtgccctggttagcttccttgagtccatctgccctgtagtatcatcagccactgcttgttggtactctaacaaagcttgcttgactattcccggcttcacgccaccagtttgttcctgtactcttttccgattcccagcactaaactcatccgatgagacttccccaaaagaagcttgctggtgcagattagcaatagccaggatcatctcagagtttggagttgcttcctttgccgacccctgcacaatacggttttcttctccttccatttgcatgtgttgtgcctgctgagctaattgttcatctatcttgccgtctccctccatctcctcagcctcaaagttgtcacgagcatccaccctaggcggaactgcttcattccactgctcaccttgtttctgccgagaagttgatgaacttgcactgccagcacctctgaagacaaggttccgagcaacacctgaggaggagaacgctttcactttgctaactttccgctcgaaaggtttcatcggagagcaacgcaattctgctgaaaacctgaaaggctggtcttcattagcaactcttctcccatagtccttatcagaatgccccaaataaccacatatgaaacagaagtgtgggactagttcataacggagatcaaacttcctaatctcctctttgccttgcaccaggatcatgattgcaatcttctcttttagcggacgtttaacagggagatccacccggatatgaaagaaatcgtgcatgtttctgccatcatcaccaacatccacttcacaaactttacctagtctactaccatacaattctcctctctgtttcgtcattagagccaatggaaggtcataaatcctgacccagataggaactgattctaggggcactttcgatgggcaagtaataccatcaaattcagccataggagagcatcaccatgatggatccatggtcctccctgaagaacaaacttataatcaccctcagagctgaaagttatgatgaacatattctctcgcagggatttgtagctcatatctgcacgcagctgccaagcacgacacatatcatcgaagaggctgatgggtgggcaatcttatcgaataaaatcttgcttggatagtccattggcctggaatttgcaccttcttcttcttaagggttacttcaataattttcttttttttcttaataattttccctttttgaaaggccgcagggccttgggaagagctagtgcccatatcctcagtcatcaccactttatcatccttcttctggctcccggacatcgccttcagattggcatccggcactgtgtccatcacccccttctcctgaatcgctagcttgatcatcccgccatccgtcagcttcgggtgggcaatcatctcaccgatgatccctttatcacccccactggcgttggcagccatgaaacaccttgcgatcaagtgtcgacggaactctagattggaacctgaggaatatgaggaccaaggaacggaactatgttggataatcctccagagaccccccccccctcctctttatagtagatatcgaccaagatcggatctgacttcatctttgttctcatagtctggataggattatacttcgtccccaatccatccgaatacggattgcatccagattatctcgtatacctaaagcagacatctcctttaccaattgtgtgttaccttgactccaccaggaaaccttcatctgccgatggtaatctaccatcattgcctgaacgatatcgatccttccaagaccaacacagaacgcaggaggaaatcctgccctcagcaacaacagatcggagacgaactccatccagacccatctcactagatgggagacagccgccgccccccagttgcccgggagtcacccctgcccaaaccctaaaaacatcttactgttgatagtaagcctaaacttaacactataaaaatatgttgattcagataaataccactacaactcatttattcgtagtcatgccataaaaaatttatggaactaaaattatgccaccgccgtcacgtttttcatcaacctccttcctttttccatcttttttcttatctgcacgtgatgcccacccgtcagattcatcttctttcttcatttcccacctgatcttagatcctgacactgctacagcagcaggcaaaaacaaaaggaaggaaaaaaacgaaactcttgctaccaataatatacggcaaaacggtttcgtttttttatcccatggaatggaatggcatgggtaatttgctcgtataattaattcaaagttgtcttgcgacagtaaccttctttcccatgctttgtttccttccattttgttaaaaaaaacaatttttgaaatttttttttgcctggccggttgaaggaattagccggtcaaagcttacggttacaacaacgctgcctattaacattaattgttcttataaatctgcaaatttgacaaatgctgtgtttagttcccttcaaacttacgaaaattccgtcacatcaaatgtttggacacatgcatggagcattaaatatggacgaaaaaaaccaattacatagtttgcatgtaaattgcgagacgaatcttttgagcctaattacgctatgatttgacaatgtgatgctaccagaaacatttgctaatgacagattaattaggcttaataaattcgtctcacagtttacaggcaaaatctgtaatttgttttgttattagtctacgtttaatattttaaatgtgcgtccgtatacgtaaaaaaaaatttggagtaacaacactgccaaagtactcttaagaaagttcctgttaaacatttttttgctgtatacatattgaattcttcggcagcctttattagaggctacgcacgtactcatgaaagaagtacaaattaaagaaactactactacagtttagtttttagttcgatatatgcgccatcagtgggcaaaagttaaggattgtctttgttattcaagcagtcaagctccatcttctagttttgcttaaggagatcttgtgcccggcagcattgacttgctcattactactgaactagctatgctcgtgcttcacaactggtgttgacgaaaaacagttgaaacaataatgtgtagttgccatggtcacatgccaaaaagtagtaggattttttttccatgaataaaagtatccaactgcatgcattcctcaagtacagtttactgttagctaatgcgtgtgtgactctgtcatctaaacgcttgaattcgttggtcgattattatcttagcagggggccgggcccgagcctgtaagaactcgatcaatcgaatcatatcctcacagataatctgaaggcatcagaaagcaaatcaagggattatcaagtagggctccagaagaaattgagtttaatccagcattaaaaaagagatgggtttcttggcattgctt

SEQ ID NO: 47647 - DNA, 15086 bp, Oryza sativa
ggttacagcaacattctaacttcaagtgctctaagcgatatgaacaaggtgagcacatagccattcactgcgaaaaaattgtattaattgtctctggctgatcttgttgagatttctgacaggttgttttcaccgtcttcacaccatctctcatgtttgctagcctggcgaggacggtcacgttttctgacgtcatttcttggtgagtttcagtttatagatatgcaacaatgcaagtgcagttactacaaaatctgcccaaattccatctccacattctaataactgccaaaatcaacacaatatgtatagctcagccagactttctgaattttttgaaccgtaagctctttctgaaatttataaggattcttgcagaagtgagaaactctctttctgaaatagaaaacaagctttacatatatagttttctcattcagagcactgtttaaatatctgggcagagcatatatacaatatccaaattttgtttgctgggtaactccacagcactaacaaaagaattctatcatgtaggtggtttatgccaattaacatagggatcacattcatggctggtggcactctaggctggatagcatgtagaatcttgaaaccaccacaacatttcagaggaatgatcattgccttctgctcagcaggttagtttcctaggtggattgcatgtttttaccctcatatttttgctgaataatcctaatgttagcagtgtcatcaactgacaaaaaatgcaggaaatcttggcaacttgctcctgattgttgtcccagcagtctgtgacgaagatggcaacccgttcggaaaagacagcagccgctgccgatctcttgggctctcctattcatcattgtccatggctgtaaggaacaaaaatatatcattcactgaatgatcagctgaacaaaagaactgacacacactgtatctgcactgcagcttggtggcttgtacatatggacgcatacgtacagtcttatgaagaagaagagagatcaaatgtatcaccagcctaacagcactcagtgccttgacgacagcgatgaagaacatcattctaagaaattcaaagcaaatggtgaagctgcttacgccgatgaggaggcaactcttccggtgtcagctaaactggctcaacacaacgaagagaaccaaatggtaagttgagtggtttgttcctcggaaaaattaatcttcagagaaaacttagtactattaacttgtctgaaattcaggaagctccattgctgtcttgcgagagcaaggttgctaagaaatgctcgtggacaacaacaaacctgaaggacaccatccaccacgttgtcgaggagctgatggcaccaccaactctatctgctgtgtgttcctgacaaaaccagccacaatatttcatctcatcaacccagtcttggactaaatttggttattcttgcttcagatacttggatttgtttttgggctagttccatggttgaaatctcttgtcatcggtgatggcgcccctctcagagtcatccaggactccatccaactgatggggtaagttagtatttacagtgttcttcttcatagagtatatttctgtctatttttcagtgttgcccttcttttgcttgtcttgcagaaatggcacgattccttgcgtcaccctcatccttggtggaaatctgataaaaggtaggatgtcaattactcatgattcatgaagctgtgtgttttctgaacctttatctgaatgtgtttatgcagggctaaggaagtcggagctcaagcgtacggtgatcatcgcgatcgtctgcatccgctacgtgatccttcctctagtggggattgcagtagttcatggtgcatactgggtcggattcttgccacacgacccgctgtaccgctacgtgctgatgatgcagttcgcgctgccacctgcaatgactattggtaatctttccctataacagatgtcattttcttcgtactctctgtatttaaatatatggtactgatgattttatttcgtcgatgcttatgattttatttggtctttaatgtacaatgttgacctctattttctattttctgttacaatataacattttttatagctaacaaaattataatattgtaaaagtacttagcatgaagaaaaaaacatacatatatgattttttatgtcttacactaaatattttgagagctattgttatcaaagttttaaaagtgtaataaccaaataaaatcaacagtatcatatatttaaatacaacgagcgtacttattttgcaaggcaataccatttcgttctaaagcattagtctctgcttccaatgagatctcctctgatcatgcctcttgcatgtgtgtgatctaatacaggaaccatggctcaactgtttgatgttgcccaagaagaatgctcagtgttatttctgtggacttaccttgttgcttccatttctctcaccacctggtccacgatattcatgtccatcctgtcttgaggtcaaagtcgacaagaacaaaatgcgtcgtgatcttggttaagtgcaatgatttaagcatttcagctaactcaaagggagtaggttgaagataataatacgcctctggaaaagagtcgatccaactgaggcttgttcgtgtcaccgtttgcaccacctgtataaaaggagttgagcagtataggcacaacggtttttttctatcccaatctattggttcatttaattggaatggtttttcatctcttaagggatattcataattcactgttttcacatgtcatctaatagtcatgaaaatattttaaatttttttaagtaagatcaatatatacatgtatatcagtttatatacatataagtttattaaaaagttgacctatacagattgaaaaaaaaaaggtgcacagctccagctcctaactctaatttacctggagccggaattgtgccaaacaatccagatcctccatttttggaagcggagttggcagagctgctccacaaaaatatactacgggggtggagctgggtttttttctactccacagctccacttcacctcaaaagacccactaccctttaattttttagtgtatttacgcaaaaatgccactgaattactcctacccacctctcctcccgttctctctcctttgccaaccaatcctctcgagtcacaaccagctgcggcgggaggcggtggcagcgtcggcggtggtaggcacacgacgacatcagggcggcgggcagcgagcgtggcgacgaggcgttggaggcgactagacggcgatgggcggagagccggagacgaggtgcgggaagcggccgacgtgcagcgacggcgagcgggaggtggccagtcggcggtggacggcgcgcgcaacgacgacgcgcaaccgacggcgggcggcgcgcctgggattgggcaggccagcggctagggtttccttttttttcaatttttttttcagacctagagctaaaagctagccaaacacttctcaacgactctccaactctaacaggagctagctcccactggagtaggagtttggagctaggagttggagtttggagccctaccaaatggggctaaagtgtgcatattcacaaacatatttttaatagatcgaatgcaaatctatgtgtttttgaagtgatatatcatgtattaattaatcttgtcgaatttacattgctatctattttttttcataactatgtggatggcttgaaaaaacactctaagggataaaatgaatttttcctatttaattatttcttcatatttgtctgttagtatatgcccgtctattgagaggtaataaaaccaccacatttactttggagttctataattcaccatattaattaaagaaaacaataaataatactattagattatggttggctagattatagctttaatttggagattgatcaacagtgttgtatacaactgtgcattttattgtggaaaacaaaaacaataactgcattaaaaatgtatttacgaaaagagaagcaatggttgtagataaaatacaaatcatattttgaacatacagctcgacacagtattgtaggagaaaatccactagcgtgtacgaaactaggaaatagatgcagtgaccgcaacttctttatggtaaatacacgtatatggtatattggtttcgataaaactaaaatagcatagatattcccgacattttcttttgagtaaattttatttcactttgagccatcttttaactgatctttctcttcagaccatcctttaacggatggttttgctttggactagttaatcttgcttgatactttagaattcggaccaccattaaggctgtgttcggcagcatagtttctcaattctctcccctcttatttttttcacgcgcacacttttcaaactattgaattgcatatttttaaaaaaaatttatatgaaggttactttaaaaaattatattaatctatttttcaaaaaaaaaaagctagaacttaattaattcatgtgctaaatgagttattctattttacgtgtgcggtagatttgttcttaactgtaagtaactaacactaacgtaacctaattattttactcacctacatccaacttacatatgtcaaagaaatgatctatatacaactgtaagagttcattgatgagtaggaaccggtataatcgaaattgttcatacttttcaaaagagagttagagtaatttaaagtgcaacaaaggtaaaggtaagattacccactttggttaaagagtaatacaaaataaaacttcggtaataaaagatagcccaaggtgaaatttacatttttttaagaaaagaacatgtaccctacgaacacatatatatgccctactattaagcacgtacgaaagactgagcctataataatatgcaatctctaaaattattattttaactaagggaccacctatatatttgttgacaaattttctaaatcgtagtgtaattacactataacttgtatgtaattacactgtaacttgcatgtaactacagtgtaacttgtatgtaagtttcacgtaattttgaatcgttagatctattacaagatttgttctggtgaggaagaaaaaaaatcacagcacacagatatgtgaaaggatttgttcccacgacctctattttactgaaataacatgttaccgagagattcttgaaagttacatacaagttacattatagttgcagtgtaattacactacgattgtactgtaattacatttgataaatttttggaggaaaacttgtcgacaaatatatagcaaatttgttaactaatacaggtttgaaccgagaaatatggttggtcataaataaaataatccggacgcagtcaccatacctaggtcgatatttaattatttattccaacgcagagaagaattttagaagaaagttttgtactcaaatgaacatcatgtttcagttcaaaaaaaaaatcatccagttcaaaaaaaaaatgaacatcatgttccagaagctgttgacaccatatgaattattgcagacgatccatgtatcacactccgttcatatattcctgggctgtattatttgcacctgttgaatgggcatgtcttgtgtgtgtttctataagcctctattccaccaaactaaggattacaatcttcttaattatagacattattgagattttgggactaaagtaccaaatcaacacaaatatagaaaaatactcccgtaataaaatgtattgactttggtcaaagtcaaactgttttaaatttcactgagtttatagaaaattagtttatcttgggtaattagttttaaatttcccgtaataaaatgtatttacattatcaaattagttttattaaattaataattaaatatatttttataataaatttatcttgggtctaaaatattactattttttttataaacttatcaaacttaaagctgtttaactttaaccaaagttaaaacatgttacaacatgaaacggagtggagagagtacctaccccaagaccctgataaattggttgctctcgtctcttcttgcttacagaagaatcctcgcttctgtttgttattccacgcttcgtttttttttttttgaattaatattccacgcttcgttgcgcagctctcagtcaaagcacgccaccgtattacgggagatggtcgccgccgccgaggccaaagccgccatcggggtggcaacgccgacgccgacggcggcgccatgcgggtcgacaacaacgccgcgcgatgccgacgtagacgacaagatgaccatcgtcggccacccggcggcgtcgctcccgctggagacgcggtggccgccgttcccgctccgtcggctcggcggcttctggatgcccgagtccctcctgccggccgtcgcggccctccacaccagcttcgcgccggcgccggatggcgtgctcctcgccagcttccccaagtccggcaccagctggctcaaggcgctcgccttcgccgccgcgaaccgcgcggcgcacccgccctccgacgccgaccacccgctccgccgtcgcaacccgcacgactgcgtcgagttcttcgagatgcgccccgacgagcacaccggcgccaccagcgacggcatcgccgtggacgcggcgtcgccacctccgccgccgcgcgtgctcgccacccacctaccctactccctgctgcccaagcgcatcaccgccggcgacggctgccggatcatctacatctgcagggaccccaaggacacgctggtctccttctggcacttctccaagaagatggcggcgaccatggcggtggacgccggcgcgttcacgttcgacgaggcgttcgagctcttctgcgacggcaactgcaccggcggcccgcaatggcgccacgtcctcgagtactgggaggcgagccggcggtgccccggcaaggtgctgttcctccggtacgaggacatgctgcggcggccggcgagcggcctgaggaagatggcggagttcatggggtgcccgttcgccgcggcggaggaggcggccggggtggccgacgccatcgtcgagctctgcagcctcgacgagctgaggagcctggaggtgaacaggaacggcaccgacgtgctcgggctgaagaacgagtcctacttcaggaaaggtgtcgccggcgactggcgcaaccacatgacgccggcgatggcggcgaggctggacaagatcgtcgacgacgccacgcgaggctctggattaagccttgccaatgcaaccccgtctccgcccatgcatgaaaatgaaattaagggaaatttaactatttaccactcttacatttaactatttatcacccatatttgaatgacatactactactctatcctaaaaaaaaactctagctacgaacttagacatgtatgtgtttagattcgtagttaggattaatttttttttaccgatggggtatgggcttaagtactgcagtttatttttttctatatatgttactgcgtgtttcttctgttctggatgtgcggtgtgaagaaggatagtgtgaattatttgtaatataaaatgtgcagttcaaaagatcaaatagagtcaaatttaattgttgttatcctgacttttctgggcgtttgaaaattgtttagcatagaagtcctcttatttgactccaattttccaactagaagacaaatcttcgtcatttcaaattagtcataaattatggtacaaatacgtacgccagatgatacatgaacggaaaacaagtcaaaattttggttggataataataaagcagtactacaataaacaagacaaaagcatttatccttttttttaaggcaaaagcacttatccatgcaaagagagtaaccaacacagaaacaggtgggccttgtgggccgagataaatttatgggcctgtttactgggccccaccaccttaaactccctcctttctcagctggctttgcataggctttggctgtgataataactacggtcatgacacaagtcttttcgtcggcaacgacctttgcatcgtcttcgccgacgatctaaaagacttgcgtcagatggttagaatttagaaaacctgatagaattagggtgggtttagttcacgttaaaattaaaaatttggttgaaactggaacgatataacgaaaaagttagaagtttatgtttgtaggaaagttttgatgtgatgtaaaagttaaaagtttaaagaaaaagtttgaatctaaacaagagctttgtgcattacttactccggtctaaaacttgaggtctcttcgcctatgatgctcaatttttcaatatttgttaatctctttgtaaggaaaacattgaaactggctaagatatttgttaatctctagagtacatgctctccttacacaggaacttatgtactccctcctaggggcggatttaggaataaaaaattggagggctcaattacatagtttctttaacctctagccatctaggaacctttagtttatcattcatggtgagaaaattgaagggagtgctccaggggtatccatgggtcttgtgggtgtattcatagtgagaaaattgaagggattcgagtcccccctacacccacgttggatccgcccctgctccctccatcccagaatataaacaattttaaagttagacacaattatgaagaaagtaggtataagtgaatggtggagggttgtgattgattgagtagtgaaggtatgtgagaaaagtgaatggtggagagttgtgattggttgggaagagaatgttggtggaaaagttgttatatattttaggacaaatcttaagagttaaaagttgttgtattttggaacagatagattgtaaaccaacattcacatataaatatcaaaggaatttttttcttcgcacgtgcatgttggatcttctgcttctgcccttaaagatggttactctagtagtagcaggtcgtacaaacaaacgataaagagaatccggttgaattcaacatagccatcgtacgatgtatctgcaaatgaaaagtaatttgtgaataaaacttttatatatgtgttaagtgaaaagatgaggccacaccctttttcgtttgggtagatgtacaagcagagcggtgaaaatagaggagcatctgccgcgcactggcgctgtgaaactgaacgatgttctttactctactttcctaacttatctctctcgttttctgcgcgtatattttcctattgttaaatagtgtaatttttttaaaaaataatatatataacagttgctttaaaaattatatgtattaatcattttttaaaatttttttatagctaatacattaattaattatgcgctaagccatcgtttcgttttatgtgtagtagggaagtgtttccaactcaagttggcgaacccatccgaaatagggggttgggtgcagaaaatgcccaatttaatgatagctcatttttggtggtatgagttgttaggtacgactcaaaatacgagccaaagtcagggttcatactctcaataccggatcgaaatatgctgagagaggtatcattggatttcgcagagtccgttgataaatcgatacaatatataaaatttgaataaattttatcaaaacttacaatttgatttgaatttttttgtacttagcccaaaaccgagagattcgtgtttctagagacgagtaaaaatatgggccagagggtgtcggtaaccagttttggatggtgcaaaaggtggtgaagttgctaggaatgaaagatggaggcaggataggacggggcaagccgagaaggagctaacctgatcgagtttactgaaaggaatgctagtgggaggtcgccattgttcacaactcaattgctaatgcagtcatgttctagctgagttaaaagcggatgagacgagaagcttcttgatctaattcaagaaatgctcatgggctagtctggagttagcaatggaattcccataggagcacggaagatgcatatgggtttgatcctaaccgcggttgcaaaattgcccatgcacgtgaacatgcacccatgaccaatgagcatggtttacacggttgatcgctaaatttccaacctcatcgatatcatggttttcgataaattttgattgaatttcgaccaaatctaccatttaaccttcgaaattccaatcgaaacttaattccgagccgtatcgaaacatcaaaatttcgtgaaatttgactggttttcatcggaattgtgaaccctgccaatgagactgaacccatgagcgactctcacgtctctctttgagaaatttaggattgtgccattctaaaaaaggatttatccaaataccatctctcaaacacgctttaataatatgctaaaacggtgtccgaacagccaaaatgaatattcttatattcctatccaaatatcgcaggttttaattcctcaaatcgaaaaaatagaaatagaatccgtttggtttcccaaaacaccagtgatcatatccagttcgtgactctagctgtgattgtgaaccgtagttacctttttcaccaccgcccaaataggagcatatcacggctcacggcggcatcgacgatcctcagccgtcggatgtgtttcggcttttgcacagatccccatatgccgcgggggccgaaaaaagtgtcgcgatagtcgcgccctccaactccaactccgccgctctctccgcttccgttcccctctcctccttcctccgttcccctcaccggccgggagcgccgccccgcgccgccgcgcctctgatcacgccgccgccgacgccgagaccccctctccgctcggtccacccgtcctcttcgggagggcggcgccgcgaacgaatctccagccccacctccggctccgggcattgttggaaaaacccaggtaaacccctgttcactcgtaagtaacgaagcgtaggcagggagagcaaagcgagcagccatggctggcggcgtccgggaggggagggagattgagatggcgccacgccgggcgacgattttgctggggcggatagggtgatcgtgttcgtaggcggcggcgcggccacgcgcgcgtctaggcggggaggctcggccatgagcggtgagcggccggcaggctgggtgccgggaatcgccgatcgcgggcggcgctgctccatttgctggctaggctgggccggtgggcagttgagagtcattcaatgcccactacttagtactctattttcgtcatgcaatcgccagcgtgctctatttggtttgtgtttgtttgttttaggactcaaatcgagcttgttttccttcccatgcacatgcagggtgaacgcttcgagggctggagcagctgctgttgcgtggcactgattttcgtcatcttgcgttgctgaggccgttttagttgcccaggcttcctaaaattcctgcctcctctgccactggctgaaggttgttagttgttaccaatctttttttatggacagctgtcattggacctgcaattttgtagtggatatatgctattccaatgcatgcatactttttgcaaagataagtggaatgtggggctttaacagggtacttgtatgtatgttaatgttttctagtcgtgtttattgttcaggatggaggagccaagtcttgaggtgaaaatgcctgaagctgatctgaaggccgtcaaattcagcctcatgaccagttcagacatggtaatctttcacactggctgtagatttaacttactgtcattagaaataaccatcgaatttgtgttatttcaggaaaagttaagtagtgcgagtattattgaaatgtgtgatgtgactaatgccaagttgggattaccaaatggtgcaccacagtgtgcaacctgtggatcgcaaagcgtacgtgactgtgatggtaagtaaatattaattatgcagcatcatataacacgtcttttttctccatttgctaactggtaggagtaattgttaggtcatttcggtgttattaagctggcagcaaccgtgcataatccatgttttattgaggaagttgtccagttgctgaatcagatatgtccaggctgtctcactctgaagcaaaatggggacacaaaggtttgtagtcaccagattgatgtagtttcatcctgaacaagcaatttattctttttttcacaaaacctataaatatcaaattcctaattctctagtgacaaagcatcttcagtcaatgagaggctctcaagagctcatccaagcaatttacttgatgcccagttatgggtttctttcgccagtgtccaacttcttacaagttttcacctaaggagtttagttactttttacttgtggtcaactgtatcacccccttcccccaccaaggcccaattgttccatgtttgggctggtttaataactacagtaatatgagaattgcatataaaacttggggtttaggacttatacaatggggacggaaatcctgagtattatatcaactgccttaacgtgagcacagagttactgttaacttattggcctagtttatttagctatcgtcataagcttttattgcagaaggcagtagaccttttttttttttgctttctttgtatattgatgatgaattagtgaaaaccttatcatttatttccttaacacattcttctttttttcttaattaaagaagactgatgggacaacaattcagacaacttgcaagtattgctcagtaagtgcatgtgcagatattttgtgcatatttctctctcatatattttgtgcatatttctctctcttgtattaaacattgtgtttttcctggacagaaggatggagcaaaactttaccctagtgtaatctttaagatgctaacaagtccaagagtaacactatccaggagtaaacttcaccgtaacactagtgtgatggacaaaatttcaattatcgcagaagttgctggtggggtgacacataattccaagaacaaagctccccatgaaacccttccccaagatttctgggatttcgtacctgatgataaccaaccacctcaatccaatgtggctaagaaaatattgtcaccataccaagtaatgtatcttttagctatccagttgaaaaaaattctcttttgtactgtcttgcaggatagacttcaatagtacttcagttctgtatctatctactttcaagaaaattattctcttttatttgctgaaatctgccaatttggttactgttaattttggctcaaatgcaagttatagcgctcttattggttgctttgattcaaaaatttaaaacacacagaaaacataacgatactgttctagtaagccataaatatgatatattatgatctcacctggtaaaaaattgttttgtatgactataaaactcttcccagattatctggtatggatcaccaacttgatgcataatgggtcaatatggacccatagccatatagcatgatgaataaagtttgaccactcttcgatgaaatcatgatatgccttctggtttgctcttgtaagtgaaaggcgaaagtatgctgtgtagaacatattacaatacaatccgtcatcaaacttataactctggggccatatcaatgtctaaaatgactattgcttgtgatcggtaggagtactttattaaggttctttcagaagtgggtatgcaattctagttggatactgaactggcatgacatattccatcgattcatcgcattccttcatataaataaacaagatgcttatcacaattaatgaattatccttatactcattatttccattttttcaggtctttcacatgctaaaaaaccttgaccctgaacttatcaatcaggttactccaaggcgggaactattgttcctgtcatgtttgccagtgactcctaactgtcatcgtgttgcagagatgcaatatggacattcagatggcccccggttagcttttgttagtgtcaactctcttttaatatattgtttgtttcatcgctttcaagacttgtcttctccttaaactactagtattaatatactctaaccatctgtatactggatagagttaaatcttccagtgagttatcaaatagtcatttaatcaacgagagagcttagagtagcttctcaacatctttattaaaaaggtttcttcattgtactgtctgatctaaccttacttttgtgccaagaggaggcagcactttattttgttcccatggtttagttgaactagcttgtgataggggtttgacagacatgcttgagcgcatattttcaatattttcgcatctcaattatgaactaatactttcttcattccatggtaggatgaccggacaaaagcatataagaggatggttgatgttagtaagagaattgatgattgtcgccagcatccacagttcagtgtttttgcaagttcagttgtcacaagccgcgttatggagtgcttgaaatcatccaaggcaacatagctaaaaccttactctaaagcagtacctatgtagcatcgtgcactttgtcttgatatgtttttccagttgtcatattggcattaatttgttatagtacttttggatgcacaatttttctgaactttctacatccactaaaatttacctataatttatcttggtgttctgataaatcatagtatcagaacttcaaatttggttggataaggcatggtttgtttaactatatcttgtctcttgtgtttaaacacatgcatatgtacatcacaagtgtggcatcttgacaaaccattgcagtggaaattacgttgtgccctgttgttttgttcatttatctccatcttatgtttcccttatttggttcacacatataaaataactatttgccactcccataaagatgtttgtaataacttgtcacttgaaagatgtcaactaattacttgtcacttggaagatgtcaactaattacttgacatctaatagttgagtcctcttaataaaaaacccattttagccatttttcacactctaccttctaatca

SEQ ID NO: 47648 - DNA, 1091 bp, Oryza sativa
ttgatgatactaaccaagtaattactttgtaccatgtaatatgccagtatgaaacgactagcacctactccctctgtcccaaaatataagcatttttagctatgaatatggactattgtgtgtctagattcatagccaaaagttactatattttggttcggaggtagtatttcttatacaccaactacttctgtaacttgctgcttctttttcaggtaaggtaaacagggaggtagttgatgaaacagtttccacatatagagaatcatgcataacatgtagtttctgaaatacctgtatgaaatacaaactgaaggtatcatattgttcaacttttttcttaaggcattgtattggtcaatgagctctcttacaataaatcccagtcgtaacctttttatcttcattgtttcctacatatacatacaattttaaacatacatttagattccaatccaaatgtccctatgaaatcatgagcattttacttcaaaaaaaaaaaaacctcgcttaaatggaaatgagtgatccatggatttccttgtgttctctgcatatcagagctgccatatctagataacaaaatgaaaccaacatggagattactaaaatgaacaatattagaaggtgaagaaagtcacggataaaatgtactaacaaaatcataaccgtgtcaaccaaatcagagaagtccactcgctctagatgatccttaacttctagcgatgcatactcaaaaccatatctatacttctttagatacttcgataggaaaagcaaaccagtatgaactgcagattttgtacccttatggcacttcaaaacttcctgcacagcaaagtactaaagttaaaatcctgtcaaaaagaaagatgaaagggataacatgacaacgatagaccattaaagagcagaccaagaacctgcaagttcataagaggggaatcctctaaagcattaactgggtgatccaaagctccatatgcagcttctgaaatggaacaagcggcccaagagccaacaggggcaccaggttcaccttcaagatcatgatcattgttcatgccatcagcagtatcataagaaaactg

SEQ ID NO: 47649 - DNA, 5374 bp, Oryza sativa
  unsure (1)..(5374): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaagtgacacaatgaacagtgaagcacagcaaatggtcctagtgaagtcatcactgaaggtgttgcagaggctgacaagcattgaaggggaaatcggcaaagcactgcggtacaagatatcgaagcatcccttcttgttaagaaacctcgcagatatcttgggagacaacatcagagaccaagaattaaaaaagcttgcagtaggaatcctcagaaacatttccattgatggtaacacaaggcaggagattgggaacatgaaggtgctcataaccagactgatgaaggcattcctcgacttacatagaacctccaacacagatgttgatttcttgctaccaaaggtcgccgggcaagcactagcaatgctagcaatggataatgtgcacaactgcttagttatgttgaaggaaccagagttcattactaaactcaaaaatatgatcctgatccaagatgaaaagtacatatatgtggcgccaagcctgttacgtagtatgtgccagcatgcccaagctaagctcacagaattagacctaaaagaactatctcacaccttacgagaggtgagccctgctacttaatgctacagatgcaatatttgaggtggatagtgtggtatgcttttttgcataaattattttatgttagaggagggaattccacctgcatttttttcaaactgggtcatttattactagtaaaatagagtataatataccgtgttttgctgaattatgttgttaccaatcatgctacattatccactacaggtgttggaaagaataatgaatgctgaaggggcagaactagagattctcattggccttagttcacagatatgcaaagtcaatcctgaagaatttgcccaagagctagatcacggacatattaggcaaagatttgtgaagaggctagtggatgcactgaatgcaaacatgaaaccaagtgctcactgccctgggatccggagggtgatacttgagcaatccatatacatgatggagtgcaattctcactatgccaattgtttcaatgaattccggatgatggacgcactgtcaattgtagaagaaacgccctcaaaggttgagaactacatggttttcttgggtgatgtaggctttatggaatgcggcacacctctctttgctctagtggacagagcaaaagaactgatgggtcgtcaatggttgcaaggaatcaacaactaaaagtaattgtatgagatgatttctcatttacagttacagtgatttagtctattgtgcattgcaatccaaatgccgtaaatttttagttgatgcatgttgtggccatggtaaaagaaataaacagaaaatgatggcattggagtccgaaggccatgcatattactaacatgtggtaaaaagaaaaaagtgaatgtgcacatggcctttctagaaagaacacgatttgcctctgagatgagaaaatactattgtaattgtacctcattagtttctttttagaaaatggaataaacccgacctctacatccaaccggatgtacacggccaacctcattagtactgcattgtaatatgtttgcctgcttttctaatgatgatttgtcccattatcatctcttggggtgaacaatgcataactggtaatatatagattgcagttcctgtgccaggctctagcacgtgtactagttttggcatcaattgttttcttaaaatctgtggtttattttgacacctgaaaattgagttatcttttgtagcaactagccccattcaacgcaagccagtagcagcccacattgcacagcttatggagtacagtccctccctggcgaactcaactgaacaaccatgaatacatgaatcatgcgccatgtcaataatgcatgacatgatgcctgattttgattttagtagttggttttccatttttgtaaactacgatgcctgtttggaggcgagtgaacacaaaaccctcaaattcgcatatactgcgctggttatatacttatatattgagaccaaaactatggcgcattaaattttctgcaagtcgcattgcgattaatcagtacagcagcaatcgaagaaaactcccaaatttccacatccctaaaccagtcgattccagtataatcattgactctccctgttactattttcttacgcaaggacaaccatatataggaactgaaccaaatgacctaagcgacgagataaacattctgcttccttataagaaaagagacgagcaaaacgaagggatgcaaaagagaaaaaaaacgggggaaggagacaccacccgtcgacggaatgagctggagggggattcgccctctccgcggcggctgctcttctctccgcccaagatcctcccccgccacccagccgctaccgtgacgcctcgccgtcgccgcgtcggccgctcttttctccgccggagagcccctcgcccagcccaccgccgcgcccagccggcaccgttgcggtcgagggaagaagccagtgcccagataaaagtttgtacgtgggccaaatgtcaggcccttcaaaagacctagcgaaattgtttacggcccaaatgttggaacagctacaactcaacgtgggcctaattttagtcgacgtaaaatttgcacaatacccgaaatatgggcctaagtatatacttactccgtactatatttgaacgtttaatttaattatttagatcgtatatgaaaaataattatggatcataagaacgtttaaaaatatatagagcatatattccaaggagtattacactggtagtccaaccgaaaataaatgcttgcatgtaatactaaacaagcagctctgaacaaaagtaaccataataaagtaattaaggctgtgttctttccacaagtttcccaacccctttccctcgttttccgcgtgcacgcttttcaaactgctaaatggtgtgtttttttgcaaaaagtttctatacgaaagttgctttaaaaaaacaaattaatctatttttgaaaaaaaattaactaatacttaattaatcacacgctaatggaccgcttcgttttccgtgcgatggagttgggttcccaaccccaattatcaaacacagcctaagtagctttaacaacagccacatgacccaattccaccgaacccaaataaagcttgccgccgcctctctcaatcacctccgttggcctgacgttcttcggccccctcaactcctgcaagatcttccccttgcgaccgatccttacggcgaggaggtgggtgtccgagccatacggcgtctcggtcttctcgcggtgcagcgccacccagtagcctcccttcccatcgggcctcacgttgtccgggtagcccggcagctcggcgaacggctccgacgtaccggccttggggccctcgatccagtgcctcaccagcttgcacggccccgtcagcgccaccacgaggtgactccgatcggcgctaatggcgaggccgttcgggtacgtcattccggactggagcacgtcgaggtagcccgtcgtcgggtcgtacttcatcaggcggcccgtggagtcgccggtggccgtgaccatctcgtgctgggatcgctggaagcgcgtgctgctgtcggtgaagtagacctcgccggtgacctggttgacgtcgacgccgttggtgaacttgaacggcacgccgtcggcctccgtggcgagcaccgttgcctccccgccgcgcgggccgacacgcatgaggcccttgtacgcgtcggcgatgtagaggttaccggaggtgttgtggaaccggaggccgagcggccggccgcacttgctctcggtgagctccgcgggatggagcttgggagccatgcacttggcgacgttgtaccccggggcgtgggagtacgtcgtccagcctttgtcggcgccgtcccagcggaggatgcggccgtcggagacgccgctgtaggggccatcgccgaacttgtcgaacgcgacgctctctgggccgaccagcgtcgtgggcagcggcagcgtctcgaccagtgtggcggaggtgtccttcgcgacggccgcggcgagggcgtgcgacggcaacagcagcaggaagacgacgatcgtcagcgccacccgagtcagagtccccaccctcccggtgccgaggacggcccccatgaatgagaatcgccttgctttgcttcgtctcactatcgaaatttcttttttttgtcttggcgtgtttttcttaaatgttcttcgcttcttgcttgcactggtgccgcgcgccggagtgtgcctttatacccgtggccactgcaggcaggccacgtccaatttcggacgccgattccgattgtgtcgtgtaactgaacactaaagccgattcggagtcggagttaccaagattagtgaggtcgacgtacgtaattagcccattaatatgccaattcggaatcggcatatttttatggggtgacgtaatcaacccatttaatgtcctggacctaattagctcatccacgtaaattcagcccatctaagggcttgcttggaacatggaaattttatacacccgcaaaactttcacaccgattcattctggatttagtgcgtcgatgctgtaacaccattgcccccgcgtcgctcctagggcaggggcgacacgggaggcgacccagccgccgccgccacaccacccccactgccctccttccacctcgccgccgcccgagcgggccgccggaaaccgcgcggccgcaaggacggcggcggcgtggccttctccccccccaaggtcgcggcgtttggagcccacgactccgacctagctccggggcggcgacttcggcggctgcgatgtcgagatcaacggtggcgcatggtgtcggcgaggtggcggcgccgacgacggttgaagaggtgggcaaccgggccgacgacgatgacgaggcggcggtgctggctcccacgctctcctgcgcggatctggtgcggggggataggccgccggcggcggtgatgcgcgtggaggcggcggggtggccggattcggccccctcctgtccggatccggcgtgggaggccgagctctgaccccagcagcgagg

SEQ ID NO: 47650 - DNA, 8099 bp, Oryza sativa
tcgggcagctagctgctcggtggtggagggcgacggcgcggcggcagtttgcggaggcggtggttggcgtcggtggcagcggtgacggcagctgcgactctggaggcggtggcaacgtcggcggcgaggaaggagttgggtgcgaggtgaggatgacgacggcgaggtggctgggtgtttggcagcagcggccacggtggtggtgaccgtgtttgcggtcaccgaaggcatggcggcctcgcttgactagccgagggcgtgggagacggctgcatctggccggcgtggcatcgtgcagtggaggggtcggaaaccggcttggcgcagagaagtgcagccgatggtagcggaggccggctcggcgcgagaggcgcaggcggcggagatggaggccggcttggcgcgagaggcgcggccggtggagggaggccggattggcgcgaggcgcgtccggtggaggaggccggcttggcgcagagaggcgcggccggtgatggaggaggcgacctaggtgtgaggaggagctgccggtgggtgtggcgcggtcttcgacgcatgaaggctggccggcgggggacgccggtgcaggggtcccacatgtcggcaaagcttgtgtggtggtggagcatcggtgcgtcagacgtggtttcgcagaatctcgtctgtgcccctttgttggcctagtggcggtcggtcacgcttagtggcggccgatccggtgctagccttctcctgggcgtgtgtgttggcgatgtcggcgtgtgggtggtggtatattttttccttttcctggttacgactctccagagttgtaatattgtatttttttcctgctctatcaatagaacttcgcaccgtctcgtgcgagtcgttcaaaaaaaaactttcacacccgtattttttctgtgccccaagggctttcctgggatcgtggaaattttatacgctcgcaaacctttacgcccgtattttttgtgcaccaagataacatgtaaaacaaaaataaatatatttggtaaaatgatgtttcctttcataatacaaaagtagacgcacacgccactacatgtgtaacacccacgaatgctcatcctagctaacaaacatctatgcgtccgtaatacttgtgggtgttgggattttgaactctagtggatggagtcatgcacccacgactccactcccgtatcacttactatgacaaaacataattttgcatggggccaaacgctttgctagtatttaaggtctgtgaaaattgatgagtttcgtaggccgctaccctaagagccccatcagcgcataattaagtggcttgactaaacaatgaattttagcgtaagaaaacaaagtgcacatccaaatatcgtccgattcgcaaaattcataatgcaatttcaacatttgaaattcgaaacagatttgtcaaattcacaaaaaaaaagccagccgatgatgtcagcatcggcatccctacgtcggtatcctctctagcttcttcaaccagtctaagggaagaaaccgaagtagcgcaccatcattgatgttggtgagggagggcgcggaggcccgccgcgacaaagtcaaccacctcagcgaggatggccgtggaacgaggatggccgagagctctccgcgacaacgagtgagagcttcttgaggccttgtggcaaatctgcatgctccaggcccaacgacggcaaatccacccgcgtcaggctcggcaacagtggatctagactcccaagaccctgtggttgcagacctgatgctcctgaggccggtgacggcggattcaagctatggaggtcacatcgctgtcttcacgatcgtggtcattgtcgtcatcactagtgtcgtggtggtggtggccacgttcatcgtcgcaggcccaattgatgtccctttgcctcctaaggcccaccaagttggtgtgatcgacggtgccgatttttataggcagggctaaatctacgggcttcccgttatttatacaagtattaacaagcattaatattttaagcccacctgataaaaataaaacgtaggtctgggcaaaattgtttttttagtgctagtacttccccctgataaatgtcgtttcgtttgggtaaaacataaaaaaaacatgtgaattcatgtaccgattctgaactcattaaaatcattgcatgagctgtagcagcaaaacaagctatgatgctgaaacgtgagagtattcacgcatcaaaaagatacaatgacgaaataggatgcaagtcagaatagattatagaacatgacttatgtgataaattctaagcataccagcaatactcgtgcaacaagcgtgtttggtggaccataacccctagatttatttattttttttttgggggggggggggggttgttgtagataatgagaaacagctcatgtgatttcagctagcataggaaaatctactttgtggttactagtttttttgtaaaattctcctattacagtttttaatcaaaataaaaggctaaattgtttaatttagaggagcttttagttttaagaaaagctgcaggttccaaaagttctcccaacattgccctatgttctaaactaattagcatattgctaattgttcttttagtgatagcaacttactcatcgagtatgaggtgtttataagtatgtggtgtgcaattgtccattcgagttgctcatagtaataggagtgtgtgtatgtgcatgtttatatggtcactagtaatcgtgcacgtgcaatgcacattttccacgttataaaaaaaacacaaagtagattcaaagtttattatattttcctacagtatacatcacataaagtatacttcctccatttcacaatgtaagtcactaacatcaatatgagatgtgagcctatgatagagattccaataaaaaaaataactaaatcagtgcagcaaatcaagaaagagtgtgcaacacgaatcgtccagaaccaaaaactaaaaatgccaagttggtagggcttccatcatattctatataaacatgttaccacgataaaatttcaatacgtacacaggttacaaccacaaaatttaaaacatgaggctttcacgaactaacgtaatatatcgtaatcctaacgtattattgtattctgatgctcaccccttgataaagtaaatgtgagaatatcaccttcagataatcccgaggaatccttattgttttggtggcccctttggtgctatgaaggtgtaacggcaggatgacacattagtcttcttgttggttgaatgaacttctgaaatcgtagaattttgggcactttcaattttgttaagtggtggcccatgaagatattgttgattaccacaaaccagtggaaaaacatctcatttgatttaatagcaaatcagaaaattcatatgttgttattttacatcaaatcaaaacccaaaaaaatcaagacattttaatatttcagtatgatatgaaatactttgacgcaaaaaatcaaccactgatcacttccaaatacaaaggattataataattatcttcctcatatattccccaagtagctttggtcttccacacttcaccctggaatgaaaaggcattatcatttaaaaatgttaaaagccacaaaaaagaacttgtcactataaactgaggcaggaagtgaaactgtccctcatcctaatgtaggcctcaatataaaaacataagactacacctaacctctaaacatgccaatgccttctagaatgaatagagttgtgcattgagatatattgaggcaaattaagaggaaaaaatacagaagaaatttgaatcctttgcttcagagaagaccagtgataactttttccacccttgattctggatcctcaatttccatatgcttagaaagttggacatgattagaacaaaatgttatttagccctgcgtgatactattaagcaattgctgaaaacaagcacttgaaaatgaggacgtacatatgccaaaaatcccacagtttgatgcatggcattctagcacctattagaaatgtttcagttatcaacccgataattcattttgttgaggcattaaactaaaggttgataaaccgtgcatagctatatatcagtatattattcttcctctgccctccctccgagtgttaagtctagccattcaaatcggtggagtacatatcaaacatgcagaaaatatacagaaggtaaaaattatccaataattaattacttcctccgtttcacaatgtaagtcattctagcatttcctatgctagaatgacttacattgtgaaacagagggagtacatatttgtgctgctctatgataaaaagaagagatttaccttcccctaattcagattaccaataattaccaagccattacatcatacagtacacattcacttgacacttaaaactcacaaaatagtagactccctatcagttaactgaatggatataacgcttttaacagtacaacctacctcaaatggcattgtggatagttacaaatctctcttcctcttctgttgttgcaaatctgtcaattgtaattaaaaaagtagataaataagatgattgcgtagagatttctcaaatcgtacaagcttagcaaagaaaattatctgcttaaaccaaatgggatgtttgaaactgattcaaactaaataataagcaattatagaatcattcccattggtgtgttgcacacacatttttgttgttcatggatgcagtatttaggcacgcatggacagtgttggagaaaaaaaaaagacacaggtgccagggaccatcacatggccctcaagtgtaaattaagttgcagaggaatgggcaaggtacaggaggtgtttgtgagtgagccgaggccaagcagagagaggagaacaacaaaatttgcatcaataggacatgagctaactgacaacatatatgagtgaattttaccaatctgcaaaacaaaacttttagaacaatatgtgaacttatattgaacgtcatttaagttttattgtgagcaaatgaaagcataatgtataacgttaggattatacctcaccgttaagatacactctttctaatatggggatgaagactacagctgctgcactgaatcttgaatcatgtacaaaggtaaatcaaattgaaaattgcatttataattcttcatttagagtgcaaatgaaataataccgtgagatactgaggatagttctcaaaaatatactggggatatatttgttgccaaaccgtcaggacatacaacattaaaaacatctgatttctgcatcggcaaaaatatgcaacacatgcaatcaattttgggaagcaaagagttgccaaggtggatgtgcagatcatggaaagacaatacattcactggaagctgcatagcaccttgagatcaggtctgtgttagcaaaccgattactcctgcagttcaagaactgtgaacaccaccaaaggcggccgcatcaacagctgtgacctgctgcccttcttggaaaaacaaatatatgaagatgatagcaaagcaattcaacaacctgaatcatctcatcttcatgctgatgtatgtgtgttctgtacttctggtagaaagctggagcatccgaaacataaaactcaattaaatctctaaaacaaagggattattagtgcacctttgcattgaccaatatgagggggggagcaggcgacagtagagaaagcaccaggtcacatggtagagcaggaggtgagcagtgagggaggggattggcggtagaggcgaggtgagcgggctatcggcaatggagtacatcatctcagattctcagtccgctccccactttacgatggagtccgacagtcgacagaagcatggcagcataggcgacagcactgtggccttctccctcaccctccattgtctctgcatgtggactgagaaggaagaggcgatctagcacaaatggatgcgtagcaacagcggaggaatgtaaaattggcagatccagcactaaaataagcaatgtagtcacattttcaagttttcatttgcaacagcagcatcatgcaattgcttccatagccttaccaacaaatataccatccttatttcatctctaatttcatgagaaaaattgtctattgttattcttaatttgtgcacaatcagcaaaaattccgttctgctatcatcagtttgatgggtactacttgaattgcttgaataataatttaacaatgttattttcttctccattgaaaatctatgaataaatcaaaactatgatcatgaagctcaattcttgtaaatcacatcatctagatgcattactgaaatcagagacaaagattatgaacagaggcacggggcgaggactcaccacttgttctgctagctgctgctgctcgcccctcgctgtctgatgcccttcatggatggatggcctgatatgctagctcctcgccccctcactcctgctgctcgtgccttgctgttcgctgtcgccgccgagccgctgcagcctgccacgtggcagctgcttgccgttgttgccactgcatcgtcgcttgccggcccgccgtcgccggccacgctgatagctgctagggtttgtgggctgcacaccaacggagcagctatagaaactacagaagcggcgggtgatggggaggcggacgcggcggcggtggacaggacggcgcgacatgcgttggggatcgagcactggaccaccgttgccgagttcacccagtcggcggatctgacgacgacggctgcgctcgcgaaggggactcggggacggtgatggagaggagaaggacacgaaggaggtggggaggaggaggacgcggtggcggtggggagaaggcgatgcagcagcggtgagtgggaaggaggacgacacgaaggcgatggggaggaggagaggcatgcagcggcggtgcgtggggaggaggaggacgcggcggcggtggaaggtcagggagattcggtggcgcgggggagtggcaggaaggggatcgatagcggtagtagcgagtagcgcgggcggagtcctcgcgcggtgatgggagcgaaaatcacggtggagataggatgggattgctgtgggagggtgaatcgcactggacggtagggatgagagtgatgcggacgtggatacagatggatggtaggatcaacatgttgatttcacccgtacgattgcaaaaaggcaactcctactttttatattagtatagatatagattatcgcaagattagcctaattgtattctattcaattacatgattattagtgagtgttaacttcttcctccgtctcatattaagtttagttttagctcagtccatttgtcccaaaataagtttacttttgggaggaatcattgcatcagaattagtaaaagtaaagaataattgtattaactagctgggtggcccgcgcaattgcgcggctagcacccaaacaaaatcatatattttttagtataattttacttaaaatttattaaatagctacctagctatctcatagttttaagactttaaaataccaaatcttatcatcctcgtgtttttaattatatagttttaaaagttacaccagttgctaccccttatgtcatatccttctttatttgtttgtttgatctaccactatttctattcattcttcttagaacctttaaaaattgaattttatagtttttagagtttattgtcacgttaggttttatttttataatttctagatgtaccgtcaaacgttgccattatactcctctacggcccgtccactgtctcttctctttgttgtcattgagactttaaaaatcgaacataattatcgtttgggttcattttttactttttagaagtcccgcccaaccgtcagcggctttgccattgtactcttctatggctcgcccgttgcctcctttctttattgtcattgagattttaaaatcgaacatgattatcattgaatttttttactttttagaagttccaaacctttaaaaattggacttgtagttttattttttataatttttaaaagtcccatcaaacgatgccactatgcccctct

SEQ ID NO: 47651 - DNA, 4846 bp, Oryza sativa
ccctctacagcccgttcgccgccaactcttttttgtcattgtgattctaaaaatcgaacataactattgttgtaattcattttttattttctagaagtcccgtaaccatcggcggctctgcaactatactcttatacaccccgcccgctgcttctcctttttattgtcattgacattttaaaattgaatatgatcatcgatgttttttttttactttctagaagtcccggcaaccgccttactcatttttgccttactcatttgcttcatggcctgcctgacgtccctctttttaatcgtcattaggattctacttggtgttttattaataatttttatatctcgtatcaaccgccaccactctactcctttataggcatgttacttaatttatatcgtcatgtgttttttagatggtcttttctttcaataatctttatttttatcacaaattttagttatttataaattgtattcctaattgaaatcttatttttctttttctaattttagaatttttttaaaaaaaattagttaatatcgtattgtgttattttaatgtttttattttttattttgaatttcagttgtttcgaaattgtattcctacttgaactctcttttaatttttctaattttagatattattttatttttattctaaattttaattaatctcgtattgggttcttatatagattcttctttcattattgcttattttaattccgaatttcagctaattttaaattgtatttctacttgaactcttcttttattttcttttgctaatttcagatttatttatttttattccgtattttaattaatctcgtattgggttcttatatggactcttcttttaatatttcttatttttaattccgaatttcagctatttttaaattgtattcctacttggactctcatttctttttctaattttggattttattttatttttatttcgaattttgattaatctcgtattgggttcttatatggaaacttatttcaatattccttatttttaattccgaatttcagctatttttaaattgtatttctacttgaactctcatgtccttttctaattttggattttattttatctttatttcgaattttgattaatctcatattgggttcctatatggactcctctttcaatattgcttatttttaattctgaatttcagctatttttaaattgtacttctacttagactctcctttttcttttttctttttctccgattaatgtgtgattttctagctcccacagcgaacgtggggcctcctttcaaagctgttttaataatataatagattaggagtagataaagagatgaattgcattgggatttgatatattaggagtatttctttttattattactacctccgtcccatattacttgtctttttgagttttcgtttgtcaatgtttgatcattcgtcttattcaaaaaattttggaattattatttattttgtttgtcaattgctttattatcaaaagtactttacatatgacttatctttttttatatttgcattaatttttcaaataaaacgaatggttaaacgttgcaaataaaaagtcaaaaacgtcacctattatgagacggagggagtattattggtatgtgtaggatgggtaaaatattaacttatttgggacgtatgtagtagaactagtatatagatatactaatgtaggattttacactaagatgtacgctacattacaagaaacaaaaatgacaagtagtgctcaatcgcagttctatgtgagaagttatcttatattactaaaagaaatttacagctaacaattcacggtcgtgcgaatatactagcatttcaatacactatgtatcaaaaaataaagtccacgtcctaaatatcaggattgttgaacaggcaccgcaaaatgtgactatccgaagttagagttttatttgaaatcaaaatatacagcatactcctatattcccaggagagatgaaatgcaaactattacataggtagttcggccgaaaattgatacttgcatctaaaacaaaataagcgctctgaaaaaagcaactataaactaatcaagtagcgctagccttgacgacggcgacatgacccaattcaactgaacccaagtaaagcttgccgccgcctctctcaatcacctccgttggcctgacgttcttcgccccctcaactcctgcaagatcttccccttgcgaccgatccttacggcgaggaggtgggtgtccgagccatacggcgtctcggtcttctcgcggtgcagcgccacccagtagcctcccttcccatcgggcctcacgttgtccgggtagcccggcagctcggcgaacggctccgacgtaccggccttggggccctcgatccagtgcctcaccagcttgcacggccccgtcagcgccaccacgaggtgactccgatcggcgctgagggcgagaccgttggggtacgtcattccggactggagcacgtcgaggtagcccgtcgtcgggtcgtacttcatcaggcggcccgtggagtcgccggtggccgtgaccctctcgtgctgggatcgctggaagcgcgtgctgctgtcggtgaagtagacctcgccggtgacctggttgacgtcgacaccgttggtgaacttgaacggcacgccgtcggcctccgtggcgagcaccgttgcctccccgccgcgcgggccgacacgcatgaggcccttgtacgcgtcggcgatgtagaggttaccggaggtgttgtggaaccggaggccgagcggccggccgcacttgctctcggtgagctccgcgggatggagcttgggagccatgcacttggcgacgttgtaccccggggcgtgggagtactgttaaactttgcactaggatcacctaggttagatctagtcgggtggttctatttgggtttgatgaacgacattgtagatgaaagggagagggtttagataccgaccggttgaggagatcgtggaggaagaggcgccggacatcgtcgttgtcgtcgcggcttgacgtggatgcggcggtggcgtttcccgtcactggctgcgccccctctcgatcggattagggttttgtggggtggagttggcggcggcggtgaatctcgtaccatgtgccgtgccggcctccacccctcttttatatggcgcagtgtgacgggggcccaccagccattgggctgggcgcccccgatcagggcgcggtcaaggcccccttgagccgttgggctcaaggggagagagatctatctaacattctcccccttgatctcactttttcttttagctttttctattccatcacagatttgtaaatagagcatgtttcatcgtcacggtcaatcgccgatggattcgacagccactatacacatctctattcagaaacagatactttacttttgggccctgtagtccaggattcataaggcttcccttaaacccatgccggctacatgttccttgaacacgttgggtggtaggcctttcgtgagcggatccgcgagcatcctttctgttttaatgtgctcgagactgattgtttgatcccggactttgtccttcacaacatagtactttatgtcaatgtgtttggcagcaccacttgactgattgttgtgagtgtacattactgcgggttcgttgtcgcagtataactttagtggtttctcaatactgtcaaccacctttaaaccgggtatgaacttctttagccagttcacctgccccgttgcctcatagcatgctataaactcggcatacatagtagaccctgcagtgatagtctgttttgagcttttccatgaaatagctcctcctgccagggtaaacacgtatcccgatgttgactttgtattatcttttgcaaagtcagaatctgagtaccccactatctggagtgattctgatcttctgtaagacagcatgaggccttttgttccttgcaaataacgcaagactttctttaccaatttccagtgctctaggcctggattactctgaaatctgccaagtaacccggtaacaaatgccaagtcaggtcgtgtgcacacttgcgcgtactgtaggcttcctacagctgacgcatatggctttgttttcatttcattgagctcatactgatttctgggacattgcgatgccccatacttttcgcctttcattataggagcaggtgtagcactgcatctgtacatgttgaatttcttcaacaccttttctatatatgtcttttgagaaagtcccaatgcatactttgttctatctcggtgaatctctatgcccaaaacatatgaagcctcaccgaggtctttcatgtcaaagtttgaggacaagaatttctttgtttcctgcagtagactgacatcactactagccagtagaatgtcatccacatacagaattaggaaaataaatctcccattcttaaactttgaataaatacagttgtcctcgacattctcttgaaacccaaatttctttattgtcccatcaaacttcaagtaccactgtctcgaatcttgctttaatccataaatggatctctttagacgacatcccatattttcgtttcctttcatgacaaaaccttttggttgcgccatgtatactttttcctccaaatctccatttagaaatgccgtttttacatccatctgatgtaattccaaatcataatgtgccactagtgccattataatcctgaaggaatctttacaagagactggagaaaatgtctcattgtaatcaatcccttctcgttgcgtgaagccttttgccacaagtcgcgctttaaacttt

SEQ ID NO: 47652 - DNA, 3052 bp, Oryza sativa
ctttgtataactgtttggacagtagaaacgatagccttttgatctttcaggatagccaataaaatggcaactgactgttttggggtccaacttcccaatatttgggttaaatactttggcctctgcaggactcccccacacacggaggtgagttagcgagggtactctccctgtccatagctcatacggtgttttgggcaccgatttgcttggaactctgttgagaatatgaatggcggtttttaacgcctccatccataaaccgagtggtagtgtggagtagctcatcatgctgcgcaccatatccataagggtacggttgcgcctttcagctaccccattctgttgaggttcgcccggtgttgaatactgggctactattccattctctagcaagaaccttgcaaaaggtccagggacttgcccataaggcgtatgtcgaccatagtactcccccccacggtcagatcttactactttaatctttatatcatgctgattttcaacttcagctttgaatatcttaaatttatccaatgcttctgatcgctctttaattggataaatataaccatagcgggagtaatcatctgtgaatgttatgaacgagtcatagccatccacacttttcacaggaaatggaccacaaatatctgtatgaatgatctctaaaattcccgcgcttcgttttgcaccctttttgatgctctttacaaattttcctttaatgcattctatgcattgttctaagtctgagaactccaatggaggaagaatttcattcttaactagtctctcaattctccccctcgaaatatggcccaaacgacagtgccataatttcgatgagacatcgggagttcgctttcttttcttgttttcttttgtcaacgaggacacaacattcacattctcagaaagagataacaaataaagctcgtctcgcaacacagcaagaccaatacatgcattattatgccatagttcacatttgccatttccaaagcggcaatcatatccatcaaaatccaactttgatacacttattaagttcctttgcaaagaaggaacataaaagacatctcgaagtaaaagtatgaagccattcgagagctctagaggaagatctccaacagcttcaactttttcttcaactccattggcaactctaatggtgctttctcttctttgcgtagtcctcgtcgaacggaatgcctttaaacaattacaagcatgaatagttgctccagaatcaatccaccatgtggatctagagtaaccaacataatgagattcatttacaaatgtaataatgttctcacctttctttgccatgatcattttcaaaaaatcaggacaatctttcttgtagtgtcctgtcttcttgcagtggagacattgatctttctcaacagcgaactgttgttgctgaggcagatgctgagactgtttaccttttgaggtgggagacttgtggttctttttcttatctttaacatagtttattgaaccaccatttgattctttgattctctcctcctcttgcacacaattagcaatgagcttctcaaagttccatttctctggacttatgttgtagttgacaataaaattgtcaaactgctttggcaatgaggccataaccagatggaccagaaagtcatctgttatgcccaaatccattggcttcaacttggaagccatgttgctcattctaagtatgtggtctctaacaccacctccattgtacctttctgtcacaagctgcttgatcagctgtgtagcataagtctttgaagagccagtaaactgactctttattctttcaaggtactctgagacagcgtcacactctgggatcgagcccaatatggtaggctcaatcgtattctttaccacagccaaacatttcttgttggctaaggaccatttcttttgttcaatgtcatacgacatgacgagaggagcattgtccctatgtctcttttgccagtcagcatctgactcactttcacctctgacaaggtcagcaggttctataggacatggggtagtcaatacccagtccacctctcccaagataaaagcaaggtcgagttttcttttccattctgcgtagttatctccttttagggtcggaatatctttaatgcaacccatcaaggagtagccacctgaaataatcatgtgcggtgagaacaaaattaacattaaaatattatgcattaagcctacatcaccgttgggcagaattagacataacacatataaccataactataatattgcaattaacaacgttggtcagaaaattacaacatcatagcacataattaatgttcctaaaattaaattctcccgttggttcgaaatttaattttagaaacactaattttcatcaatttcatctatttgcagcggaagactatataaaatcatatgaacagtagcaaaatctctgtaattctctctctgtgaaaattctcccgttggttcaaatttaaacagaggtaaaacatgcaaaaatctattcaaaattctattgaaatttgcatgaaaaatcgacaaaataaaatggaaaaattgctactgttctcttttattcattttcggccccgagggacctaaattgaacttttccggcctttgccggtcggcctatggccactttgcgcgcgggcgagcgccccctcccctcccccaggccgcaacctgggcctgggccgggaaagccgccgccgcgcgctccccacttgggccgatttcggtccggccgccgccggccgtccgatcagctagggtttcgatcggacggccgggcgccgagatcggaggatcaaaaacccccctctcccggccggccgccgaaaaccctagcttctcttctcttctctctctcacgcgaccgcgtggacggcgtcgccatcgccggcgaccttcgcgccgccgcgccatggccggcgctcctttcttttctcttctccgctccccccaccgtctctaacccccaccgtgtgagagagagatggcgacgacggagatggcggcgccg

SEQ ID NO: 47653 - DNA, 3310 bp, Oryza sativa
aggcgccggacatcgtcgttgtcgtcgcggcttaacgtggatgcggcggtggcgtttcccgtcactggctgcgccccctctcgatcggattagggttttgtggggtggagttggcggcggcggtgaatctcgtaccatgtgccgtgccggcctccacccctcttttatatggcgcagtgtgacgggggcccaccagccattgggctgggcgcccccgatcagggcgcggtcaaggcccccttgagccgttgggctcaaggggagagagatctatctaacaagtacgtcgtccagcctttgtcggcgccgtcccagcggaggatgcggccgtcggagacgccgctgttggggccatcgccgaacttgtcgaacgcgacgctctcagggccaaccagcgttgcgggcagcggcagcgtctcgaccagtgtggcggaggtgtccttcgcgacggccgcggcgagggcgtgcgatggcaggagcagcaggaagacaacgatcgtcagcgccacccgagtcagagtccccaccctcccggtgccgaggacggcgcccatgaatgagattgagaatcgcctttgctttgcttcgtctggctgtcaaactagcttctcttcttcgcttcgcgctttgtaatggtgagatgttcttcgcttctgagatgcttggattggtggagagcggtggccgtgcctttataccggtagccacatccacgtcgtcgattcggataccgactccgatccgattccgactccgattttacaacgaacctaacctcagcttgttgccttgtttacagtccagactgtgcttaatttcggcctgtgtatgaatggatctggatctaatgtcagcccatgaaaaaaggttggatggttaggcctgcattgaatttgatatggatgtatgtttggcccagatataattttatatgggcttagtttccagccgacgtatgttatgtcgtgggcaatttacgccctcagttaggaataagttcactttgagtccctcaaaatatagctccatcaaatttatatccgtgaaccgcaatatcagatattttaaacccccaactattaaaaccggtgtaatctcactccctcagcaattttgaaggacaatttctttgacgtggcctttgacttggtccaacctgctgagttatcctgtaaggcccacccgttagtgacccttatataacttatcttccttcctttcccctccatttgatcggcgccacccctcttcccccttctgctccacgttgggccgccgtcaggaaggagaagtgcgttaggagcgacgtcgaatgcagtagtggcagtagggagagtggcagaggtggtgcaggtcaggggtggctctccggcgagataagctacggcggcttgacagaggtcgcggtttgtagtgacgatggcgtggttgtggcggttcttcgatgagataagctatggcggctcaacggcgcgcgcaatccttttggtgagataattaagctacggcagctcgacgggtgtggtgctctgcggtgacgataacatgggtaccgccgtgctcattcgcattgaggtggggtgcttagcaacgacaaggtgtctagtcggactagttccgtcccttttctttgctcttaactaaacataggagcttatgtgatggcaacaagaacagagaggaggcagggtggcggaaagacgtagccctgctttgtcttgaagtttgaagcaaggaggaaaagcttgaagctagtgttttagtttttctttattgtttgttatatatttcagttatgagattaagaatgtaacttatggttgtataaatatccacttgaggtcggatttctaaccgctcttaagcttttttttttgtgtgtgtctttgattactgctcaggataaattaaagagtgaaatacatggccggtctctaaacttgtgtagtggtatcacttaggtccgtaaacttaaaaattatacgtttaggtccgtgaatttggtttaatgtaccactccggtccaaacgtcctttgactgtgtttgaccgccaacgtggcatgccacataggcaacacttttgttatcagccccctctacatcacaacacgtcgcatatatctcgttgtagctatatagtgacaccagaatcccaccccccaccccccccccaaaaaaaaaaatcctcaaatcgttcttccctctcattcttctccttgcgtgtatagaaaatacggtcccaattagcaattgccattgcactgcctcccgccgctaatccggccgcactgtgccaccgctaaccccactgcactgcgctgcctcctgccgctaatctcaccaccgaggtcgccacagccgctacctctcggctccttccactaacctcaccgaagccctagtcgatttagggattatttttaggggatttgggttgaaatgcactggtcagggcaagttatgtgcgaagatatatgtggagggggctgagcataaaagcattgcctacatgacatgccatgttggtggtcaaacgtggtcaaaggacaattggactggggtggtacattaaaccaagttcacggatctaaacgtgtaattttcaagttcacggatctaagtgacaccacctcccaagtttaaagaccggccatgtatttcactctaaattaaattatttacttagttatcaaagtgtggagtaaataattcatttgaataatctgatgaacaataatcttttaaaaacacatagcctagtccgtaaaattatattacaagcagaaaacctacatgaagcgatcagaatgtcagatatagtatccctgacaaattcggatatcaacgtcccacttctaatcagaatatttgctatactacggagtacagagttactagttacgctaagaatccgaaattagactagctaaatgctacttcaacacccaaatcggaaccggtggtcactgttcagccccagatacgaaacggagtcggtgtccgaagcttggacgtggccactggtataaaggcacgggagcaccacgccaccaatccaagcatctcacatatctcagaagcgaagagcacatctcatctcagcatcagagaagtgccaacgcaaagaacagagtttgaaagcgagactatacgcaagcaaagcgatcatccatgggcgccgtcctgggcaccgggagggtggggactctgactcgggtggcgctgacggtcctcgtcttcctgctgctcttgccgtcgcacgccctcgccgcggccgtcgcgaaggacacctccgccacactggtcgag

SEQ ID NO: 47654 - DNA, 3185 bp, Oryza sativa
cggcccgtcacaggtatcccctcacctgtgacgggccgaaaggaaaacccgtcagaggtataccagtgacgagtttttcttccaacccgtcactggtatcccctcacctgtgacgggccgatacattagaagccgtcagaggtgatgggccgccacctgtgacggctttcatttctggcccgtcacaggtgagaggataccagtgacgggccgttgaatagaagcccgtcaaaggtatgagcaatacctttgacgggctttttttatctaacccgtttgaggtgtgttgggtctataaatacccccaaactgccaactgctttccatcccgaccattgtactgttcacaaatcggttgggagggcaaggggggcgattttttgctaaaattcaaggtaaaaaacacattattctccattcattctcaacatatcgatcatcatttatttttcttcgtatgttgttgatttcagatggatcgtagatggatgtactatgcgcatcgttcgtctaccgagtatagagagggggtcactgaatttgtcacatttgcggataatgacagaaaaaataggatgagcatgcacatgttgtgcccatgtagggactgtaagaatgaacagatgatcgaagacaaggatgaagtgcatgctcatttgataatgaatggattcatgaagaaatatacctgctggaccaagcatggagagcaagaggcgcctgatgtcgcagctgaagaagtgttggatcaggatgtagagaacaccgccgcagctcgagaaggcatgttcgtaccttctcctttaggtggagagaccatagatttggacactcaatgtctatctacaatgttgcatgacattgaagacgcagaggacaacgacagagattatgagaagtttagtaagttggtggaagattgccagatgccgttgtatgatggatgcaagtcgaagcacagcaagttgtcatgcgtgttggaactcatgaagcttaaggctagtaatggctggtcggacaagagttttacagaactccttgagctgttaaaggatctgttgccagaggggaacaatttacctcagacgacatatgaagcgaagcaagtattatgtccgttgggcctggaggtcagaagaattcatgcatgtccgaacgactgcattttgtattacaaggaatacgctgacttggatgtctgccctatctgtggggcatcaagatacaaacgagcaaagagtgaaggtgaaggaagtaagtcaaagaggggaggcccagcaaaggtggtgtggtatctcccaattgcggagcgcatgaagagaatgtttgcgaacaaggaacaagctaagcttgtgcgctggcatgccgaagaacggaaagtcgatactatgctgaggcacccagcagattcagtacagtggaggacaatcgataggatttaccaggaattctcaaatgacccaagaaacatgcgtttcgcaatgtgtacggacggcattaatccttttggtgatttgagcagtcgtcacagtacatggccagttctgcttgttaactataaccttcctccctggttgtgtttcaaaagaaagtacattatgcttgccatgctcattcaaggaccgagacaacctggcaacgatatcgatgtgttccttgaaccgataatcgatgacttcgaaaggctatggaatgagggcacacgaacatgggacgcatatgcacaagagtatttcaacctccatgcgatgctgttttgtaccatcaacgattatccggcccttggcaacctttctggccaaactgtgaaagggaaatgggcgtgttcggagtgtatggaggaaacaagaagcaaatggttgaagcattcacacaagacggtctacatgggtcacaggagatttctcccaaggtatcacccgtataggaatatgagaaagaatttcaatggacacagagatacagccggacccccgacagagctaacagggacagaggtgcacaacttagtgatgggaataaccaacgagtttggaaaaaagaggaaagttggaaagcgaaaagagaagagcacatcgaaggaaaaaacagaggagcatgtggaaaaacaaaagacaaaagagaggagcatgtggaaaaagaagtcaatattctggagactaccatactggaaggatcttgaagttcgccactgcatagatttgatgcatgtcgagaagaatgtatgcgagagtttaatgggattactacttaacccaggtactacaaaggatggtctcaacgcccgacgagatctggaagatatgggtgttcggtcggagctacatcccataaccacggaatccggcagggtttaccttcctccagcctgctacactctctcgaaagaagagaagattgatttgctaacatgtttgagtggtataaaggttccatctggttactcatcaagaatcagtaggctcgtttcactgcaagatcttaagttggttggaatgaagtcgcatgattgccacgttcttatcacacagctgttgcccgttgcaataaggaatattttgcctcctaaggtgcgacacacgatccagcggttgtgttccttcttccatgcaatcggccagaagatcattgatcccgagggactagatgaactacaggcagaacttgtgagaaccctatgtcatcttgagatgtactttcctccaactttctttgacataatggaacatcttccggtgcaccttgtgaggcaaacaaagtgctgtggtccagcattcatgacgcagatgtatccttgcgaaaggtacctggggatccttaagggttatgtacggaaccgttcacaccccgaggggagtatcatcgagagttacaccaccgaagaggccatcgaattttgtgtggactacatgtcagaaacatcttcaattggattaccacgatctcatcacgaagggaggcttgacggtgttggtactgttggaagaaagactattaggttggatcgtaaggtgtacgataaagctcatttcacggtactacagctgtcggtgatatgggaccgggagtatcatgaccagaggcttgaggcagacgcaatcgcccacgtggcctggcaccttcggggacgtcgggcccgagggtgaggtgtccgccctcctcctgatttcccccgaggggggggg

SEQ ID NO: 47655 - DNA, 6965 bp, Oryza sativa
accgtgctgatctccgcccattcaagagaaaaagaacagtccagtttggaaagagaagggtgcatgtggtatccccttgaagtataaaaggaggaccttgcccatagagagggggttgttggttgattctttcccagattatgagcttagaacgggggagaagtcagctcacacttgtagctcattcatacgcagatccaccaaaacacaggagtagggtattacgcttctcagcggcccgaacctgtatagatcgtcggtgtctcgtgttttctggctggcatacgatatttccacatacagagagagcgagagcttgagatttcaccctaagcccccggccgaactggcaaaggggggcctgcgcggtctcccggtgaggagccaccagctccgtcatctggcgcgccaggtagggggctcagcgtgtgctttctgagctctcagactcttccgtgtgccccaagtttttcttgttcagcctaatggccgagcaaggaaaaacacacgacctctcgccgagtgtgagcggcgacgacggggagccgaatccgcgccgtcgagctcgtactcctccacctcctccgcgccaaagccctaagcagggggaggcgcttgagagggtcgacaaatccgcggcgtcaccagccgcaggtgatgcaggagaacggcgagacggggagcgtcgcctcctcgtctacggcgacggcagcacacctcagggtgcgcttcaggctgctggcgcgctcctacgacacccgcctgtcgtccatgacccggagtctccagcccaacgatggctggaagacgtggccaacttggtcatgacggcacagcagcgcctgggtgctggtggacggtccgccaccaccaccaagacctccggcgccgctaccaccggctccgtgtcatcaaggcggagggcgcggcgagcggcggcggctgcacgtcattcggctgccactccctcgtctacaccgtcgactcgggaggatcagcatggggagccggatgcccgcctcaacatcgggcgccggcgtaatagccggcgtactccccgcgcaacggagggcgcctcttcgtccagagtgtcacctcgacatggacgtgaggaccagccctccgtgcccccggctggtggtgtcggctgtagagcctttgtggcgagtcttcggaatgtccgttggcccccaaggttccggcccaccatcaccgagaagtatgatgggagtgtcaaccccaccgagtttctccaggtctatacgaccgggattgaggccgctgggggtgacgacagagtcatggcgaatttctttcccatggccctgaagggacaggcgcggggttggctaatgaacctgccacctgcgtcggtccactcttgggaggatttatgccaacagttcactatgaactttcaaggcacttatccgcgcccaggcgaagaagcggacttgcacgcggtacagcgaggggatgatgagtcacttcgctcgtacattcagcggttttgccaagtccgcaataccataccatgtatccctgcacacgcggtgatctacgcgttcagggggggtgtgcggcacaaccgcatgctcgaaaagatcgcttccaaagagccccagactactgcggagctttttcagctcgcggaccgagtggctcgtaaagaggaggcctggacctggaacccctccggttccggagtggcagcttcggccgcccccggatccgccgctcagacagggcggcgtgacaggaggaggaagaagaggtcagcccataccgacgacgagggtcatgtcctcgccgtcgagggcgctccgcgggccacccgaaaggggaggccagcgagcgacaaaaagaaggaagccgacgctccctgacctcggctacttggaagagcgaaggcggcgcgcggcccttcgagccgcgcgctaccagcagagcctgcggcgctaccatcagcgccacgtccgggcccgatcactctgcgtcgacgacctcgtcctacgccgcgtccaaacgcgtgctggactgagcaaactctcaccaatgtgggagggtccgtatcgagtgatcggcgtcccccggccgggctccgttcggctggccacgggcgacggcacagagctgcctaacccgtggaacatcaaacaccttcgtcgcttctacccctagtgggggtcgggtgtcaggttttgggctcgggccaaccccgcacccccccgggcgtgcagggttggccgggggcttatcttttttctcttccgtatttcaataaaagcgttttcgatttcctaaaggctgtgtctgtgcttttgtttccttttgaagaatcttgacttgaaataggtcactcgtgttcaatcctgccctcgggggctcgggtcggctaaaatcgccaaacggggcccagaaccgagccgtgccccggggcgtggtgaactccgggggggaatcggcaaaaacccacaatcgggtcacccataaccctcggtcaccacgttcccggcctggccagtctcgacatgtggatctccccaggcactagccccgacccgagccatttgaggactaggacctgggcacgagcccttgatcaagccaagacacagaaggaccgcggcacagaccatcctcgtctcatacacacaacaaatagaattgacatagaaatttcctctttatttggttgcagattaaattagtctatacaagaaggggcccgaaggcctcggaagaagaaagaaaaagctattcaagattggcgggggcctgggggctcactccgacgcgcccgggtcaccagccttgtcgtcgttatcgtccgcaccaccgtcgccgccctcctcgtcggagtcgagggcgaacgcgagccgaggggccgtaccctcgaagctgtgaacgatgtggtcggcggcgtcccggacctgcgcgcgtgcgccgtcctcggttccgaaagggaactcttccagcgctgcccacggggagaagtcagggtccgagaggcccccaagccgaacggcggcccaaggcccccgacggccagagttggccctccgcctgcttgtccgacggtgtcaggcgcccccgaccctcaggatagcctcggggccactgcgggaaggccgcgcctgtcgccctcttaccccgaggatatcggcgcagaagccgagggcgccccgcgctgcctctcggatgaagagcgccctggagatgcggcccctagcgaagaggatcggccccgccgaaaggtgcagcggcccgtctactttgttagtgaggccctccgggacgccaaaacccgataccctcgggcccagaagatgctatacgctattctgatggctccgagaaaagcaccatcaccatatctccaggcgaagcaaatcggctcgcccagattcgtgcgctgctcaggtaatgtggcagtcttgaagagaccgcccattatggacagccaagtcaccattaccaatgtgcatggattgagaccgttgggtattttgcccaactacggagaccggtcccacctgtcaccaggctttaggggtggcgtcacacctgaccgcttcccttgggaagggaaattgctctggcataacgccgggggctactgtcggtgatatgggaccgggagtatcatgaccagaggcttgaggcagacgcaatcgcccacgtggcctggcaccttcggggacgtcgggcccgagggtgaggtgtccgccctcctcctgatttcccccgagggggggggtcgggttgcgcttgccccggccccgagggccgaggcaccccgaccccttaaggaagtctgcgccacatatatgggataagtgagcacagctgtgctcacctaacagcatttattgcagtctggtcaagcgtgtcacgctgcatgcaacgcagtacagcgcgttcctttatccggtctgtgaccagtcacagaccggtcagatcacgggttaggtggcggctggcggtctgacgcacgccttgccccatcccgtcaagacgaaagcctctaggcactcgtctcaagccggagctagggtgttatctcttagagatggcacgttagccctggtcagatttataccaggcttcatcctaaccattacaggcaagatgttgtgtgaagaagggcaaacatgcacgttgccaagattacacgcggtggacaagaatgaccgatttgtgaccggtctgacactgaccatatcgtcagcgcacagccatgttcccacgacgcgctcacccccggcggaagtggaggtaggtgtgggctgtcccatcggagcgtcattcggacagcaaccgtgctgatctccgcccattcaagagaaaaagaacagtccagtttggaaagagaagggtgcatgtggtatccccttgaagtataaaaggaggaccttgcccatagagagggggttgttggttgattctttcccagattatgagcttagaacgggggagaagtcagctcacacttgtagctcattcatacgcagatccaccaaaacacaggagtagggtattacgcttctcagcggcccgaacctgtatagatcgtcggtgtctcgtgttttctggctggcatacgatatttccacatacagagagagtgagagcttgagatttcaccctaagcccccggccgaactggcaaaggggggcctgcgcggtctcccggtgaggagccacgagctccgtcaacagcatatgactgaggtggtgccgtacgttgacgaacaccttgcagttatccgacaagagaacccaggccgatcagagagttgggtcaggaataagcacatgtcttctttcaacgagtggctgaagaaccgaattgccaggttgcagaacttgcctagtgaaacacttcagtggttgtcacagggtcctgaatggagtgccaccacctggcaaggatatgacataaatggatacacctttcacacggtcaagcaagacagcaaatgcacagtgcagaacagtgggttacgcatcgaggctgctagtgacggtggtcgtcgtgatcaatactatggtagagttgagcaaatattggagctagattacttgaagttcaaagtcccgttgtttcgttgtcgatgggtcgatcttcgcaatgtaaaagttgacaatgaagctttcaccactgtcaacttggctaacaacgcgtacaaggatgaaccgttcgttctcgccaaacaagttgttcaagtgttctacatagttgacccgtgtaacaagaaactacatgttgttcgtgaagggaaaaggagaattgttggattggacaatattgcagacgaggatgattacaaccagcacgtccatggcataggtcaagaaatacctctagaagaggaggaggaagaagatgaagttcaatatgcacgtgtcgaccatgaggaaggattatttttgtaatttatgtacgtagtttatgtctacatgtctgttatctgtatgattctaatatgttcggaatgatcaatagtatattgcttatgaaatagtcaaataaaataattaagtgaaacacccactagaagtgaaataaaataattaagcaagtattagcattggaaataatataattaaagtagtataataatgaagtgcaattactactgttagtgaaataaaataattaagtataaaaaaatatgtagtgtatgtgaaaatatgttaaggaaaataaaagaactaagtgaaataaaataaaataaaattgctctaggcaaactcacctgtgacgggctctatctgtagggccgtcacaggtgacctcacctgtgacggcccagagtgctgggcccgtcacaggtggtcttacctgtgacggctccacggttggcgcccgtcacaggtgacctcacctgtgacggccacatagttggagcccgtcacaggtgagtttgactagggttgacctagggttggacatcttctagatcgatccagatccggcgcccactctcactcactcactctctcgaccgccgcctcgcctctctcgacctctctgccgccctctacgccctcctctccaccgccgcctcgacctctccaccgacgccggcctgcaccaccgccgccgcactcactctctcgaccgccgccatccatctccaccgccatctccaccgtcgccgtctcgacctctccgccgccatctccgccgccatccagaccctcctcgccgccgccctctctgccgccatctccgccctctccgccgccctcgccgcctccttctccaccgccgcctcctcactcactctctcgaccgccgccgtcctctccaccgacatctccaccgtcgccgcctcaacctctcctctgccctctccgccgccatctccgctgccctctctgccgccatctctgccgtcctctccaccgccctctccgccgccgcctccaccgccgccctcgccgccggtcgtcctctccgccgtccgtccatcgacttccccgacctccccgaccctgatctccccgacgccgggatccccgaccaccgccgaccgcctcgacctcttcgccactgcctctccgccgccgccaccaggatccaggacgactacggcctgcgccgccgtctccaagtacgccgcttctccaagtatgccgccaccctcccccattcctccttttttccgatggatgaattgcattgtttagatgaatgaaatgtgatttgttgtttcgattattggtgctgctgtatagatgaattaaatgtgatttgttgtctgtggatgttttggatgaatgtaggggctagattttatatacatgattttggtgcagtgaatcttagcatcaatagaggatcttagcatgaatttttaatgcattttgttttctataattctttgataattaaggacctttattaggtgtaggtttgaaatctagttacaagggaagaattgatagattggccg

SEQ ID NO: 47656 - DNA, 6174 bp, Oryza sativa
aaattctccatgcattttgttttctgtcataatttgatgattaaggaggctttgcagattatctaaacttgttgatttatataccctttttgtctatgaataggtcaattgtatgaattgttgtttatatacatgatttatatacccttgctgctgctgccacaatattgtgggctgttttattatctagacttgcttgaattgaatggatgaattgctgtttacatgaagttagtagtactgtctccttttttatctacacccctgctactgcccctacacttgttcacttgttccttattaaatggccagtgtagagtagttatatacctctacacttgttctttttttatgcataagaacagattttgtgcacttgctctttttttatgcataagaacagattttctgcacttgctcttttcttctggattgataaatggccagtgatgaattgctcaataagaacagattatctacacttgatcatttttttatctattcttctttttgcccctgttgtggctcaataagtaatgaattgctcaataagaatagtttatctgtacccttattgtgggctgttttttaaatttgcatgattgactcagtggttatatacctctacacttgttctttatggataagaacagagtatctacacttgttctttttttatgcataagaacagatttgctcttttgatgttatgatttcctctttttatcccttcatgcaaatgaatataattgatgcatatttctgagcaaaactgaggccatatctttcatagtataccccgtattacatgattttggtgcagtgaatcttgaatgtggatttaagtgcaactgctgctgtctatgtttgcccttgctgtctatgtttgcccatgctgctgcctatggttgcaactgttagttaagtgcaacttgaatgtggttttaagtgccatttggacatataaccattcatggagtgtgtactgctatatatgttgctagacctattgaattttgtggacttgcatttatactcctcctgctgctgttttatgtcaatcatgcaaattctgtacccttgctgctgctgttttttaaattttcatgattgatttagtggttatatacctctacacttgttctttttttatgcataagaacagattttgtgcactctctctttttttatgcataagaacagattttctgcacttgttcatttttttatctacaataatatatgcatgatttatataccactgctgttgttgcccctgtacttcttgttaaatggccaaggatgaattgcttaataacattctatctatacctgttcttttctttatggataagaacagattatctacacttgttgatttatatacccttgctgtctatgtgaatttccctctgctgttgctgtttatgtgaatttccaccctgctgttgctgtttatgtgaatttccaccctgctgttgctgtttcctactctaatttcctgcacttgctcttttccttatggataagaaaagatgaactacacttgttctattttattgataagaacagatgaactacacttgttctattttattttctatttcctcttttttctgcacttgctcttttcttctggattgataagaggagtatatctagacatgttgttttagttaatttgcccctgctgttgctacccctgtggcatatatactcctcctgctgctgttttatgtcaatcatgcaaattatgtacccttgctgctgctgttttttaaatttgcatgattgattcagtggttatatacctctacacttgttctttttttatgcataagaacagatttcctgcacttgctcttttccttatgattttctctttttatcccttcatgcaaatgattgtaattgatgcatatttctcagcaaaactgaggccatatctttcatagtataccccgtattacattggatctaatgctatttagtctaatggtaggaaatttataatctttttcgcgaaagttaaaccatgtcaacgcccggcgcaaacccgccctccccaacacctgcgaggatccaggaagaagcaaacccagccacagaggcagttgccgaaggtcatcccgcgacaacggcggtccaacaacccgaaattcatggtaatttataggataaattttcaccacatgaccacataaattttagctagcaccccttagcaaatattgccttctgtttgtgctgcagaattgccgcaggaacaacatacgtcgatgtcgggcgagacaagtgcaagtaggtctagtagaaatccgcggtcacaaaatatatggccgaccacagtgcaagttataagagaggttgacgctagtggtaggcccacggcgcccaggactgtcattggaagatggtctaactgctgcgggatagcggcacgtgagaacttcgggatcctccataaagatatcgggaaggtcacagaagccgagaaagagcgagcttggacggcaatggagaaatggttcacatttccagccgaagcaaaggataggctcaagcggaaggcattacaaaagatgggcaaagcttggaagaattggaagtcgaagctcttcaccgagtatgtcaacccgcccggcaatcatacgccgttcgatgaataccctcaaataaccgaagcggtgtgggaggaattctgctctctcaagaccacccaagagtttagggaatccagcgaggcacatcgcgtactgcaacagcggaatgagcacccgcatcggctgggcaccgcagggtacatcggcaaggaggcaatatgggcccaagaagatgcagccgctgcagcagcgaatgtacctgccccgttttcagacatccctgaacaaagagctcgcaactgggcgcgggcaaggggtaaggtcaacccggacggctctgtcacattgagaacaaaagtgatgccgtcgtctatcaggaactggtgagttcactacttaacctaactaatttccgttcgtataaagtacaagttcgtataaacgactatcttcttttctagttaggcttggttgctgaacaagcttcacaaagcgaggttgagtccgcgccgaagaggcgcgaagatgacatcctcacaaaggcgctcggaaccaaagaacatcctggccgaactcggggaattggtagcgatgtgccctggaagcatggactccctcagtacagctcccaatacaggaaacggaaagtctccaaggaagagagggacgctcgtttgaaggccgaacttaaggttgaggtcattcaagaactagaagctagcatgaatgcaagggtggaagaaagggttaacaaggtgctcgccgacatgaatataccccgagtcacaacacctgctgtgcaaccaactcctcgtatacaacacgacgcgagtccgtcacagcataggagtagttgtgcatccacagaggtgccggcccctggtctcccgatcgcaccactagctgcagtggaccacatcgaggtaattattgttatccgatccatatctaataaaagacatttacacattccaatattaaattcaaactttcaccttatgcagggcgcagcacagtgtgtcctactagcgagagtccacccaactttcgctcctgaagtcgctgagggcatggctttcaagccctcggttacagacaaggtccacggcgcagacctgctagctgggtatgccaaggtgtccatcgatacagtaaaggacacctggtcaggctatccgctgcccgtgcccccaaatgatgaaatcatgactttgggcgatgcgcgcaagacattcatacaatggcccaaagaatacatagttgtgaagatgactcctcgtccaagtcgaccgacggagcttacacctcccaagtctaagctatcaattgaggctccccgtggactggcattgtcagtacctcattctcccggtggagctgatatggacttggcagatatagctcaaagcttggctccaataaagaccacaagaaaggccgatagctccccaccacttgtcaagggccagaagcgtgaacgaggcaaggggaaggtcggggagttggcgccggagccaaaaaggggcaaggctgcgacgtcgatgccggtaagcaaatcggggaaggtcgtgagggcgccagcccaatttgagctaggcatgccattggtggaggacaatgtgttagctgtgatgggtattgcttgccgagagctacataagcaatacatggagctaagcaatgccaagcggaaaatgagggagtcatccatagttggacatcacgaccaccagccgttcctatcgtcgcctgcctatataactataggctttgatgacctcttcgaccttttcaggatccggaagttggacactggtcttctaaaatgctactccttgtaagtgcataccttctatacttgtgatatgactggactatatctcctaattaaattagttctaatacgtaaatattttaaggttgtgttggatcgagagtcgtcgccatggtaatcaggttgggttccttgatccatccatggtgaatgaggttaatttacaacagagctccactgaggtggttgactatgtcaaccggtgtttatgggcccatcaagacaaggagtacatcatgtgcgcacacaaccaagagtaagaggacaatacccttcgtgtatattgtttttgaagttaaggttcttagtactaacgctacataaccactgcgcaggcgacattggattctcctagtcatcgtacctaagtggagtagggttacctaccttaactccaataagtccaaagattatgatttcagtgaaatcaccaaggccttaaatatggcttggggtccatatgtggaaaagggtggtaggcacaaggagggcaagaatgaactttatcatgacaccaagtttgcatgcgcacaacagatcggagaccaatgtggtttccacgtgtgccacaacatgtcaacacttctaagagaggtgaaagatttcgaccctgaggttgttgctaatggcgaataagctcatttcaatatctacattgctattcaaaacgtgctaattaacctcttatttattaaacagaaaggtagagctggcttcaagatctcacccatcaacccccccgctatcagaggcgaattgcgcgcctttattcttgcagaaataatgaacaagaaaggacgttttcatgccaaatagactcatgaacttggctagataatttattgtgatgtaaaaaagatgtttttataatttctggcgatgtaaaaaattatgtttttatagagtgcaatgtaatttactttcatatgtgcaatatttatggtactttactaaattgtcatcacatttgatcaactacgatttatgttgtactattcatctgttttctcctttttttttcccttattgacaggttgtggaggttcacaacgaacagaatacaagaaattttggtaatcatttgaggactttcatggggtatgaattgtgtgctataataaattaaattgttgcatatgtgatgttgtaaattgttgctttgtgatggatctgtgatatgtgatgcatctgtgatgttgggcagttggggaatatgtgatatggagggggggtgactggcacctgtgatgtttctgtgtttcagagggcatggctagcaattcctgaggctagccaatatttagcatttattttttttctggaattaactcatcagtgacggttcggaagaaacatccgtcacaggtaacttcacctgtgacggactcgcaaacgtcggaccgtcacaggtgacgcacccggtgccggctgttactttcgggccgctggcatgtggtttaccgcgtaacggttccgatataccggggatatcacctctgacgggcctttatttaggggctcgtcagagatgagacacctgtgacgggtcctaacaagccctagtctagcttagaccaacacctctgacggccttctattaacttgcccgtcagaggtggatgtaccactgacggccggccacccgtcaaaggtgactggacttaccagtgaccactgatcactgaccaagcccaaaaccgtcaaaggtgagggtttgggcccgtcacaggtgacctt

SEQ ID NO: 47657 - DNA, 10303 bp, Oryza sativa
  unsure (1)..(10303): unsure at all n locations
cgtaccccaacggtctcgcgctcagcgccgatcggagtcacctcgtggtggcgctgacggggccatgcaagctggtgaggcactggatcgagggccccaaggccggtacgtcggagccgttcgccgagctgccgggctacccggacaacgtgaggcccgatgggaagggaggctactgggtggcgctgcaccgcgagaagaccgagacgccgtatggctcggacacccacctcctcgccgtaaggatcggtcgcaaggggaagatcttgcaggagttgagggggccgaagaacgtcaggccaacggaggtgattgagagaagcggcggcaagctttacctgggttcagttgaattaggtcatgtcgccgttgttaaggctacttgattagtttatatagttgcttttgttcagagtgtttattttgttttagatgtaagtattcaatttcggccgaactaccaatgtaataaatttgcacttcatctggatctcctgggaatataggagtatgttgtatattttgatttcatatagaactctagctacggatagtcacactttgctgtgcttgtttaagaatcatgatattaggacgtgggcgtttttttatagtacattgaaatgctcgtatattcgtatgaccgtgaattgttaggtttanatttctttcagtaatataagataacttctggctagaataagtactacttgtgatttatgtttcttgtaatgtagcgtacatcttagtgtaaaatcatacattagtagatctatatactagttctacaacctacgtcccaaataacttaatattttacccatctcacacataccaataatgatctctactattataaaaattgaagatgtttttaccgatattttggtacgtcatccgtgtattagtcggtttttaggttcgtttgcttttggaaatacatatccgtatttgagtcggtttttaacatcgttcacttttggtaatacaggtggaatcatataagaaatttgtttaaaaaaactcgcatgctaacttgagacgatcgaactcctaactgcagctcatgattatctaaaaatatatatatccaagcgaactccccgcagtgaatttcatcctaactaaaccatataacaataataagattaaaatagacttcacccgttgtaacacactagcattttttttctagtaataataataaaagaaatactcctaatctatcaaatcccaatgcaactattcctctttttatctactcctaatacaattattttttacttttataaactctgatataatgattcctccaaaaataaacttatttagggacaaaatggactgagctaaaaataaacttaatatgagacggaggaagtagttaacacttactaataatcatttaattgagaagaatataattaggctaatcttgtgataatgaccatataaacatacacatacacactcctattactatgagcacttccaagggacaatcgcacaccacatacctataaacacctcttgcttgacgagtaagttgctatcataaaagaacaattagaaataactacgagcacctatgctaagtttagaacatagggtaatgttgggagaacttttggaacgctcagcttttcttaaaatgaaaagctcctctaattaaacaatttagctttttattttgatttaaaaactataatagtagaattaaaaaaataaactagtaaccacaagtttatattctcactagctgaaatcacatgggctgtttgcctgtttctcatcatctgcctccccccaacccccccaaaaaaaaaataaatctaggggttatggtgcaccaaacaaattaaatgtaggagttatgatcaattcgcttgttgcacgagtaatgctggtatgcttagagtttatcacataagtgttctattctgacttgcatcctatttcgtcattgtaattttttgataggtgaatactctcaggtttcagcatcatagcttgttttgctgctacagctcatgcaatgattttaatgagttcagaatcggtacatgaattcacatgttttttttatgttttacccaaacgaaacggcatttatcgggggaagtatcagtactataaaaaacaatttggccgatacatacgttttatttatttttcaggtggacttaaaatattacttcttgttatcacttgtataaatagcgggaagcccgtagatttaaccccgcctctaaaaatcgatttttatgggcgggttaaaaagaccggcatacaaaatatgggggcactattaaatttgacacatagagagccaaagttttccatctctccttctcccttggctctctcaccacctactccacctccttcccacccgagcgagcagactctcccccatccccatctcctcccccaagtcctccctctcctggccttcctcctccgtacctacctatcacagccaacgctccgctcctgcccactgccgtcatcgaccacgcccgtagttggtgggccttaggagtcaaagggacatcaattgggcctgcaacgatgaccgtgaccaccaccacaacgacaatagtgatgacgactgtgaccacgatcgtgatgacagcgatgtgacctccacagcttgaatccgccgtcaccggcctcaggagcatcaggtttgcaaccatagggccttgggaatctagatccaccgccgccgagcttgacgcaggtggatctgccgtctttgggcctcgagcatgcagattcgccaccacaaggcctcgagaagctctcactcgtcgtcgtggaaagctctcggccatcctcattccgtggccgttgacatcatcgcggctggcctccgcatccttaccgacatcgatgatggtgcgctacttcgatttcttaccttagagactggctgaagaagcaggcactactacagaaagggccataggtgccggttgggaatcggctataggtgccggtttcccaaccgacacctattggtcggcaccaatagtagcaaccggcacctatgaagaaaataaaaccgacacctttagctttgctcaagccaaaaaaaaaaaagggaccggctcagctcgaattgagccaaactcaactgagcactgttactgcgtcatcgcccgagttgctccgaaatcaatttaaaatccccaaatccccaaatcatccacaaatcgctaccaaaatcaattgacatcacagaatgaacatactctaatccacaaatcgaccaaaacatctaaaataaatctacaagagacgagggaggagagccctcttcatgctccaccatccgcttcgtcgctggcgagcccctcttctgtcgccactcgttgcctcccctcccgccagatccggcggaggggagggtgccgccgccgcccgccgcctcccctctcgccagatccggtggaggggagagcgccgcctcccctcccgccggatcccgcggaggggagggtgctgcagccacccgtcggcgaggtgcgccgccgccgcccgtcacccgccgcctcccctcttgcgccgctgatccctcttccgagctgccgccgcgcgcgtgcgagagagagagagagagacggtgagagagatcgagagaaaggatagataaccgataaggataataaataaagggaggccaacgcttatagataaggccgacactatcggctcagtctcaataggtgcctttttaaaaaaaaaacgacacctataatatattaaatgtgctggttttttttaaaaaaatcgatatctataataaccggcacctatggttacttaaaggtgtcggttttaattgttccggcacctatattgccgatccgtatgagcttttttgtgctagtgaggagaggatgccgacgtagggatgccgatgctgatatcctcggctgaattttttttgtgaatttgacaaatcagtttcgaatttcaaatggtgaaattgcattatgaattttgcgaatcgggcgttatttggatctggactttgttttcttgcgccaaaaattgtttttaagtcacttaattatgcgctgatggggctcttagggtggcggcaaacaaaaatcatcgattttcacggaccttaaataacaagcaaagcgtttggtcacatgcaaaattatgttttgtcgtagtgagtgatacagtagtagagtcgtgggtgcacgactccatccaccgtgcggagttgaaaatcccaatgcccacgagtattacagactcatagatgctaattgttaggatgcatgagcatacgtgggtgttacacatgtagtggcgtgtgagtctaccatgtattccgaaagaaaacaatatttaccaaaaaatatttatttttgttttacatgttttcttgttgcacacaaaatacgggcgtaaaggttttgcgcgcgtataaaatttccacgatcccaggaaggcccttggagcacagaaaaaatacgggtgcggaagtttggcgagtgtataatgtttccaggtccaagcaagcacttatgtcggctgaatttacgtggatgagctaattaggtccaggatattaaacgggttgattacgtcacccccataaaaatgccgattccgaatccgcagattaatggtctaattacgtcgaccgcattaatcttgctaactccgagtcggccggcttcagtgttcagttccatgacccaatcggaatcggcgtccgaaactggacgtgatctgcagtggccacggctataaaggaacacaccctcgcagacgcagcaccaatgcaagaagcaaagaacatctgagatcagaagaactcgtgaaagcaaagaagacaatttcgatagtgagacgaagcaaagcaaggcgacgactttcattcatgggcgccgtcctcggcaccgggagggtggggactctgactcgggtggcgctgacgatcgtcgtcttcctgctgctcctgccatcgcacgccctcgccgcggccgtcgcgaaggacacctccgccacactggtcgagacgctgccgctgcccacgacgctggtcggcccggagagcgtcgcgttcgacaagttcggcgatggcccctacagcggcgtctccgacggccgcatcctccgttgggacggcgccgacgaaggttggacgacgtactcccactccccggggtacaacgtcgccaagtgcatggctcccaagctccatcccgccgagctcaccgagagcaagtgcggccggccgctcggcctccggttccacaacacctccggtaacctctacatcgccgacgcgtacaagggcctcatgcgtgtcggcccgcgcggcggggaggcaacggtgctcgccacggaggccgacggcgtgccgttcaagttcaccaatggtgtcgacgtcaaccaggtcaccggcgaggtctacttcaccgacagcagcacgcgcttccagcgatcccagcacgagatggtcacggccaccggcgactccacgggccgcctgatgaagtacgacgcgacgacgggctacctcgacgtgctccagtccggaatgacgtaccccaacggcctcgcccttagcgccgatcggagtcacctcgtggtggcgcttacggggccgtgcaagctggtgaggcactggatcgatggccccaaggccggtacgtcggagccattcgccgagctgccgggctacccggacaacgtgaggcccgacgggaagggaggctactgggtggcgctgcaccgtgagaagacggagtcgccgtacggctcggacacccacctcctcgccgtgaggatcggtcgcaaggggaagatcttgcaggagttgagggggccgaagaacgtcaggccaacggaggtgattgagagaggcggcggcaagctttacttgggttcagttgtgtggagattatgggtaccccatacccacacggcatagttatccgactagttataggggataacttatatatatggaatatgtataagatcatgacttgggtattacgtttccttatatattacggaacagcctaaagtcctggtttgataatattgtaaagtagatttaggaaaccgataccgtattggttaaggtttctatcttgtaatcctgccccccaccctatataaggtgggcaggaggccctctagggggcatgacacaacctgatcgtcagatctatactacacccggcggattcaaatccccaaacaggagtagggtattacctctcattgagagggcctgaacctgtctaaatcctttgtctctgcatccatccactttaggtctcgtacgctacccccttttattattgccgaattcatgtttcgacagttggcgcgccaggtaggggtgcgtcgagtttcctgacgacgagtgcgatggaatcaactttatgagtcgccggcttcgtcttcgcttcgggagctccttgattcctcaccgccgacgacttcatcaagacgaatcgccactgctgtcctccgcctgatcttgttcgcatcagcacgacgacaacgacggttcgatggatttgatggtcgtcctcgtccaccaccaagcctactggtccaatctacccaacgaggatgccatggtgttgcaagatggatctacaaacacgaagcatgtcaaaactgatctaatcggatgcaataggagatggctgtagccacgcggatgccttcctgccgtcctgcgtcgtgctaatggacaccaaagccgtcggggccgcgcacgctgctacgccgcccgcgactgcgacctccgcctcctccgctccgacgactgcgtcgcctccctccccgccgtcctcccggagtcgtggatctgttccctctgccgcttcaacgtcggcgaggaccgcccgattttctatggcttctacatctactgctagacctgcgcaggggactgtgcccgcgccatcatcgatcgctaccatggcgcacaaaacgtcgtcatcaacaaggctttgatcgaatggcaacatggccgacaaatgagacgatggcacgtcaccagcatggacaggactatgcaacaggaccatgcagcaacacgcatcctcctcaagccacccattaatcacctcgcattgatatttgtacatttatctttaattaattccttgctgccgctgatcagattaattctttgattgattacatgtgctaccgagacgccgtggtggtcaggatgtcgccgtgctgcagaatgtcgacttgatttgtccacgagttggcagctcattgctgccgggcctctacgcctgtgtggctggctacatccgctgacactgtcgaccccttcaacaagttcacgatcggctgcctccacgccgccgagtccgagtaccacaggagcttggcccggctacgtccaaggcatgcacactcgagcccggggggctccgccatgcggacccggctgcgcctcaccgttggtcgctgctgatgggcgtctacgacctcaccctcggcctgcctccgtcgccgccgactggtgtctccgtctacacggctggcctattatgccgccattgttgggcgtctacaatctcacccttggcctgcctccgtcgccgccgactggtgtcctcgcctatacggttggttggtcacaccaccgttcatgggcgtccacgtcttcaccgaccggctggacttcgccgccgccgactggtgtttccgcctgcacggccggcctattatgccgccattgtcgggcgtccacgacctcacccttggcctgcctccgtcgccgccgacaggtgttttcatcgctattgagatggactgcttcgttcccacatcggctacttctgctgtcaccaagggaatacgataaagctaagtcatcatttattttattctttatatgatatttttccttttcctctgcctcactacaccaattggccttccattgagtagtgagtcgggggctacagatgttatatcatatttttcataacatttatcttgattgcttgcgacataatctgagtacaaaagtacctatcgagttatggagttctatcttcctatgctttccgtttggtttgccaatggatggttgcctttgggtcgattcctagcacccgggggttcgttggatggaccgagtaacgcaaggtgctaagtattattcggaataaatcaaaagcatagagatgagataaatttattttctgctcttaataattgcaaaagtacctaagtagtaaattctgatccgtgaaactttgttccgtgatactactcatcctatatgtttgttctgcaggatccaaatccaaatatgcataaaagggattcatggctttaagcttatctcttacgctccaggaatggatcagtcagaacatcaccaccggctcgccgtcgtcgccgccgactggagtcttcacctatacggttggttggaaacaccaccgttgttgggcgtctacgtctttaccgactggccgcttcgtccaccgccgactggtgtcttcgcctatacggttggttggttacaccaccgttgttgggcgtctacgtcttcaccgaccggcttgccttcgtcgccgccgactggtgtctccgcctgcacggctggcctattatgccaccgttgttgggcgtctacgtcttcactgaccggccgcctcgtccgccgccgactggtgtttccgcctgcacggctggcctattatgccgccgttgttgggcgtctacgtcttcaccgaccggccgcctcgtccaccgccgactggtgtttccgcctgcatagctggcctgttatgacgccgactgatgctatcttcttcacggttggctacgtcgccgtcaccgctaatatgcgtcatcatcttcaccgaccggccgcctcgtccaccgccgactggtgtttccgcctgcatagctggcctgttatgacgccgactgatgctatcttcttcacggttggctacgtcgccgtcaccgctaatatgcgtcatcatcttcaacgcaagctgtctacgtctgccgccgactggcgcttttatcgtcacaattgcgcgtcttcactaccagtttgcttctgtcacttcatcacggcaatgcaactttgtcatcatggatttctacttggacatcttcaacacttattttcaatcaagcaatgactactcgacgataagaagctataattctcgactctatgttcagttgtttcccaactaaacaaagagtcgggggctacacaaatacatggctcaaaattcgacaagctttatgtcaaagatggagcaatcaattaatcagccaacgagtcaactccaggagtcattatcttcatctttacttcggagcagacaatctacttcaacaacatcaaatatttcggtttagacgagttggacaacagcatcaactctcctccaagtgaagcatctacaacagctataacattaatttgaaggattattgtcactgacatcatcaccagcacctttgcttcatcggccctgacatctccgctgttgctaatggatgattatgtcttcaccgacttattatttcaccttcacggttgacctactatgcaaatgctgatgagcgtctttgtcattatcattggttgctacactgctattgactggatcaccgacatcgttatcttcatcatgtcggttgcgtttgtcatcgtcaactattttcttcatcttcatgattgatggatttcgtcaccgcctttgatcttcattgttagttgatctgtctgtcgctgactggtttcttcgcctccatggctatgcgacttcagtaattttgattggtatcactatcttcactaccatcaatatttttgtcacctctgctgggcaatattatctctatattggtcgtcttgtctctatgccaactgcgtcagctaccatcaatagacaattgtgactacgacagaaggacaagctatatgctcagaggcttactagttcaaacacaagtattatgtctccaatttggacttgttccggatacatgcaacatgaatttatatcaaccgaatacttgcgccagtcgggattcaatttttatatctattttggagtatcccataagggataatcactcagatcacatggtctatatcacccgggagcatgttacatgcgtcatccttcaaagggtatcgaaggcatattttttggcctaggcctaatatgtctgcagcccatattttcaggtgtggcctgtcacgttcttttagggacttaggcactttttgcttaggccaaag

SEQ ID NO: 47658 - DNA, 821 bp, Oryza sativa
gccgccgactggtgtctccgcctgcacggctggcatattatgccacgcgttgttgggcgtctacgtcttcactgaccggccgcctcgtccgccgccgactggtgtttccgcctgcacggctggcctattatgccgccgttgttgggcgtctacgtcttcaccgaccggccgcctcgtcagccgccgactggtgtttccgcctgcacggctggcctattatgccaccgttgttgggcgtctacatcttcactgaccggccgcctcgtccgccgccgactggtgtctccgcctgcacggctggcctattatgccaccgttgttgggcgtctacgtcttcactgaccggccgcctcgtccgccgccgactggtgtttccgcctgcacggctggcctattatgccgccgttgttgggcgtctacgtcttcaccgaccggccgcctcgtcagccgccgactggtgtttccgcctgcacggctggcctattatgccaccgttgttgggcgtctacgtcttcactgaccggccgcctcgtccgccgccgactggtgtttccgcctgcacggctggcctattatgccgccgttgttgggcgtctatgtcttcaccgaccggccgcctcgtcagccgccgactggtgtttccgcctgcacggctggcctgttatgacgccgactgatgctatcttcttcacggttggctacgtcgccgtcaccgctaatatgcgtcatcatcttcaccgaccggccgcctcgtccaccgccgactggtgtttccgcctgcatagctggcctgttatgacgccgactgatgctatcttctt

SEQ ID NO: 47659 - DNA, 5475 bp, Oryza sativa
tgagtctagggctgtgtttagatccaaaatttggatccaaacttcagtccttttccatcacatcaacctgtcatacacacaacttttcagtcatatcatctttaatttcaaccaaaatccaaacttccccctcaactaaggttgcgtttagtttagcgaaaagtttggattttggttgaaattggagatgatatgacttaaaagttatgtgtgtattgatgtgatggaaaagaactgaagtttggatccaaactttgaatctagttgagggggaagtttgtattttggttgaaattgaagatgatatgactgaaaagttgtatatgtataataggttgatgtgatggaaaaagactgaagtttggatctaaacacagcctagatgcatttgatgcatctgctactgcactgcagctgcacagttggtaatctgtccttaacttgactggatgacaaggaatttcctcgtaataatatcgcttgcactgtaatcaatccatcgccatctcttcaacgacaagatatgagtaccatacgagctgagaagcctgagatagaggagctgatgtgacagcactcttgaaaggcagaaaaaaaaaagccagcagcatcctccccttttttgtgccatatttttcaaaaattaatgattctcactttctttagcagcgcaaacagatttagtaaagaatttataacttaaagtttgtactgacaaatattctgagtataataaataatttagtaaagtaaaatataaaaccttttcccactgttttggctacagttaattatatactataacacttattaaaggtaaaaaattatgagtaagacttttagatgtgtattacgatgaaaaggcatcaaaaattcaaaatcaaatttctttcttagcaaacaaaagtattctctttgctacttaaaataataagtagtactatactattactttaaaaccaataaaaaaaataaactacaatgaaaagcataaacaatccaatatcaatactgaaattaaggtttgacattcacttttttactgtgaccaagttgaaaagcaaacgccaattaaaatttttcggagcacattcgttccagaaaaagaaaagtttgcgctttgcagagcactcgagccagtaccactcctcccttttgttctccagcgtccaatccgcatcggcgacgacgtcatcggctaaccgatgggccccacgaagcggaactcaggattcaggaagtgggtgggggcccactgggcagctgctcgtcggggatccaagtcatccgtaacgcgtacggacgtggcaatccgagttgcacacgtggccttctagaagcccgagttccagcccccgttcacacctcaggcctggctgtcttccccaattctcccttttccttccccaattcttctggtcatctcatctggtcatatggggtctcgtttggttcacggaggcattgatgcgtgtgtgagtgtgagatgcggtcaagttaccagtttttgccgctcgtggttttgaaaaaaaaaaaaaactgcaaaatccgctgcatcagaaaacggcatttgagtgcatatgaattccaaattttgttctaaatttgaggagaattcgaaatttcgaaccaacggaggagaggagagagagagagagaggcatcgcattctctcgtcgaaatggagggccacccaggcaaagcaaagcaaaaatcaccctccctatcggcctatcgctcgcctcacgccctcaccctcttttgtcggcttccccgtggtgggtcccacctcccaccatccttactatcccccgcgcctcatcggacggtcgaggaagcgagcaccggcgacggccgtccgatcccgatccgacggacagcatcgccgttcaaaccccccatccacgtcaggtcaaaggcgcgaccgcgtacgtgtccctgggccgcgccgcgcgagtcacgcgtgccgtggcgctcccctcccctcccctcccctccccgcgcgccgcacgtgagagggcctctgcaccgtcggatcgcgatcggacggccccggatccgccgtcagtggcacgggcccacggcgtcacgacgcggcagcgctgaccgccgcggcgggggagacggggccgtgacggcgtcaggatcacggcgaggggaaggggagagagagagagagagagagagagagggggggggggtataaaatgcgtggcacctccggctcgggtataattatcgcagcacacgaaaagagaaccagagagagagagagagagagagagagagagagaggagtggaagtggatcggggcatcgctgcggcgtcggggctgtgcagatcggaggaggtgagagctctcgtcctcgtaccatccatctcatcggattccgtgctgccgtggttgctaattttggcttggtttgtcgaattctttttgggctttttttggggtgctttttttggttggtattacccggggtttgcttcttgagggtgaaggcggcgtctccgagcggtttccggtggaagtctagtggtttttcggcgaggagatgggtttcagttgggtgagctaggtttattggacgaatttgttggggatttctgttggtttgagccgattcgatcgcgtccgagagcattttgctgttggggacgagagggcgcctccattttcgggattactgagtttatcctgtgcaaattttgcaaaaaaaattctactaattttggtccgtttcataggtgaatcgtcgcttattgagtggttcgttaggttagctcttaactgcgccgcttgcatttgttgccggaatttattattatctactccacgggtaactcgagggcgtgaagtgaaagctaattatgtcgcccaaagttactgatccctttttttttttgttgaaactgagctagcttaatttgcctctgttggcttgtggagacatgatgcagtacaaccaagtagcagcaacagtttttgccctgtgaaacactggaaccatgatcccccttttttgtgtgtgtttgattaggacataacttacaaaattctatgtttcacctgattagtcaattggcttacctctcctcccgatgacaaatccatcaaagaaattttcttgctggggggtaaagtgccactggagaagaacaaatcgaggttgttctgtgacttggttgtgtagttttatatagtttttagcattgtcaaccaggctccaggatcccagaaatttcactcctttgcttactgcatagactatacaagttgccctcttgtttgagcgatgaaggcgacgttgattccacacggttgattggtcaaacctcttgttggcggaggtaccttcttcagaattcagaggggtgatagaccaatagtcaaacaactaggttggtcaatgatcaatcgtcttcatccaactagagaatcttatagcctgcttgtgagtagtcctaattgtgtattttggaaggatcaaagaacagtccacgtcaattgtcttcaaccaactagagaatgtttgagtctgcttatcttaattgcaagggaagtcgatgaatattttgatgggggatgtataactttttttccttatcttttctcctgttgtttgctctccaaacctcattgttaggctggttctcctcggtagtacttagaatagcttcatttctccagagcttgttgtcctctagttgtatgctatgtggctgagcttgacattctggctagattaattggagttatgtgggagtgattgggatatttcatagataatgttcttcttttggagttgcgagcacacggtatgtgatgcaatgatggacttaagtaagagaatcgctatcagtttgtcttgatctatgttaaataagattagaatgaagatctaatactctttagtctttaacagaatagtataacatggtagtgtgtaagatcataacgtgatgggattctagtcaattggcatgttgactctggaaggcgaactcttgtcatgttggttgtttgcaatctttcttcctatatgatggtacatgctggaaattttggatcttaagctttgacccactcatgaattcatgattgacgatcacttcttttggccgaaatgttcgattttgacttctgtggttctcctttaagcttgaggaaagaaggatagagtgatgacggggacaccttgacagagaaacattgcggtttatgcataactctagagagctactttacaaattgtgctctatttatagatgaatgccaagcagaaaattcactaaattgttttaagtttgttttgataaaataaaaaaaagtgctcgagtcatgaatgtttaattttggtatttaagaaatcacggatgctgttgccgagaattctttttaccttgttagcattaatttcatcatgatctgaagtagctctagcttaatttggtattctttgttagctaagacatgatatttcctcttttggtgcatatgcaaattcctatcttttccccctaaaatctgcaaatgtttaatcagatttttatatgccatctcaattaacatttatatactgttatggattcatctgggtaaacttttttagtcttatctcagtctggttgattcatcttgttccacatgtgacatgtcttgataatgtagtgacagacaagccatttatgctaatttcatacatcctcatgataaccgggctgcgtttgtgtgcaatgttggctgtctgtttgatgtgcttttctttctttctatgatttatatgtttgtaatttgcactgatagagcaaaatgttctgttctgcttgtttgtttttaccacctcccatggaataaatggtttatagtttccttcttttgctatgtacaggtcatgaacgactaatctccgttcatttattatggacttgcaccagttattaaagtacagattgactggcgctaacgttgtgtacgaaattcctacagagaacaacttgcaaaactctccctggcaagctaacccactgaagtacgagttcagcgattccccatacacccctctctcttcccaatttgagtgtgacaatttgtctgctcttaccaacactccagataaccagagctctacagaaaccatttcagcccaaccaatctccccattggaagcagacagctcatatagacaggcgggtattcttctccaggagaacattcaagtgggagctgatccgttgtatgctacatcaagacataatatgcaacacgccttacgggagattgagactgttctgatggcacctgatacagatgatgcaacaactagcaccaagcatgagtttgaggaaatcaagcctgctcagcttgtgaggcagcggtcgagaacatggagtcatgaatcacggcagccgttacctggagttggtcggtcacagtttgcatctggtggataccccacagcaagctatgaatt

SEQ ID NO: 47660 - DNA, 706 bp, Oryza sativa
cagtattattcggaataaatcaaaagcatagagatgagataaatttattttctgctcttaataattgcaaaagtacctaagtagtaaattctgatccgtgaaactttgttccgtgatactactcatcctatatgtttgttctgcaggatccaaatccaaatatgcataaaagggattcatggctttaagcttatctcttacgctccaggaatggatcagtcagaacatcaccaccggctcgccgtcgtcgccgccgactggagtcttcacctatacggttggttggaaacaccaccgttgttgggcgtctacgtctttaccgactggccgcttcgtccaccgccgactggtgtcttcgcctatacggttggttggttacaccaccgttgttgggcgtctacgtcttcaccgaccggcttgccttcgtcgccgccgactggtgtctccgcctgcacggctggcctattatgccaccgttgttgggcgtctacgtcttcactgaccggccgcctcgtccgccgccgactggtgtttccgcctgcacggctggcctattatgccgccgttgttgggcgtctacgtcttcaccgaccggccgcctcgtcagccgccgactggtgtttccgcctgcacggctggcctattatgccaccgttgttgggcgtctacatcttcactgaccggccgcctcgttcgccgccgactg

SEQ ID NO: 47661 - DNA, 709 bp, Oryza sativa
attatggcttaggctgattatatattgtggtcatttttcaggcggttggtaaatcctttatgagtttatttactcggattttataccacatatgccatatatttccaggtgtggtggaaccatgtgtcttctagggacttaagcacatctgttaaagcagtgtgcgcatggcgtatgcccaatactttggaaatttctttattcacaacatacaagcttttttatagctgttttgctatgtgaattttcaataatgtagccaactttaggttacactcatcatattttacaaagcagtcggtatatcactcggatcatgttattcagggatttacaccgcatatgctacatattaatatcaagtcgcttggttaactataattattgaagccactcggttggttggattatttattccttgactatatgcttggtttgttcacttaaccgcatagtcgagggctacacctattaggtgcatctagtcgatgcacctgactttatttttcagccctccacagtcttcagatttggtaaaagtactcgggagaccatggcaaagatgattgaagtactcggctttggagtaatctggttcgagagaagattatcttttcgactgtgaaggtctcaggggctactgtggagattatgggtaccccatacccacacggcatggttatccgactagttataggggataacttat

SEQ ID NO: 47662 - DNA, 13115 bp, Oryza sativa
taattttgatttttacatatgcttttacctttattttatccaagtttaaatatatttgtgtattttttatgaattgtaaatttatttcatgttttggatagaataatttattctttaaccttttgtattaaaataatatataatttttgaataagtagtaagcgagtgacaagaaccattggattttatccatgtttaaatattttttgcgtatagttttgtattttatttatgaattgtaaatgtatttcatgtttaggctagaataatttatcgtttaaacctttttttcttaaaagaagatataatttattttgaataagtagtaagggaatgacaagaaccattagattatcactaaatggatttttaaaaagaaaaattgtaaaagcttcaagcatttttttaaacacagaacaaatgcaagtgctcacagcgtgtgcacaccctacccttatgagcatatttgaaaggctgggtcggtatatattgagattggtaaactcatcactggtatctcgctgtcaatgggtatgttacctatcactgaaagaataattagccgtaaatacgagcacccgtgttaagtgtacgacttgagccgaagtgggttagttccatcataagaaacctaatcaattgagttacgctcaccttgcaaaagttgagtatcgagatcacactctattgcctaccggagatgtgtagtggaagtaccactagtcgagatggctgacgagcacgcatggaagtacggaaaaatagaaagtggttttcattaaaaaaacataaaactctttttcttcagacaaatttcataggaatataagtgcaacatcaatttaaatagacatatataagtttaactgtttaagaggagggcatgtggtctatataaatgttctacttactccatcttataacaaatcaacttacttacatgaatttagatataaatgtgaccagattcgtttaaaaaagttaatttgttttggagtggaggaagaagtaggtgatcagtatgtgtccacgtacatacacatatgtgccccacggccacattggcagctaattaaatgtaattatggcgaacgaccaggaagtagctaggaacagcaatatgcaaagctttgccctaggaagcagctagcctatctcaaaataaaaagggaagcagatagccgacgatgcatggcacggcacggagcatgatgtttgtagcgtgtatgggcgcccaccgattcatttcatctgtatcgtccgcacttgttggtcgttgccctcgtgataagcaactaacctagctcgtgataatgatgaatcacaccaccgtccaccccacacccacagtcacacgttcacgtgaataaatgaaaacacaaaacagaacatgtactatgctaaaactagtactaatctactactataccccacgtcccaaaatataataaattttaccccctccatttactttttgatagttatattttcaaatctaaaaaaaatatttttgataggtatattttaattcttaatgactttttcggatttaatgcgtgactctccattcttccacacaagattggctatatggacatcgagaaatgtaaatattaatgaatcgtttgtttacgagaaatgactagtagtatgtttaaatagatgataagtagaattacttatccttgatctgtgtgccaagatgaaatatgactattaaaaatagatggagtgagtagcatttaagatttatcacaaaatataagaactttttcattaacattttttccccaaccaatcacaatcttctaccattcaatttattcacctttcctcacttctaaaccaatcataatatttctctattaaattacaagggcatctttgaatcgcagggttgaaaaaacggtggaataagaaaaacacagaattctgacaggaattgaagtgtaaaacaaaggtttgcaaaacacaaaaatgagattgtaccgcataaaaaacgtaggaatcagatgaaaaagattgactcaaaggaaatctacacggaatgtgttattccatatgaatttcatcggatttgaaaaactacaatattttaaattaaatggtcaaatagaaaacaatttataggatttaaatcctatgaaatttctaaataaatcctttgatttcatggagccataactttttcttcgcacctatatatattttgttggacagagatagtactattagctcgttgatcgatgccgttatccatgcatcttactcctgttcatccgtcgtcacacccaactctttgtgtcccaccagatcgggtgtatcgatcgatctatccgtgtagaaggggccggatatgtactactctgatcctgtaatctacttgagtatagttcaacgcacatcgcctcgtgcggatcaaatctgtgggcatgatcgatcttatgggcaatttggcaccctccgaatcccctgttctacacgtatctggtatacatccatccaaggcatcaattttagcgcacgttcccagtttcgccagtgcggcgccaagttgccagttgccctcgtcaaatcgccgaaaggctgcccatccgccacgtcccgatccaattttatccaaacaccccatgatatccgagagtccacgagagcgaggcataggtgtcgcatctaattttatccacgtaagataaaagacgacatgcatattatattacatctacactatctttaacatactaacccaatgattttattttatttgtttgatcactatactctttcttttttaagtttgtatgtatgctacttctttcaatctactcatatgctctttccttacttctcttcgtcacctcatcatccaatccaatcactataaaaattgattttcctatatgagcccctggttagattccagacagtccataacagaccgcgtctggaaaaaaatcatcctcccatttttgcatacggacccttataaggaccgcacatgaaaatcgattttcgcgtgcgggcctctttaagggtccgcacgcaaaaataagactattttttgcatgtggacctcttaaaagactgcacgcgaaaatattcgcatgcggacatctttaagagcaccgcacgcgaaaatacgggcctcttaagggtccgcacgcaaaaataagactattttttttgcatgtggacctcttaaaagactgcatgcgaaaatattcgcatgcggacatctttaagagcaccgcacgcgaaaatactctccctcctcggtcaaattttcctctcaaccacttcaaaaatttctatattatcctcttcacctactcatccttatcctcatttcttctatctctctcgtcactcgtctctcacgggtggcggcgggctcggcgggcgacgggtgcggggcagccgagagcagcggctggcagcggcagcgtggcctcccatgcgggctgtggccaggaccagcggcgggtggcggcaaagcggcctcgcgcacgctccccggcagtggcgcccctcgcccgcctggacatggaggcagcgcccctctcccacccggatccggtagtgggcggtggcgacatgaccgggagcggcggagggctcggtagccgcccgcggcggccggtcgtggcggaaggcagcgacaccgacaacggcggacgacgacgacgacaacgacgaccacgaggagggcggtggctaggtttaaggtttggatttttttttttttttttgcgtgcgagtgatataagccacccgcacgcaaaaatcagattttcgcgtgcggatgcgtcaccggcatgaaaaaatcggatttttgcatacacttcggtgtagatgggcgggagatccgcacgcgaaaacccttttcgatcgcacggaaaaaatgttttcgtagtagtgaatgtagcacttttagagcaacacgtcaaacaatcttataatacgaatttcatgcaaaaactccaaagaagaattgtgccacgtggcaacaccggtttcacagaacggctcgatcctgcttgcgcgcgtgcagcgtgaaacgctcgtgtgcgtgcgtgcaacgattgtccagaaggtcgtccagaagtttctatcgatggagcaattaggtccatgggggcacagcagaggctatgtgatttctcgcgtagtcgtgttgcgccgtacagctattgcttcctcctaccaccggatattgaggattaaagaagtaatgatacatactttggttagggactaaaagaggattaacatgatgcaatcaaatcacccactaaaattactacgttgcaaacatccatccttttacagtgcttgtgtttccttattttgtatccgtgttcatgtgatttatattatttctttcgtgtgttttcctctaccgaaatcataggaccttttctctttggggcaattttattctttctcctactttaatgtttaatattgatgttgcccagtattttagggttttgtttttgcccatggttttttaaataaagataaattttgcccctacttttgatggacagattaacgatgttaaatctttagcgagaaggcattcaatacccttgctcatgttgcaaacttcccctgtttttatttatgattgagaatttgcctacatttagcacatgaaccttacaattttgataaacttttaccaatataataattttgataaaaatatcaacaaatgtattgcctacatgtgccaagctgtcatcgtcacctcctctcacgaactgccaccaccgttgttgcctcctcttctcaccaagctgccgctgcctcctccgcacgtcgagccgccaccaatatcatctccccgtgctaagctgccattgtcgcctcctcttctcatcgagccaccgccactcctattgacccgttgtcctcctccctgtcgcctccttgacacgtcgagcagccgcgccttctccctgcgctgagctacagcagccgccattgtcctcctccctaccacggcctcttgcgcaatgcctagccccctcctgcacgctgtaattgggttgggtggcctacacctggccgggtcgtccccgttgcctggccggcccacggacactgccatcactatttcacaacggggattcgggttcgggaagggaatagttgatgccaagtgcccaagcctggaggtacaccaagcggtacttgggtatttttaggggtaaaagggtcgatcaataatttaaaatatcgttatctctttctttctctaattctttaccgcattaagtccaatcccactcatttccgtcaaactcattcgtttaaaaaagggcaaaaaacaacaaccctaaaatatagggtaaaatcggtattggatatcaaagtaggggtacaaacaaaattgtccctttctcttttctccctcagtcaaatgcaacctatatatgtcttgtaagggctactttgaaacgaagattgtgggatgaataggaaaaacatagaattctgacaaaaaatcaagcacaaaacaaataattataaaacacataaaaatatatgaaatcatcatttgattggaccgtacgaaaaatgcaagaatttggatgatatagataaactcataagagtctttgcatgatattggacctcacgttaaaaatactccaaaacttatatgaatttgggcattccttagaaatttgataagattcaatagtattcaataatcctttggttcaaataatcatatagaaaaaaatattgtttctatacagaataaaagttcctatatttttctatatttttctttcaaataaaagggccctaattagttactccactaaagttgaatgagctgggttcactttaccatgcgtggcaaagccacgcggtttttctagtatagtacttattttgatgcgtcgtagccttgccaacgaatacacacgataggtcccattattttctaataacacgtggattctactttagttttcattagtatattttttaaactactaaacagtatgcttttatgaaaaatttctatagagaagatgctctaaagtatcaaataaattagttttttaagtttataataattaagagttaattaattatgtgataattataatacaattaattatgtgataattataatacctttctcattttcatcttgtacttactcgtgaatccgcgatcccaaagcggggcacggcagccatatctattaggtcacttccaatgagagttccggtgcgacgttagcaatttgaataatgtgctaaggattaatgaagtgagagataaaataaatttcatctgaatgaaattacgactatattgtttccaatataacttgtctttttttaatacacaaaagaattgtgcatatttgtactaagattttgaaagacgtaaaatgtttacaaaattatattcctgagagtgcccacacaaccaccacaccctgaggaaacacaaccacggccaagaacctcaaaaaacggtgcatccaataagattccaacactaaaaacacctccaacgcccagcccaaaaagatatgtttttcacctagaggattctattaaagaggggaaaggaggcacctcgacaacactctcaagagtgttgcggcgctcaaatgcatcatcattgctggtccaaagttgcactggcttttgtctggaacctgtttgcacctctcttatagcttgtctattgcatgtattgtccataaagacaacaaaattgaaatagttcattatggaagatattttgatcatcaattaaacacattcgccctgtttagagaacttagtattttttagcacaaggaaatagtcctttaataaaatatccctaagttgtttagatccaagagtattttgagagctatttggcctttaatacattttcccatggagagagggggagagaaaaaacacttttcagtgagccccacccgaaatagctctcattaatactcttgatggggatagttttttttaaatagccgtgaaatagcttaactgtttaaaacatgtgagctttttcaggactatttaagaaagaataaaaaataacccataaatccgaacagaatcattgttgctcatatatgatgccttgggaatggaccttatccaaattggaagcacgcaagcacctggctggctcctggctgtggttggctgggtcgatgtggaccaacgttgttcgcgtcgaaccgtgcgctgttccaaccgctgcgcatacgtggcggcccgagttcctaggtgggtccgcgtggcgcggcgtttgttggtgacgtgcgcgctcgcgtgtccgaccgtggagcggctggcagcgcgtgaggaagatgcagtatatgtgaagttgtgaacaggtgtgagcgcctgctaatttcaccgatgagccttttgaccgcggtcaaacaccgtcgtggtattgtgatgatactagtactatacgtgtggtaatgtggtcggcatcctgttaattttgaagtggtcggtactaggtcggtaatatggtcggctaacgcatacactaagtatatactacctccgtttgtttaataaataacgccgttaactttttcttacatagtcatatatttgaccattcgttttattcaaaatatttatgtaaatatattttcttttatcgtggtttgatttatcactaaatgaactttaagcatgactaatatttttaagatttgtgcaaaatttttgaataagacgaacggtcaaaggttgtaacaaaagttaacggcgccatgtattagaaaatggagggagtaatttagtttgtacaagtatatttgcttggaagtcatttcaatggaaagactaatccaacatgtaagtagctttttccttggaacgaatatatacaattaagcaacttgtaactgcagattagtagtattttttttatagtggtagcagtaataaagatttatgaagtctctaaagatactcatggtagcgagcaccatccgtacatgtgcggaccgtggacaagtaatgcaccatccgtacaactgacatggtactccctacgtaaaaaaaaaaggagataatgaatttggataaagagtagaccagattcgttatgaccccttataagttgatttttttttgacgggggagtacaccagaagtagcttcacggtaggctgcgttcgttcacgtaggctggaaactcattccctccgcacggaaaacggagcagtctattagcgtgtgattaattaagtattagctaaattttttcatggatcaatatgatcttttaaaacgactttgatatagaaaattttgacaaaaaacacactgtttagcagtttaaaaagtgtgcgcaagaaacacaagggagatgggttaggaaccctgtgcaaagaacacgacctaagggcccctttgatttgtaggaaaagtgtaggaaatttgaaggatttcaatcctatgaaaaaaattcctatgaaagcctttaaattcctatgaaaaacaaaggattgaatcctatactatcctttaaaattcctatggaatggctaaccctatagagattttggaggaaagttagcaagaggtccaacctcttgaaaaaattcctttgagtctatctctctcatccgattcctgcggttttcctgtggtccaatcaaacggtcattcctgtgtttttcctgtattttccaatcctctgttttacacctgtattcctgtcagaatcctacgtttttcctattcctccattttttccattcctgcgattcaaaggggcactaagtagtacttcttccgttctagaaaaaaaaatcaacttctagagtttgaattttatcttacaaaaaaccagtttctaccatcctactcctcagcacgtaaaacgagatgttttatcccttcaataccctttacctacctaccaacttctattttaataattctccacctatactaagggtctgtttggatcttccaaaatggtaaaagttttgtcattttgaagcactttttgccattttagatctaaacactagtagcaaaagttggcaatttggcatttggcatttgctagtccatggtagcaaattttgccaaaaagtgctccgggaccacaccctctctctttagtgctaaaatagcaaaattttaagatgcatataaacaccaattagtacttttgcaatgttaaatcttttgctaccaaaacttttgttatttgccatttgccatttcaaatggatctgaacatgccctaattccaccttaggatgctaggaatggatatttttgagacggagggagtatgttcaaatttattatacgaagaaatatcgtcacattttgggttgatttttcatgtaaagaaaggagtagttcttgctttggcctcgtcaacaaatttcacaggtcctctccgtctgctgagaacaagctattagagcaggtacaatagcaggctataagccagctgcaaacatattttaagaagataaatcaggagagaaaagagcagcgggctatagatttgtagccagctatagcacggaccccaagacgcagtgtgtctatgacaggtaggactaggtattaatagtgtagtacgtaactattgtatgaatgagttattagattggccatagatgaattggagctagtagttggctatactattgaacttgctcttagcagatcagatcagactgagcaaaagcagattagggggtgtttagatggggctaaaattttttagcccatgtcacatcggatgtttggacgctaatttagagtattaaacatggactaataaaaaaactaatttcataaataagagctaatccgcgagataaattttttaagcctaattaatccataattatcaaaagtttacggtagcatcacattgtcaaaatcatggcgtaattagactcaaaagattcgtctcgcgaattagtccaagcttatagaatggattttgtaattagtgtatatttaatactccaaattagtgtctaaatatccgatatgacagggatttagaataagtcgctggaaatcatacagccctgtcccaatgtcactgcacacgtgtgctggcaaatgtctggtcagtgtcagacacccacagaccaacgctcccgcgtctgttcggcccgcctaaccatgagcatcaattcagcccaaaagtgcgcctcgattcggcccaaacgttcggcccatatatgggcctgaattcggccgtatgggccaaatgtcagcccatccccgagttcccgacgagactcgtcatcctcgacctcgactccgccgaccgccgactccgagttcactctcaccgaggccgccgccgccgccgccgagccatggaacccggggtgggggggtgggggggtggcgcagctggtacgagagggagaggtggacgacggtggcggccggccttgatccggccggtggcagcgggaaaggggggagccggggaggtggcggcgtgctagatatggaaacacttcggagatggcgatggccgtcgaggcgcgcggattcagggtgggggtggtcgagctcaccggcggcaagggactcgccgggtggtcgaggtctccgatcatccgacgcggagagttgcttgggttttctgtttctccatggttggtaaataatagcaattccatcctggaattctcctcctcccattcccgagtttccgacgagacgctttggcaatggcggtggcgccagatcacgcgcccgtattcgtggcgctgccgccgcggattccgcgggatggacatggggaggaatttcccgggcttggacttgcctgtccttctcttttcctcccttgttcttggggtggggttggcggattggggaatcggcttcgagctgattggttttgactgcgccatccgatttcttcgcttttgtggaggggggcagcacggctgtgcatttcgttctcttgtcgtggatgcccccggaatttatccccaattctcgctatacttgctcgtctacatcggtgtgtttcttggagcatttcaagcacttctcgtcttcatcgatgcatttcttggagcatttcaagtgtccagcgtctaaatcgctcaggcgaatttggaggagcctttaggcgcattccgctcaaaatcaagtggaattgttgcatgaatcttcagattgttttggctggattgccaggtttcttcgatcatttttctctacggggctgaggaatttttcgccccatgcccggaaagctccaaaggggatgtttgccacaattttcagagtatctgtgttgagatgatcggtgtggtgtagaaggaagcacgcaaatgatgaggcattgtaggagagaatggctcctcgccctgtgcctcatctctgtgcagctcctcattccaacaggctgcgagggggttctcgtcgcggcaagcaacatgtcgccacctgctttgacaccactcctcatcaatcaagtagaccaattggtaagcacatttccatatattttgatgcatacgtaagcttcaatttgtgtgaaaataccatacaagagatggcagtagcagcttttgtaaggagatgtaggcatagtcgtgtttgcattcagtttcgaaccaagaattaggaccaagtcctttccaagtggatgtgggttgcaagacattaatcgggactcgggagtatgctctcaggagcacagaagcccatggcattccctcctatacttattacggtgtgtgtcgctaggcattaaacgggaatttgctctcaagagcacagaaacacatggcattcacctcctaacggcactgatgtttttgggtaatgcaggactcagggaatcaggattgattcatgaataggtccacatttacttatttgttgtgggacatgcagagtattcttgtactcttgtagtctcgtgtttcccaaattgcatgaaagacagacgaataaggttgctgaagtctgtaggtgattcccaaaggcaaccatgattttatttgtgttgtgtcttatagttttttttttttttttttttggctttggatgacagatcacataaggttaacctttctgtgaacagagttttgaatcattttcttcttgtgttttatggctgaggtagtctgtttgtttttttagaaaatggcagcctctacatccaaaccagtctgataggtgtgcaccattgcattgattgtgatggtgttgtgatttaaacactggcttaacagaatcaaactgttaaatttggcttgcctccttctctcccctccccctcctggcctcctctctcctttaacagcaggtgctagattcctccttgttatgacatgacaaatgaagactcggagagaggaatgtgactagtagtgaatataattattttcgatccaactagtagaacctaacattttgtggcatcaatggctgtttaattcctaactggtgaatgttgccttttgttggatatgactacaaatgttgggtatatccttttttttaaaagaaaaaacattcgtactgattagagtgactgttaattacatttcatacaggtagaacatgcatgggtcaagtgtggattggacaagagaactcttgaagatgttagacgccacttcaactacaaccatgtattggcaattctccgtagaatgtctgggcaagacattaaggacacctctcctgacattgatggagggaccagtgtattatcactagaaaggagggacgctatactgaactgtttaagcaagcagaatttcatgagtatcgctggacaggatggtttaaaaatcttgtccgctgattatatcaaagcacttattgcctcacttagaacagaccttgctcaggaatcttcaactacaaagtcaatacctgaacaagcaggaaaacctgtcccagggaaaacttctacaccaaaacctgtaaacaaaccaaccgacagtgtatcatctccaccagatcgttcatataaatcagctcctacagaaaaggaaaaccctcctactaaatcagtagcggaaaagaaaaaggacagcagtggcatgccaaatgctttcattggtttgt

SEQ ID NO: 47663 - DNA, 10963 bp, Oryza sativa
  unsure (1)..(10963): unsure at all n locations
aacttgtccggtataaaatcgcccactctgctgcaagataatgtaaaaatttcatctagtggtggtattaactctctcttttgcagctgcttttaaatcgtcccaaggaaatccaattgatgtcaataagcttggggtagtgtcgttgaaatcagaggctggtcaaaatggaaatgtgaaactaatttcgaaggaaggcacaaacaatgtgaatgtggtgcacccagtgagttctgtgtcagaatcaacattgatgccacctccggaaggcgcaaacaacgtgaatatggtgcacccggaaggcgcaaacaacatgaatgtggtgcacccggaaggcgcaaacaacgtgaatatggtgcacccggaaggcgcaaacaacgtgaatgtgaatatggtgcacccagtgggttctctgtcagaatcaacaccgatgcagcctcctgtgatgccacctccaattccgaagcttctttctccaccagcaccccaagctcccatgccaccattaaaggcttctcctgttcctcccccagaaccttcaccacctcctgctccaaaagctgcacctccaccgccaccaccaaaatctactggccctggcccacctcgcccgccaccgccagccatgcctggttcttcgaaaacacgcccaccgccacctcttaagccaggcgctaaggtgggtgctgttgaaaattctaatgaagctaaaacaaagctcaaaccattcttttgggataaagtaactgccaatcctgcacgatcgatggtgtgggaccaccttaaatcaggatcattccagtaagtcttcagattaaattgaagctgtgcctgaacttactattgcaagaacacactagtttaaagtatctgaactgtttcacaggtttaatgagcagttgatggaaaacctttttggttataattcaactgacaagagcagtgacaccaagaaagatttatcatcgaaagatgccactcaactcataaggatacttgaccccaaaaaggcgcagaacctagctatatcattgagggcgcttggtgtttcacctcaggaagtatgtagtgcagttaaggaaggtaaagttcatcctgtatggaactcgtcttttttattcttagcacacactcacagtgctttctagcttcatatttatcatacatacagtatctttgtaaaagttggagaactcagctatgatggaatgctgatgctctgaattattatcagacttctagtttactttgcttgcaataatgtatatggcatacattgtagatatgtgcctatttcaatttagttttcaaagtgacgagatgagggttgctctcttctgagctaagggtgacaagattaactttttttcaccaaagcgaattgtgcaaaagatatgataagtgaaatgattcatttcatctacttcaaccgctactattgagaaatgatttacaggattatactgcaaatagatgcatgttactagccattagaagttagattggtttctggtatacacaaatagtgcctccaaccattttgtttcaagaatttgatgttggatttcaccttaaccatttttcttgccaatttgtaggaagtgaacttccatctgatttgatacagaccttaataagatggtccccaagtaatgatgaggagctcaggcttcgattatacagtggggaactctttcaacttggtcctgcagagcaattcttaagagtaatcatagatattccttatattttccagcgcttagatgcattgcttttcatggccaatttaccagaagaagcttcaaatgtgaagcaatcctttgccactttggaggtaatgaaagattcattgtgaactctcaacttctagattatctcacattgttgtgccagttttgttcagttggcgatgtctagtattctattgatctaacatttccatgaagggttatatccaagtagttagttctgttacaataaatgcacttttactgcacagtttatgcctagcgatcggattcttaaaatatgagcctctgatcagttatgcttttaatgaattttgttccatattgattactattcttatctctgttggcatttcaatcccaatcaggtggcttgccaggagcttagaaacagccgtctttttatgaagttactagaagctgtcctcaaaaccggaaatcggatgaatgttggcactttccgtggtggagctcaggcttttagactcgacacgctcctcaagttgtctgatgtcaaaggaactgacggaaagacaacactattgcattttgttgttcaggaaatcattcgttccgaaggtgtccgtgctgaacgggctgcaaaggagcagaacagtggcgtttccagtgtgaagactgatgatctaggtgacaaaagtgagcaaactgaagacggttacaaacaactggggctgaaagttatctccagcttaggagatgaacttcaagatgttagaaaggcagctatcctagacgcggatcaattgactatgtcggtagcaagtcttggccacaagctcatgaaaaccaatgaattcttgaacatggacatgaaaagtttggacgaagacagtgggtttcaccgcaagcttacgcacttcgtacagcagtctcagactgatattactttcttgctggaggaagagaagaaaatgcggttattggttaaagacaccgtcgactatttccatggaagtgcaggaaaggatgagggcctccggttatttgtgatagtaagagatttccttgcaatgctggacaaggtgtgcaaggaggtgaaggaagcatcaaaagttgctccagtaaaagcaaaagccaaacagccctcccaatcattgcagtcattccgtgatccacgggttaatctttttccggcgattcaacacctgagggcagatagctctagctcaagttctgatgatgaaagttagatcaacatacctatgttttaccgtgcacactcagtgagaaaaattcatcaggaaatgataacgccaaaacaggttaaaactgaatcgatcttctatcgttgggttgttatctgttccgaccctgcattcttcacttttgaatttctgattctatcaagcaaaagagttgcacaaaactgaggctacacataattggaagggatgctatggaaagtaaaatttagcaggaaatggaaggaaactgacctcctagttctatgttagggcagggataaccggctgactgatagtctgacacttttttttcttttacacatttgtacaaccacagaaaggaagatgtatagacattagacagagatagaaaaagcaccacatgaactggcaaaacgggcaaatgtaacctttaaactgaaacatcatgtgttcctatcctgcgtgaactctcctgaaatgcttgttgcatggagaacaattttcaaaagaaaaggaaatatactaaatgtattcaatggtgaactgaatgaaactaatttgatgtcgtagatattgctacatttttatattaaaaaaggtcaagtttgactttagacaaaactcaacaaaattacttatgaaacggaggaagtacataatttcttttttgaatctataccaagtatgcatcattttgttggtcagacaataacccaattactctgacaagattttatttttcttccattcatctctcctgccgttaagccgtttctcctgcagctagttggtcaggcaatagcccagctaatggtcaggcaatagcccagctaagccgtttcttcacacgccaattttcatcttcccgccctggcactgtttcaaatcacaaaaatttcgccactgcccgcgcaaagctttaattttgtagaatctcctaaacctgcaccagatccaagaacagctatacactttgaacacgatgcaaagctttaactaaacataacaaattattcaggaacaccagccaagtcacaactttctatgccaggctccacatgctcgaataatgcatgttacattggaactcccaaaatcagatatacgaatttcacgaccgaagccagcatcaggctaaaaaacgaaaccacacatgaattatggccaagaacatttgccacgattcaaagacaacccgctcaaaatcaaattgaaaatttgagcaaccgaaagattttgagaaaatcatcaaagcaatgatacttaaatagatcatagcgacgatttagagagaagaacccgttcaaatcaaatcaaatcaaaaactggagcagcagttaacatttcaagaaaatcatcgaaaggatgatacttttatatagaacacaggtaacgaattacagagcaactaatccccctgtccatcatacacaagtgcaccttcttagttttagcatcggtacaagcacaattaagcatctaattcagatcctactagagatcaacgcaacacctaggcatcctagaacactactactactacacaacatatcatccatccatccactgcatccacatccaccgccgccgccatcgccgggaagcgtcagaatctagttgtcatcgtcgccggccgccgccttggcgctgccgccggccttcttggggaggagcaggttgtggatgttgggcatgacgcctccgctggcgattgtgaccgtgccgagcaggcgggatagctcctcgtcgttgcggacggcgagctggatgtggcggggcactatgcgggtcttcttgttgtccctcgccgcgttcccggcgagctcaagaacctacacagtagacacagattccaccgattagccccaaatcctcgctaattcgagcgaacaaagcgaaccaatccacgcaaacacacccgaattcgaatcttccgactaacccccaaatttcccccattggaaaccctaaaattctacccccaattctgtaaccgcgaaccccccgcccaaatttcaccgcgcaaaaaccaaaatcaagaaataggaggaacagaatcgaacatacctcagcggcgaggtactcgaggacggcggcgaggtagaccggggcgccggcgccgaccctctcggcgtacttgccggccttcaagaaccgggcgatcctgcccacggggaactggagcccggccttggagctccgcgacatggccttcttggcggcgcccgagccgatcgccttccctctcccggccatggctaaaccaaaccaaatcaaccaaccaaaccctccggtagtagtacggaatccgcgggcgaggcgacgaagcaacagcagcagaaaaatctgtggagaaagtgcggcgacgcagcgagcgagcgagcgagcaatcagtatacggcttggtaggttggaggtgggggtggggagcagaggggattatataggagggcgcggccaatgagacgcgagtacgcggatcggtgacgtggcgttggagggcgtgggggctggggatccatcctggccgtcggatcgggagagagccgtgcagcggttgggtttttggtttttttttttttttttttgccgcgcacagcgtttcgggcgccagcggtgggccccacccgcagggccgtatcgatcgtgggcccggattctcggcctgtgggctgcgggatccatggaaatgtaggagtattcgcccggaagtcaagttacgactagtttggaatttttcaaatatttcgtcgaaaactgtcgattttttgcaaagactgccttcttttagaatttgatttagtagtaaaataattttatttttcacccatcgcataaatcttaacgcaactataaatcactttatctatttctaatataattattttttactttgacaaactccaatacaataattatttaaagataaatttattttgagaagctaaaaatgaatatggaacggaggaagtataaaaacgaatctagaaccgaatgtaacatactaatattataaatctgaacatatgtatatttaaatttaaaatattaagatatgtcacatccgatattaattcgattttttatatgacgggggagtagtgcagtgctagcagacttgctctgctgttcatactcttcggccgtatcacgaccgaatggattggtaaagataccgtcagttcgtagccatcaatcagtccagaaccctagatgcgcgagtactaggtgacacgtggagcggggagggggcaagtgtcaagagcgtggtaatctgagccgtcggttcggtttactcgaccatgacgccagcagaggtggctcgtctccaagaaccacgaattcgcactaaacctgcagctagtggtaaacagtcaggatcaaacgagcgattgcactagtagtgtcaaccggcgactctgatccaggagtgaggagagagcacccggtgaaaattactccctccgtcccaaaataaatatagttttacacggttcatgttcaacttttgaccgttcgttttatttgaaattattttatgattagtatttttgttgttattagatgataaaacatgaatagtactttacgtgtgactaattttttttaatttttttataaatttttcaaataagataaatggtcaaacgtcggacacagttccccatgactacacttattttgggacggaggtagtacaaggattgcagcgaatggatacattgttgacaatgaacaatgaaaatccatcttcggtcagttcagtgagaaccgcataaatttcgttagttcatcgcctggaggactgaccaaattagtacaaaacaattgcgtatcgggaattcgagaccgagcaggcaaacacgataaattgtttctaatattacacaaacaaagcagtaatcttgcattgcgaaaacagtttgttcagcgcaacgcaacgagaatgcatcaacgaccaaaatgatgaggcagagacaaatagtggctcaaagtttcagtttgttcctcatttcttcaaccattaaacaaaccaacccaacatgatcatcagttcatcacaggcttacatctttagataaatacccacaaaaatttcgccgtattcacatcctgatcaggccaccaaaccaccaaccaagaacttctctctctctttttccccttcctactgctcagcgcaacaacacaatgcaaatccagacgaacagctagcaaaagatcctactaatgcagaaggcgcccgggcggcctagttgtcgtcgtcgtcgacggtggatgccttggatgacccggccttcttggggaggaggtgctggtggatgttgggcatcacgccgccgctggcgatggtggcgccgccgagcagcttggtcaactcctcgtcgttgcgcaccgcgagctggatgtggcgcggcacgatgcgggtcttcttgttgtccctcgccgcgttcccggcgagctcgagcacctgatgtcgaacaggagaagacccaacgagttagcaaaagagaacaatgcacagttctttctttcaatctacaagatgcgagcaattgaacccagcaaatgcaaatctagaatacccaaacatttgttccccgataacctcaaatccgtatggatttttttcaagcgaggcaaacctaatcgacgaaccaaactgaaacaaatctaacaacacccgaaataacatcgcctagatcggacgaacagaaaaaaatccccaaatcacaccgacgcatacctcagcggcgaggtactcgaggacggcggcgaggtagacgggggccccggcgccgacgcgctcggcgtacttcccggccttgaggaacctcgcgatcctgccaacggggaactgcagcccggccttggagctcctcgacgtcgccttcttcgcggcccccgcgccgatcgccttcccacgtcccgccatatcactcgccgacgagaggagaggagaggcgcacgcgctacacaaggaagaagaagaagaagccggcggcgagaaggggcagcggcagcggcggcggcgctaggtcaagaggcggcggcggcgtggattcgcgtggcgcgagaagactagggaagggaagagctgagatgctgggatatataggggtcgggggggttcggggcggcagccaatgggaggcgatcacgcggatcgcggacgtggaccgtcggatgcgtttggacggacggcggatgcgaggggggttttcgatccggaagcggcgggagtaggaggaggcggtttcgtttggatttttttgggagcgcgccaagtggaaattgacccccggatcggtgacgtggttctctcttgtgggtcccggcggtcagtctctctctcgtggtttgagttctttgttcctcgtgggttgaacacgggcttgggcctcttttttcttcttcgcggggttggttacttgggcctcgaggtaatttggggataagtccaatttacacccccgaacttttatgtttgtctaaattacaccccaaaactataaaaccgggtataatacaccctctaactatcaataccagctatttcatcccctggagcggttttaaagactggttttgatttaattggacgccacgccagcattgtctcaccaagtcaaagcaacgccagcatgcatctcactgtggagatgggcaaccgagcaaggaggaggccaggagggagtggcgacgaggaaaacgagcagcggaaggtcggaggcagccggcgtgctccctccctctgtccnngggcatcctccctcctccactccccacgagcccatccatggcgaggtgcatgcagcagcgcgggagaaactacgacgagcggcggcgcggcatcagatagggcagcgcgggagaagctgtgacgagcacgagacaagctgttggatcttgaactcgtgctcgccggcgacgaattcaccggtgctcgggagtgcggctacagagggggacctgggggaggggggaggggggatctggaggtcaccagttcttggaagggcgatgcagagggggagatcaagctcaccggcgctcgggggtgcggcaatagaggaggagctcaagctcaccaccggtcactcggggacgagagaaaggaaagaaagagctcaccgccggctgcactgtgtggggtaagagagaaggaggagaggaagagaggaggaagaagaagatgacgtggaattatttgacaggtgtcatcctacgatacgtcctcgtgtagcaaaaccacggtaaaacagcttgaggggataaaatgtccggtattgatagttagggggtgtattatatccggttttgtagttcgagggtttattttagacgaatataagaattcgggggtgtaaaatggacttatcccgtctgcaaagctagcctataaaaccgggggctcctagctagcgcgtgctcggctgctcgctgctatcgagcactcctcccatattaactacctctattaaaactattagttaatatacttaactacctttattagtatttagtaatgatagtaattaggaaagattgtggagatttttttactaacaaattgaaaaaattttaagttaaatttgaaaactttcgatttaaattttaaattagattaaaaaactttcgatttaaattttaaagtcaaattttgaaaactttcaacttaaatttgaaaactttcaacttagattcgaaaacttttaactcgagattcgaaactttcaagtccagatttgaaaaatttgaaaagtttcaatttgagatttgaaaactttcaactcgagatttgaaaactttcaactcgagattaaaaaactttcaagtccatatttgaaaattttgaaaacattcaactcgatatttgaaaactttcaagtccagatttgaaaactttcaagttcaaatttgaaaattttcaactcaaaatttaaaaactttcaaactcaaaacatgctaaagattacaaaaaataatcagaaaaaagtggaaaaaatgaaaaaaaatgggtaaagaaaaacgaaaaaaaaccgtgggagggggcgcgcaccggcgctgggccttatggcccggaaacgcgcgccgattagcgatcgcgtataaaagcacaaaataaattggatgtgagtatttataaatttttgaattcataatataataactataatagcaataataaagtcaaagtcatctttgagaagtgctggtttctctagaacttatgaggacgtggatttgttttcatggatgaagttacgaggttttttacttagatattcaacttgtttgtacatgatatcattgttctgttttaaattcattatataatgaatttatagtttgaataccttattaaaacagtttacctgatgtgatttatcctcacacccatataatagttttttcaggcgcctgatgtaacatgctcgcttgtgcgatgagagtatctacacttctacatgtcatgatcacactaaatatatggagtacatgtttatgatggggttatagttgagtttgttatcctagtgtattagtttaacactagatatgttcatcattattaaatgacttgtttgccaaagttttggttctccactacgaatcatacgtttccgttgcggaagttaccaaagaagttagagtctctttcaaccatttttctccttttcgctatcttgcttcttcccttgcagagacaaagtcgggtcttcacaaattcctcgtggcataccacaagcttgggtgctcgccgatgactcctatccatctaggaacctatatctctaagagtaacaaacacgatcgagtatttacatgctatgaactcaatggctcaaacaatacagtgaggctcgctagctctcaaccttacaacctctcaatccaacccttctcttttcttctcatatcactctcacaaagagctaacactaagataaggtatttgggagggctacaggctttggataggtcttctcttgcctgcccaagaacaacaaggggctgcaggaa

SEQ ID NO: 47664 - DNA, 6310 bp, Oryza sativa
ggccttctaggagtctccgggttgtcctccactcgccatacttttccggaagatcccaatatcgactcggaacctcctagttgagaaataaagccctataaaaaggtcataactacatcgactcgggtaacaatgatatgaataagcattaatccgaaggttcaaacatagatcggctggagatccgatgtcataaaatataaacgcttagataaacaatgaaacctttgttgcgatcggctaaaaccaacttgtatgtaatccttataagccaatgtaacatccagataactcatcggctgaaacctcgatgaaacccttattggcaatcaaaaagcaggctagatgttatggttctaagcatgaccaaggctgatgcagcgcaaagtatgaaaaaaaacataatatctagacaatcaagcccttgactgattttcagggtggtggataccttagctaatctaatctggtaaagcaatttagccgatactagcataaaccctaaaatgaatcttagctgatacaagtaaattgaattaccaaacaagattaactaagatataagatagataggtgcttacattgacaagatcagagtatcgaagccctagccccgccgatgcaaacatccttgacaagtataaaatcgtcaaaaaattataaaggtaaaatagggtggtaatgtgccgaatttgtattgattgtggagataaattacaatacccccaggtgtacatatttatacccatgggtagatacgagtccttattggacaagaaagaaactttactaaagataaaaggaaaacataaagtccttatcggacactaaacactctttcctaaagataaagaaaactaacaaactctttttaattaatagataaactgtcatgtcgcatcctccttgaactcggtctcttgtgtataaacttcctttaattgattaatttccttaaccgaatatagcaaaaatccgactattggcgacttgataattcccatcggccgattcgagtactctaaaaccgatattaactctaagccgatgatgacttcggggcttaccaaatttcactgttaacaaaaggttccagcggctactcaaaccccctctcctctcctagatccgacagtcgatggatctggggctaggcagtggatccaagggctcggggtggtagggttgccacatgcgatggaggcgggaaacttggtcacgggaggcgggcggtggatcggggcgatggctcggggggcacgggcggtggagctcagccatgggcggcggatttggagatttcttttgctcaaaaatcatttttttatggtggtcaacttaacctagccacttgtgaaaatgaaaatcatttttcacaagcggtgtagttccgcttgtgaagatggctgattttcacaggcctttagttgctgatggtagtgccaaccgttgtagaaaacgtaaactggccgccaggaaaaatctattttgtagtagtggaaaaatggtgcgaagatggtgtgaactttactaggaaagaggttaaaattgttagatattatgtttatgtactcaatacaacatcaagtcataatataactagcaaacaatagaacatatggtttgagaacctgatttccactctcggatataggaatgagtcaacggaccgtcataataactatgtgcttaaatgcgtaacaatatgaatacacgatttccataacataataacttagcaagacttaaaagtgcaacatgacattaacaagtccaaaacaagcatccaatcagcataagataacatacatcacatgatacttatcatgtccaaatatgatttccataaagtattgttgttaataagttacaaatgtaaaataacaacacataggaaatgttattggtctgtggcgacgactaccacactggtatgagttgagatgatgacagtcttagatcaaagagtctagattaaatgatgaattgagttgttcgatgtgccgactcatgttgcatagaacaaatagagtggttacatgagctgataactttggataattcaacgtttaatctatcggttaatccacgtctgcaaaattttatggataccacatccttatttgtatttgtagggtactaaatgataaggtgaagatagagaaattaccacctctcatacaagtggcaacccccataggcggatcttggggtggtcccgatagttctggaacaaaaaaaaaatcctagtccaatgcatatatatacacatatgtgaaaaaaataacttttgaaaaagaaaaaaaacttgtttttaatatattatgatgcaaatttgatccttcatatttagggtatttaaaacaaatatatatgttacctatataaaaaattagatacaccactggtaacccctacataaactccaataaaaatgtgatttgagagtgttagagttgttgggaattatgtgttagaggtaatctataatataatacatgtatactcagatcaaattagagatagtatccacctttactattggaattgctattatgcatgtatactcagatcagagtagcgactgtttgccagagtgtcactgaagaaaaagaaagaacacccacactaaagacaatgatataattcatcctccccaaagacaaaccgacggcttttttgcacgacgcatcaaactgtgtcgaccggaagcgatccatcatcctgaatgagaaaggtgaacaatcttaccgctcacattattgccttttgattttgtcgacgcaaacctttaagtaaccctgatagtactgaaaccaacctctgcatttcctacaagattttccttccactgcaagcacactgacgctagcttaccagtacattacatgcacattgatataattttacatgctctaatcactaataattagcatctaatcgttcccatcacctcacgcacatcaagcaaaaatcacaccacctacattcgtcttcatcccatttctgcaggagaaatggatgagaagcaacgaatcgatcaagggtggcggccgccctcctcccgcttggcggcgttggcggaggcgtagtagacgaggcagaagaggccgtggacgaagcagaggatgccgccgatggagaggaagtggtggcgcgggaggctgcacttggccgccttcctctcggcgttcggcagcgcccccaggatcagcagcgccaaccccaccaccagcacgatcctgatcgaattcgaatcaaacacacacacaaaaaccactcaaatctcacctcaaaatccgtaaacaatttgctcctgcacgagcatgcgagaatcttgtactaggtgcatgcaggagaaagaagaagaagaagagaaagaaggtggtgtactgtaccacgagatgacgagggcgaaggacgccatctgccggttgggcgtggcgcggcggtcgcgggagcacgcgcaggagcacccgccgacgacgttggcgatggcgtgcgacgccgccagaacggcggccgccgcgacgccgagctcgtaggcgcgccggaccggctgcctgcactcgatgaacagtatcctcagccgcctcccctgcaaatttaaacctctcgatgtgccataaaccctagtactttggatcctgcttcttgatgtgatgatgcacgaactgaagaacatcttgacgtacgtacctggtgctgggctttctccgcgtggatgccgaggacgccggcgacgacgtccatggcaatgatcaggaggcagaccaccacggcctccactctcgccatggccgttgattcgtcgagcaacttcgcttgcttcgatctcttgggacttggggaggaggtggcctgtcacggaggtgcaaagatgggcgatgtcggcacagttcactgcttttcaccttcatttattcggctattttgcttttgggggtgttatcccaccccaaaattttacactatgtctaatcgaacgtttgaatactagtatattgtatgaagtattaaatatatattaaaaataactaattacatactccctccgtcccaaaaaaaggcaaaccgcaggtttgcgtgccaacgtttgactgtccgtcttatatgaaatttttttataattagtattttcattgttgttagatgataaaacatgataaatactttatgtgtgacttatttttttaattttttataattttttcaaataagacggacggtcaaacattggacacggaaaccagggtttgtcttttttttgggacggaaggagtagatcgctattaatttgtgagacggatcttttaagcctaattgcttcatgatttaataatgtggtgctgtaataaatatttactaataatgaattaattagatttaataaattcatatcgcgttttactgacagagtttgtatttaatttttttattagtatcaaacgtctcatacaacaccctatatcaaaactctacgatcctgatttaaacaccctctgtacgtccttgttttttcttctttttctttactgcacacctcacgaggacgacaggaaaagctaccgatgcaggcaggcctgtggctctgtgcttgattgagcttatcaaggagaaaaaaaatggtttgtttaagtggcaagcgacagatgccatggcttggcaacatccagcgctttggcaagcttgcaaatctttttatcttccttttttcgctttggaaggcttgagctttacatgatttacgcgctaattgcattgagggtaacattgccgatataaagtcgcgaaatctaatttgggttaggcccctttgatacctaggataacctttctctttttttttccgcgggtgcttaggaaagaaaatgtagaaaaggaatcacatgacgacgcgaaattaagaagaaatttagagaaagttggtagtttaaaaaaaacttaagaatttatgtgagtaggaaagttttagtgtgatgtgatggaaagttgggagtctgagggaagtttggtgtgagagaacatagtaagttgacgtgtatgattacattaacccatttcacttccctctcttactacaccgggtcacaaataaataatattttggataccaatagagtcatcaagttagtactatcagaaccaaaatatagcaactcgtaaatttaaactgtataaaaaaatagcaatatagtattacttttaaatgtgacatttttttaccactaaatcaaccatactaccactttgctttattataggcgcaactagtttaggcctaaaccttacaaataggttgaatgttgtttggaaagtttttggattccgaatctatttttaaggcataaagcgctgatcattttttttgaaacttttataaaaataacgaatttatttttttcaaagaaacgaaaatgaatacggagataaaataggcaaaatagacttattccttacagtagggcctaaccatcaccaaaaggcctgaagcccgacggccaggcccacgacatagagatttggcccgtaccgaccattgggccgtgcctgggcctttttctcggcataatgtgctggcccagcacagcctaacccaacgatcacgatcagcgggccgtagactgtaagcggccggcccaaatagacgagagaggcataatatacttatggaaaaagtccacattaactcccttaattgtacgccgattctaattcgtacccctcaaccagaaaaccggatagaacgactcctcgaactattgaaaccggtgcaatttgactccctcagcggtattggagggcgtttttgctgacgtggcgctgttgacccggtcttcgtcccacgtggcgcttaagtggcattagaattaaaaatttttgtgggacccatctgtcattcacaaaaaaaatatatattgtggggcccacatgtcatcctctctctccaacctttcttcctcttcccttcctctctctctcccctttctctcccccttccccatctgcggccgaggaggccggagacgagagcggtggcggcgggcgggcgagggcgtagacaatgaggaaggcagataggaggttggcggcgacgcccgcggagacgacgaggaggcgatcggggacggggtggttgcgaaggaggtccaggttgtcgggcgcgaagccggagttcgggtcgtcatcggggaggtggcggcaaggaaatggcccgactcgtgacgaggacaatggtggcgaggacggaggcggtggaggcgacaaactcgacgctagcgaggaggtcggacggggcggcggagatgga

SEQ ID NO: 47665 - DNA, 6807 bp, Oryza sativa
  unsure (1)..(6807): unsure at all n locations
gcgccccacgcctgcgccggccgccgccaactcccccagccgctcccttgtgccttcctcgctgccgcggcctcctcgccccaccgcgtccccgcgtccccgacatgtcgtccccactgtcgatgcggccggcagctacggccgtccctccccccggcacgcgacatccctgcccgcgccgacagacgccgccttcccccagccgctccctcgtgccttcctcgccgccacggcctcctcgccccaccgcgcccccgcgtccccgatgccggcaccaccgtccccgcccttcaccggcactaccgtccgatggggaagagaaaaagggagagaaaagatagagaagggagagaaagggaggaggaagaagggttgaagagaaaggatgatacgtgggccccacaatatattgtgtgtgtgaatgacagatgggtcccacatatatttttttaattgtaatgctacttaagcgccacgtgggacaaagactgggtcagcgctgccacgtcagtaaaaccgccctccaaaaccgctggaggagtcaaattgcacttgtttcaatagttcggggagtcgtcatatccggttttttggttgaggggtacgaattagattcggcgcacaattaagggagtcaaagtggactgttcctatacttattccatccattaaggcccactctaaagaggtgagagaggtaatatagacttattagccacgtaggcacgacacaagaaagcgaggacaaaaaatggacttattcccaggacgagcatggtgggcctgtcgccggccccagtgttattggactctgtatgggccgtaggtgcagcccgtgggctgacacggcacggctcggcgtgtcggtcggcccgactgatatcttgccttggtcgtgcccagaccgggccgtgtatagcggcccatttgatcatctgtagcctgaagcccacattgccacggcccaataaatcgcgcgatgacgactcgaccaccggaaaccccctctccgcatcccacagccacaagcggcgccgcaccacttcgtcctcaaccaaaacctccgccgccgccgccgccggagaaggaggaggaggaggagtagggagagtaagcggggagaggaagatgtcgttccgtgcgcgggagatgtacaagaaggtggtgcggcgcgtgggcggcgaggggaagctgccggcggagctgatggcgtcggtgaagaacttgctgcctgacagcaaggtcgtcatggggagggccaagcgcggcatctacgccggacgccacatccagttcggcaacaaggtctccgaggacggtggcaacaagtaagccatctcgcccgtgcaaatcttcactactctactcgtcgtcggatctatgcgcgtagatactgtagggttgagttcgtggggtggaataaagctgtgtgatgcaacgaggtattccgaatccagatttggttggtttggattggagagaacacgattgcgaggacagtggttgagggtagtggtcaggagagaaaactgccctttgcactgtattggtttgattgcatgtctaattgatttgctcctagttactgacttagaaatggatgtgttgaggattaaattgggtttcatcctccattctggtttaccttagtagtttttaccaagattgatagagttattcatgtttgaaatgttcaaacctacacaatttgctagttattttttaatgatgtgcaaattgttagattaccaaaatagaataggtagcttgtttgcactcttttttgctagtgtaaatgcttgactagtatgttgcttacttgcttcatccattcactattgtacaatttggttctttgatcataatatttgaaacttcaactatcagtttcttttggaacgagggaaatgataatccacacaatcttgttaaatcccactgttcacttcctgaactgccaccaccatggcaaactgtcagaatggtttcatgagtcatgatcaacatgtgtaacctcaagacatgcaaagctgcttacttaacgattcctctaggcttgcaagttgcatcctttgatcaatgtagcacatctttaagtatctggagctgcattctggatctctttaagaagaaatgatttttttttcttactactgtaaatgtgtaattgtgcatttggcacacttaaaaatctccttgaaatttgtgtattcaagatacttccttttaaatttccatagttcatgagcctttcattaaaaaaatattgctcttgatttccccctaaacgtatttgtgtccgtggtagtttttgagcaatgtcttattttgttcaggtcaaggcgaacatggaagccaaatgttcaggagaagcgtctttttagctatattcacgaccggcacattagggtcaaggtaaccacccatgctcttcggtgcattgacaaagctggtgggatagacgaatacctcctgaagacaccttacaacaaaatggatactgagatgggggtagcctggaaggcaaagattgagaagatgtattcacagctagctcaaatggaggtaggcttcttctctcctgaggaagagactaagatcgaacagggttttgaggaggctcgagctgccaagagagagcaccgcagggaagcaagaagagctttggctaagcagactcagctagaagctggtaacgctggtggtgacaaaacagctgaagctgcttctaatgttgcagtgaagtcctagcttggacctatctgctcgtcatgattggtaaaatgtgatcatatatcctcattttcatgaatcggcatcacctgtgtgctatatgttgaaagtctatttatatggcaatgccactttttaataaatcaacttcttttggaaccttggtgatattgctaccgcaaagttctactttttacgcctgatgatttaaaatgcgatgtgtggatatggtaatttatctttagtttacatcattgatgatcaatgtgaaacctctttatgactccatagtccatattagtaaaaaccacagtatcattttcggcatcatctcatcaaaggtgttacctttctttgtgatatcaaatcagtgaaggataaaagtttgtatgcacaacaacttcccttgctaaataccatatactttttttgcattttggattgtactattacctgaatatactccctctgtccagtatttgttgtcatggagaacaataaaactactctctgttgataaatacaagtcatggtgtctccaacattaaactttaaccattattttcttttgaaatgtattgtcaacaactgtacaacttgtatgccaatgaacatatacaccctccattcctaaatacttgtcactgaatactattttagcaacaaacttgtatatattaaaaaacatactatgctattgaaaaatatgtttcatgctaaacataacaattcaattttcgtccataaaaatatgataatttagaagctatcaatggtcaaagatgaaacagcactagtccatatgtcaggtaaaagcacactagtcaatggtcaaagatgaagcagcatgttactaggccaatttttagtccaaaatcacagagtttgcacattttgagttcatgcttgtcttatattaatcaataggggataaaattagatttcaaacccactgtatgcatgcagggggccttttgtactccaaataactcgacatactcctcttgcaggtcaaaaggagaatcattgagtgccactgaccaaataatggaggattttcgtttcatataaagcagggatcatatgctgagtcagtaacccctgtttactggcagcagcagcagtgtatggtaagctggagtctaatactatcagcatgtgggtgttgtaagcagttgctgaacaaaatcagttaggtggaaattttgtacacttactgaatactcgtgtcagagttcagataactttcttgtagaattttgtatcttctactactgcccattcaacttaaacgtcgaaataatctatgcttgccaggatacgtggtaatgtgctacggagctatgccgtttttatgctgatttctgtttcgctgctatattttgttaccaattcaggctacaattcttacaaccaagaagaatgcttgacaagttacagatggcaacaccccaattaaattgttagtttggaccagcgatgtgcatatgcaagcgaatgctgctgggctagcatcgccccgatgaaattgtttctttggtttgacagtttttccttctctaaacttgtgatgtgaaatgatgcttctgaatatgaatgaattatgcgatgattttgttcagaacttttggatttctcccttgttttctgataatcgcgcctgcttggagatttagccgtcaacaacaactcaagattgaatcatacgtaagtgcttgctgatacaatatcaacatggagggtacattgccggttccatatgaacaaacataaaaacaccgaaaccccatatggccattatgccgatcctagcctagcttggcgaggacatcgccaagagcagatttggtcaacgtgtagtacttctccgcctcttcggggctcttgatcttggctgcatggtcaagctgcacaaatcacaaagggggattcttgtcaacaactcagctgagcaacagtaatactttttccgtttcatttcatattataaattgtttgtctattttcttaatcaaagtttttagctttgactaagtttatagaaaaaaatagtaacatatgggatataaattaattttattaaatttaacattgaatatattttaataatatgtttattttgtattgaaaatattagtatatttttaaaaaaacttgataaaacttgaagaagtttgacgaagaaaaaaaatcaaacgatttataatataaaatgaaatagagggaataataaattttaagagaagactctgtagtgaagtgaagctaaattagtttttttttgaaactaagtgaagctaaatttagttaccccgtcaatggtggcgaagagcttgccggtgaggtccttgaggcccttcttctcgtccttgggcttggagttgatgacggttttgaggtcgtagcgcaggtaggaggccctgaggcggaggtcgtccctgacgaacggccactgcttcttctcgatgagcggcttgagttgatgatgtcctgngccgactccttcgccctcgccgccgcctccgccggcggcagcggctgcaggtagaacctttccctcagcggcaggtccgtgtccctcgcctggtccgagttcagcgtcccagctatcaccacacaaatcaaatcaaatttgtaagtttcagtgagatattcgtgcgaaatttgtcaaacttaattaacggagaaattctacggttcttcaaaatatatcatgacacactaaaaatttaatataaaatttaatactttatagtatctcgataccaaatttacaataatacctcatgactctttcaaaattgctcaagttaataatactacacttacggagtccaccggagggcggtggcggggggccgagcttgatgggcttggcggcctcggcgagcgccgcctgcgcgagggcgccgccggcgatcccggtggcgacgaggccgagcacggcgcggcggccggtctggacgtcggcggcggcggcgtcggccctgacgacggcgagcctggacctgccgccggcgcgcctgggcccggccggcagctgcacgccctgcgacagcccggtcatggacgccattgcctgtgccatctctcaacctcagctcagacctcacctgactataagctgagaatttctctcttcagatgaaagaagcaaagtctcgagcgcgtggcggaaaaaaatatattgaggaggacgtgttggtgtgcaaccttatctgactggataagttgggggccagtggggaagcgccacgtggaccggcgagccgcgcgatggcctccgtccggattgcgccacggccaatggggaggcgacgcgtgtccgggagcgctcgtgtcctccactctcctttggcctccgttgatttcgatcggcggccgccgcgttggcgtggcagttggcaccgtggcggcagcggtaactcttcggatgatcgtgtggctttatccgatatattgctttcgttcgcacatggaggttcgccccggttgacgggtattttttagttttttttatttttattaatataacttttcaaaaaaatacttttaaaaactgaaccttttgttcacgctagtttggcaacgccagtcacggtgacgtaccttggtgtggcgtgacagagttatttggccacgccagacgggctggtggccaaaagatttagatttaaaaatattttcttggaaatgtttactaataaaacttttaaaaaataaaaggtctaaataataataatattaataagttctctgacggcgcctctacacttggatatgtattgggagcatttttttttacaaaatttgctatataacattaaagaaaatgtacgtaaatagataatggataccgtaagatcgtaaaaattctctcttctcagctaggtgtatatattattttaatctccatagtgtccactattaaattacatgtgttttgaagtgtctttcaaccgtttcacgatcttgcgatgcagctcagctaattacacgttttttcaatgttctatagtaaattttgcctttttttttctaataagagtaatggaaatatagtgactggacaca

SEQ ID NO: 47666 - DNA, 1291 bp, Oryza sativa
tagtttaacgaaacatttcactacataatatttttgtagataaatattctttttaagtttctagtgaatttatcaataatttctattgaaagaactagctgcatgctgtgaaggattgtcactggcagctcgttgggttcagggactaataatagttgaatacttgaatcagatagcttgttgtgcaagctttgaagtcaatggctggaatgcacaagacctagtgacagtattgggcgatatcgactttgtcaatattgagggggagctaaatagagtagcacataaactagctaattttgctaagagtgatttaggtacagcggtttggttgggtaatattccaccggttattgcatctttagttattggtgaatgtaattaggcatccttagttgagtaataaagatgtccctttcttcagaaaaaaaaaacagaagaaaatgtagcctgccctcatgtaccggtagatatgcaaaaaaaaatatatggagtatagtaataggagtgtgtatgtttatatggtcattatcgcaaggctagcttaattgtattattttcaattacatgattattagtaagtgttaactactttctccgtctcatattaagttcattttagctcatttcatttgtcccaaaataagtctatttttaagtaattattacatcggagtttgtaaaagtagagaataattgtattgcgagtagataaagtgagaaatagttgcattggatttaataaattaggggtatattattttttttattggtatgtgtgggatgggtgcaaagttaacttattttaggacacaagtagtagaactagtatataaatctacaacggtctgattttacactaagaagcgcgctacattacaagaaacaaaaatcacaagtagtacgtacttaatcgaaattctatgcgagaagttatcttatattactgaaagaaatttatagctaacaattcacagtcgtgggaatatacgaacatttcaatatactatcaaaaatataaacgtccacgtcctaaatatcatgattcttaaacaagcacagcaaaatgaatgtgactatccgtagctagagttttatatgaaatcgaaatatacaacatactcctatattcccagaaaagatatgatgaagtgcaagtttattacattggtagttcggccaaaatttaatacttgcatctaaaacaaaataagctagctgaacaaaagcaactataagctaatcaagtagccttgacaacggcgacatgacccaattcaacttgtcgaaa

SEQ ID NO: 47667 - DNA, 2311 bp, Oryza sativa
  unsure (1)..(2311): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncttgttgcttgattgcttaaatgactatgggcagaaacgtgacactaatctaacttgacgggtatgtcaaagtcaaataaggggggaaaatgaggttaaattcgctcaagtgcactataaacctgattttcctagatcagcaatgaaattgttgatatatgttaacgtgtgatcaattttattaccacaaaaggcaagagccaagaaatgccagcaccactttgccgagcagcaattgttgtagggcctcccaaagatggaatccagaaaaatccttctgtcagtaatcccttcagagaaatataagccacttagaacaaaatcctcttaatgaagcaaatattaggaagcaggatttgagttttacctcgtttgctacatttgaaagggcttggtagaggccaatccagacaggtattgttgccaaagttggaaaacatcctggaagagaaaccataatatcaaaacactatatcacaaaagcaatctcacttaaaactttaaaaagccaacaattggttttgcaagcacatgatggcaatagatgcattatgtcgagaaatagaaaatatgatcaactaataaataacaaactcatacaaaaaagatgcaatggaacaattcaactatcaaagttaataggctaaagaatggagaagtaagcgacctgccagagggttgactccagcttgcttgtataaccgagcagtctcaagctgtatcctttcctaataagagttatgtaggagtgatagatcagaaatgcccaaagatatgtgcttgaaaatataaaacacaacagtgaaataagaacattttttgggaagatagttctaccttctatcgttaaaatatgcaaaacatatatccagaaacaaacctcagtgttcctactttaatatccatggcgtgcgtaaaagataaacaaaacaaacctgatttcctgcatatctctgttgaattgctttgatctgtggctgtaaattctgcatagccagagttgattcgacctaaaaaaagagaggaaaaacagcacaactctcaacccaccatatccatgttactcattaattaaaaaatagaccagattttatcatttacctgttgtttcgttaaaggtaatgttgcagccttcacaataacagtgagaagaatgatggcgaatccataagagtacggcacatgaacagctgacaggccatccttcagcacctgtatggtgatactcacatagtatcagcattccggagccgatgaatgctatgcaataaaatcctaacagttcttgaattgtaacatttcatatcaaaacctgtggataggaaaatgctaaacaatgcacgcctggtcataactagatataagttacttaaaaataaccatgccgggttgccgtctgctcaatgtttagtaagtttcagagcatggaggcgtcataattaagtgcatgcacatctactcctgcactctccacgaacttacatgactccaaatctccaattccccaaccaattcaccagaccaacttttgcaactcagggatatatccattaaccaatcttagcaatcctgaacctgaactcctaaagtgacttggattcctataggtttgggagaagacggcggcgcttaccttaagcacgacctccaaggcctcggagatgaacccgaaccaccccccgttcttctgcgccaccgacgccgccgcttcaccgccaccaccaccgccaccccctcctcctcccgccgccgcgtccgccgcgacgacagcggcgtcggcgagcgtgtagagcgccgcctcggcgcgctccagcgcggcgtggaggtcgagccccgcgatcgagtcgagcccgtggaggctcgccctcaccctgcacgccgacgcgcggcggcccccgtgcctccgcagcgaaggcagcgtcagcataggcagcctcgcggcggcggcgcggggctgcagcgaggggagcagcgacgaggagagga

SEQ ID NO: 47668 - DNA, 3659 bp, Oryza sativa
ggggtggtgagtggtggtggtgcgagaggaggaagaagaggtagtcgttggaggggaagaggcggaggtgggggatgctttatcttcttcctcctttccgcgctcttttgctgtggactcggtgcacaactccacttcgccacttcatcaaagcggctcactactacagtgtacgtaatactccctctgtcctaaatgaaactaaaactgtatgtaatattttctattataatatagagtctattatgatacattatacttgaaaacgtcccatccaattttatattctaatattttagaataggtagtaatgatttttcgaggttttgacacgaataacgtttccgttccgtgtcgaaacctcgaaaaatttgtaagatggttttcgcctaagcaccggatcctgatccatgtggatataacggtttttgtcaatttttttataacttttcgtttaattttggtcaaattgactgtttcagatttgaaccattctaaatttcagtcataacactatcaaaacctcgaatttttgcggttttcaattggtttttatcgaaaacatgaatcctaatgtctacacttctgttcacttcagttcgattttagtgaaaagcctccttggggacaaaaataaattttgaaggaccttcgtatacaggaattacactgatctatgcagaaaccatttgaaaaaaaaaatgtatttcaaagaaaccccgagtatttcgcaaccaacctttttggcatattttttctttaaacatgcactatattcagattcaacgatgcaatcgtaatttcattacaatcataccctacatatcagttttctgaacgttattatcattttttttctaaacccattttgacaattgggtatagatcgaccaaatgtaaggccccgtttgaaacacgtgaactgtttccctgattcttgtgaatattttgtgtttcaaactttcagaatgtgaaatacaaactgaattgtgcagcattgaacaaagaccgcaccggtaatagtactactttgacagcacggtaacagatggtcaatgtctgctagtaacagcctggtttctgaatgatcggcccgggtgagaagagattgtttgcctgaagaaaatcgagtgtggtcaagggactatctgaagaattcgcgaacattgtatcagtgaaaaattattcaccattcgtcagaaagaaagaaaagcacacgacaaacaatgaaacaaacatcactggggttcagactttcagaacagaagctgtgattgtttcacgaccacacacaaccatcggtctcaagcacattacgctcctttctccatggctacacaaactacagaactcgtgagaagcaggccacggtagcatggctcattgctggccacacgcaagcccgaaaatatcatttgctacagtccaggtgaaaaaaagatctttgcttcaccatagcatccaggaaaggtgcaatttactgtagcaaaaaaaaaaaaaacagaaattttgatcacttcaattcaggattcagcaaacgggttcaccaaacggaattcgcataggagcatatcgatcatgaagttagtacagcaatgggatcgagtttttggtttcagttgaaagcgatccagccagtagtattgtagtacagcacattgaaatgattaagacagcgattacaaacaattgctgaaattgacaacacagttccgaacttctagtcgtaagtagctgtcgacattattatggagtaatgaaccgttgaacttgatcatcagatatatatacagaattttaactttgccatgttccatagaaatcaagatctccaatatagtggtgctagtgtaaaaagtacaggggagaatcaacaaagtggtaacttttttgcctaaatcaccaacactactgagaaaggaatttcagctaaatgtttagcagcaaaatatccatggcatcacttgttactttcctgcatatcatggcatgacacaggaagatctaaagactaaactgttttctgttctatgataaaagaagatcgttttcaccaaggtgtgggggcctcatgcaaacctggacttcatgctcttcgggtccaactcggtgcttggggaccatgatttccagtccagtgccagtctcgtcataatacgcttcgagctttgcatcttctggaatccttgtagccaaaggtatctctctcacaaattctccaggagggcagtgctcagggaaaggatcagtcaacttgaatgtcctgtcatgtctcttaacaaagggcattcgagcagtgctcacacacgatatcttcacaatgccatgtgtcaatgtgttcctccaagagaccttgacactgtgaggatcagagaagagcatgctcaccatgattaagtagccttcatcgtcctcatatattgtcttggcagccgtaacaggtccacttgcatgttttgctacaccagtgaactcatgcatccatgacggctcacctgtgtgaacttctatctcttgctctctgtcagaacaagaattatttgccatcacgcaatcctcatctgcaccatgagcaaagaagtccttccgtcgcttggcgcattttggtgaaaggtccatcccatcgtctgatgatggtggcgtagaaaggttaagacctgaaccattcagtgcctttttgtgactgtgagagccatgtgtaatctttgatgacagtggcagtggcctatcaagttcgaaatcagtgcttggaagattcctccatgattcaaagtcacttgcttcaggaggaattgagaaattaagttctcttcctgtaagttccgcccaccttttcatttcagcttcaggaacagctgacagatttggtgaactcacaatctctatcccatgaaggcattgtgggttggacagccctcgatagtgctttcgttgcatgcggtgtgaccttgcaaagcccttatctgcactgaatggaaaggatggctcaccatgcttggaatgcccattcatgaagctccggagctgcatcttcccgagggcattgtcaggccgttccttaaaaacccacatgtacatgttctccatgtcatgctgcaccaggaagacatcaaggcgaagatcagacttctcaaagcccgaaacgctcccagaagagtcccgtgtcaccttgcccttcggcttttccacaagtgcaggtttgaagtagtgattgaagaagaaccatgcaccccaaatgctgtcccccctcttggcacacttcctcgcaccgacgccaaccgcagtgttgccattgccagtcaactttggaagcgtgagcgcaacctcagactcataagtctgcgtgccgagaccgacatcaagcatgtcgaactggtcgataccccacgacggcggatgcggcggcggtggtggtgaggggtctgcagaaaggggcaggttaatgtccggtggtcctggatgcgcagattcacgccgcggaatgatgaacaattccctgtcaccaccgccaccaccaccaccaccaccggcaccggtgctgccgccacctccaccgccaccggaggagtcacccgaggccgcgtgcgacccggcgggatccatggagaggcgggtgcagggatggctgttggtgttctccatggacagggtggggagga

SEQ ID NO: 47669 - DNA, 2774 bp, Oryza sativa
ccctcctctccttatccttcgtccttcctattctcacctacttctcttcgcttccacctcttgctcctcctctatctactgcctcttcacctcttgccccatgggaggagaactccatgggagcatcaaggatttcgcatagccttgccccataaaagatggagttttcaacccaccaaatccacccacagatcaagatttgcgatgggggatccttcctttggagcaaaattaagatcttcggagccaatccagcgctgcaagcctagaaaaatccagagacaaaaaaaaagaaaagcaatttatcagacttactaccaaattaacagcatgttgatgcacacatacctcgaaatacagatcaagtaaaaaaaaacacttcctttcgctaaaaaggccactcgatttccccacaatacctcactaaatttcgtcacgaaaacaacaatattttctccaatcaagccgtaccacacctcgaaaatcccattaaacacacaaagaatcctcgctggaaggtggaaacgaagacaaacgaggaagaaagaaagaagaaagagcagctgcccttgctctgatctaacctttgggggaggaagcagcaaggttctagaaggccccttgtcccttcggtgaggagctctcctgaaggttctggaggcttcgcctcgccggagcttctcgccggaagcgaggaggagaggggagagaaggggaggaggggaacaatggaggaagagagagaggagagaggagggcccaaagaaaagcgaaaacaggggtcgcgggtgtcaacgggttacggatccaaaagtcgtttgcgggtcgcagaatgcaaccgtgtccagtaattttagagatattggggtagtgtattggatccagggagttaactttagtccctatatttagacactaatttaaagtattaaatatagattacttacaaaactaattatataaatgaaagctaattcgtgagacaaatattttaagcctaattaatccataattagagattgtttaatgtagcatcacataagctaatcatggattaattaggctcaatagattcgtctcgcgaattagtccaagattatggatgtgttttattaatagtctacgtttaatatttataattagtgtccaaatatccgatgtgataggacttaaaagttttagtgccatctatacagggtctgaactactcccttcttccctaaatctctaaatgttcgacgccgttgacttttttaaacatgtttggccgtttggccgttcgtcttacttaaaaacttttgtgaaatgtgtaaaactatatgtatacataaaagtacatttaacaataaatcaaatgatagaaaaataattaataattacttaatttttttaaataagacgaacggtcaaacatttttaaaaaagtacggcgtcaaacattttaggatggagaaagtatatgccacttttagatgaactatttgccactgtaaccacatgttatagacacatgtggacccacatgtcattgagataggtgtggcaaatagttaattgctaaatctaaaagtggcaaataattaaaagccccgtaattttagcttcccttgggaaggggtttgtatgtaggtgtacttatgttttcgacgaaaaccgatcaaaattcgtgaaattttgatgtttcaacgttgaacgaaagaagatactaattgaaatgccaaaatggtctttcgagaattcaagtttgaaatagtggattcgacccaaattacttgaaatttgtcggaaaccgtaataccgttaggatttggatccgacgctcaatcagagaggtaaaccttgcttgagataatatttgtttgtttggaaacttttttgggaggaggggagcattggggggtttggtttactccacattatttttcttgacgtttaggctacaatggagacccacgatttagcttggttggtgagcaaattcaggtgccagaagctctccttctaatgaactttctttaaaaaaacaattggttggtgcaattatcttgagaggatctttaaaacacatgaattttataatatttttataggatttagctcaaatcatacacaagtcctgtaaaatcactccattcaaaagccaagttttacaatccggtgctatggactcactcaacccacaaaaccgcactcatttagacccacaattgagttaacaatagacaaaaccatagtattaatttgtacaaactcacactattttaaaatcgccacttagctagatctgccgccagtttctaggctaacattggaatagaactcgagtaaataataaataataaacagatcattacgtttccaaagggtcgtttgcaacaacgtattgagcatcgactagaaagattattctaagcatggagcattaggaaattacgatgaaatgcgaccaaagcaagaagccaaattatccgacgactacttgccgtttggaacggccaaggttgcaattattactagtattcttttctttcttttttttttcttaagacaggttgcaattattcaagagaagattccctcgtcaagtggtcaatcagatcccttttgttttcccatttcaaaggtttagccgtacatgcaatgaagcaaaaaacgatagatattggtctcttactacttcacacatatactctccgttccttaatataagagattttgacattttgcctgtttgactattcatcttatttaaaaaaaattgaaattattattta

SEQ ID NO: 47670 - DNA, 15851 bp, Oryza sativa
agtgcaattttatttacatatggaaaagccaaagtttggtacaacacaccattaattagcaaatcatgaaaatggtactcgtgtacatttttatttaccaagggaaaagatagtccatgtatttcggcatttccattctaatacacttttacttatttgctgaagaaacggtagcaacctgagctgtagctgcgagcagaaatcagattagatagctcttcagtagttatgtggttttgcttttgccaaggccttcttccgcagggcgatcaagtagcgaaacaagactggatatactgcactcatccaaatgaaacaacactgcagtgtgttaacaaatcctacttgttttcctttataaaattcctacaactaccttttcttaaaaaaaaaaactaggttatagcatcgattactaaatgaagtacaatcccatggaaatactacctgtggcaaacgaagccatgaaaaagagattggcatagaagtagttgaaggagaaactccatttgtcggatttctcagatgcctgatattgttgagcctgatattgctcatgcaaaagaaaagagcatttaaacaagattcattatgaaatggaggcgttgatcttcctttctaagttattcaagttaccttcatctccatgaaaggaagagcaatgtagattaggacaacctcacaaaccataccaacaggaaagcatactatgaaggtgctgtacctgcaaagaaatcagtacggaagtaacagcaacatatttttaagagaattcgctgatcagataacgagtttcatttgaagtttatgctacatattatgatttgtttacgactagaaccaacctaagccaaaagagccaggaaggtgtaaatccaaatgactccttcatgccatggaaagaatatctggtaacctgcaaggaattaataattcacttcactctccgaagtgaagaaaatttcataatatttgttcaactaagctcaacacaggaactttcaaagttttttttgggaatacgcaaggagcacattttttccattaagagaaataaaggttatttacaatgaaatgaagagcagcaggggactgaaacaggactcaaagtacaaaatcaaaggtttatctctcacggtctgttttggctaccgaagtcccttctgaggatcagagcagggatggctgaattcgcttggcgccagagtgccgtctctgccgccattcccttcacgatgtccacccaggtcctttgttgctgattgaaaacccggccgttgcattctttccaaatcgtccatgccactagcgtgaccaccgtgtcaaaaccccgacgcaatggctctcgaatgatcattcggctgctgcatagccattggtgaaatgagagttcatttactgacagacactcaggatgtccaattgcccccaacgtccaccaccatagctattagctgcctggactccagacaaccaacaagaagaagcgccgactgttttctctgatgaagcttctttgcagattggcgaacaagcatgaaattgtcatggatgcaccgttttttgatgaacgagctctggttctgtgcgaccaaggagttcagaatgggggctagccggcgggagaggatcttcgtaaatagtttcgcaacgctatgcaccagactgatggggtgaaaatccttcaatttcctggcgtcttgtgttttaggcaacaacgtgaggagagccgtgttcacctttccaaaactggacccgtccatgcgatggagctgctgcaacgctgccataacatcctcgcagatgatcaactagcaggtttggtagaattgtcctgtgaaaccatccggccccggcgctttgtcacgcgatgtatcttttacagcaacccacacttcctcatctgagaacggggcttccaactggggtagaggtttccccctctcgactagaaaatcaaggatgagagcaaaggatcttgaaggagaggagtcgagcaaatgcaagaaccagcacggccttctcgtcaggtgaggttgctacctgaccgttgtgttctagttgttggatgaagttgcgccgtcgatgggacgtcgcatgctggtgaaagaagcgtgtacatgttggcatcaccttcctgcagccacgaaatccgagagtgctgacgggccatcgttcgctccaaggaggccagcgcaaggtatttcaactttaagctcttgtgaaagtatctctccgaaggggacagggcaaacattcctctactctatcaaatctgccaatcagttctcttgccatttccatttgcaatttcatatttccgacctttttgtcgctccaactccttagttttttggccgttgttctcagcttgctgtcaagcctgctgatcgggtcggcaatgtggcaaggcaatgaccaggcatcttgtataacctcatggaatttaatccttcaagcgtgcaccaaaaactctcaaagtggaaccgacctcctctagggtgcgaaagggaaggtggatagaaaaagcgggcaatgatccgagaccgtggacgggagagctttaaggaagcattggggaaatacatcctcctagtcggttgtgtagaacaccctgtcaaggcgttccagcgttgggttcaaccaaccattcgaccaggtgaaggagcgaccattcgggtgaagctcatggagagatagatcattgatggccctgcgaaaatgacccatcaaacgcctgtttaagtttgcattgctcttgtcctgatcttggtaaatcaggttaaagtctccgaccaccacccacggtcccgaatggctgcttcggattgatcgtaactctagtaggaaccgcagtttgtcggcctcgagttaccagtaaggaaatagagtgcgagctaccatcaataaaagaaagatgtgcagtaagggagaattctcccatcgtggggctgtcacaactgacgaccgagctgtcccacgcaaatagagaaagtctgatagattagcacttaggaattaattgtgtagcatcaagttcagacacacgaccgaacaacgagcatctacaatcaccgaccgaacagcatcccggtgtgcgcggtcgtttaaacccatgcacattccagacaaggaagttgaagttgaaactcgtcatgggacgcgattgatgcgacctgacaacgaagctctcaagcggcctgcaccacggacgccggcgccatcagcgcgctagctggcctgcgggccccggcaagctgatgtctaagagatggtcgatactgagctcattgtcaaagatctccgtatactgctggagtgcattattggtcggctgtggaggaagaggcggtacatcgtctgcatcaacctcaagctttttcgccaaaaccacctggcaccttgacattaatattgttggagctccatggagtgcttgaaccacctgccgctcactccggcgaggcgtgaagggggtagcaggcatgaccgatgcaggcggcgttggcagcggcgggagaagtggggcagggatcgccttctaatcttggtgcgcctagagaaggtgatcaatggatccggttgcggagagcccggcggggttggcgtcgcagcgacttgatcagggggcgcctcggtggttggcacgtgaacaccaccatgctgggccggctccagtgcgacttgtcatccgagcaggccgcctccaaccgctggcccaaaggaaggaacgaccacttcatgctgggctggttcagaggcctcagccgcttggtccagtagggtgttgggctgtcccgagcccaaatcatcctggactggtgaactgggcctgactgggctaggcacaaccactggagaaaggcgatctggcccggcccagaccgcatctcccttggaagccttagcctcgactagggatggcaattgtgcccatttgcccgtttacctgtgggtaaaaaccctattagggttgggtttgttctccattttatacccgtgggtatcttattgggtcaaaagttatgcccgatgggtaaatgggcatgggtataggtaatcactacccatgcccgctttgcccgtttacccgcgaaatctaacttacatgtaggctaggagcaaaatccactagaatatataagccacgttctttgttttctacggtttcccttttattccccttattatttctctccccttactctatcgccgccagaggagagacccgacaccgaggcggagaatatttgatgttttaagttcgattcgaacttagaagcttgtagactttttgttccactgcttttgttgtggcgggtaaacaggcacgcccgcgggcataaggcgcccgcgggcaatgggaataggcaaccatccttacccgtcatgtagtaatgggtatacccacgggcacaaataatctcacgggcatgggtatgggtaggcactacccgtgcccgtcacgcccgattgccatccctagcctcgacgccatcccagcgcgtagcctcatcccacatcggaacatgtgcaccggatgggggcacatgctccgcctgccagcacagctcaaaagaagcatctcgacaggggctagctttgcaggggctttgaagcgaatcagaagacggttgtgatctgaacaggggccccacagaagaggccaccgcatcaacatcggtgactgagttgagggaagagacaaggattttggtggtgtttggatcagggactaaactagtccctgtcatatcggatgaatttgaagtattaaatatagactacttataaaactaattacataaatgagagctaattcgcgtgacaaattttttaagcctaagggcatctccaatgtttataatcataagtagcattaaggtgggtcccactattcttatggttattaccacaatgtttgaagtaagagtaaactttaagatgggtcccacaatgtactattctagtacttcttttatcagccatgcaaatttttcatcctcacattcattttaccctattattttattgcttgtggtcaagccataagcttaaagctttcttttgcatttaatgccttatggctttgtttcacaatgtatatggtcactataaaaccttatggcctcttcttatagccacattgtggctgccctaattaatccataattagcgtatgtttactgtagcatcacataggctaattatggattaattaggctcaatagattcgtctcgcgaattagtctagggttatagaataggtttttattaatagtctacgttaaatatttataattagtgtccaaacatctgatgtgataggactaacaagttttagtcccatctaaacagggtctttgtctcccaaactctctcctctgtcgggggaagggacagctgcacaggaggcagctgacgcgaccaggaattttctttcaagaatttcaacaactactgtcatttcaagaagcagaactataataaaattgcatccgaaattcatgatcttccaagtgagtaatttggtgaaaggttttagggagtagcgtatacctcagtgatgcaccagcatatgatcaaggaggtaacaaggatatgagagtgtgtctgcaaaacatgtggacagtgattcaccgatattgtttataaacaaaacaatcctctgattgattagaagataaaatacatggaataggaaactaggatgcagaagaaaagagcactattttgtccttatccatgatgtaattaattgcaacagcttcattacttaagcaatttcagcagcttcggtttatccaatgcctactagagccattatgaccataaatgaaagtatgggatatgctcttatagctgcaacattacctaacatcaatgttttgtcattctaagaagtgctttctaatccagaacttgtttttaagatataaaccttcttataacttggagtaaggtcctgatattacctcagggaagctccacaagatgccccagatcatgaacaaccttccagtaacttgtagaacagtagaaggcactggagacctcaccaaacctttttaacaactcagatacagtaataagcaataatttttttgggggaaataattgagtctaacaggacacttcctttctctctttaggaagaagttaacaagacgattttctcaaaactgaaacttctcttgatttatttaaattccaggctattgtttttgaaacgagccacacaagacagtgcgagtttcatgtattgataaagcaggagaaaaatacaatctatagtcctagaagaccacagacaaaaaaagaaaatacaaccacaccgcgcgtctacaacaaaacccactgcatgagcaaaactgaaggtcttcgagacgacaccttcaagaagggtacgacaccaaaagtgccgctgtcgcctgtcccggagggccaggacaaggttttcacctgaagaaagtaattgggagagacaagaaaagcggcaacaccccaagaggaaaaaacggcacccacaggcgtcgttgttgccggctcgaaggcagagctttcgcccaaaatttgtctctcccaagaactgaactcctacacgctccgcagccaccaccagcgaaaaccttcgacgcatggccaccgcaccggcaccacgccgccagtcaatcgccatggggaagctcgaacctcgacacacaccggctccatccacgcagttgggttggatggggagagggtgagagagaagaatggatgccctctcccccacactagcccgcacgacgtggccaacttttgccgacaaagtcgccgtcgcaagaggacatatgtctaggaaggtgcacgtcgagaggaccgcggctccccctgacagagtaaccgccggctccgccacgaatccgttgtccatgtcacctcggaccaccagaccgttacaccggcgccatgccaccctccgcaccgtgctgttgacccctccgccacagtgcacccgccgtccaaaatgacgcggcactagaacgtccaccgaagcacgatgctctcgccccaaatccggtggaggggatcggatcttgcccgggggaagccagacgcccagctgtcgcgcggcgttggctgcccaccgcagcttgggctccgccgccgccatcaccaccaagctccaccgccgccaccactcagccccgccaccagcccccaccccgccgccagcaccgccaccgtgccctgccaccatctcccaccccgcctccagcatcaccggatctcgcgcgcgtcgcgccatgcacgccgtcgccggtcccgccgaccagccgctgccgccgcctacgcgtctccgtcggctgctgttgccgccctctcgactccgtcggtcgccgtcgccgccctcgcttctccgtcggtcgccgtcgccactgccttccgccgcaaacctcctcggcgtcggccacctccgcctgccggccgcagccatccggggggactggatctgccgccagagtggccggatccgtcgtcccccccaccaacggtcgcggtcgccgcctcccacgccgcctcctgccaggagcggcatgcccctcccgatctggccgcgacagggccagatccacctccggcggagccggatccgccgcatttggcccagatggcgccggacactgtcgccgccgtccgcttcgctcgggtcccgccggtgccccagccgcgcttctcgagagagggagaaggccccgccgccgccatccttgccgccgcacggctttgccggcggctgctcgggcggcggcgaggcggaggggaggaggagaagtttgtggcggcgcgcgcggtgtcgccgcccgtgtcgccctagggcgagtgacgcgggcgttgtactgtcaatttttttgacgctgctctgagatggatatgtaatgtttccaggctattgttggtatcataatgatttcaagtgaatgaaaaagaggctagaggatacatattacactgcacaaatgtgaaagtatagaattttattgtgcgcataccctacgttgtgcagataccagaaattaccatctaccactatctaattcagtatgaaaaatgtatatactttcagtttcagatatgctgtagttttgataaatgtatattctgaacagcatatcttttgttgtgcacacaccagaaactaccatctaccacgatctaattcagtatgaaaaactaagaaacaatatcaaggtagcccttaggcctaatgtgtttgcatgactaacaatttccaccatgaagagcccccagattcttattaggcttttaggctcaatcacgtatcatttttaatcccttctttttgcagtaaaaggttcaaaatgaaatttaatgtggtaccccttgttgaaaatacaacgtattggaaagaaaataagacttattttctttataaagagacaaagtatatctcacctacaatggaatgaagaatctgcgctaccagcatcaccatcaccaggcaaacagcagaacataaaaagtttagcacctctcaatctccatgagcaatgaaacaaaatggttgtacaactgcattcaaatttacagttttactacaataaaggcaacaagagaaaaaaagaaacaaacctccatgattgcagcagtctgcgcgaacagcagatgctgctctacggcagcatacacggcctcatatccgttcttcagcaatgccaatatcatgaaccacgacacctgaaccctgcatgatccaaatcaaagagccttgatcaaaacaacaccctgtacaatccaaaagaattggccagcaaacaaagatgttactccctccgttattttatcttttttttctagtcaaacttttttttagatttgaccaagtttatataaaaatttagtaacatctatcacactaaattagtttcattaaatacaatattgaatatattttaatagtatgtttgttttgtgttgaaaatgttactatatttttctctaagcttgatcaaacttaaaaatgtttgactaaaaaaagtcaaaactaacggatggagtagaagtgagatcgatattcatgcataagtcaggctgtgtttagttcacatcaaaattgaaagtttggttgaaattggaacgatgtgacgaaaaaattaaaagtttgtttgtgtaggaaagttttgatgtgatagaaaaactgaaagtttaaaaaaatattttggaactaaacatggcgtcaacaagttaccatccgatgaagacaatccagttgtagagagagaggtagagcctccgcacccctgacgcattccctgccattgcaggaaatatgcgagatggaagaaaacgtcgagatggctgatggctttgaccgggatactctactcctccaagatgtacaagcatcacactatcgcaacatcagaagcaccaagatacaagtttgagcatcttaccggttggggattatgtatttatggggctatgggatttgattaataaccacataatttggatcaaatcagattagcagcggacagttggcagttaatgctactaaaactgccagctaccccgccaatttcgtccatgtgatcaaaacatttcgggtgtgtttggataatgggaaatgtggggtgggattgagattgagaaatgaatgaagggttagtattaaatagaagagggagaatgaatggttaagatttaaagatgtcttttagtgggtgggaaattatttccctatcccattagccaaatagggccttcgtcacaacaaacaagaacagaacataataaatactagttggcaccccgcacaaatcaatgctttaaatgattagatgtaactctgtgtatatacaaaatagattataatgcggctttttatatagcttctgttataacaatacaattcatgttttattttttgaaacatcattgtgtattgttatgatatatgaaagttattttcatgtacaatttggatatcgtcacaataaggttgtgtagcacttatctgcttcatctcaagcatgtttcaaaaatgagtttggattaatgatatctaattattgtatgttatccaattgtttataacaaaacaaagctcacatcttatataataattggagttgtattttttttttgaaaaagagtagtattatctttgaggatttggatgtgcacactggataacaatgtcacgcgcgattatgagctaaagggaggtgaatggatgaataatcaatgattaaattagatggatgagtagctagcttcttgatccaacggttgataactctatactaatgcgatccaatagcttaaaattattgatgatgtggctacttgcatgtctttctttataggagtaaatgtttcttagtgggtactaactctatatatatatatatatatagaaagataggatatcatctgttgtttctcattgtgccttttcttttctcattttcattttcaccggtgtaaatgtaagccatattatactcataactaggtggcaggaaaagttcgttaacaagcttgattcaaaggtcatgttctttctttttgacggaagaaggtagagctggctctactttatagccatttcatctatagaaatgaggtggtacaaagttaaaaaagaaaaagaacaaatagaaaggaggagaaaataaattacaaaaattacaagtggcatttacatattaaggatctaattgtaggagttgacaccaagactcaatcttagacttggtaattcctttagctcgatgagtccatagttcgagggagctctgtatttgctgcagcaagaggtgtagcgaagtgtgaagcttgtcgaaaaccctgctgttgcgtgctttccataaggtgtatgcacaaaccgcgaaccagactggtccaataccgtgagttgacaagtttacctggtttgccttgattatttctttccataaggtgtatataaggtcatgttcttttaatcagtcctcggaaaagaagttcctttactatattctcaagaacagataaaaacatgtatagatatgttcgaaaaggaaaaagtataaagaagcagctcaatagcatgtatgaatcgaggtccagttaacatcaacaaccatcgtaagtggtaacatacatagacatgtactacttctgaagaacagttcacattaacaactccccaacatcgaactgctaatactgtttatctaattcatgtgttaagtgttaaaaaatggcttcaacttagaccttgtttggtaggactccaaactccaactctcaactccaatggaatagaaagtgtctggctagattggttagctccactccaccacatcccttgttgtcattttaccgaacacctgtaggcgtcgcagctgctgctcagcccatgctccaccgatgccgccgcctgtcccaccgtcggcggtctgctcgccggtcgccgctgccgccgaccccgcacgcgtgccgaccgcgcgccgccgccgccacagcacgcgcgccggccgcgcgccgccgccgccacagcacgcgcgccggccgcgcgccgccgaccttgcgccaccgctcgcgcgcagccgccgccgccgctgctcagcccgcgccccgtcgccgccgccgcttctcagcccgcgcaccgccgccgctgcttgaggccgatgcgtcgccgcccgccccgcagccagccgccgccactgccaccgcacgagcgctgccgccgcgccacccacccgccgctgccgacgccgacgccgacgccgccgccgccgccgccggcctcgaccgaggaaggaggatgaggagagagaacgggaggagatggggtaggaactaggaaggggtagttcaatggcattttggtgtaaatacactgaaattttaaagggtagtgggtcttttggggtggagtagagttgtagagcagcaaaaacccagctccacccccatagtacaattttgtggagcagctctgccaactccgctcctaaaaatagagaatctggactgtttggcacagctccggctctagataagttgtagttgggagctgagctagagcttggctctgattatggaaaacatgtgcgtttccctccttcaaaactatccagcagacaagcaacaccagagtgtcgaaagcgcccttgtagctggtccgaagtccttgccgcgtttcagccggcagttggaagccaattccagcccaacccttgatcatagggcaggaaacaaaaagatgctcacagtcctcatcgctgctcatgcaaagtgagcaaactcgctggtgcaatcatccgcgcttactcaggttgtcagccgtcagacaacggcctttctccgccaactacataaaaaacttaactttgacggcgctctcgtatgccaaataagtttaccacaacacgccaaaatgagcttagctttaacgtgaaccaattgaggctttaacagttgactagaatcccagattcctcagccaattgatgtacacgcatcagaagctcttaaatactatcagcatcttgatagtgactagctcggatcgggattggagtcaagttagtcactgtccaaattgatttggcattgcagtggagatagaattcaacatcttggtagtgacttgctcggattgggattgtagcaatcaatttgtagccacagttcaaattgatttggcattcagtggagatttaactggacagatggttgagcagcgcacagttgaacttattgccactgcaactgctcgccaaactgccaatatgattcatgtgaatatgtgatcagaaaattgatttggcattgcagtggagatagatttcaacatcttggtaatgacttgctcggattgggattgtagcaatcaatttgtagccacagttcaaattgatttggcattcaatggagattgaactggacagatggttgagcagcgcacggttgaacttaggccctgtttagttccaaagtttttttttccaaactttcaacttttccatcacatcaaaacttttctacacacataaacttctaacttttccgtcacatgacacatcgtcccaatttcaatcaaacttccaatttcagtgtgaacaaacacagcctattcccactgcaactgctcgccaaactgccgatatgattcatgtgaatatgtgatcaggaaatttcattgcaacagcgaaaagatagcacgtgattacaagtatacaacttctctttctcattcagcttcgttttttccctgttcttcttcacctgtacatggagtacaattttttggcatcatctaagcatcatttttcggcattgatatggagtacaatttttttcttcagataggaaaaatgcttatgtttggtacaacacaccattagcaagtcattcttttctttaccaagggaaaagataatccgtgtattttagcatttccattctagtagtaacctttacttctttattcaggaaatggtagcaacctgagccgtagcttcgataagaaatcagattccatagctcttgagtagttatgtggtttttgcctttgacaaggccttcttccgctgcgcgatcatatcatatggtgaaacaagtatggaaccactgcattcacgaaatgaaacagcaaggcagtgtgccgtcaaatcctagtttgacaacaaccaactacttcgtccgtttcatattataagactttctagcattgcttatatatatatatatatagagagagagagagagatatatgtgtgtttagatttattaacatctatgtaaatgtgggtaatgctagaaagtcttataacctgaaacagaggtagtgtttctttgacaatctgtaaaggcttaaacatttcagcatttggatgatccacgatatcagtgtgacaatgtcagatgcaattggctcctttcactgatccacccctactttcatgaaataatatccagaaacagttacagggcaccaatatgaatcaaatggtgatagcaaccttcttcatccttgaaaagcagaaaatctacacatcattttttggcatcgatatggagtgcaattttatttacatatggaaaagccaaagtttggtacaacacaccattaacaaatcatgaaaatagtactcatgtccatttttatttaccaagggaaaagatagtctgtgtagttcggcatttccattctaatacatttttacttctttgttcaagaagtggtagcaacctgagctgtagctgcgagcagaaaccagattagatagctcttgagtagttatgtggtttttgattttgccaaggccttcttccgctggacgatcaaatagtggaacaagtgcgggtatactgcactcatccaaatgaaacaacaaggcactgacagtgagttagcaaatcctacttgatttcctttcagaaaatcctacagctaactttctttaagaaaaactactaggttatataatcaattactaaatgaagtataattgaagggaaatactacctggggcatacaaagccatgaaaaagacagaggcatagaagtatttgatggagaaattccatttgttgggcatcctaaggcagtatttctcagatgcctgatattgctcatccaaaagaaaatagtttctaaacaagattgttatcaaatggaggcggagctcttcctttctactaagtattcaaattaccttcatgaaaggaacaacaatgtagactaggccaacctcactaaccataccaataggaaagcatactatgaaggtgctgtacctgcaaagaaatcagtatgaaaataataagtacttatttttaagagaattcacagataatgagtttcatttgaagtttgcgctacatattatgatctgtttacagctagaaccaacctaagccataagagccaggaaggtgtaaatccaaatgactccttcatgccattgaaagaatatctggtaacctgcaaggaataagtttttttttctacaaagtcatgctctgtagtgaagaaattttcataatctttgttcagctaagctcaaaacaggaactttcaaagcttggcattttctttcaggaaaacaactactatcattttaagaagcagaattataataaaattgcatccaaaattcatggtcttccaagtgagtaatttggtcaaaagttttagggagtaacatacctcagtgatgcaccagcttatgagcaaggaggtaacaaaaatatgagtgtgtatctgcaaaacatgtggacagtgattcaccgatattgtttataaacaaaacaattacttgatgagaagttaaaatacaggaaataggaaactaggatgctgcggaaggaaaggacactattttatccttctccacaatgtgattgcatcagcttcattacttatgcaatttctgccgctttggtttgaccaatgcctactcagagtcattacgaaagtatgggatatgttctaatagctgaaacattacctaacatatagtatgttttgtcattttaagaagtgctttctaatccagaacttgttttgaagatagaaactatctaataacttgggagtaaggtcctgatattacctcagggaagctccgcaagatgccccagatcatgaacaaccttgcagtaatttgtggaagagtagaagacactggagacctcaccaacccttctcaacaattaaggttacagtaataagaaaatattttttgggggggaactaattgagtctaacaggacacttcctttctctccttaggaagaagctaacaagatgattttctcaacattgaaacttctctagatgtatt

SEQ ID NO: 47671 - DNA, 1793 bp, Oryza sativa
acctgccacgccacctatcgatcagctgcagactgacctggccaccacaaaacatatcggcaaccgcaggtctacatggcacatgcatggaggcctgtcgtccactgggaagccgattggtccacatgagggcctgtgcatttaaaccgtgtatgcagctagtttcaactccctgaggccatccccaaccctccatgtcatatcgtgtccatagcattaaggccatgtttgattcagcttaggattattataatctggattattaggaataagctaaaacaaacatatagctcattatgatagattattacaatctataagccatattactataatctagtaatccactctaaaggtgcttttttagattattgggtggctaacaactaaaaaacaacttataatccagggaaacaaacagctcgcagcttattctatggcggcttattataattcagcttatagtaatatggttcaataatctagattacaataatcttaagctgaaacaatcaggacctaaatacattgtcacataagcaaaaatttgatgtggcaagagagttaatgaggaaagaggtaaaaagatgaagaaaccatttctcatgcaaaaaaccatctctacacaagaatcaagaatgaaaacaagaggataggtggataaaaggagagagaagagcgatgattggatgagaatttaatttgaagacaccatctattggatatatagtttctatacatagtatctatatgacatggtaagtatggaaactacttaatagtttctgggttggggatggcctgacacatgcttgaatcaggtaggctagatacttcctccgtgccaaaatgtaagtattattgaggttgtcacaggtataacgaaagtaggtgagaataattatagaaagtgtgtgattggttgagaagagaaagtagatgaaacataatggttgtgattggttgagatgaggaggtaggtggggaaatagttttattttgggacaaggcactgtgcaagaaatagctacatttaggatggaggtagtagcattttaatccatgagtgcatttaatccgagtgtgctagcagaccgctccaccacgtcacttttttgaattggcatagggcctgcattatttttggaaggtcgcctactcccgacgagggagtatcgatcagctgtgggacgacgaatctttgctgttcttcggtgggacgacaagctacaatttccaccatgcagagccaccagattcatgtaaactataaagtgtttacatgacttggatttttctcacgccagctaagcctgtcggcctcccccagttcgacaagtcacctattgagcaactataattcaatagggttctatttttgtgacttccaccaatcgagcaatatttctgtgattttcctttaaaataatattatttttaaattatgcatgttttaataaaaaaaatatgaaagtctatatacattcatcaaaactacagcatatcttttgttgtgcacataccagtaattaccatctaccacgatctaattcattatgaaaaaccaaaaaacaacatcaaggtaacccttagacctaaagtgtttgcatgattaacaatttccactctgaagagcccccagattcttatgtatcttttaggctcaatcacatatcatttttaatcccttcgtttgcagtaaaaagtcaaaaatgaaatttaatgtggtaccccatgttgaagttttgtcatcgacatattatatgtttttctgcaaaaaaaaagacaatgta

SEQ ID NO: 47672 - DNA, 14099 bp, Oryza sativa
agctgcatccaaatttacagttttactactataaaggcaacaagagaaaaaacaaacctccatgatggcagcagtctgcgcgaacagcagatgctgctctacagcagcgtagacggcctcatatctcttctccaacaatgccaatatcatggaccacgacacctgaaccctgcaagatccaaatcaaagagccttgatcaaaacaacaccctgtacaatccaagaattgaccagcaaacaaagatgctggaagtgagatcgatattcatgcacaactcaacaaacagcaggcaatagaactgaccatccgatgaagacaatccagttgtagacagagaggtagagcctccgcaagactgacgccatcccctgccattgcagagatatgtgagatggaggaagacatcgagattgctaatggctttgaccaggatactctactccaccaatcgatgtacaagcatcacactatcacagcatcagaagcaccaaaatacaagtttgagcatcttacagcagcttcttcgggcatggttggggattatggggctatgggatttgattaataaccatataatttggatcaaataagattagcagcacacagttggcagttaatgctactgcaactgccagctaccctgccaattccgtccttgtgatcaagatactttgtcacaacaaagaagggcagaacataataaatcatcagccgttgtttcttattgtgccttttcttttctcattttcattttcacctgtgtaaatgtaagccatattatactcataactaggtggcaggaaaagttcgttatctgagaggccacaagcttgattcaaaggtcatgtttttttaatcagtcttcagaaaagaagttcctttactatattctcaagaacagataaaacatatatagatttgttcgaaaaggaaatggttgagcagcacacagttgaacttattgccactgaaactgcctgccaaactgccgatatgattcatgtgaacatgtgatcaggaaatttcattgcaacagcgaaaagatagcacgtgattacaagtatacaacttctctttctcattcagcttcgttcttttcctgttcttcttcacctgtacatgtaagccatttcataagtatgctttatgcgtgaaagacatgtatagatgcctaagagctaactcaaacagctgaacagcttatactggatacacatcgatggcctgttaacatcaacacagttatcagttatgagaattaggaagaggagcaccatcgacaatttttcaagtgataggacaattgccaaatgtcgacaatgagttcaacaaacgggacagaaggccttcatccccagccggagaaacacaccgaaaacaacacagatccactaatttcatgcagaaattgattcacggagccttcatctgcatgttcatgcttgcactgtactggaataaatatttccctctaaaaacctccacgaattaactagattcagtagacgaaccaactgaagattcagtagtaagaacggtaccctcttaccccaccacatcggagccgccggccgcggccatcctcgccagtggcctggcctccgaatgcgtttcgaactcgtcggccggagactacgggcaagagctcctcgtcctcccgccacaatccactccgcgcgtcggtagccatggatggactacggagccattggctcgaacaggagaggaggagggagggggtgggggcagcacggctgcgcgagcgagagtctctcgccggcgcgccatggaggatactggctcgggaagccagagacggagaagaggaggggattgcgacggcgagcggcggcggcggcggcggcgggtctgccaacccatgaggctgacgtgtgggccccaccgcgccatggcccacctgtcagtaataccgacaatgggctccacgagacgttcgatcacagatgtgcggcacagatgacaaatttgactccacaccaatatgggctgtgggccgcgtgcgactggaagcccaagttatgggcctaaattctgtatgggccaggaatgctactgccgtatttgggcctaatgctgacgataggtagggtaattaggggcttgtttactttgatgtcaaaaaaaaccttaccaaaatttggcattgttgctaaaattttggcaacttaccaaaattttggcaggatttcttatgtagttaccaaaatttggtagcaaactaaatgtaaccattttttttttgtaactttactaaaatttggtaaggttgaaaatagcatctaagtgaacaggccctaggtttcttttgtacggagtatttattattttcttttcaaaaaggtgttcttttaagaaaattacttcaccgggtattttgagtgcacaaatagaacatgtatgctatgataaaaataaaagtggcattgtttgcatactccttccatcctaaaattgagcatcacggtactagagtagacccattaacaatagttgtgtctaatgtagtactattagattaatatatttaaagacggaggaaatactttattagtattacttatgagagcatagggggcacaatgctccaacagtttttcaaacaaaagatatgcttcactgcccttatctgctatcgacatcagccgtaccgtgttgaccgaaagtcattgatttttaccaattttggatcggttttcagtaaactagcgaggaacaattttcactttaaaaacgaaaaggtaaaccctgtctatacattggaaggccattttcattcaacagccaactatggcttaacaatctgcaaaaaaaaaaaaaaaaaaaaaaaaaaaaaaggctttacacatttgagcaatcggatgggtccatggataagagtaggaagaaatcaagaatgatcagacgcaattggctcctttcactgacagttactgcacatcaatgtaaatcaaatggtgacacttcttcttcatccttgaaaagccgaacatctaaacatcatttttcggcattgatatagagtagtacaattttttttctccggccgggagtacatatttttccttcagatgggaaaaaaaaaagcttatgtttggtacaacacaccattagcaagtcattcttttttaccaagggaaaagataatccgtgtattttagcatttccattctagtagtaacctttacttctttattcaggaaatggtagcaacctgagccgtagcttcgataagaaatcagattccatagctcttgagtagttattgttaaagggtatatgtgtcttttcatctcttgtatacattatatgtggtccttgaccctaagtcaatagtacacagcaaattccccaaatttatctatcactggtatcagagctcatgggctgaaccctatgtcacaccctgaagtttccccccttttcttgctttaaaaattggttaaataaattgcccgaagaaattatcttaattaacctagagctaaatccctagttaataaatgcaattaataatcggaaatagcgtggtggaatttttcttgagttccccatgctccaatgcattaataagatttttagtggaattttcagagccttggaaataattttaaccaattaaaaatcaccaaagtgcaattttaaatcccaggaaaaatcctttcttctttttctttttcttttccttcttttttctctattgggccgtcggcccactccctcccgcgttcagcctccttcctttgggccggcccgtttccctttcccctctctccgggacgctgacaggtgtcgtccccttcctccagccgcccgccccacgacggcaaccgccgccgaaaccgtccgcgccgccgccttctccgctccacgccgcgcccccactccgcgtccccacgtcgccgccctccccgccattcccgcccgcacgcgcgcccgcaaatgggcgggattcgatttgaatcccccccactctctctctctcccccacgtcaccggccaaatcgagggggtttcccggccatgtccgcccctctcgagcccctataaagcttccccgtatctccctctcccttttccccttttcgccgcgctctcccgtgcctcctaccgccgccgcgccgctcgccactagagccgccgcttgccgccacctccagtcgcgcgccgcagccgctagagccgccgccgcgccaagccgccgccgccattagcattgccgccgcgtgagccacctcggccgccgctcggtttccgctaaaccccaccggagcccggttctcctcgcacaccggtgagctatccattctccttcgtctccggccaacaatggtggccgccgtggtcactctctctactcctaatccttctcaactccctccgtaggtgccgccgccgcccgtccgcccctcctcatcgccaggtcgtcgccgccaccttcatcctccgctccggccgccatactcgccggtgaggatcccctcctcctccctcttcccctctctctcgtttgcgccgcctctctccacgcgctcgccatcgccttcggtcgatgccgccgtcctgtaccccgtccgccgtcgcttcccgcgccgccgattgccgtcgccggcgaccgtgcgcgtcgccgccggttgccatggccggccggccggttttgaagccgagccgagccgtgcctagccgccgctgtgccgtccgatcggcctcccggccgatctggaccgtcggtcccgtggaccggccgtggaccacccgcgtggtcccggtccacggtagaccggccaccttgagccactgcccgtggggcccacatgccggcgcccccttcctctcccctttgagccgctgacccgtgggccccgcctgtcggcgccgccccccccccccccttggatgacgtcagccctgggtattattgcgcaataattaattaaggactttttctttattagtaaaaacacagtttatcttctaaaattcataagtaattcatccgagctccgtttaagtccattcaagtctcagtaaatcaagaaaaatgcaaagaatccattaaaaatggttttgtttcctgtttcagtagtcttatagcatgttttgcttgtgtgctttgtttgtcgcgtaggtttcggccgtttcgtcgatccgtggtttctcgaagacgttgctgaggtctcatcagttcgagagcaaggcaagtcatgcaatacgtttgatcatattgtacccaatttaccaatatcccgcatttctattaaatgttgcattcttttacaatgtaatgtgggatgggtcctattcctcagccacatattggttaccttatgccattgataacttgggtatcaaaatgactagatgttggcttaggaaatgcttagccatgcttagttcaactaggacacaaatggggatcacattattacatagactctgactattggcataactttagattggtgccaccgcaagggtgtcagttaattaaaatattctgaatggcgggctgtgagtgtatggttttgctggtcgcacccatggcagttaaggaccggttcacgggaaaccctgggagacttaccgtgcttaccacaagcgggagtaggtaactgcttgatctgaagtatagctcgaccctttcctaggcaccggtggcgagggtaggcgtgatggagttgggtcggccgaggtgttcggttgtccagctgccggattcaccgcggcgcaagaggggaccgcccactgccttttgaggggtgggggtgaaatcttagcgtggtgtggatggttaggggagggttatgtggagggtcttgtcacgatttccccctttgcagtatcatggtgatacttcggggcatggcgacatgtgtggaatcgtgtcttgtgggtacagttgtacacctctggccagagtaaaactattcgaatagccgtgcccgcagttatgggcgatcaaccagattcaccgtgattagtctcacccctagtttagcttaatgaactggtgtagttcaggtggttggttgggcctgttgcaacgtggtgtagcgttggacagtgattggttaatattgattaattactacaactgttttactgctttcaactactgctttgaaatgcctgctttatgcaaaagaacccctagcttcctttggttatatcctgcatcatacctcatcttccggtatgacttgctgagtacagtgggtagtactcagtcttgctctcttttcccccataccagagttgaagttcttctcagttggagccgtctcagagaggttggtttcgtcgctgccgtcaaggtttgcctgtggagtggagttgcccgctgctgaagtcaagcttcccggtttagctcgcttttatctttcccgctgcatttgtaatcttttatatttttgtaagacgtgggtctgtatgtcaacaattgtcgtttatgtaccctggctggtcctggatagggatttaatgcacattcagcttagaaattctggttcgagaatttctgggtgtgacaccctagccctcgatccccgtcgtccgccggcgctccggcttgccggcggcggctccctatcgggcaaatcttcttcacgtcctcctcatccggatcagcagcgggattcacagcaagtcagtgtgattcgtccatcacgcgtgagtgtatcgctcattgcagccgctcgtcacgcggttcctccgctcagccgttgttgctgctcttccactactgctgccgctgtgtgctgctggtgctaattcaggagacaatacatcaagtcttgcaagcaagtctctgtccagtcaatttgtcaaattttcttctgctggtcttgatggcaacatccgacccctttcttggaggtggagctttgctctccacggacattaagctaaatggtcaaaattatcaagaatgggaactttcagctcgtatgcttttgaggtcgattggtcaagcatctcacctcacagatgatcctcctgatgagaaaacggatgcaactaaaattaaggcgtggaaaacagcagatgatcgtgttatgggattcatattcatgagtgtagaggtgcctattcggatgagtttcagggatcactcaaccgctaaagagatgtgggactacctcaaacagaggtacactcaagaaagcggagctttgcgtttttccttgctgcagaatttgcacaacttacaacaacaagatcagtccattgaagaattttataatgcctttactcggttgtctggacagcttgaggcacagactccaaaaggtgcttcaggttgtgcacaatgcaaggcgagagagaagcatgatcaagaaaatctagtgtatcaatttgtcatgagactttcctctcaatttgagtccattcgagttcagttgcttggacgtcctacacgtcctactatggcggaggctcttgcagatctaatcgctgaggagacacgtctttgttccttggacactactcctactcctgtggttactcacaatgtcatggcagcacctcagcgtgttggagctcctatgggcgggatccctgaattcagttccatcgccaaaagtgatcgtatttgctctcattgcaagaaggttggacatatttccgatgattgcttctatcttcatccagagaagttggctgattatcgagctaggcgtgcagcggtcccccgtcctcgtgcgacggctagtgctcctgttttcttggatatcactgctgctggtccttctagtaccagtgctggtggcagtgcctctagcgccgtctcatgtgctcctcagtcattggttgcaagaccgtcttaccaagccagtgattggtcatggccatcaccatagttggtccccaaggcctctgtcacgccccgaactagtaccgaccggaactagcccgtgacgctccaaattaacctgttaatcgataccagtcccaggaaacagtgctggtatcacaggaagacggatcatcacagcaatagaggtctctttattatagagtagaggtacagtcatgttgggctgcggacagatcccgagctcacaactgcattacaaaagggaaacggaagccaggacttggaccaaacaacacaggcgcgacttgggaactaggcagaaaccctaaaactcatcgtagtcggcttgctcctggaagaactcctcattagcaggttccgcttcatcttcttcagcaactgggggagggattatttatatagagcaagggtgagtacgggagtactcagcaagccatgggaaataagtgtttaatataggtttcaaggaaaggctgttgtttttgcaattgattttatttgaactcttttctgaaaacaactaagtgagtgcttctcaaacgacacggatgagacagtgcgtctcgtccggtcggagtatgtgcaatgtatcagtctttagaattgaaacaaggttggcacccggccaacaacttttcaaacggccacccgggccaacaactttcaaacggccacccgggcctagctgatcccatcagctgcagatctttcaaacatcgaacccctttccacaacagcaatttcacaagcaagagtcaaacaagactacgctaggaatcacctcacatccgcccatgaccgtgggcacggctgttcgaacagtttgttaacctctgcagagggggtacactttacccacacgacattactaacccggatcacccagcccgtggggattagccacgtcgggagacctccaagctttcatgacaaggcatttccaaagccaacacaggtttatcatatgccgacgagaggggtcccagaccaacaggttaggtcccagaccatactgtgccaggaagcccaggggtcctccccgacaccaccccggcgaatccacatgtctctcggcatcaaggctcccttgataagctagttactcagccaggggtgtcccattccacccatgtggtcgtacttgtcttatgtttggatgaaattccaaggaaacggtccttaagtgcaagagcgggaaaccgtacacccggtacgttccccggtccgcggttttggaaattcatttagttcgcaagcaccgacccaggtgtcgggttttccaagtcttttgtaaaacccaagttttacccaagttgttattcagattttaagtttggaggcgtccgtcgatacttgcacaggatgcacgaatatcgagacgcaactagatggttacaaggggacatgacataacaattaacaaggaaggatcaaatgcaacaaattaggtaggtccgccaatctgccttgcagacgggacaacagattaagtgcgatcctatcaatgcataatatttttcaagtaacataattaaatttcaaatataggctcaagatgttcaaaggtggcttgccttgctcgagatctggagcttgatcctcgaaatcctcgcactgcgggtcttcgggctccgaaactacacgcgaaacgggacaactcaacaaacggcgaaaataaagccctattaatgacctctaagcatgccattagatagatctcgagatttgatgaattttggaagttgaacggagtcaaacggatttacggttgggaagatattgaatttctaagattattggatttttggtctaaaggaaaaggatttaattaaatcctttttgaaaaaaaagaaaagaaaagaaaagagggagggaaaatagacttttcctcgggcggctagggcgcggcccaagggaaatggagcggaccggcccaaggcggcccaagcgcgcgcgcgggggaggggaggagggagagggccggtggaccgggctcaccacgcgtggtcccaggtgggagccgcttgtcggtgacacggttcaccgtgcggagcgagcacgcggcgcacgcgcgtgggcggggaagggatgtggtgcacgcgcgtggttcgcggtggaatggatgcggcgggcccacgcgcagcctcacggctcgcggtggaacgcgcgcatgggaggggctgaccggggtcggcccgacccgattttggccgagctggcgccgacgtggcgcctacgtggctgccacgcgggctggcgggaggaagacgaaggcgccggccgcgaatggacggcgggcggcggcggtttctccggggcgtcttgcgacgatgaggggtgacggggcgtacaccgggatgacgagggagaatgagagggagcgagccaacggcttggattcgccggagggagtccgtcggcggcggattgcggcggcggtaaccggcggagagcaaaaggggaaaacggcgacgaggtcacgaggggccaattcccggtggtgagagcatctacgcggctacgggaatccgttgctagcgtcggattgagcggagctacgccgagcgaggccggcgacgagcgggtgctacggagcacgggcggcgacggcggcgagcacacggcgagcggcggcaatggtcggggcggcgccggcttgctacggggaggctactcgtgctactaccgaaaactaagggggagagatggagcgaggagggagaacgaagggaggcactaccgagatgaggaggggcgctgtgacgagaggccgacggctcgggagtaatctctccggcctcgggccggggaagaggaaggagacgagcgcccggagtccccttccgcgtcctcgctcgtgccggctcctccgacgcgcgcaacgacgaacggcgacggcgaaacagaggggcggcaacaatggagtggaggcgatgggacaacgagagaagaagagagggagggcgcccggggctttaaagggcggcaatgtcggtttggaaaccgactttgggcggtcaaggcgcgagctggcgctcggcgctcgcgtccaaatcggcgacagggcggagggaggatgacgccggcgggaggaaaaaggggaaaatgagggagagaaagggggcttgcctccttgccgctttgggaaaaggaggaggggagcgggggcgtcgcggcagagggaggagggctctgcctccgtcccttggcggcttgcgcgcggagtggcggggctgaggcgatgacgacggcgatgacggcggggcggtgtggagcggagcggcgacacgggcgacaggcgcgggcaggcgctgacgacggcggcgaccaagcggtcggccaccacggcacgcgcgcgcggcttgcaacgggagacgcggcggtttgagtggcgcggctcgggcacgcgcgctggctgcggggccgagcggctgcaggcgcggcagggcagcggggccgggcggcgcacacggcgcaggcgcgacgcgggcgacgaccacgcgggcgcgtgcgcgaacaacggcgcgcgggggccgggttcgcgggcggggagctcgccagggatgggcacaaggagagcgagggggagggggcgctcgcgcacgcgcgggcagagcgaggggaagggagcgcgctcggcgcgagcggtcacgcgcacgcgcgcgggcagagcggaggaggagggagagagagagggagagagagagagagagcgccgggagggaggggggaggtgggccgagagagattcggcccatcgaccccgggggaggcaaaatagacttttgtggagggatttgatttggaaggatttggattcgggattgaactcgacgatagatcggggatttgagatctgagatggcatggacactagacaacaagcaaggaaacaatttcgcaattagggtttttaagagataatttttccgctaggcgccacgacggaacgggcgctacagcctctaagtgtgaggtcatcttcgcctaccacttttgctgccatctcctacttgttgcttttgcttgctgtttggagaaaaaggttgttgctgctatagtatatatctgtccttcagttcagttcaagtcttctgttatccgtcaaatctatccaagtcaatttcatatcttccatttgtctaagtgtatgagtcttttatatcatcaccaacaacaacagcagctcccaccggagctggattgtctcaacctactccaaatctttgaagagccgaagaacaatttgtgaaggcttcatggtaccaagggctgaagaacagtttgtgaaagcctcgaggtccacttcattgaggaggggatgcatctttcctacttaatcatcaagacttacatgcttcgacaatatctttaagcttatattttggttttagtttagttgtaccttccaaatgtattgttgtatacacattgcatttgagtgggggtgttaaagggtatatgtgtcttttcatctcttgtatacattatatgtagtccttgaccctaagtcaatagtacacagtaaattccccaaatttatctatcactgtaagagttatgtggtttttgcctttgacaaggccttcttccgctgggcgatcatatggtgaaacaagtatggaaccactgcattcatgaaatgaaacagcaaggcagtgtgccgtcaaatcctagtttttttttaaaaaaaaaagatacttgattatatcatcaattactaaatgaagtacaattgcaggaaataaaatactacctgggacataaaaagccatgaaaaagacattggcatagaagtagttgaaggagaaattccatttgttgggcatcctaaggcagtatttctcagacgcctgatattgctcatgcaaaagaaaagagcatttgaacaagattgttatcaaatgcaaccggagctcttcctttctaagttattcaaagttaccttcatgaaaggaagaacagtgtaggctaggcaaatctcactaaccacaccaacaggaaagcatgctatgaaggtgctgtacctgcgaagaaatcagtacgaaaataataagaattacttttaagagaattcaatgatcagataatgagtttcatttgaagtttatgctacatattagtatggtttgtttacaaccagaaccaacctaagccataagagccaggaaggtgtaaatccaaatgactccttcatgccatagaaagaatatctggtaacctgcaaggaatcagtaattcacttcattctctgaagtgaagaaaatttcataatacttgttcaactaagctcaacacaggaacttccaaaagcttgggattttctttcaggaacttcaacaactactgtcatttcaagaagcagaattattccttatcatcttataataaaatttcatctgaaactcatcgtcttccaagcgagtaatttggtgaaaagttttagggagtaacatatacctcaatgatgcaccagcatatgagcaaggaggtaacaaaaatataagactgtgtctgcaaaacatatgtggacagtgattcaccgatattgttcataaacaaaacaattacttgattatagaagttaaaatataggaagtaggaaagtaggacgcagaaggaaagagcactgttttatccttttccacgatgtagttgcatcagctttattacttatgccatttctgccgctttggtttgtccaatgcttactcagaggattatgatcataaatgaaagtatggatatttctaatagctgcaacatcacctaacatctacttcccccttttcatattataaaactttctagcattgcccacattcatatagatgttaatgaatctagacatattgcccacattcatatagatgttaatgaatctagacacatgtgggcagtgctagaaagtcttataacctgaaaagatagtatgttttattattttaagaagtgctttctagtccaggacttgtttttaagataaaaactatctaataacttggagtaaggtcctgatattacctcagggaagctccacaagatgccccaggtaatgaacaaccttccagtaatttgtgggagagtagaagacactggagacctcaccaacccttttcaacaattcagattacagtgataagcaatattttttggggtaaataattgtgtctaataggacatttcctttctctcctaggaagaagctaacaatatgatcttctcaaagttgaggcttct

SEQ ID NO: 47673 - DNA, 11678 bp, Oryza sativa
  unsure (1)..(11678): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncaaacactttccattctttacacccttacgttgctgctcaatcaggtcccatgacatgagaaaatctttaggaagctgcatttgagatttcgatttgcttactaatgcagtcttccttttttccacccaagttgtgacatgagaaatcgttaggaagcctcatttgagatttcgatttgctgactaatgcagtatagttttccacccaagttatgacatgacaaattgtcaggaagctgcatttgagaatttgattagctgactaatcagtttagtattaggcaacctggatgaaggtcatttatggtctgcatggatttccttctctttttttgtgtgcgtgtgtgttggggggggggggggttactctgtaaaggttataactgatcattaagttgctttctagccttcactgaattgttttgtaccacttgactctgtcgttaagatagtgtagatatctgcttcgatgtattgttccttagggactgtgctccatcccctgtgctcacccaacccttattaatctggtatacaccattaaagtacacatgcccacaaaagtaagtactagttaactacggagtagtaatcatcctcttaggttatctattatatttgcttaaacatttgagttttttttattttaggtaggcaactagcgaatacagttttaatctggaactatgtttaacaagccaacaattgttgtatacaactgcgatcctgcatttatgctctagattagattcagatctggctgtggctcttttatttggcacgcttgatcaaatcatcaaaagctgtgattaaggttgtttccattgctaatgtaacccaaatatctacctgttcatatgggacgtccgccccatggttagcatagattgatatccagtgattatgctattgagttaaaccgtcaataagtacgtgcttggttaaaattgcgcaacacaaaaaaagtatgcaccggactagggtagcttcatggtctggaattggaaatcctcatatgctcttttcatggtatgatgttaccggtctgcctcatggttagcttagattgatatccggtgattattctgttgagttaaactgtcaacaagtctgtgcttggttaaacggcgcaacacaatacttatattttacaaaagtatgcactggactcaggtagcttcacggtctggaacaagaaatccttatatgttcttttcatggtacgatgttaccgaactgcagtatgtaaattcggtggttcataaagcaatttcacccgatctcttgtgacgattggaatttcttaaccatttgaccatttattttaattcattgtcatgagacctatgatggtacttattttattttattgtttgctgggaataacttgtgttctgagttatgtctgaatccttattttgcctgatgcagggaagcagaatgaccatgtgaaggtttgaacgaacagtggcaagactaggctgtatttggactgaaactgtccactatgatgaatgtaagtttggtgaaagcagcagtaatttagcagctataattttagatttggtgtttcatgcgaaatttgacttggttttggttatgcatctgcttgaactagacaacttctccggtgtctgttgtcttgtttatggtaatttgtggctagcaatggaatcgttatggatccttataaatatgcttatattcgttggtgaagccacgggttctgtttgaaatggacgaattgcgatgaaactagataaaagctctgcgttttgctgcggaaaagttgtatcccaatgatatgaggtgcaaggtggatttgttccttttttttttgtagctgactatttgacaaaatatacattttgttcagtcaccccgaggttgaattcgcaccgtgtagaacctagacctcatcgttttctttacatctcataagccgtggaaaaactaacagaacaacaaaataaatttggttaaactttatatttgttcttagcgatggttttagaaaataaactacaatcagaaaaccttaaaattaactatatactacctctgttttttaatagatgatgccgttgactttttctcacatgtttgaccattcgtcttattcaaaaaatttacgtaattataatttactttgttatgagttgttttatcactcatagtactttaagtgtgatttatatcttatccatttacataaattttttaaataagacgaatggtcaaacaaataagaaaaagtcaacggtgtcatctattaaaaaacggaggtagtatatttcaaaaatcaaactatggatgcggattaataaggcaacaggcaaatggtggaaatttagctagaccgctaaagtacggtcagcctgtgtccacttctcgtagcatttttctttgggggatttgctagatttgtgttgacatttttttaagagaaaacaatcagattttgtactgatggatgtgtgttaacttccgtgctatcatgggctaagtgcctaagttcatggtccattcagatccagttgcttcttttaccgtaacagacagattttgaaatttgcatatgttccatgagagtaatgtgctctaaaaatttattactaagaaaagtgatcagggtagttctttgtaattttaaattgtaatttctctacttacatactgcaagtgaatatgcatgtaattttcttatctttaattattagtaatgaaattcaaatcagtattgtttttaagtcaagctatatcaacctttttaatcttgctaaccgtttaatgactttattacgtttgaactccatattatcttaataaaattctcttgtgccaaccgtgctctaaaaatctcctttttcttaaatctttttttttttgctccctgaggtgatgacatattttcagtgctagtgaatagtgactccctgcgccggtaaacaaaggcctggtttccccaattttttctatcaaaaacatcgtatcaaatctttaaacacatgcaataatgcaatatagatttaaaaacactaattgctcggttaggggagaaatcgtgagatgaattttttgagcctaattagtgtataattagccataaatgctacagtaactcacatgtgctaataacggattaattaggctcaatcgtctcgcggtttacagacgagttatgaaattagttttttattcatgtccaaaaactccttccgatatcctatcaaacatccgatgtgacatccaaaaattttcttttcgcgaactaaataggcccaaaaccgacaaaacacagttctccgttagtctttctgttcaccaatgtttggcgcgcggcatcttcctcatgtcgagtgttgttcactgggtgtggcggggcatgcctagagatgttcaccgttttctcgtggtgaattcacctattaggaagcaaggatggttacaattggtttttcacggggacataaataggagaagacatgcccccgtcaattttcgcgggggcggagatggtcctttccttgtccccgctccccgcggagacccgaataggggtccaagtttaatatgtccctgtcggtttgctgcatgcatgacaccgattacacctagttacaagtttaatatgcaaaatgactctcttggtgattttgagggtgattttcaccaacgtggctcgttgacctagtccaaccagtcgaaggcccacatgtcatctcccactatttccttctccacccctttctctccctcaccctatatatttcggctttggcgacaccaacagtgggtagcgcggcgctcgggcagtgggagattgaggagaaggcagcggtcgacagtagcgcaatggtggctaaggagctcgagggagttgtatggccccatgtctctcgacggtggcagagtgggtgacttatgggcccccacatgctgactcagctggttggactaggtgaacgagccacattagtggaaactatcctcaaaaccaccgagagagtcattttgcactggatttaatagtgggaggggggtcaagatatctggtattacggttaagggatacggatttgatttgacctatatttgagggagtcaaagtggatttattcctttagttttcacatggttgggagcttacgagctcatgagcgctagtaagaagcattttgcacctataaatattacaaatttttcttggaattttaggcagaatcagcagcagtttgagtagataagagtttagggaactttcagaatatatatgaattcctgctcctcaccatttgttgactcataaatttcttcaacattacttctacgagattatgtatccaaaaactggttaaaaacaattgctccttcaacctcacccagtatataaatttcaaaacctttcagcacatgaattgaattcctaagccctaacaagtaacaagtaacaaccacccctccaaaccttgatctcttcaaggagataacaaatagaatgttaatatatacatgaggataacatagccttccactgtagaaacagctagaccaacaaaattagggggcaaaataaaaaagagagagagtaaagtgcataggatctaggccccgaaactctcaaaatacaaatccaagtaccggaacttgtcatagtgtgtcatctaggtcccaaatcgccacaacccctttatgatcctacgaggcgttgatgtggcatgccacacggacataacgcgacattatttttttcttctcttttttccctttcttctcctttctgtgacccgtgcaaaagaaagaaaaaaataagaatgagaagaaaacgaaaaagaaaagaagaaaaaaaagagaaaagagcacgtcatgtccatgtggcattgccacatcagcgccacataagatcctagaggggatgtgtcaatttgggacctagatgatatactttgacaagttctgagacttggatatgcattttgagagtttatggacctatatgacacaaccctataagtttaaggaccgccaatgcactttactctggttaagcatttaagagtttagggacctaaatgatacatccctacaagtttaaggaccgctcgtgtactttacaaactagttagactcaaaatttccaacctgaagagtgaaatctggccttgtttagttggggaaaacttttaggtttggttgtcacatcggatatacggacacacattcgaagtattaaacatagtctaataacaaaacaaattatagattccgccagaaaactgtgagacgaatatattaagcctaattaatatgtcattagcaaatgtttactgtagcgccacattgacaaatcatgaaataattaggctcaaaagattcgtctctcaaattagtcttaatctatgtaattggttttttttcctatatttaatactccatgcatatgtcctaatattcaatgtgataggtagaaaatttttgttttgggaagtaagcagggcctctgtcagaagcttgtcaaacacaaagtctgccaacaggttccccaagtgatcagcatccctctgaaaattccttgatgacttttaagtgacatgtaaaaataagaagatatccatttaagaaatgatttgagttttctggaaaagtggcacttatatgccgacatgccgtgagcatatacatgccggacaaactagtgtgtccgtggcgacgaaaggaaaattgacattgactggaatgctaaatgattaagaaggtgtgttaaggggattaagacttaaaacgagccgagtattaatatatgattaattaatcattttaaatttgaaaaattgattaatatcacttttttaaaaaagaaaaacgaagctagcacctcctgtcacgctgtgacctcccagagccggcgagctcgagctcgtctggtgttgggactctggactctggactcgtatgtaggagtggaaaaataagcttgggctcgtgagcttggctcgagcttggtgagcttggctcggctcgtaagttaaacaagtcaagcccaagcctcttatttagctcgttgctgaaatgagtcgagtccgagctagctcacaagcctaggccatcatgtgtttatatcgattattttttaagaagttattatttgtcaacttaaaatttatcattaagattttaaataattgaatatataaacttatttaaattttataggttgatgatttgttcttgttttttaataattataaaatatatatgaagaggtgtttcaacatgaaggcttgcaagctagctcaagctggctcgagccaggaaacgagccaagccaagcctagcttgttgcgagtcactacaagctaagacgagccaagctcggctcatttccacccctactcttttggtgttggctgttgggactctggactctgccgaccattcttgctgtgcacatctagaaggagatttgactgaacagggagccacttcgccgtcacaccggagggggggggggggaatttaactatttaccacttttagatttgacaattatccaaatacccttattaggtgtgcagttatttttttttccttcttaagagatggtctcttaattatttgccacttttacctacgtggtatgccaacatggcaacctagattgaaaaacggtgtgggacccacttgtcagtctctccttcccccttcatctctcccccacgcgtccacagcccccatggaagccaacactgttgccgccgaggcgccgcctcatctgcccggtccaagctgcagaggcgcagacctccactccccgctgtgccgccatcgacgccaacactgctccgctgccccaccacgccaacgtcgccctgcaaccgaccactgatggcaccgctcgcagccgacgctgtgaggccccttgctgcctcccaccattggaaccctaccagacgctgcttgggccttcgacgatggggatgacgagaaggaggacgacgccgcaccgctgtgctatccccgtgctgacaacctccacgccgctcgtcctcaaagacgccgaccttctccccatcgacagcggcggctaccccaaatcctccctatcaaggacggcgccacaccgttgtgctgtccccatgctagcaatctccacgccgctcgtccttgacgacgccgacctcctccccacgacagcggtggtcaccccaaatcctctggcgcgatgttacagacgtcgtctcgcgtcttcgccgcgcaccctgggtcgttctagtgcatccgcccgtggtgacgacgctcctccttttcatctccctcgtcgtcctccactcccacctctacttgtctgtgaggctgtgccatcggtggtcgacggcggggcggtaccggcgtcgatgggggaccatggacgtggggggagagagagagatgaagggggaaggagagactgacgagtgggtctcacaccgttcttcaatataggttgtcaagttggcatgccacgtggacaaaagtaacaaatagttaagagaccacctcttaagaagggaaaaaaataactgcaaacctaaaaatggtatttggataattgccaaacctaaaagtggcaaacagttaaatttccctaccaggtgtcaccgccacgtgctcgagaaggactgtatttccgctggtttcaatagctgttttacagctaagttttttttttgactaaatcaccggggggggtgagaatccccacctgaatggcaagctttacctacgcaagcgcaagggccctggaggataggagaacagaatacacggagaatacaacgaggagagaacagagaaagaaaacctcctaaaagattacaattgatgaatgacacctacaaaatcatcttgccaaaatccaaaacctactgctaaaccccaacaaatcaacatccaattcctcacacagccacaagcatgtcggaagaaaagagaggccaagggaatgttgttgaagtccaaggccacccgcatgaagccatcaagaagctgacttgatcttgttgctgtttgtatcagagctcgccaacgcccttttggggaagtaagccccaaaggagggtgggccactaaaggttgcggctcgaggccacccacattaagtcttcttcaatcaggctttatcaagttgcttgttagatcaactctctccaacgcccttcaagggaaggaagcctcaaaggagggagaaacactgatccttgcggtcctggacatctggaggaagagggtgaagacgagcaggggctaatagaaggggaaatggccaaggggattctcacagaggaagaacatcaacgacaactttggaggagggcatagaaccactgtaatccaagcggctacaggagcacaatttccaaacaagcacgccagattgagaagaagttgaagggcaagatcaccagcgatgtttggaactaggggggagagggcacacaaacgaggatactagggggaggggaaggagaagaggttgctatccgcgccgcgcgcaccgacgagtggggggtgggggggaggtgtggcgccgacgaggtcgtgcctgcctgctgccgctgcagcctgcgccgccagccgccaccgggtccagcgctccccgccgcccctttccagacaggccgcgggagggccagcaccgtcgcacccacttcggcctctaccttgctggccgccagcacaagcgccgccgctccgcctcctccgcgccccgtcacaccgccgtgaacggcagtgacgctcgtctccggcggtagggcgccggatccagccacgggggtgccggatccgaagcttcgctctgcgccgtcgccgtcgccgtcgcccgcccatcgcacgccgcgtcgtcgtcctcgcgcagagccgtcgcgtcatcgccggaggaaaggcctcgccaccgccctcacggctggccgcacggaactccggcggcgcgctccggcggcggcgaggggtgggagagaaagggagggggtggcgagggctagggttcgccctccgtgccgctcgcgagagagggcgacgtggaggtcagaaaatttagttccgtaagagtggtgatttacagctaagtgatgtaaaggaaattcgatccataattgagggacaagaagtgaactttttccaagctctgaacatatggattgcatttcgaggaacattcggcctgtttggttggaggaagtttttaggaggaattagaagttcagagggataggctattaactattttgtttggttgggagacataaaaattttagtggaatggagatagagaattgacgaagaaactctctccttttcaatacctgggtaggaggtggtaattgggagggattcctcctttactttgcctaaacaaatctcagccatccgttttcattaatgacttaatctccaactaaactccctatcaatttccattacctctaccaaacaagatattgggattaaaaatcaaattcccctcttaatctcaccatcaattccctcgtgtaaactcccaatccccttcctcgaatgccaaacaagtcgatttggattgtatttcgaggatggaaaaagtacatcaaatgcccctcattttgtcatcggattacaaaatcatcctccaaccacaaaaccagatactccgtatttgccatccctcatcttataaaaccgaatcactttgagtcctcgggggttttgactctggttttacccaacgcgacatctgactcagcatgggacccacacggatcctacccatcagcctcttctttccctcccctctccacctctctccttccctctccacgggcggcggcgggggagcagctggccacgggcggcggccggcaggggagcagctaggctcgggcggcggggtgaggagcactagcaacagcctctgatggcgtggcgacgcgacgacggcggtgacacgggagcaccggagcagcgtcccgacgaagccctcctcccgacgctgcctcctcccctccccttcccttattcttatccaaaactgcatcgataaatggcggatggtgttgcccagctgggccacgatgctggtgacctcgaaggagaagaagttgcgcgcgtatcctgtgaagagggattcgaggtccgacttgatgtcggtgagcacctcgtacatgccgagcatgcggtagagcttctccgtcgccagggtggacatggccacgcaaagccgatgagcaggatgaatcctctggcgatgtcggcgaagcactcgtggccgagctcgttttgttcatgtggatgtgtatgttcatagatcagcagacatccgtgtcctgcatgcacaatcaaagtagtatttgcatttggcattctttgctgcagaaaagcttacacgaactctttgaatcgccatagctgtagagctggtccctgtagttgtttataggcatagccccggcgacgcacatcccttgctggtgacgagaattatggcgatcccctgaataatttgggcgggggtgacaggcgcagccgccgcgaccaaccaccgccgtggctgcggggctcttcccgttagagcggcgcggaaggcggcaacaagaagatggtggcaataggtgatgaagatggagacggagtccgcaagggacaggacgccagcaacgaggcggtgatggtcagatggtggcggtaggtgacgagatcaggctcgacgccgtcgtccttcatccgtcggagttggcaaggacgggaaggagctgcgcgatttcccgggtctccgtggtggcagacggcgtcggagagcgtgagcagcgtggcgacggtggggtagaggggcctgctcgcccgcgcgcagcttctccccccgccgcctgcgcccagatgctcccccgcagccagctgtcacgttgaataaaaccaaaactaaaaccgcctataagatgaggatagcaaatatcaggtataagacgagggaccttcgatgtacttcttccttcgagaaacatgaaggaattatccagcccactgaggttaaacacgatgtagagttgtagacatgtggtacacaaatccatgggctcagcccattttgtagtgtattagtccaagcaggctcaaagctagattctttaccagcatgaacttcagatgaagttcgtgtagccagcaacatccaagcaagcaagataaacatccagtgacacaagtcacattaaagcaacattcaagcaaaaaagcaaaattagtataccaactcactagttcagtttcactagatagaaagcatacatgacacacagcattgcattcttaattacgtacacaccacaagactggagaggaaggactatcatcgtacagacgccatagatgtctcaaaacatctttattcttagcacttattaactaggatgcatttcttcagtctcaggtcttagatcacaaactcacagaggaaacacaaagttacagtgacaacaactcatcactcgtaactggatcatactactagattagcagtactaggtccttccatctccttggtttcctgatcaggaggttgcttgcttcaacttg

SEQ ID NO: 47674 - DNA, 1503 bp, Oryza sativa
ctgtagctagcgctgcaattttgtcatacgtacacgtaaaatggaaggcagtgagcctctcaacaaaatgttttgtacttttgttctctgtgattcagaaggggaaaaaaggcaggaaacatatgataattgacaaaagaggttggtagctagaaagatggaggtactcaattctgttctattaaagtatatatatggtagttagagtaggataagattgatttacgtggacttcttccatatccgtaattctttcttatctctacaccatgtacttctatatatagtgatccctgagactcaatacaacggtgtcaataatcacaatatttccctctccttatactattcaacaaattcagtaatataacacatggattttgcccatgaacaacaagtacaggatatgaagaaggaaaggattagtgcacataccccttggaaggtgcaacacccatgatgacagtctgggtggtggtcacctcctcagccatccccgggtacatcttgcatctgcatgtacaaataatcaatcagtttcccaggcaaggatggcaagactgctctcgcccctcaacgtacgacagaatttgccaccaatttcagtttataccgacgatgcggttctgtttttccgccctacagctgaagaagctcgagtcatcaagggtatcctggagttgttcggggctgccacaggtctcaaaaccaatttctccaaaagcgcaatcactccaatccaatgtgacgagcagcagtatgtgcaagttgaatccattctctcctgccgagtggaaaagttcccaatcacttatctcggactccctctctccactaggaaaccgacgaaggccgagatccagccgatccttgataggctggcaaagaaggtagccggttggaagccgaaaatgctgtctattgatgggcgactgtgcttgatcaagtcggtcctaatggcgttgccggtgcattacatgacagtcctgcagctaccgcgatgggcgattaaggacatcgagcggaagtgccgcgggtttctttggaaaaggacaggaagagatcagcggcgggcattgcctagtctcgtggcgaaaggtttgatcacccatcgagaaagggggacttggtgtcaaagatcttaatttgttcggtcaagctctccggttgaaatggcttgcgaaatccttggagcagaaggatagaccctggaccttagcagctttccgtcctggaagcgatgtggaagagatctttcgatccgtcgctgagcacatcattggtgatggggtggacacacagttttggacagacaattggacagggaaaggttgcttcgcctggaggtggccggtgttgttttcccatgtgagccgtgccaagctgacagtagctgatgccctgattgctaacagatggattcgccgattacaaggtgccctgtccaatgaagctctgggtgaattcttccaactttgggatgaagttcgcgacgtgtcactg

SEQ ID NO: 47675 - DNA, 1386 bp, Oryza sativa
cgtcgcgtgttcgcttcttcatgtggattgcactgaagggccgctgtctcacggcggacaacctggcgaagagaaactggccgcatgacgccatttgctccctatgccaacgcgagaacgaagactgccatcatttgcttgtgtcctgtgattatacggcggctttggcgcaagctgagacgttggtgcaacattaacattgcaatcactgcggaagatgtcaggccgcttgcagattggtggatcgcgacaagacggcgttttcagaacacatacaggacggatttcgatagtctgttcatgctaatttgttggcttatctggaaagagcgaaatacaaggatctttcaacacatcgccaagttggttgaccggctagcgaatgacatcaacgaggaaatcgcaatttggagggtagcagggattttttcccaggctagcgagtaatcccgatttgccccattttttccttttctttccgggcttgagtttgcttgagaccggcgcgacatccttcatgtcgttgtaattaaaactttgtttcccccaatcttaatgaaattgttgtaattaaaactttgtttcccccaatcttaatgaaattggccagcctactttggccgtcccgacaaaaaataatcaatcagaaattcagagcctatttcttgtctgttataagaagatgggataaaaaatgaaatcagatcctcatcagtcatctgcatgcatgctcctcgttttataacggtggaagggagctaaatcaaaatctcctatcatgaatcttttttttctctcaacaaagaccatgtcatgcatggccatcatctaaaaaaagatttttctatcatgaactttttcctctcaagaaagatcatcatcagatttggccaccatctaaaaaaagatttgttcacagactattgagtccataacatgttctattatccaaaacaaatccaaggagaggcacacatatgacacatacaacatgcatgtcatgaatacataccaagatcaacaacatggacaaacagaaatcctctacagatcacagcacacaaaaaaccctagcaaacgaacaatatcccttccgagatccaacgaattttcatctaaccaacaccaagactagacagttgatatacatggcagatcaagaacagaaattcagaagatggtgatcggatcttaccctccgcagccgctgcgcactggcagccggatccgcagccgcagtttcctccgcagcacgacatctttctttcaaagatcaacacggatcgatcgaactgggcagtgggcactgatcgcacaacacacgagcactcagaaaatctgaatatcaccttgggcacctgaaccacacacaggagggctgcagga

SEQ ID NO: 47676 - DNA, 8602 bp, Oryza sativa
ttcttaagttagcaatcctatgcaagtcttcagggagagcccttagttttgggcagccattaagaaacagacgcttaaggcaaggcatcagaacgagctgttcagatctaccacgcaaattccctgtgttaagagaccaactttccaaattgctcatatcaatgatgtgaagcaatttgagctttgggaaaatagttatatgcgtggcactgctgacgccttttcctaggagctctgaaccaatattcactactgcatctgcacatctgatctgaagaattagtagttctggcatctgacctgctggtggaagctcagagcatgaaatgcactcgttgaggtacatatgtcccaaatttggcatcttatactctggttctgagcacaaccaatctgggaaccttacaccaggaaacccctcaaaaaataaataaattaggcttgatgatggacttagcatctcatagacttgttgaattctctcaatctcgttcatctggtagtgggtaatatcatgagtattagctcccattgtgcagcgaaaccacagttctcgaagacgaagactgttcctgagtacaaatgcaccccctggcgttgctttttctagctttacaatccggagacgttggatgttggggagacattgcagttcatctagcctgaatccagatgcactctcgaaaactcctttaaggttgtagagtttctgaaacttcgcgatcccttttggaacatggtcgattccagtttgttctagctcaaggaaacttatgttgacagtctcatcaaactagctggcaggctatccaaatgtctgcaacagtgcaaagaaaggtattcaaggctggtaagatttcctatggattcagggagttttttgatttttgtatagcttagatctagcaacctcagtagcaacaagtttcccaccgactctggtatgacttggatgcttgttccactgagaactaagacacgaatatgcttgagctctctgaaaatgtccttattaattgtcttaaagttcttgttattaaaaattaggaggctcctcaagcacttcagctcttctatagcaggtatttcttttacatcattgttattactaagtgacgtagattcagtaaggttttgctattttccatattcatgaataaggaatgatcctttgtcaaaaattgtccaagtgacctcaaaagatcatgcatcgttgacatccatttgtcaacaaactctggttttggctgcagaagattcattctaattagctcatggtagtattcttctgcggcttcatgtattgagtacccatgcattttcgtcacaaagccttcagcgacccaccagtaagcgacagcatcacgatggatcccaaaatttgatggtaacaaagcacaccagagaaagaattgcttaagttcaggaggtaagttgctgtagcttaagtacagaggacctcctagttctttgggaagtccatgaatagaccatttgctatctcggatgctctcccattctgcctttgttttcttactagataggacacctgcaacaactttgatggcaagaggaaggccatcacactttttgacaatttgatacccaacaccactgaattctcttctttgctcgtatggccctaatgacatcttcatcagcagttctaggccatcgtaatcattcattttgtttaccctgtgggtataagttgcatgcatttcgaccaaaacatccaggtttcttgaggtcacaaggatacgagaattcaagcctctctcggaaggcgatcgaagaagatcaatccatacatcagatttccaaacatcatccagcacaagaaaaacactcttccctctaatagtgtccactagaagcggtagaagctcagtcttagtctccagctgatcacaaattcctccagccattctgattgcctgttttaacaaactggtctctgtgtaattctgagaaatgcacaaccatatatgaacttggaatttctcccttatcctctgttcattgtatatcttttgagctaatgttgtcttaccgatgcctcccatcccctggatcccaaaaacagttgacctgctttcattgtagttactactaacaatcattttgacgatgtcatcaatagcccttctgatatcttctccaaccacctcaagttcatctacaggagatgtctgacttctgtcaacaattgttatctggatttgttgcccgttggttctctccaagccaaacatctctttgttcattttaatttcttcaaacttttcatttatattatcaattcttttggcaatcatgtgatcaaatgaaaactttgcaaagctagagaacaagggctgattgcaacataccggccttggtggcagcaaaaacttctgtgaatgaaccatgaaaagatctacgatgtcatcgacatcaaacataacatttctcatgttcttccaccatgaatctatccctggatcctccatggccagagcctcagcatcctcacgaacagcgttgaagaattccagatttttcttcaggctctcaataccccttttcacacttaatgtcatgataacctcatcctcaataagctgacccagcttttccaagaatttccaagcgagagcatccaaaactgtgcccatagtgctagaaccgggattcccgctggatctctccaatgggagatgcttgaaactgcagatcccagaacagatatctcacagagctgcagatcacttaaatacggaagatggaaagagatattgaagcagtgtggctaaagcctgatgagaacggagagggcaatgcagattgcagaggagagctgttatagattctcctccctttcttgccaccaactgcctttgtcccaacagacattgacattctctattgcaaaacgtctgaaaaacctgaaaaaaaaattaaaatagtatgaaagtactttttgaggcagaatctgcccataaagatttttgtattcaaatctaaatgtttcaacgatgatgcaatgtgaaaaagggcaagtagtgttacaaaattgcaaggcgattcaagttgaaagctcttccaggctgtgtattcttttcctttcatccccttgacaataataatttgattttattgcagcaaaggagccacttggtgctttactttcttttcctgtttaccacctaagaagcctggaagcactggagcagagttctctttttttcaggaatatgcaacaaaaaaaatatatttatattggcattaaggttgggtaaaacaaggttcagagaaaatgatacattagatcaccagagtgcagacagcagaccgaaggaaaaaatagagtcaaacaggtgctggccggtgctgggcatgcaaccgcacgcaggaatctactgggcatttcgtcaaacagctcatctgcgccccaaccatttgttgcaaagtccaagtttcagagcttagagaaaacatcgaaaggaactcatcccattcgcatcagtcgcgttgcacataatcaagtcagaaaagaaaaaaaatatgatggttgattacctacgcaagaaagagagatgcttctcctagcgaaaccaaagacggcgacaacgacccacaagcaaagataagcagggcctaggtcgaactgagcctggatcaggatcacatcgcataactccagtataaacaaagagcaaattctctgattcatctcgcacgtaacgtaacgtaacgaatggggcgctcggggagagcgatgcgcgaatggcgttcgatgaaatgcccctccaagttcaacaggcgcgtccaggccaatcgattttgttttactttctgaattgggccctgtcgcgaagactgcgacctgaattgggccgtaagcccgtaacctaagctctacgccgaaggaaagcccaaactctaaaaactcctccaccaccgcgcggcgggaaacccgctcctccccactccgttcccgcgcacattttttcggcatcccacccgtcgattttttccggcatccaacgtcgtacatccctccacgtcatcgatccgcgccgcgtgccttccaccaatcagggcgcacgtcccctcctctacaaaaccatcttcccccgtctcctttccccacgccgcaatctcgcgaatcccaccgcttccctttcctctcctctcctctccccgggaagaagacagcagcggcatccatggcgcccaaggcagagaagaagccggccgcgaagaagcccgcggaggaggagcccgcggcggagaaggccgagaaggcccccgcggggaagaagcccaaggcggagaagcgtctccccgccggcaaggccgagaagggcagcggcgaggggaggaaggcggggcggaagaaggcgaagaagagcgtcgagacctacaagatctacatcttcaaggtgctcaagcaggtccaccccgatatcggcatctcctccaaggccatgtccatcatgaactccttcatcaacgacatcttcgagaagctcgccggggagtccgccaagctcgcccgctacaacaagaagcccaccatcacctcccgcgagatccagacctccgtccgcctcgtcctccccggcgagctcgccaagcacgccgtctccgagggcaccaaggccgtcaccaaattcacctccgcttaggcttcacccctgcatctatctatgtgttagttttagtgctatcgatgattggaaaatggatgttagatcgttagtttggtagtcagatgtcagtgatctggaacagtagctctgattttaaaccatgtgaatgtgattcctgggtatgtgatgtttgaccgccttgtgtctgctggtcaacgagtgataactagatctaatttttgtggaactatttacatggttgctacttgcattctgttcaactgttgtaaattcctctgtcactcgttggagttttattctctggagcatgtgtggaattgcctgggcatgcttttgggaaactatagtctgtagtcctatgttatgtttggttaattggttgccctgagcttgttggaattaatctatgtataattttgtgcaattacatcctgtgagtatgttgctatttgcattgtcttgcaaactcctttgtatgccacaggaatttaatttctggagcatggatgtttggagtttgatactgttcaagtgcttattggcccatgtagtttataagtacgagtaggtttcatctaaggacactttctaaaagaagagttgtgaattggttagtatatagtatgacaacttggccatcaccgttctattttagctgataactttgacatctgaagtaagttttgctttaccttagtactgtactgtttcaactttcaaagaagtttaattggaaatagtaactgaaacaccggaaccgtaagtattttgcttgctattgcaggatgctgctacactagcctgtttcctcatttatgttccgaaggtctaatgaaggttctctctttgttcttgattagcttgtaagctaactggcaagcatgaggtatgcactaaactgctgcatcttctatcaaagcttgctgttggagttgttgctctgcaggatatgccatgtgtgaagatgatgaccaaactcttgtggactctagaatcttataatgttatcctttggttctttgtccaaactcttgtggactctagaatttttattggtattgtttaattttgcattacagtagtagccagataatatggtgtttcattattaaaatttattaaaggaaacaattttaaccaacttactaaactatcacatgttcaatttgtgagtatctcatgcaaaagtaatttattgacctcacagtgcttacactctaaacaaagttactaaacttttacttttggtaatataagtactattagatttattgttgtaataaaattacttgctcatattgctattgcttaagtgctacttcgcagtttgtataggaaagctaaaaggatagcagaagaacttgagaatgtccattaactacctgaaacacattatctatgttgtatgtgtaaaatatctatatatttataaaaaatcattttaggaacaatttctacaaatatgataatataaaattcaacttatattttaaaaaatatgcattctagattttctctattttaaacttatgcttctttctacaatgcaagtgatctaggaattactactacaacatagtgtatcttctagtttttacaacaatatgttgacacgccaatccactacgccattgttattgaatgagaacttcttatgttgaaagacatgattcactctttgtggaaaagtaaaaaactatgtatcaatattgaaaatttcttgggatcccccagtacatgccccttgggcctatttataggcttagtgcaggctcatgtgccctagggttactaagtacatgggaatttacatgattacccttacaatagggacatttatgaggataattatagacaatttatccttgggcctcttcttgggccgccaagtgggcctccattggttggttggccccctcgggccttgaatccctcggcttgggggcgaaggtcttcggcttcgctcgacgatttgcccagagcctctgtctttgtgacatttggcgttttgctgtcgtgcttcgtcctagcgattgtagacttgtttcggcaggctcggttgaaggccctcgtgacatgcctccaacagccatgctacgcaccatatcaatttttaagtacaggaacaatcattcattcatatgatgcataagaaattaacagttatgtgactttgaagaccatcaagagcttgatcgggatctgagccaataaaagcattgtggacatctaaaagcttgaggcaaaaattttggccaacctaaaagcagttcatatgtttgatcaagtttaggaatgtaccttgagtgctttatgtttagcgatgcattgataaaataataaagatcaggcataggggtgtaagtgggtgttaacgaaaaatccgcgctttgctaatggtgccagaattgtattggcgcgaactaagtcgacgaacataacggccctaggagatctgtttagctctagtgcaggtccaaagcttgtagagatgcgggcatgccagtcagtttgatcctgcaactaactagatatataaatatgttgatcaccaaagagctgatcggctgacgagtcgatcgagcgatactagccgatgccgatagcaaccgatgtcgatagagttttgagcaatcgactatatgtccaatgtagagtctgatacttgagtaaataatgatataaagataattggctgatgataatgtaataaaacaacaatataatccaataaaaaccaatcggctaacaatgatatgatagaataagtgacccgatggttaaagcatacatcggctagtggtatgatgtcattaattaaatccaaatgattagataaacagtgaaatctttgttacaatctgctaaaaacaacttgtatgcaatctttgtaagccgatacaacgtctagataactcattggctgaatcctcgatgaaacccttattataatcaaagacaggttagcgtttaggattctaagcacgactagggatgatgcatcgcaaagtatgcaaagaaacataaagtctaaacaatcaagcctttgactaattttcagggtggtggatatcttagttaatctaatctagcaagatactttagccgataccagtataaaacctaaaacgaatctcagccgatatgatcaaattaagatgctaaattagattaactaagatatatgataaataggtaggcaaacatatcaaccgaaccagagcaatccaagaggtcaaagctatgcagccttgaaccacgccaatgtagccaatacaattgccagagctagcagaacgtagtacttaccccgtcggatgataagtaaaaaccttggtaaagagggtggcgatgcgccgaaagtaattgtattgatcgagagatagtttacaatgtctctgggtgtacatatttatacccatgggtagatactagtccttgttggacaagaaaaaaacattcctaaagataaaaggaaaacataatgtccttatcggacactaaacacatttttctaaagataaaaggaaactaacagactctttctaattaatagataacttgccatgatgcatcatccttaaactcggtcttttctggataagcttaattgaatatattaattttcttaatcgaatatagcaagattccgactattggcgacttgatagtttccatcggccgattataggactctgaaaccgatactgactctaggccgatgatgacttcggggcttgccaaatttcactgtttacagtgggtcaaccgtgaacccacttataggtcaaaataagcaggttcgtggcttattttagcctataagtgggttttgtgggctagccacttacacccctaatcaggcatggacgagaagtttatatctcattaagaaccacattttcactgtcacctgcagggatactattgatctgggtaacaga

SEQ ID NO: 47677 - DNA, 3196 bp, Oryza sativa
ctgcaccccgatccaatttttgcatatgaatttaatccactctaacatcctctcaaaaagtgaactctaatataattacccccttctcttcctttacttttttcccccttgactcctattgttgtatttgaatcctatctttctataaagttaaagcccactacatcttaagctcaacatgcaaagatgctatatcatcactaacatttactacatctcaaatctcatgtaggcatgctaatttattaagttttagagctttaaaatgcaagcatgttaattaaattattatcccacataatccacataatatttcaatatacctctccttcactttttataatatcctatatgcttatatagttaattaaaattttagagcttaaaaaaatccaagcatgttaaatcatcatttcacataattctcaaaatatttcaatatatctctccatcattttgtataatatctatataccaatacaattcattctcacatagttaatgttatttctttcttctttcattaagctatatcacctcaattgtttctaacgctcaaatgattaatttatggttggaattatcttcctcatttttttctttcataaagccacatcatattacttttaaatttgggtcatcattctgtatactatttaaattattataaaccacatcaacttatgcaagtttctatcatctagctatcttacacattatttatatttcttattatcataccaaactcccgcagcaacgcgcggggtttcatctagttatattatattttactgccatacctgtgccttctctttcttactgcactgaatatatgaaattgaaattgaggccacaggaagtttgtatggctgaatatgaggcacttccaagggttcatcacccttgtctcaagagttcaatttaagtacaagcaaaacccactatttaagccactaaaagaaaaaaacagaatttaaatggcacaatcggggtaagaggattattggttatgtcaccccacataactgaaacagatgtacttcgatcgttgtttatcacacccagttcttgcatattccaagtttaacatgttgatcgatctgaagtcctgaaaagtatttgtattgagtactgggaacgtctattggtcatgctgttcaagatatttacatggaggagcccaacggacaagaacatgttcaaaaactcgttggatttgaaatctgcacaagctctcagaggctgctcagcctgaatcagtcttggagatagcatcacactatgctgcaatcgaggcagcatttacacccaccgttcttacctccagcagtggcaaattgatgttagtcttaaccttgagtcaggcaacttcacctgaagggatatctagttttcgacagtgctgaccaagtttccaaatttttgcatttatattaagctgatgaattcaagctataatctcggaaacgatgttgcttccttctgttaggactgcaccaagctgcatttaccactggactgcattttgaataccattggctaccacttaccacagaaattgaattgttttcctgtaacatttcaggtgcactagtatcaccatttccttaagtgcgctccactctagtactgcaagaagagtgacaaaatgattaaatgaaggatattttgattgtaaatagtttaaattatgatgtctcggtgcaatagccagaattacaaaaacaaaagataaaccaaaccatagtacaaacagaatcaaaggaaaagatcgagactaacaaataaatgtagtagaacttcctctaataatttgtagagtaaattgctcacctgcctaattatagagagattcatctggaaagatatccctgccatctgcaccaactgtaacaacatggacggcaagttgttggtcttccaggaggctcatcctgaattgcttcgcgttgtggcaatcgaccatgtagagtctctttagtgagattagattctctgcctgatacagcgctggacagtcctgcgcaagcaagtcctttagattacagagattggaaattctcctcaaacacctgttgttcttgaccttgagccataacactgaaggaaggttgtcaacttcttgcagcgtgtgagcaccttcgatatggattcttcttaagttagcaatcctatgcaagtcttcagggagagcccttagttttgggcagtcgttaagaaacaaacgcttaaggcaaggcatcagaacaagctgttcagatttgccacacaaattccatgtgttgagagaccaactttccaaattgctcatgttagtgatgagaagcaattcgagttttggaaaaatagttatatgctttgcgctattgacgcctttccctagcagctctgcacccatattcactattgcatctgcgcctttaatcttaaaaactagcagttctggcatctggctgctggtggaagcactgaacatgaagtgcagtcgttgaggtgcatatgacccaaatttggcatcttacgctctggttctgagcacaaccaatctgggaaccttacaccagggaacccgacaagaaatatatacagtaagcttggcgatggaattagcagttcgtagacttgctgaattctctcaatctcgttggtctgataataagttttatcatgacctccgattgtgcaaccgagccacaattctcgaagatgaagacagttcttgagtacaaatgaaccccctggtgctgctttttctagcttcacaatccggagacgttggatattggagagacattggagttcatctagtctgaatccagttccactgtcaaaaactcctctaaggttgtagagttgctgcaactttgcaactccttttggaacatggtcgattgcagtctgttctagctctaggaaacttatgttcgacagtctcattaaactatctggcaggctatccaaatgtatgcaaccatgcaaagaaaggtattcaaggctggtaagttttcctatggattctgggagtttctgaatttttgtatagcttagatctagaagcctcagtaacaagaagtttcccactgactctggtatgatttggatgcttgttccactgagaactaagacacggatatgcttgagttctctgaaaatgtccttattaattttcatgaagtttttgttatcaaaaactagg

SEQ ID NO: 47678 - DNA, 1651 bp, Oryza sativa
cataccggccttggtggcagcaagagcttctgtgaatgaaccatgaaaagatctacgatgtcatcgacatcaaacataacatctctcatgttcttccaccatgaatctatccctggatcctccatggccagagcctcagcatcctcatgaacagcgttgaagaattccagatttttcttcaggctctcaataccccttttcacacttaatgtcatgataacctcatcctcaataagttgacccagcttttccaagaatttccaagcgagagcatccaaaactgtgcccatagtgctagaacctacggattcccactggatctctcctatgggagatgcttgaaactgcagatcccagaagagatatctcacagagctgctgagtgccgatcacttaaatacggaagatggaaagagatattgaagcagtgtggctaaaacctgatgagaacagagagggcaatgcagattgcagaagagagctgttatagattctcctccctttcttgccaccaactgcctttgtcacaatggacattgacattctctattgcaaaacgtctgaaaaacctgacaaaattaaaacagtatgaaagcactttttgaggcaaaatctacccacaatgatttttgtattaaaatccaaatgtttcaacgatgatgcaatgtgaaaaggacaagtagtgttacacaattgcaaggggattcaagttgaaagctcttccaggctgtgtattcttttcctttcatccacttgctaataataatttgatttcattgcagcaatggcgccacttggtgctttactttctttgcctgtttaccacctaagaaaccaggaaggccatggtgcttctctacctgcactagcaagaagacccaaagaagtgtactttttaagcgaatttagctgactgttaccagcagattttgcatcaaccaatacaggaatcctatgccaaagcctttataagtctagttaaaagcaccggagcagagttctccttttttcaggaatatgcagaaaatcttttgcagagttcagagaaaacaaggttctctgaaacaaggttaagagaaaacaggaatatgcagagttctctttatgcatctttgcattaagattgggtaaaacaaggttaagagaaaatggtacattagatcaccagagagcagacaccatactaaaggaaaaatagagtcaaaccgccgctgggcatgcaacgcacgcaggaatctcctgggcatttcgtcaaacagctcatctgcacccgaaccatttgttgcaaaagtccaagtttcagagcttatatagaaaaaacatcgaaaggaacacatcccattcgcatcactcggtgttgcacataatcaagacacaaaagaaaaattaagatagttgattacctacgcaagaaagagagatgcttctcctagcgtaaccaaagacggcgacaacgacccacaagcaaagataagcaggggctaggtcgaactgagcctggatcaggatcacatcgtataactccagtataaacaaaagcaaattctccggttgtgtttgtacctgacaagttgattcatctcgcacgtaacgtaacgtaacgaatgcggttcgctcggggagagcgatgcgcgaatggtgttcgatgaaa

SEQ ID NO: 47679 - DNA, 10344 bp, Oryza sativa
gagaaggcccccgcggggaagaagcccaaggcggagaagcgtctccccgccggcaaggccgagaagggcagcggcgaggggaagaaggcggggaggaagaaggcgaagaagagcgtcgagacctacaagatctacatcttcaaggtgctcaagcaggttcaccccgacatcggcatctcctccaaggccatgtccatcatgaactccttcatcaatgacatcttcgagaagctcgccggagagtccgccaagctcgcccgctacaacaagaagcccaccatcacctcccgggagatccagacctccgtccgcctcgtcctccccggcgagctcgccaagcacgccgtctctgagggcaccaaggccgtcactaaattcacctccgcttaggcttcacccctgcatctatctattgctattgctaatagttgtagtttgatctgtttgtgttagttttagtgctatcgatgattggaaaatggatgttagatcgttagcttggtagtcagatgtcagtgatctggaacagtagctctgattttaaaccatgtgaatgtgattcctgggtatgtgatgtttgaccgccctgtgcctgctggtcaacgaatgataactagatctaatttttgtggaactatttacatggttgctacttgcattctgttcaactgttgtaaattcctctgtcactcgttggagttttattctctgaagcatgtgtggaattgcctgggcatgcttttgggaaactatagtctgtagtcttatgttatgtttggttgccctgagcttgttggaattaatctatctaattttgcgcaattacatcctgtgagtatgctgttgccatttgcattgtcttgcaaactcctttgtatgccacaggaatttgatttctggagcatggatgtttggagtgtgatactgtgcttattggcccatgtaatttataagtacgagtaggtttcatctaagggcactttctggatggagtccaatatttttttagcctgatggcaattttggtttttgatctttgcgtttgaaacaaaagaagagttgtgtgaattagttagtactatatagtatgacagcttggccatcaccgttctattttagctgataactttgacatctgaagtaagttttgctttaccttagtactgtactgtttcaactttcaaagaagtttaattggaaatagtaactgaaacaccgtaagtattttgcttgctatttcaggatgctgctacactagcctgtttcctataaatttcctttgaatcaaagggggccttatgttccgaaggtctaaggaaggctctctctttgttcttgattagcttgtaagctaactggcaagcatgaggtatgcactacactgctgcatcttttatcaaagcttgctgttggagttgttgctctgcaggatatgccatgtgtgaagatgatgaccaaactcttgtggactctagaatcttataatgttatcctttggttctttgtccagtgaggttgtttgaggtgtataatttttttcgaaggttctactgcaagagcatcctgaatttctgttgggcttgtttgcattaaacattccatgctgaattgaagttaactacattctgtttacatctttacagtggcatgcatctaagcttaatgaatattaactacgcaaccttgtgttcctccaattattcctggtacaatcatcaacactgtctacatatgtatcttgcccaacgtttagctcacagtgctatgttcttcatggccgaccatccaagacctgagatattcatctctggttgcatgcatctctgatacagcttctgccaacatcattcgctctctgggttgttgctttgagcatgatatgccgagcctaagaacagacaccaagcactgttgaataattcttgtttttatgctttcatttttaacatctgcaacattttcttcttcatgaagccagattgttggatcagctatgtctaggggttggtgaagaaaagaagctgcaacaaacttgtgcagatccattgaatccctgaaaatgtcatcagtagggctccttccagtaaacatctcaagcaacaatatgcctaagctgtaagtatcgcctgctctggttattgtagacccttccccatactctgcaatgtttgcaatcaaagttagttgtcaaccgtaccctccacatgtaaaacaaatacaaagtgccccagtactccaatccacacccatgagggaggagggggagggattatgggaattaatgtaagaagttcagtttttttttaaaaaaaaaaatctacctggtgcaatataaccaatggaacctctgattccaattgagcttttcgaactttgaagagttttagtactacttttcgggaggattcttgatatgccaaaatctccaaccttagcactcttgtcttctgatagaagaatattactaggtttcagatcacagtgtatgattggtggctggcagtgattgtgaagataatccagtgcatcaaagatatcaacagcaatgttgagtctctgtgaaaggctgagtgtattgctaggagtgagattgcttgacttgggatgaatccaaccatccaagctaccattgggcatgaactcaaaaaccaatgccttgaactcttgaccctgtggaccaatacttgagcaacaagtgatgatctttatgagacaacggtggcgtactcttctcagagcctcacattcagcctcaaagctttttgaagatcctgattgttgaaggtcgaacacttttacagcaacaagtgcactctcatcgtctaaagtacatctaaaaacagaaccatatcttcctttgccaagcaggttggcttctgaaaattcattacttcctcttgataatgcataatatgaaaccctttgatactgttcctcaataaccagggatgttgcttgtctattttgtctttgtttgaacttcctttggtgtaacagaataactacaatagcagaaactaacaccaatattgcacccgttgttggcagagctattgcaagagacttcagatgctggtttctgttcttgcttacattgagaatgggacatggagccaagtgaagctggggtattccaccgcacaagttattccccacaaccgatgcaaaagtcaggtttctgaaaacacccttaactggaacttccccttgcaatttgttgaaggacacatctaattgccacagcgttgtcaaattttgtagagttgctgggattggtcctgaaaaattgttgtgtgctagaaacagctgttgcagattgggaatcctagcaatggtgttggggatcctgccagataacttattcatggttaggttcagtatggtgagcccttttaggttgctcagagattgtggtattcctccttcaaatgagttctcttctagatagagggcttccatcacttcacaatttcctatactgtcaggtatttgtccagatagctggtttccggatagatccattccatttaggttaaccaagctaccaacttctgatggaaggggtcctgacagagaattatatgacaagtccaagaaccacgagagtgactgcagctcaaaaatttctttggggatcgaaccatttagatggttgtatgacaaatctagaacaaacagtttttttagatccccaaggcttggtgggattgggccttccaaattgcagtagaatgcgtatatcctattcaaatttgtaagatttccaacagatgccggtatgaggcctgacaggctggtattgtacagggaaatttcaaccaagtttgttagcttcccgatgctttcaggaatcactccagataatatggaattgaaccccagatcgagaaagctcaagcctaccagattgccaatgtcctcaggtatgctccccgagatattgttgttatctaaattgagcatttgtagcgtcgttgacaggttcccaattggccttggcagctgcccactgaaagagttgttagcgaggacaaattcttgcagctggctgcagtttgacagtgaagtggaaattcccagcccttggtgttatctgcctcaagttgatttcctaccaaatacaaatactgaagatattgcaacctccccaagttgggaggcacaaatccggtgaatttgttgtctgagaggtacagatccgtgagtgttgaaagattggagagagaatgagggatgactcctgtaaaccggttaacatccaatccaaacacttgtataccgggaagcatgcgaccaatgtcagaagggatgctgccatgcagcatgttattgccaacctggagcatcatcagcgacgacaaattgtacagagatagcggaagttcgccggaaaggttgtttgcattgagaaaaagataacgcagacctgcgatatcgccgaggcctggagggatgagaccctcaagcttgttgtaactcagagacaagtgctgcaacgacgaaaggttggctagcgaggccgggatcttccctgttaagctgttcttcctgagctgaagcttcttgagccgtggcagcgtgttaccgagctccggaggaattcgcccgccaagctgcgggttggactggatccgcaggattgtcaagctgatgcaggagctcagattagcagggatcacacctgagatggagttgtggtccatatcgaggaccaggagacgccggagccggccgacggccggaggtatctcgccgtgcagctggttggagctcaggttgagccgccgtaggaaggtgaggttcccgacggccggcgggagcgtgccggtgaggttgctcgacggcaggtccagcgccgccaccctcgtcggccaccggtggctgcatgtcacgccctcccagccgcagaagctggcgctggtgttccatgaggcgagcgcgcttgagctgctcccgctgagccctgccttgagagcaagcagcgccggctcatcgcttgccgtgccggtgccgatcgtcatcaggacgcagaggagggacaatgcaagcctcatccgacgtatcgccatgtggattcttggttcggtttgagggagcgttcttggagcagagtttagttaacacgactagctattttagttaaatggagatactagcatatctctgtttcctgctgatcaccagtaccagtacatttttctttttcttcttttggaagatttcacctgactttgttgacctggttgggactggttctcagttgcactagggcccgcccggtttagttctcaaaataaaaattttaactctgtcactttgaacattcggataaatatatgaagtattaaatataaaaaaaatactaattatatagattatgtgtaaattatgagacgaatcttttaagtctaattacagtaaatatttgcttgttaatgataaattaattatgtttaataaatttatctcatagcttactatcggattttgtaataagtatttttatcagtgccggacatttgctaatgctggactattagaagcagtgtacattccactatgccaccaaacgcaagtggtcggtcaggaaaagtgacaaatactgccaacatgccgtgagaatatcttatgacaaactagtgttccttttcagcgaccgtggcgacgaaaggaaaaaattgacttgactagaatgctaaatgattaagaaggtgtgttgggggattagaacgtagatgacttattaatatatgattaattaattattaattattttaaatttaattaattaattaatatgattttttttgaaagaaaaaacgaggctagcacctcctgtgacgccgcgacctctcagagacggcgagctcgagctttggtgttgggactctgccgagcattcgtgccgtgcatatctggaaggagatttgactgaacagggagccacttcgccgtcacaaaggactagatttgcgttggttttaatagctgtcttacagctaagtgatgtagatgaaactcgatccataactgagggacaagaagtgaactttttttcaagctctgaacatatggattgcatttcgaggaacatgaaggaattaaccagcccactgaggtccataagtaaacacgatgtagacatgtagtacacaaatccataggctcagcccattttgtactgtatagtccaagcaggctcaaagctagattctttaccagcatgaaacttcagatgaagttcgtgtagccagcaacatccaagtaagcaagataaacatccagtgacacaagtcacattaaagcaacattcaagcaaacaagcaaaattagtataccaactcactagttcagtttcactagatagaaagcataccacatgacacagcactgcattcttaattacgtacacaccacaagactggagaggaaggactacatcatcgtacacacgccatagatgtctcaaaacatctttattcttagcacttatttaactaggatgcatttcttcagtctcaggtcttagatcacaaactcagaggaaacacaaagttacagtgacaacaactcatcacttgtaactggatcaaactactagcttagcagtactaggcccttccatctccttggtttcgtcaggaggttgcttgcttcacttgccgcagttgcaggggttgcaggtgcagttgtcgccgcacttgcacccgttctctgctcctgctccggcggcggcgccggcctccaacccctcggcatgactgcatccatcagagaatcagccaaccatagatcagtaattaattagaactcagcgaaacatgaaacaatcttggattgttgctacgcaattttcagagtaaaaggcatcatcgttttcttcagataaaggggagagtttttgtcataacgtgcatgaagtttttagtcgttttccttacgctgtagctagcgctgcaattttgtcatacgtacacgtaaaatggaaggcagtgagcctcttgactctcgacaaaatgttttgttctttgtgactcagaaggaaaaaaaaaaggcaggaaacatatgacaattgacaaaagaggttggtagctagaaagatggaggtactcaattctgttctattagagtatatgatagttagagtaggataagattgatttacatggacttctttcatatctataatcttttcttatctctacactgtactcctatatatactgccccctgagactcattgtattacaatggtgtcgataatcacaatatttccctctccctatactattctacaaattcagtaacacatggattttgccaatgaatcacaagtacatgacatggagaaggaaaggattagtgcacataccccttggaaggtgcaacacccatgatgacagtctgggtagtggtcacctcctcagccatctccgggtacatcttgcatctgcatgtacaaataatcaatcagaaattcagagcctatttcttgtctgttcaaagaagaggggataaaaaaaatcagatccttatcagccatcagcatgcatgctcctcatttaataacggtggaaaggagctaaatcaaaatctcctataatgaatcttttttttcctctcaagtaagatcatcatcacattaagccaccatctcaaaaaagatttttctatcatgaactttttcctctcaagaaagatcatcatcagatttggccaccatctaaaaaaagatttgttcacagactattgagtccataacatgttctattatccaaaacaaatcccaaggagaggcacacatatgacacatacaacacatgcatgtcaatatgtcatgaatacataccaagatcaacaacatggataaacacaaattcattacggatcacaacacacaaaaaaaaccccagcaaacgaacaatatcccttccgagatccaccgaatttccatctcaccaacaccaagactagacagttattatacatgacagatcaagaacagaaattcagaagatggtgatcggatcttaccctccgcagccgctgccgcactggcagccggatccgcagccgcagtttcctccgcagcacgacatctttctttcaaagatcaacacggatcgatcgaactgcgggcactgatcgcacaacacacgagcactcactctgaaaatctgaatatcaccttcagcacctgaaccacacgcagggaggggggcggagagggttgctacttatagagagggagggaggccatccgccgtacacgtggcacgcatcgggagacctgccgtgaacaaatcgtcgatttggggaagggggggaagtcacctcctgtgggggtgagtgagtttacggttttgcccctcattgattgagcgattcttcgggactcaaccgtccgtcgtcgctcgcggacaaccgaacgcatatgcatggcgtgatcacgtatgatccgcgagtttggcgtctggtttgtggcctctagttcatagtgagaattgagaaggttgtgtacgtgtttgtttgttgagttgttgggagttcgtgtatatttttctaaactaaatcagcacagaactatcaattatattttattttgaatgagtataattaaaaaaaaacatcaacgagaatagacttgtcaagcatcaacctattaacaactataccaacatagggttatttacgtgcctggcgatgatatgtgtagggtttacaatatatgttataacatttatggtactaaagtttacattcttttacatatgtgcttgtggacatactaataagttagtgatagatcaggtacacaatcacctagcctagtcatggcttatctaaaagtagatgtcctattaaacttcagcaaatattttttaaactttatcgaaaaatattttctaaagaaagaaaatattggaactataaattacgggtatgtttggctgtctgttttgcgcaaacggcgtagctgacaccgacagtgccgaaaagcgcagccgcaaccagcttgccgaatatgccctatattatgggatagatttcattctcatcattcatgtgctttatatatttcttccacaaagtttatgcatttctttataatatgtcatcatacattcggcgcgctagaggtgtataatgcacgttcaaggaagaatcaaaataccacgccgcatcgctcgcagcacagaggagattcagaagatcacaaattcatggtgcttattgatgtgttgggccatgccattatgtcaagcacttgataacactgaaaatggcctggaaatggcccggatggtaaggtcgtaggtaggcataaagcaggttcatgtctactctatcaatggttgtttactgaaaagctattattgttattttatgttttctctatttttgtgaagttattagtcaccaccactcgctgggaactaggaagagataatcgtgacaaataaaataagctccatatcaatctgctgatcttttgcatcgaaaattttctaatcctttttattctaacatatattttctcagttttaaaactattgacttttaaaaataacatttcattatttgtcttacttaaatatgcaaaaataatatggcatgtttaaagtatatttcataataaaataaatcatagcaaaataaatgatacttatagctttttaatacgatggacggttaaacgtcgtgttcaaaagtcaacaagttaatatattaaaagtctgaattttcttttagttccaatacctgatgatatattgcacataataccagtttatttcacttcgatcataagaaaaacatacatgcagtagacaatgttcttgcaagggtagtggcacaaatttcaggtccaccgattctctgattctggtgccaatttgaaacttttttcgtgtttgacgtgcatggatcacggataatgtctcacgcacaaataaaagaaaagaaagagaggagaagagttcaaatattcattgcagcgagttggaacacgtgtaatccacacgtccataattgtctatgctggccagaatggacacgccgcactttgttttaaatttaaaataattttttaaaaaattaagcataagaaaagctgaagaggacatggcctgaacctccacggcaaatgaaaatgggcgtgtcattatcggatagagaagagacaatgccatcattgacttttgactttgcgaatcccactgattagtactcccaccgttattttaagtgcgaccataaatttaacgtttaattttgattgtccgtcttattttaaaaatttttataattagtattttggttgttatgagatgataaaatatg

SEQ ID NO: 47680 - DNA, 1307 bp, Oryza sativa
aaaaaactcaatttaaaattgaagctgaagcttgaaacaaaagctaattaaatgatttttttaatgattgaactgtattggactttttaatgtcccctgcaactcataaagtaaaaatacttgatctggctacctttatgtaaatttaattcagacacttacagtgacaggtcactgaagctccaaaatcaaaggctctaaactaaacatcgtattttttttcaaattatagaaaactaatgtatgtatgtaagttttctgctactaaacggaaatctcaccatccaggattgtatatttcactggactagcaggatcatctgggaaggtcatgtcaagaacagacattggactatcagtttcttgttcacagcttagatttatctcagcttcaatttcttgactgggacgaggaacacaaaaagtaccttctcttgacttcagaacatcggatgaatgaatttgtttgtcatctgaagttgttgtatgttcttctgaaatccttccgtcttctgaaactttagtagtatgcatacctgcttctgttgacaaattagtatggtcatcgtcacaagttgttccatgttcttctgggacatcaatttcttctgattttgaatgaacagtacacatattatcttcagttgatgagtgaacctgatcgtcatcacaagttgctacatgcccctgtgaaatatcaatcacttctgaaagtaaagggggagtacatatattagcttcagttgacacagaaacaccacactttttgtcaacgatgtactcttcgattaacacagtattttcagagccatcagcatccttatgaccagagatctcatccatagcagcatccacatctccatccacaataattctctctggaacatatggtgccaaggcatgttctgggatcacgagattttcagcagtcataaccaaactctgcaacccagtcatcacagcaggcgcatccaaagaatgatccctagtagattttgaacttgtcagcgtcctcttcgactggttgcttgaaatagaatccagcaagtgagaatatttctccaatgattcagtgagggaacgtgaacgccgaaaaccttggtttacaggtctttttgcagcagttacagtataagatttcaaaccatccctgtcatatgtggcggaggctgaccgggaaagtccttctttaattacatcttcagatgccttatgtccataagggaccttatgaagaactccatccattgaaatgctacggtggctcctttgtttcacatgaatgtcacctctctttagaagcgaag

SEQ ID NO: 47681 - DNA, 1191 bp, Oryza sativa
cacactgttttagtaatattgctcatgagaaggcccctggggtattccggctagcaccacaaggtagtgggctagccggtccgggttcgagcctcactcctcttaataatttcttatatgagagcccctcctctcatatccaatgggttttttatggtaatatttctcataagttacataattcgcctaaatatcaaatggaagagaagcgcttgctagcgcagtggcagaggtatgcggattcaaccccgaagtcccgtgttcgactctagtgcacgctcgcatttcttcttaattaattgacaccaagttcctctttagtgtccagcgtttctccttggtgtcttgtgtgtgtttttttttcaagcaaaaaacctttccaaccacatgaatttgcacagttgtattattcaactacactctgttgcaccatagtattcaaggtcctatagcaactagcaggtaacaaaaaaatgaagcagtaaacttaccaccactgccttttccctgactctgtttcttgtcaagatcatcttagtggatcgcaggcggcgacggaagccaaagaactgaagaatgctccatcggcgcccatggagttccttcccataaaacgcggagtcctgatggtgcaacagctgggccatttggtgttagcccgtcaacaaaggtaggaggagtggttccttataagcaccacctttgcagaataaggaacaattcctcaacttttctttaaacctgtcatgaacagactgaccaccgattaacaacttagcgaataacacgcataatatcatttcaagtacaaataaattattgcctgaatagcaaactggaactctggaaaagtgcagccaaacaaatttaatacagaaaaaagatgttctccaaccaagtatccataaaatcggctagccaaaggcagatgttaatcatgaggaaacacataaaccataatcaatgaacaaagctaatagaaaacaagttgagaaggccctttgctgcctttcagacaaagaaacagaaatgatgctgacacaagcacctctttctgaaaacatgcagacaaacacccaccaacagcaactaaaccatttcttaagacaccaattaaaccatatatccatacatatccttgttagttagaatttcaattcctaatcaataattaggtgacaagaaaatgaa

SEQ ID NO: 47682 - DNA, 1001 bp, Oryza sativa
gttgtatatgcttgtttgccgggtgatttagaaagaaaggaacaccaggatcttcgagcacaaaaactacacggcagcacaagtttaaagggctatccgagaggaagtcctggtttagagagaagactgttttcaaacaacgggagtaaagcttcaggaaggtttttttttttttttcgttttcgcttgaggcttttggctctcagctgatcgatccgtctccactgtttaaatttgagttcttctctatctccatttcacatttgtttagcgactgcatacatacttagttacataggatttttgtcaagcacaaaaatagacaattagacagtttaaaaagataacagaagataccatgaatcaatcaaaatatcacacaaatggtgataacacttagagactcaaacaaagaaaaggtaaaacaaacaaacaaataaacaaaatactccagtataattcaccagtcagcatgtcacgcgtaaagtgtaaacagaacagaagataagtatagtgataatagctgttaggatgatgcacacatactgccagttgagaaagcatgtggcatcaatgtaattatggtgccactaactagatggcgaggacaatctggaaaggcaacacggagctgatgagagaaaagtacaccaggcgaaaaagaaaagcatcactttggcaacttttcagcaactggatggactgatgaaagggagaggtggaagaaaggcacagcttaccaactgcagagggcaaaatctaagtatggagagatgcaattggcttattggctccctttcaactgatcttcctctcacttcatgtcatcctttttcagatgagaacagtaactacacatcgacctaaagcaaatgacggtactagtatccttctgggttcttgacaagcacaacatcgaaatataaaagatcacccagagtttaagtacaagaccagtacattttatgtaggaacggaaagctagtcattggtacaacata

SEQ ID NO: 47683 - DNA, 1913 bp, Oryza sativa
aaactacacttctcagttggcaaagatgacaaaaaacaacattcagagaagggggaaaaaacaagtctcttttcaacgaaggaaaagaaaaaaagatttctcacctacaatggaatgaagaatctgtaccaccagcaacaacatcatcaggcaaacaacagaacacaaaaaaattttagcacacctctcaatctccaattctccctgataaataaaggtaaagaactaggaaaaaccaggacctccaagatggcagcagtctgcgtgaacagcagaggtcgctcgatggcagcatagacggcctcatgtcccttatccagcaatgccaaggtcatgtagcacaacacctgagccctgcattgatccaaatcaaattcagaaccccgataaaaaacaacaccctggctgtccagcccatgaaatggccagcaaacaaagatgctagagggcaatgttttcactctcgcggcagtgtgttattgtagacgcgtggtgtggttgtttttctttcctgactatagatttgtatttttctcctgctatatcaatatatgaaactcaaaataaaaaatcgatatccatccagaaactcaacaaacagtaggcagttgaactgaccatccgatgaaggcgacccaattgtagatagagaggtagagcctccgcaccattgaaccatccgctgccattgcagagctgcgagagatggaggaggaagaagacttcgagatggtgcttggcttttaacatgatggattcatggctaatggctttgaccaggataatctcaatatctcatccatccaccagtcgacgtgcagtcaaatcgcactactaccacaccatcaggaattcaggacatataaatttgtgcatgatctgaccacccaaaagaacacactgagaacgaagagatcttcaactaagatcaacgcaagatttgtgtgcatatcacccgcatgttgcacgcagattctgcaagattcgagacgcgggcttacccagatccgatgggaggcccctcgacctgcttcatgagaggagcaggagatgtggtggcggtcgccggccatggaaaccgccaatttttttaaaaatatatatatacttttttttcacaccagttttacataataaatatacatgtttgaaaataatagcaaaaaaaaagagaatgcggtctggtgaattaattgatggaataattgttaattaattgctaataatggtaattaaacaaaaataatgataagttaattaatcctacaaggttgcgtactcaccgcacgaactcgtgatgacatcacaaacacgttacgagtttgcacactcatcacgtgaactcgtggcaaattcgcaccaccccactgtgataatggtatatttctgctaattcattttaaacatgtatatttccataaaatcaagtgaaaaaaatgtatatttttaatttttttttatggagacaacaagatcagactggtgattctgtgccgtgcactgttgtttgggggtttctcatagccgtttggatgatttttttttaggattgaggctcttgtttttttcacaagaattttagttcaccttaattgcaaaccagtaaatatgtcattttatagcactcaatgcaggtgtgcaactcagaagatataacacagcccaacaagccaacattcgacttgggatggttcgccacaagggagaagattgtttcccgagaggatacgacatgttggtcatcctagtcgcttctagcttgaatgttatgaaaggagcatctatactccttataaaaaggaatagtgatggtggtggttctgccaccaccccactaccaactctaactttttttaagaaaaataaatgacatgtggggttagagggtcacatatcgactactcccatcaact

SEQ ID NO: 47684 - DNA, 2905 bp, Oryza sativa
gcggcggcggcatccattttttggctgcgccgcatctattagccttgagtctcgaccccgacgtcttcccctgttgtttttccctttgcggcgatgacacctacgaccacggtgacgactcatgcagcggcagtgcttccgagatgattgcagatggggtcggccttgctgcgtgcctgcaaccggtgcggtggatggggtcgccctcctccttgagtttttctcccgtgtcgtgcggcggccccacctagcgtgagatgcagaagggttagcgcacgggatagagaagggatagcgagatagagatggatagcggaccacacgcgaaagcgcctcatgcccatcgtacccctcagcaatcaacagctggatgaagaccggtaccagaaagaaggacggaagaaaatctcgctatggtgatattttaggcctgatgctgccggtcacttgagcaatttttctttttgtattatactattttctttttaaaaaaatgatttgtctaatgatttcacctagtattttgagtgcacaactagaggaacatttacgataaaaatatactaaatgacattgtctgcatacttctttattgtgagagcacaggggccaaaatgctccaagaacagatctacagttcttcagacaatttgtttttttgccaggtcggccaaaggctggccgaccaatttcattaagagtggggatgaatcttcagacaacatatatgatcctcctttgcttctgctgctatacatcggaaggccattatcattcaacagccaactagtactatatggcttagacaatctgtgaaaatgatacacatttcagcagttggatggatcgatggataagagtaaggaagaaatcaagaatgactcatctaaaaaataataatcaagaatgatcggatgcagttgtctccattcattgatctggccccatttcatcacatccaatatggtaaatcaaatggtgacagtagccttcttcatccttgaaaagcagaacatctaaatatcatttttcagcatccatatggactatggagtacaattttatttacagatggaaacgcccatatttggtacaacacaccattagcaagccatgagaatggtacttgcatacattctaatttaccaagggaaaagataatccttgtataattgtattttagcatttccattctagtaacctttgcttctttgttccagaaatggtagcatcctgagccatggttgtgatcagaaatcagaaatcaaatttcgcgagtaatcgccatgactgtccgcggggtttagccctgctttcatttctcgttcttggttggttggggtccttccctggctaccgtggcattgtaatgccgttgtaacattttactgtattttcccccaaaatcttaatgaaattggtcggctaacctttggccgacccagcaaaaaataactcttgagtagttatgtggtttttgcctttgacaaggctttcttccgctgggcaaccatatggcgcaacaagtatggaaatactgcattcatgaaatgaaacaaggtagtatgccatcaaatcttacttagtttcctttcagaaaatcctattgaaaaaaacctagtacatgatcgtagcatcaattaataaatgaagtacaattgcatggaatactacctggaacgtacaaagccatcaaaaaagtagagaaatagaagtagtcgaaggagaaattccatttgttgggcatcccaatgcagtatttctcagatgcctgacattgatcatccaaaacaaaagagcatttaaacaagattgttgtcacttatcaaatggaggtagagctcttcctttctaagttattcaggttaccttcatgaaagggaaggcaatatagattaggccaacctcactaaccataccaacaggatagcatactataaaggtgctgtacctgcgaagaaatcagtatgaaaacagtgaagcaattttttttaagataatttactaataagataatgagcaatttttcgaagcttatgctaatacatattgtgatatgtttacaactagaaccaacctaagccataagagccaggaaggtgtaaatccaaatgattcctttatgccaaagaaggaatatctgatgacctgcaaggaattatagtaaattttccacgaagttatgctctgaaatgaagaaaaaaaaatcataatctatgttcgactaaggcaacaacttcaataactaccgtcatttcaagaagcagagttgttgtttaactactgtcatttcaaaaagaagaattgttgtttatcatcttataataaaattgcatctgaaattcatggtctaccaagcgagtaatttggtgactagttttgggggcaacacatacctcggtgatggaccagcttatgatcaagggggtaacaagaatatgagaatgcgtctgcaaaacaaatgcacacagtaactcaccaatattgtctacaaacaatggttacttgattagaagtttaaatacagaaaatagaaaacttggggtgcagaacggaagagaactatcttatccttcacgatgtaatggcatcaattactcgtgcaatttctgcaacttaggtttgtccagtgcttactcagagtcattatgatcataaatgaaagtataaaattagttctaatagcagaaacattacctaacatacttttttttttcattttagcaagtgttttctaatccaaaacttattttcaagacaaaaactatcaaataacttgagtaaggtctgatattacctcaggaaagctccacaagatgccccaggtaatgaacaaccttccagtaatttgtggaagagtagaagacactggagacctcaccaatccttttcaacaattcataat

SEQ ID NO: 47685 - DNA, 17789 bp, Oryza sativa
tattgttgtaggaaatagttcaatctaacaggaactacattagtattttctacattccagattgagggttagccagaaagtctgttaacataaagtttgaacaagacagccatacctagcaggtaactacaattcacagttgacaaggataacaaaaagaacatattaggaagaagaaaatgacttcttctcttttttttttacaaagaaaaaagggggggggggacttcgtacctagaatggaatgaagaatctgcactaccagcaataccatcaccagccaagcagcaaaacacaaaaaagtttagcacctctcaatctccatgtggaatgaaataaataaattgcagagctgcattcacagttttgcaatgataataaagctaaaagtgaggaaaaccagacctccatgatggcagcagtctgtgcaaacagcagatgccgctcgatagcagcatagacggcctcatgcccgtcatccaacaacgccaagatcatggacaatgacacctgagccctgcatgatccaaaaccaaagaaccctgatcagaacaacaccctgagtgtccaatccaagaaataccagcagacaaagatgctagaagtgaccatccgatgaagacaacccagttgtagacagagaagtagagcctccggagcactgaaccatccgctgccattgcagagctgcgagatggaggaggaagacgtcgaggagatgggtttggctttaacgtcatggctaatggctttgaccaggataatctaatcaacaaatccgatgtgcatgcaaatcacactatcatagcatcagaagcactaaaatattagagtcctgattgacaggcagcagcttcctcagacatggatgggattaagggaataaggctaaccactgttccaattgattaataagcatcagatcgggggatcaaatcggataaataaatagttggcagcacaaagtgacagtcattgctactgcaactgtccgccacccaaccaattcatccatgtgatcaacacatttcgccacaacaaagaagggaagaagacagatacatcagctgcttcattttcccttttttctcttttcatcttcacctgtgtaaatgtaagccatgtcatattaataaatcataactaggtggtagaaagagtttgttatccaagagatcacaagcttgattcaaaggtcatgttttttttatcaggcttcagaaaagaagtatctttactttattcctaagaacaggtaacacgtgtatagattcctcaaagagcatgactgacgcatctcaaaaacatgtaatgtatgcatcgaggtccagttaacatcaacaaccaatagcaatcagccatcgtggatagcaagaatgtagctacgaggaacagggagagggagagatcagcaactctccgaattccaattgataatactgtttcaacaagctcatgtgttgagttagtgccacaaattgcctcaacgaactggaaacaaggcagctgatgtaacaggggtaatatctgcgcatgatctgaatctgaacacaccgggaaactacccgagaccaactgaatccgcgcatgatccatgccatcagccacattttcgcacgcagattttgcgagattcgctgcaggggacttacccagatccgcgtcggcgtcgcgtccccgatcccgaactgcccccatccacgccactcgctgcgcctcggatcccatcagatggattcaaagccacagcagcgccacgacctgctcgaggacgacatggccatggactacagattactgaagagaagcgtcggatagtacgggggaggcgtgtgcggcggcgggttaatcaactgcgcatgaaattattttttgggggatttttcatagcgttttcgatggtttttgtaaggttgaaatttggctccttttttttcaaaagaaatttagctaactacttcaaatcatacggccttatcgtttgcctttatgtttatgtttactcgaaccgcttattagcaatttaaaaataattatgcataaaaacttttatattcgtgctcttagtgattcaaaagcaaatgttgtaaaataagctgtgaagagaaaatcacaaaatcaatttatttataagcataagtgaaacaatgggactcataattgcaaaccagtaaatatgcaaatatgccaattctctatagcacgcagtgcaaagtgtgcaacatacagcataacaggctaacagcaaacgcaaaaagagtgcaatttgaaacaagctggtaaattttggatcaatcattcaataatttaaccaggtaaaatctagaattcttggtagaagactacagttacaacaaatgatgggcagtgtaatagtagttctttccaacatgtcctcatctacagacttctactaaaagagtagcaaatgtgagctatttaggcagatccttaagccacaagtgacaaattcaagaaagctcttgagcatcaccattatgcagccttagcctttgccaatgccttcttccgttgggcaagcatgtaggtgaacatgtgaggcgatcctgcaacgcagtgttcttgtcagaacctatcaaatcccagttactaagaaacaacaattgcaattataaaaataatttcaatcactgaataaaggacgactgcaaggcaggaggggataccgggcacgtagacggcgagagaaagaatggatgcataggagaaatcaaaggagaagttccatttgttgggcatcctaaggcaatatttctctgttgcctgcatagcagtcacaggaaaggagcagttaaatacgcattacgcattatgcaatgagcctgaacaacatggagatcttcatttctgaagttcattcttgttaccttcatgtaaggcaaggcaatgtagattaaaccgacctcactgctgataccagtaggatacaataccataaaggtgctatacctgtacaaaatcagcaccaggtttaagaaaagaagttatgaaagaaaaagaaaagcattctctctaaatttatgctaaataatgatgtatcttctttactaacctcagccataagagccaggaaggggcaaatccgaatgtctccttcatgccaaagaaggaatatctaatgatctacaaggaaccacaaatatttccatcacgttatgctatcaaatgcacaatattttaaatattggtgtgaataagcttagcccaggagaaatcaaaattataatttggaaaatgtcgtgtctctttaagaagtgagtcttcaaaatatacctcagtgatggaccagcttatgaccaaggaagtaacaaggatatgtgaatgtgtctgcaagacaaatgtacaaagggatcaatcaatatatatgtcatgaaaccatgtgttaagctacactacaagcatacaactaacagaaaactagggatgcaaaagtaaagacactgcatttgcatatcagtaccagtagttatgccatttagtaacttgtacaatcatcaccattatttacttgatccacaaccagacataaaacagacaaactacctagtgtccagccctcatataaaaatcaaattatatgatccgtattttctatttagacaatgctttaaacccaaaattatgtcatgtttcaatgtctcggcgaaacagtaaatgcttaggagaagtagcatgaacgtagcatgtcaacacttattagtgatagtcgatgatacctctggaaagctccacaggatgccccaggtaagaaacaaccttgatccaatttgtggaagagttgcagagactggagacctcaccaaacctttaaaacaaagtcagcatgttatacaggtgataaaaatgagaagtgtcataaaagtgaatttataaggtacaattgtttctctaatctaacaggacacttcctgtaaattgaaatatgtctttggcatgctttctaacgagaaagtctattactctatttccatggagtttgcgtgctgcacgctatagataggaaccgtacaattccaaatgatgaccaggatagtgaaaataacataagtagaagagaagaacaacttcttacctacaagcccatgaagaatctgagccaccagcaacgccatcgccaaacaaacacaaaaatgctcagtacctcacaaaacacaatttgcaaagaaatgaaatatacatcggtcggcattcttcgccatcccggcgaaaaaaacaaagaaatgaaataaacatggaatgttcgttcattctatgttcaccgcggactcgttcagccgctccgtgcaaagaatataaatgcttccttatctagggaactacaaggaatataacacaaagtactgctagggcagcagaaatttttcttttctttttagcagaattatcgggggagaggatccccaccatcaggcagcagaaacataacaatgaagttgaattaattgcagtatattttgctataacactggtaatatttctctcaggctaaatgtttggttgatttttagaacgcaaaaggggattaatttttttttccctctgtgccattgctcaacaggtagcaaccctaattgggtagacggaaaattcaaaatgaagtcagagctgcccaaattatacaagctcgagctaaaacctactccctccattaaaaaaaaaaagacaaaccctggattttcgtgtccaacgtttgaccgtccgtcttatttaaaaaaattatgaaaaaaatttaaaaaataagtcacgcataagtattaatcatgttttattatcgaacaacaataaaaatactaattataaaaaatttcatataagactgacacagtcgaacgttggacacggaaacccaggtatgtcttttttttttttggacggagggagtacagttttactcgattaaaattcagaaataagtcagagcgcacagactagcagaaaaaccagacctccaagaaggcggcggtctgcgcgaactgcagcggccgctcgacggcggcgtagacggcctcatggccgctctccagcagcgtcgtgaccgcgtagtacagcacctgcgccctgcaagatccaagaaacccccccaaatcaagccaagaaaacgagagatccaaacaccagcaggcggcggcggcgcgaggcggcggagtaccatccgaagaagacggcccagttgtagacggagaggtagagccgccgcaccgccgacccgacgcccgtcatcgccgagcactcagcagcagctagcaaggaggaggaggaaccgaggaacgcgaggcctggacaaagatggacaaggacagtggcttggctttaatgggcgcgtggactgaatctactacgctgttgattactgctcgcattcgcatcagcagatcagatcagaggatgcaatcgcaatcagtaggctgcttgctccgatttgagaattccggtggatgggaggctggccaaccgaccaaccactgatcaaactgaattcgcaatgaatcggagtggatgtgggggtggcggtggcagttatggcagctgcagctgactgagccggctctcccgccaatatcatccatgtgatctgctgcaaattcagttcagtactgcaactttcaattttatcttcagaagagttcagacacgcaggttcagtaaaaaaaaatctctcatttctctctctgttctcaatcacaagtattatgctgttaacctgatggcctgtcaaaagaaaagaaattgtgtgtctgtgtgtgtatatcagcatctacaactaccagaattaatcagtgatacataggaagcacatcaagaaacagaataaagatgataattttgttcagctgttacatgagttgttttcaatagctttccaagtgatagaactgctcagccaactcaactgtctatcagaatatcagttagttcgactaactgaaaatgaaatagcctttacagaatgctcctctgtacttcacaatcatattatccaagacaatgttgcatgacctgcctacccaaacaaacaaacgaactctatagattacttgcattcttttcagctgtatgttgtattagattacaagaatggactttaaagaacaccataacttgactgaatacagaagatgaacaatcaattccaagctacaatgcagcagagaggatccccagttcggtgcagagtggctccagcccttcctcttccagcaaggaaagagcggcaagtccatagtaagaatggtagatatccgggaattgatcgtacaaaaactttgtaaaacctccatactgttgcaatggtaaacaagggcatacatgatcagtaaagatgcaacttgatcaatgtgagaaattaagctgattagagaggaagtcattacaggtgattggcaatagagcaaaaaacttcgcaaagcaccatgatcaatgaagcggtatgcaccgatgatctttaggacacctccaatcctgcagagtgttgattggcagcaagacagattacccaagtttgctatttgattgtcaggcaattagtatatataactctgaatggtgtatttaccaaaatgcatagcatgtgtcactggatttgttccttcttccttgaaaacctccgtctgccgcttgtctctatatgataatagtgaaaacagttaagattccctactagtaaagtcgtcctagtccttattaatcatttctaactaaatccgtttatgattcacattttttttactctacataagggagattttaaaaacaactggatggtgtggtgtcattgagcaagctgcacttctccatcatgaataaatgaaaattgaatggttgatgcatatatctactaaattagaaacatttaaaacgggttggtgtactgcatatagtgtctgtccagttttggaaatatatgttagtcctataaatcacatcaaagggcagattttgatggtaatagcagatatatatggttgagcagaatttaacctgaagacaccactccaggagcaagcgtacatcaattgatgatggttcttgtaaatttgatgccaaatcaacttgaatgaaacccatcaggcacaaagctgcaacagcacagaatgtccctccacctgactcactaacacaaagacaaacaatgagtacccataaccgactccaaaaaaataaaacaaaaatttagctgaattattgcattctgaaactctgaagaaaactgccacatgaaatgacaaactcagtaggacaagaagcacatcaaaggttaaaagaagctgtaccatgagattctgaaccaggaaccaagccaaagccaccatcgtatgactgcatgtggtagaaacaagaattaaggattttaaatagcatggtgcaaaacactggtgtctcaaaaccaagtgcatcaggaattgttgtaagccaacctggcaactaagaatgtattgcttggccttttccttgtccattcctgtccaatcttttagcatcgagcagattgcagctgagaagacaacacaagtgtgtcaagttatttcaaacaaagataaaattgaaagcatactaaatataaatgacagtgcaacccacctgcacagtatacaaagcgtaggtctgtttccgcaccaatatgagtaggcatgaagctaaaaaaaaaatgcttctcaagttggccaataagataatgcatttaagcggtgcgtggagtttagttgtttgcagaatggaaccatggaagccatcttagtgaaatcaatgaaatgctcacaggcaagcaagattgcattgcacatgcacaaacacctctatcacatgcatgcagttaggatcacagcacattaattaacattctgattgaacaagcttgaagactgaccaacaatacagagatataccagaaaggaggtatttaccaatatcaagtttgtcgaacgacatggcatgactaaattcatgcagagaaaacatatgcaaatggaaaggtagcaatcaacacatacaaaaaataatcaaggaggtgggccaactatggggtattatgaaatcttaagacagaatgtgagttggctgaaactcttttggtggtacagttaaaactaaacacaggtagcagatgtaaatgcatagatatttttggaggataattacaagaataattagcatggagaccaaaactaaaatgcataccttccatctggctgttggaggtttctcattgaggacaaaagaaccttgttatcaatgtttgctaaatcataacctacaatcttcaggatagcaagggcagaataagtgcttgcaagatgactaccattgtggcaagggtcctgaggaagggcatgaattcatatttcaaactgtcagaatgtaaaaattaaatgacaaattgatatgtgtgaaaaaaaaaagggttgacttgagaattagccacatctaccttcatgttagttgagggaaactgagttgttctagagccacagaatccataaaattgtcctaaaaacatataaattgtcatataatgaatatattgcatctgaaaaatatgaattagctatcttgagagctttattacataagtactgaggaaaactcaccattatctaattcattgtctgtcttaggatgtacttgaaaagacaaaatccatttggctatttgatccttgttaacctaaagaaagtataaaagggcaaacaagtacacaactcatcaaattactactcagtcaactcagtatattacttcttcctgaagagtcaactcagtcaaggcacaaagtgaacttaaattcccacaataaatatttcagctagcaaccaggcatggttacttgttttaatacataatacatacaggtacaattttcatgataagactggtaaaaaaatatttgcatgaggctataagtttttttagaagttactagtaatttgagaatggagatatcaggaggctatcatgtttttgttgtttacatgagcaaggcatcaagtatgatgaacttaaatcataaccaactaggcggctcctaactgtgcagagcattaaggcaactgcccatggacaagacaaagacgaatggaatttagaccgaattaagggacgtggaccaattcgttgctacagaaacatcacatgggcccctttcctcttagtttggctagaaatcgaaagcgaatgtagttatgtgatattgtgatctagttgccggacagatgcaaattgcctaaccgcaataatctctaactgctttgagtagactggttactggtcagtgaccacttatgggctaaagtgcttaaaccttgcagctagtagttgttctttacaggaattccaaaaaaaaaaaaattgaaaagacccttccacacttggcattctgctatccacaaactttggatccctgtgtttgtcacaataaagatcaattgcaactcccattatggatacagcaactaatttatctctgaatatactaccaatagccatccttgaggtttcaaaatacttcatggtaccataagtgcaccaaatctgctgattgattttattcctacagatgcaactttgcttccactaaatgcaagcaaagcgaccacacaaggtaaagtaaagatccaagctttgcacacgggcacatctagtctagactagagttcaacaaataactaaaaaaaaacgaatttacgcgtaattcaggaaacggatcgagaggataaccgctagggcagatcaggcggagagcggggatcttacactgtcgagctcacgaaggagagataggccggcgacggcgaagtaggcgagggtgaggtggttgacctcctgcgaggcgtagtccgcggggagctccgacgccatagcctccagaaacagcacgtgccgctcgcgcgcgaactccggctgctccggctccgccatcgccggccctcgctcgctcgccggggaaccctcgtctctcgtgccggagagaataaccgagccgctagtgcggatctggcggaggaggagagctcggcacggcgacggcggcggcggcggcgggcgctgctggtgctgggaatttgggatgcggacgggtggagggaagaggaggtttttttttccttacttaatatagggtgagaggttgacaggtgggcccaagggtgtatatataatatattgttttactccaaggtccttgatgtaaaactttgtaagatttgttggcaggagttgagcattacacaaggacttaaatacaaacaaatattcatggagatgcattgcacattagagcaggtacaatagcatgctataagccatctataacctcatatcgagaagaaaagagaagagagagaagaaagcgggttacatatttgtagccagctgcaacacggactctaagacgttatatgtgaatgagaggtaggactgaatattaatgatgtagtatatttttatagctaactattatattaattggctattagattagctataaatgaattggagccaatagttggctaacaatcaaataagcatacgagaatgactaattttcgtcttaccctcttcttattctagaccagcttctcaacaatgtgttcgtggaaaataatatataaattttcgcataataacttgttaaatatctgattgattttgtaggagagccataaaaagatcaaactatttatttaatccatcaattttaactatctcaaataaacatgaattattgttatttatgatgcaggtaaaatgaaccctgaattttccacacgagcatctgctgaatgctgatagttatgtactccaccttcctactggtaacagtctccattgatggattcttgatccgaactgatcgtgatggatcggccattgctggcattccgaaatctcacaattcacaagaaaaaaatgtctcgctattcagggaattttttgcatcacagattcagagtttcagacagcacggaagattttgcaggcggcgttggtgcccgttgggcgacctacctcccaactgcaatccttaactccttccctgacgcagcctccatgcatcgtaccgacatctttctctgaagaaccatgtccatacaccacctcaagtttttttactgacatgactggccctatcaattactagtaaccactgctttcagagtgttattgcaagttcttaagcagatgatcaacacaaatgatggtgtattatgataagaatggtgatcctaattcctaattcctagtagcatttcctgcacgaagttcctgcttttatgttgttcttttttaggtcttgcttagttccaaagttttttttttacaaactttcaacttgtcatcacatcaaatctttcatacacataacttttctatcacatcgtaccaatttcaaccaaattttcaaactttagtgtgaactaggcgtggaggaggtaattacagagtctcaccgatggtacaaagagcgtgtgcttcaggaatgcgtgccacactctttgcacattttggtcagcacatgtatccatgtggaagaatatatgcctagttgtgaacttgtgattgaacaatcaatttagactaaacgaacgatcatgctattgtgatcaggaagatatccaaatctgttaaagaaaacaagagatttacgcaaatctcagtcatgactagcacgatctagatacgcaaaaccccaaatttcgacaaaaccgaaagcaatcggtgatcaaacggtgtgtttttgcacactgaattttacttttgggggtccatggaccgggtccatacaatcaagagggccggatacgtcgcataactccggtgggtccaacggcccagcggcccgtgggccccacaccttcttgcccccgcgggatcaaatacacctcctccggccactccccgatccccacctcgtctccaccgcacgagcagcagcagcagcagcggcggccgcagcgcgagctctctctctctctctcgcggtgggcggcgggatgaaggtgtccgtcgtgtcccggagcggccgggaggtggtcaggggcggcgtcgagctcaaggactcggtatgtcgtctccattcgttccgttttttttttttgagctcgtcaggttcttgattgagaaatttggtgcggattatgggttttggtgttgcagccttgtaggggggagggtttggagttttggttcttgggtggggggggggggttaagatctcgtggaaaggtttgaggttgaggtttgattcgtgggttcttgttttcttttcttttgcaggctaaggtcgcggatctgcaggatgccatctatgccaagagtaagtgcaatgatcccgtcaaaatttcccgttttatggttgtgtttgttgatgtgttaaaggagtagtacttgtagtggctctcctgcacttcgttatcttctcattctttggaagggtttggtcgtatttacatgttgaaaaagataggaatatatgcatatgagtgggtttgcattcaattcaagctaaaggcctttttaaggcaaatatgtttttttatgtagttagactacgactgccttttttaatacatcctacagttctaaattttggaagcgtcgattgagtttggccagtatgtccaaatctgacattttgggagttaattagtatggtcatcaggagtaatcactgttgcacttatttaattcattaaaagagagttaaagaaaggattttctgcacttccattaatccaagagcgtttcaccccggggtactgttgatgctttgactcaaacttgcgagtgttagccatcagagaagtctgatttatggtgtatatcagtacatggaccatgttggtttgggagttgcagataataattgatatttaggctagtatttataagctgaaaaggtaaacaactgactgaatattatgttcgtaccgaacctagtgcttggaacatgaaaacagtacatcgatataataattgtgttcgcccttggttcattttgattggttgactagagcttgccactttgccagtactggcaaggattcttttggttgctgcagcctacaggttgttaggatctgcttaggtaggatggagttggctatcaacctctactcgctcacaagctttgtgtgtgcactttttaatattcgtttacctttgcagagtgaaagaaatcttaaaaaggatagattacatggaatgatggaaacaggaaacgtggttgaactaacttggcaatatactattgactgtatgccaaaatgattttaggaagacctgtatgttgaaaatagcttccaatctttcataaacaaagggcgatagttagttgatatactgtagccagctaatattcgttatgttgaaaactgcctaatttgaaatatgcacacatggtttactgaaataaacaacaaatgtaatactaaaagttcacactttttactaagactgtctctgtcatatgtacggcacaagcattgagtataatatgctattgttgaagaaattggaagtgtttttactgtctgcatttgttttctgtatcatgttcaaatttgcttgtgataaagcctatcttgagtgtttcatgatatttggtgctgtgccttaccctgatgaaggggtcatgctgattcgagcaactagttgtcttatttctgtaaaaccatttctatttcagccctgtctgctgatggttcttcctttttgagccttgaatcaggaagctaattcccctgtcattttgtgtgctcctgtcagtcactcttaagtcaccacctagtgtccgttttaactcacaacctatgctgatgtagcattatcaatgacagacaacgtaatttactgcttgaatttatcaaactttagctaagctggctatcaagaacctctattctatgtcattatggtatttattgtcacaattataagcaccatcttcttgcttgtgccagactggcgcatttgcatgttagtctattaagttgccataatgttatcctgaggtgatgttcacaaggaatttattattcatgttggaccctcaagagtaaagaagaggtcctgcaatgtggtagagatgtagtagagcgagaagatacatcatgatatatggttataagtactgtttaaaatcttcctaagtagttttatttcctatcactgccctcaagtgcatgttagtacaccaaacatgcaccgtaatagatgaaccaaagtgtggaatccaagtacatctagtgattactgaccagtgcaagattgcaaatgcaaactaatcttattctaactgaaagattgcagcattagttgctaatgtagatcataatctttgatcttacatatacagaaaactcagtttgattactttgggtgaatcatgaatgggctagcgggatgtttaaaaaaaaactattttattataccttgcttctcttagaatgcatgctttcaatgtgttctatgagttgctaacctcttggttttacaccatgcagctaagaagtattaccctgctaggcagcggctcaccctccctatccaacctggaaaatcaggaaagccagttgtccttagtgcaaaggccagcctatcagaatactgcgaaaagggttctggatccctgacagtggtctttaaggatttaggcccacaggtcttctacagcacgctgttcttctttgaatacttgggtcctcttcttatctaccccatgttctattacttgcctgtctacaaatatttcggatacgagggagagcgggtcatgcatcctgtccagacttacgccatgtactattggtgtttccactacttcaagaggatcatggagacgttctttgttcaccgcttcagccacgcgacttctcctgtatcaaatgtcttcaggaactgtgcctactactggacctttggagcttacattgcttactactgcaaccacccgctttacacccctgtgagtgaattgcagatgaagattgggtttggatttgggattctctgccaaattgcaaacttttattgccatatcctgctgaggaacctcagaagtccgagtggtaacggtggctatcagattcctcgtggcttcctgttcaacatagtgacatgcgcaaactataccactgagatctaccaatggcttgggttcaacattgccacacagactgtggcaggttacatcttccttgttgtggcagcgagtatcatgaccaactgggcacttggaaagcaccgccgtctaaagaaggcaagcacggtttcttttttctcctgcgctgaagtgctgaacaatgttatcattgcacagatttactgatatttcttattttgcagttgttcgatggcaaggaagggaggccgaagtatcctcggcgatgggtgattcttccaccattcctgtaaggagttggtgtcagcacgatggccacatgggattgaatctttggtctggtctcagtgttcggaagttgaagccttcagtgtaccacttctattctatgatctaaaatatctagtccacaatggaatccctcttagctattgttgaacttctctttgagtttgcattggccctgttgtaatggttaaatacaatacaagtttcatctgatatcagcttattgacttcttgtccatttgtccaagcagtagtaatgcgatcataatttcattttgacgcctggaattgctgtcctattctgtccttctcagctgaagcctgccattttcatgcttgacattgttgcctgttgtcctctgaaaaaccttaccagaagtcgtcgattgattacaaagtatatactagcttcgtggtgtacattggtgctgtttcctttttcttgcttccctgggtgacagtcacatactcacatgcatattttgtaccaagaactttactcgtgagtttgtcatcagttatcactgttctggacgtgtttttaaggacatgtttggaacaaaggaacggagaacacatgaacaggaaaaacataggaacaagaaagagcgtaaagtggaaaaattacggaattgaaaacacatgtaactgtaaaatatgtggtgatgaaacatgagtgtttggatctaatcctaagcaaattcctaaaaaatcccatgttccaaactgggcctaaggaatcctgtacaaaattctcctatgtggacttcttgcagatcacctttttttttcttgcaaaaagactgaccgcattttgttttactctgaccgttagtctccatgagactatgactactgtaatttggccaaagaataatgagcagcagaatccaagttcatagtaacaactcaaacaattccttctcaaaatcatgttctgacctcatttttgtcgaaatgaagttgtgtaatcgaactgtgagctggagctcggccaatcaagtactacgatctcatccgagattcgttcagtgacctgcaaatattttaaagaggccgtatgtttcatatgaaatgtacgaagacctacagtcccagtagccggtttgaccacaagagttcatgctgaccatcactttcgtatgctctattttgttcaaaaattaagtaaactaaatcaatatggtgtcttgttgtcgccgatgatctgtagttgcatggtcagctagtacaagccacaagttgcagagcacagtaggtagtactagcaactggtaaccagtcaattgcaatgcttccagatagaatcatccggtcaattccaacttgttttggtagatttttctgcaccatttgaataaaaatagtcagtttcatctcaacaaatttacagccatttggtcgctacatgacagctggtcaattgcatttgatggagatctgtgagcacacgaatttagcagcagaattatcaactgggagatctgtttgtaactaaggaattttacctgaatttatcaaattcatgcaacaatcagggaaaaaaaagaggaaaaaaatccatatttcaaacgaggcttggaatctatcatgtattcagcaaatccaaagttgactttttactccaaagttggtagttgactttgtagttagtgctcaaaagatttaagtatttttactctgaagatgatgcagcatgcaggtctcaaattagtcatgataaagtgagacaattcttcatggcattgcagcgcagcaatcctagtgatgactagaagcaatcatgggcgatagcattctggaggcagtaattaagtaaagattaagccagtcactttcattaacaatgaacatgtggtggaagaaaaggctggtcttgattttgatatcttgattagcgatgcgatgtgtactagtaatactctgttgttataactactggcctagaaggctagaacaagtcagcacaaggtcgcacatctttactctttcctatcacttatgttttcatctaaaattattttccttttgcaggtcttttttttattttctctctatttatacgatggagaagttccatacgtcaaagataactagcaaaaggaataaaatgatatgatttccactgaagatggcatgccaagtttgattggagctgcatgtactaccctgagcattgagcaggtcaacatagaccaagagaaaattcatagatatcacaaatacatcttttcaataaatgaatcttttattaatatcaagataattataccaaggtgatacaaatacaaccattttaaaatcgctcttggcctttgcaatgtttgaatagctaggatacaatctaaattttacaatgtatttt

SEQ ID NO: 47686 - DNA, 709 bp, Oryza sativa
ctgcgtgctattaattttacatatggacaataataaccagataaaccacaaactcaactctgagtgtgtgtggacacgcgtgtggtgtatctgcgtgtgcgcgtccaacttgtactcgaaaaaaataaccagcttaccataaaacaaaaatactttttttcttattaaaagaaaaaagaaaaagagaggagatcaaactgataactgccaaaagagaatggaagttttcaactaccagcacccgccattcaggcaggcagctacggaccggaatttatcagaaaaccccctcaaatttcccattcctcgcacttgcgatcctttcctcttcctcctcccgttcttattcggggaattcgcgtttcctccaactttccatttcaccaactccctccttgcggcaaaagcaccaccaaaccctcgaatcggacaccaaatccctttttttctgggttgcgtcggctgcaggcgtcatctgaaatcgaaggttcgtttgcagaaataaaaggaggtttctttgcggccggttttgtgggttcttgatggcagcggcgtgcgtttaatctgtttgtggaaaggcgtgagtcggtttatgtttcggtttttttttggataagctggagctggagggtttgtgaggcttcatctcggatctcaggtggtctctcgcatacgtttctgtttggtttctttgtttttttttcttttt

SEQ ID NO: 47687 - DNA, 17518 bp, Oryza sativa
  unsure (1)..(17518): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaagctgtccaggaaaggaatacacaccctttttttccctctattgtgtactttgtgtaagctctgaaaatgatatgcaaataattaatctaggcaaatgatggtgctgtactactgttgaggcatcctatcattatgatttgatttgggaagtctaataatgtgctaattggtcaagaaatcaatcaatctcaacaggagaaggacatgagcaatggcagcttcactccttttggtggtgggcagaggctgtgcccaggcctggatctggccaggctggaagcttccatcttccttcaccacttggtcaccagcttcaggtatggatcaccacatctcaatcttggccattcttagtgcagccattgattccaactccttagctttgtttcatgatcacttggcaacaatagcttttttttctttctagataatggaatacaaactacaacttttgcataattttccatgatcgctcggcaccgatagcatttttttctagataaaagaataaaaatcacgacctctacatcatataatgaatggaataaaaatcacggcctttgcatcatataatgcacgcaaccgggcaccaatggcatgcatctcatgtagtcatgtccctatcatttggccatgccctcttcgcatgcacattcatgttcctagtaataactaatctctgtagaacaatagaagagcggaacagtagatgaattatgcgttgattgacagaataattgtgggggggtatatagatcgggtacgtacatgaggatttgaagatcaagccgaatctttccagagataaaaaaaaaagaaaaaaattatgtcagataataactggtcctaatacgtcactagggatagcatcacgaggctttctcccatgcttatacctcctctgttatcatcttccttgagggagtgatcttactgtgcttaaggaggtatctaaagcggtggtgaagccagcgacatcgtcgagcccggataactaatagtgttttgtagtgatcaatccatttttacacgcgtcaacggtgattggtagtggagacgccgacagcgaagcctagacggtcgttcgacctggagccgtctccacctctgatcgaaagatatagtatggtattttcgcctctcacactgggagatacaactttcggcctacaaaatcaacttctggttttaaatctaagatatagattatttctagattcaagcttagaaattgttttttttaagagacagagatagtaccaaattctatttctataattttcttaaatacagtaaattatttcttctcgcgaggaggattacactgcgtaggaacactaggtcatttttcatgtgaaagaaaaaaatggaagctacgaggaagacaaataatttcggcgcgcggggcgaaaaagaagaagatcaaggaagatacccaaggtgggaggtcggtccagcctctattgcgaatagagcggggtgttgttccgcgcgtggggccacacgtgcgcgcacatgcggcgcatatccatcccttcccccccacacccacatgtgtgcatgcatgcggactacgccgctgtacgcgtgcgtggcttacggcgcccgctgctacagctacagcgcccgcacgtgtcagctaccacgccacgccctgcatgcccaccgccgctgcacctccccttgagacgtggtcgctgggcggtggtgggtctcacatgtcagtacgtctttcgtcaaaaaaaaaattcaactttaatttgtttttttcatggtctcacaaccatgtagcttaccaatgcaaacagactaatctaaaaaaaaaaaaataagcttagctataatgcacgcttcgattaagcaatgttacgatgcgtgtgcttagctcaggatagtgcctatattgacacgaaaatatactacatccatataaaaaaatataagcattttttactataaatttatatatttattcatatttatagctaaaaatacttatattttgggtcggagcgagtatcatattttgattaccagtcgtccatcagctatggagtctgtatagggctacgtcctacgttcgggaggtagaaaatatggtgatttattttatttttttgcggggaaatatggtgatttattaatatatgattaattaagtattagttaaaaacttaaagaataggttaatataaatttaaaaataatttttatataaaaaatcgtattgtttagtagtttagaaaatgtgccggatcgggttgagttgggaaaggaggcgggaagaagcgtggtgtagtaattggcgaagggggtaagaagggggagaccggagacatgggtgtgatggttaggcagccggaatgggctctctatcgactcgaacagttggatgagatgagacgagatgggtgacatgcgtgcgtgcatgcatactttgtgccttgtccggtccgtgactgaactgaatcccaggaacgcgaatataatactgtagcacgcacgcacgcacgcacgcatccagctgatctagccggccgagatgtgccactttgaccggtcgtcagacacgctgcatcaatgtaggagcacgtgccagggtatggtcgctgcatgcctgcctgcaaacaatactatactcctcccataaacaaatcaaactccaacaagagaatccgacttgctagaaaaacatcatatcactttaaacaatggagattggagagtccatcagtccaatgtgtttttctgtcttctttgaccatcttccaattccccattatgcttgtgctgacctctatctaattgatcctaagagaagcgttttgcaacatcttgtaaaaaagcaaatcacataatattactcgtgctttatgtagctaagctacattggatcaggatcctctgcagtcaaagtcacgtgactttgtcactgacattgtgggtccgataatcattgggtccacatgtcttacaaagacaatccggctacatcatcatgccagtttccgtaataaattgaccagtaatttagtactatggactttagaacctggcacatgcatagcacagattcatgcatgcgtgcactgcatctgcacgcatttgcattggttgcacaagcagctagctggcctacatataacatattactgtgttatgcgagcaactggccactgtccacatgaagccagtaaatcaactatcaacattgatagtagtaaagctcttgttcagagttgcaggcatataggtgctccctgcatggtttgctcaaacttaagatagatgatactacattctaaaaatgcaagtatttctggtatgtatctggacaagatggttaggactctagctataacatagaaaatgcttatattagaatacacttcattcgtctcaaaatataaggtattttgatcggatatcgatcccatccggttaaataccttaagtagggagtggcagtggcatcaccatcgatcatgtgttattgataaatgattatgattatgagatctcttatctacaatctctttctgaataatcgacctgctgatccatccattgcatgcatggttgttgcctgacaaggacattgaaatggactgctaattgctgccatggatgcaggtgggtggcggaggaggaccacatcgtcaacttccccaccgtgcggctcaagcggggcatgcccatcagggtcaccgccaaggaggacgacgactagccactagccaccactactactataccgatcaccatactcaactagtagaggagatccatcagatgcatgcatggatcgatgcagatcggtcggtcgagtacgagtagcccacacgagtcgacacatgcatgcaacaagccaagttgcacacaccaagatgcacatatatatcatctatatgtcgatctatactgctacctacctatatatatatatatatatatatatatatatatatatatatatatatatatatatatatatatatcacacgtgtactagtactactctagcaagggatatgatcaggaggggcaagctctgagcaatggtccctgcaagatggccagttgctctagccattgatagaggtgcttacgtatggtgtaattatacaggaagggtaggccagcattagctaggaggcagctttgttaatttagccaacatgtattgatgtataagctactgatcgattaattaacagtactactattgtagaactactgctcattggcctttgatttgatgctggtgctcatactatattagtggtgaccactcatactatagtagggttaatatgtgtacatggaggcattggtccacaaggagcaagtgaaatgaatcaatgggcacaggaaaagggaccctatgcaagcagcaagctgataggactttgaccactgagaagctgggggcctggggcagtgtggtgcagctgcggctgcatgcatctgctttgctttggagtgggggaaggaagagaagaagagataagcatatagggcctagagagagaaatccagcatggaacatactgcactgtagtatacatacgaatacaggacaggagaaagagagaatggactggtgaattgagtttcccttgatgtagcccagctttttgtgtgatcttttctgcaaggttcagctgcagacttgcagggggggtaaaagccactggatccttttgggagatatgccttcatcataaggctgatggttaaggcaccacacaacaaatgaagagcaacctaggggaaccaaactcaggttgccaaacataaaacgtcgtggctaatgattcgtctcaagagtcaagatcagatcagctgccctacttgtttgtttccctttcttgagctagattttcccggctttggaacatttataccactgaacatgtatcaccgcctttgtcttcctcgtgtcagatgctattggaaccctcatcttctctcacgaggatgatggtaagcatgatagctcgatgtcctacggcacgaaaatatgggtgacccaagatcaaatagcggcagcacaacgatctaacataatatctggactggacctcccttctgcagttccttccaaggtatgcccagtagagaggctaatgagcccagcttttggggagcaagggaggcaggcacgcacacacgcttgccctgccctgccttttcaattaactctcatgtggcctaatggtccaattaccatgggctccttactttcattaactctcctgtggcataatggtccaattaccatggacaagcctcctccgtttatttctttctttcctctggcccacccgcatgtgtgcatgcttgccaccgtgcttttctaaactaaagttgcataggatctccctcttttttggaaaccactacatttccaaaaccgcggccatacatatcaacagatgattacagaaaacatgctaatatatgcagcagcaagctcaactacacaagctttaaacacccctctcttattagcattattgaattcttaccatattgccaagctgtacggtttgcagctacagctcttggaccaccagagaagccctcctagcgaaccaaatgcatccccagattattgtagctctgcttcaagacggtcctgcaacagaatagtacaatcgcaacaaaaaaataataataataataatacggctcaacgtgaccaccacagaaccaaaagaacatcgaaatatcaagctgcaaaattttagcatagttactggttaatacacacaaataatacatcaggtcatgtgaactaaggcatgtacatgaaccaacagatggactcaataacatcaaagcagataagatgcttaaagtccaaatcagtccactagctagacacaaaaattcaatgatttgttcatagccatgattttaagccccaaaaaactacccaccagaaaagcctgaatagtagtgatgtcatgaaacatagaatgaaaactagcagattttgcaaaaagtagttaaggcgcaaacagaatgcaaactgtggacctacattcaaaacagatagccaattggcactaagagttacggattgatgtacctatggtgataagattcatacaaattgtggatgttaacaaagtattcatggaccacactgcagcaaaagggtctctcttcatagaaacaaaattcaggtttctggttatcatcatatcatgccaaataactccaaatgacagatgtattagatttgcaacagcagcaaggaccacaaatccattgttctggcagatccttgtttaccatattatcttggattggtacagtaaaaagctggtaagaagctgaaggccgtactagcaaagatgtggatatatcaatagcagccactacagagggaaccacacgccctacagggccagaaatttcagactgcaatttcactccaggacattgacttatgatgcacagcacaactgactatgggacaaagttcctaaacccccagtcccagcgcacagagatgtttctcaaatactgtaaataactgcaggaatagtatagatacatatgaagagcatcctatgttcgggagagagcaaaaattaaactgtcttcataccagccgcaccgcatggccacaccagacagcctacagttattgtcacatggcgatcatgagctgttggtttggctttcagaactcagaaggcaagaaaaatcatactgtccaagaaagccatttcagttgatcaccacacagcagagaaccaaaaggaagtgtaaattgggaaaaggagaagatatgcagagtaggcatatattgtacaatgctaaacaaaatagtagtgaaattatgccatcagtgttcaggcaatcaaaccaaattgcatgaaaccaaggattcatcaatgtctggtcaaaatcggtaccacaaatatgattaaatgatggtctaattaactatctttctaaatggaaatcaaaagggcttcatattaacattaatggatccaaagtatgagtcggcacactgaaaaaaatatgatagagaaaccgttctaataactgtaagcaaaatattatatgccaatgccacagtttgagctattgacacagtggatgagaaggacccagtcatatctcataaaaggggcatggtgtttaagttatataaatctacctttaccgatcattagttaaaagattcagtgagccagaaatacacatagccatccacaaagaaaggccaaacattgctctctgcaataacaacatatgaaaatcagctccatgaccggccacctccataccctctatatctatcacggtggcctgcaaagatgtgacaatagtcagtcacattcagaattttcaaattcttaggcagcactataggtgaaaagaaagtaggcagaaatcagaatctgtaaacttgcttctacaataatttgaaaatagttagataaacagagagcttgcctgaagaagggggtggtgcaccacgacccatattagctaattcagggctgaccttttgtccagcttcttctagtatgttgatcagatccttggcaaatctggcattagcagcagtgaaaaacgtgtaagctgttccttttgctccagctctgccagttcgaccaatgcgatgaacataatcctccaatgatcccggaaagtcatagttaatgacatatttaacatccttaacatctgtttccagatataagtggcattagtttacagaaataaatataattcatcgatctgggaggatttttgtatacctaagcctcgagcagccacatcagtcgctgtcatgatagggcttttccctgatttaaattcagaaagaacccaatccctctcagcttggcttttgtcaccatggatagacagagcaggccaaccatccatccgaagctgtctagtgatttgatcacatcccttcttcgtgtccataaatattaatatccggctgccatccattatatcctccagtagattaaccaaccttaacatcaaagaatttcatcatcaatgcattctgaatgaatcatttcagtgtgtaatgaagagaaaaggtcacgcggatcctacttattgtacttctgactctcggataatatctccacatgttgagaaatggcatgattagctttcaactcctcagaaccaattatgacctgcagcacaaaaaaagcaattgagttcacatgaagcagataccgtagtctgccataaattcatctgcaaaatgatgcattggcaaaaataaccaccttgtatgggtcgaaaagaaagttccttgctagctgttcaacttcctttggccaagtagcactccaatataatgtttggcgatctggacgaatctgaaaaggcagatggtaatcccttaacactatgtaaaacaatgttggtatgttgtaggcacggttcatggaggaaaactctgcctatggctgggcagtgttggctgctagggatgagaggactaggttgatgcaacaaacttggggagagattataggttgatcttcatctgattgattactaatggatacatgctaccctttcattctgttgacagtgtataagtaaaagcatgtaacatgtagcaagcataattattagaaaattgttgagaatggaataatagattcagaagaagaggcatacctgagaaacaattttcttaatctgaggttcnnnnnnnnnnnnnnnnnnnnnnnnnnnnnnnnntaaaacaaggtaagtgaccctccgcaaatttgtatgatgtgattctatcatatcaatcagtcttcctggcgtggctataacaatttcaacgcctggatgcaaacagtgacaaattaaactaaatatactacacaggatgaatgatcatttaagctatagatcaataggatgtccttttgaacagtgtcatttcattattgaccaactgaatgtccttcaaacattgttcatgacttcatgcgtgcagtacaaaagattccttctggttgttgaacttcctagcataagaaagaaagagaacctttttgaagatcgcgaacttgaggaccttttggaacaccaccatatatgcaagtactttttatttttgatgacgcaccaaacttagttgcctcttgctgtatctgcacagcaagttcacgtgtaggggctaacaccagaacaattggaccatcgccaggtgctttaataacacacggaaaaatgttagtagattaccacaaaagaagtccagaatgtatccaagaaaatcggttaagaaacataagcaacatttcgcacctagaatcggctgagcattaacatgaacaatggcaggtaaaaggtaagcaagtgttttccctgatcctgtttcagcaatgccaataagatcacgtcccctcagtgccattggccaaccttgagactggataggagtaggttctacaaacccagcttttgtaatttcttgcaaaacatattctgcacaatggaagttaagtatcttggatcaggaaatatagaatgtaagatgtccaagattaaaaaagagcaaaataataaagaatgtagttcagaaggtaaaggggctcataaattatcaatggctcaagtccaagaatgcaagcagaataatctttgaagagcacaacagatcttaaatgaataacaagtgacatattcatatcctttcctcctgatgaatgaattggctgatgaagtgatgataatgggatttaatgagaggaccaacaaatcctaatcggagttcaaagaaaaccaaatgatactttcaccatttagtgttcagcacttgagctggttgcacatgttatcgctgttggctgtttttctttggaaaaatcattttacaactgttaatcatggcctaactccagtttccaaccctcaacttcgaatagttcaccttttgaccattgactattagaaccacctactgtttaacctttggcctcattctagagtggttctgcagttacatgtcactaatgtgacaatgtggctcaaggttgaaatagttttgagtatttacagccaaaacaaattccgccaaagcagaaattgtggtgtgaaataactgttatgatacttcaattctttgatgattcaatgtagtttacaacacaaccagctaacgaaacaaatagacctatacattcccctcctgaagcacgtccatctaaattccaattcctcctggagcacgttcatctaaattgcatacatagtactatagtaagtgcaggacaagggtagcagtagcacgcagcaaacgaaacctgggaatccgacatcgcggaactcgcgcactggcttgggcacgtcgcggccctccacggtgatctcccggcggcgccggtaggcctccacctcctcctccgtcatgccggccacggagggggactccacgtagaagttcttctcgaaccgcggcagcccatccaggtcagcggccgcggccgcggagtccgccttgctcgtcggggcgaacgccctcgtcccgcccccgaacgccccttcgctgcaaccaaaccccaacccaacccaacgagcaatcagaacccccaacacttagggcttagggtttagaaatcaaaaccacggtggtggagcggttacctgcggcggtcgcggtacgagccggggtccgcggcgcggccgtcgaagcggctcatggcggcggcggcggtcgccggcgacgagagggaggcggggggtgcggctagggtttagggcggggcgcacgtggccggagagtttggtgggttctagaagaagaagcgaagcaaacggaggacgcgaatcgaatttggaggatttggatttggagggcatttcagtggcggcgagttcaagcggaggggaaaagtgtggggagaactgatggagcctatgacgtcgaaaacgtactctgaaaaagcacaaaacccaccagaaaaacgtaatactccctgtgtcttggtgttttttttttcaaaatattgttttcttcgcttcttaaaacggctcaagatggggaaaacgaacttttgattgagccgcggtcgattttaattaaatttagacctagataaatggtttatgggtttcttcatcttccttctttaattatttttcagccttttgactttggactgataacagtagaattgaaaaactacgaattacccccccaactatcatgatcgaccgaattaccccccgaaccataaaaccggacattttttaatcccaactatgcaaaccggacgaattacccccctcgacccaattcgcggtggttttagtaaacgtgggagtacagtcagcaattcttttaatataaaatcagtgggcccacctgtcagttcgccacccctctatctctctatccccaatcccccccctctctctcttctccctcccctcaccagctcaccagcatggcagcattgagaatggcgacggaggagtggagggcgatgctcgggcgctggcggtggcgcgcggaggcggaggttgctcggacgccgatggcgcactcgtgcaaccagcaacgaaggcggaagcgaaggcgagtagcggcacgcacggggcggccatggcggagaggcgatcataccacctgtcatacctcctcccccctctctctctcaggcataaagctcgcacagcggtcggcgtgtgggcgccggtggcgcgcgtcagacgggcagtcggcgtgcgggcggtggtggagtgcggggaggacgcggcagcggcgggcggcgtcgaggagggtgttggaggacgagggcggcaggacagcggtaggggcggatggagcttgggggcggcgggcggtggcggaggccgctcagggcatcgaggacagcggcggacagcagtggaacgacggcgagcgagggaggtaggacggcggcgaggacagatgtagcttggggtggtaggatggcgacgggcgatggtggaggccgctcggggcgtcgaggacggcgaggctgaggcagctcggggatgggcggcggaccgcggactcactgccggagcccgatgttgtgtccctcctggcatccctcacccgccctattaagcagaagaggggaacaacgctgcaagcggtggcagtggagtgggggcggcgacgaggggacaggggaggaggagctcatcctcggccaccgacggggtgcgccgcgagctatgtcactgcccccattatgcccgctctcccgacggtgccacacatagagagagagggggggaggaggagggaagccgcgccgagggggtgactgctcgtcgtggccgcatccgccgacgctgcctcctcgttccccgtccctgccgccaccgccgctctgtgtcccccgcctgccaccgacccgtgagagagagaagagagagagaggaagagtgagacagagagtgagagagaagagagaggaagagtgaaagaggagtatgacaggtgggtcccacacatttttataaatagaatattgactggactgccacatattatggattgggtcgatggggtaatttatccggtattgaaagcatagggtaaacgatgtctgattttcgggtttagaggggtaattcggtcgaccgtgatagttcccggtgtgtgtggggtgaggggggggggttggttaatttgtacttttcccgtacatttttatcctagttcgtttttaccaatcatgtgtttcgacttactagacgtaaccgtgatggccaccgacgttgatgacatctatgggcgcaaatgcatcatgcaccttcttacaggagatgatgttgatgttcctttcttcaccttgctgccttgagagttgagaccacaaaaatactttccggctatggtctctcagtttgtacctatgtctcgtgaatggcagacgaaacataacatttcatgcacaaatattctattttgctttcccttctcgtcatcgttgaagcatgctaagagtgatctactgttgttatgggtggggagaaaaaccttgcataccgtggaccgtgcgaagctggtgaatataaataggctctgtttatttcacaaaacaaaaattctcacgctgtcatattgaatgtttagatacatgcataaaatattaaatatagataaaaaaaacaattacacagattgtgtgtaaattgcgaggcaaatcttttaagccttattgcgccatgatttgacaatgtggtgctacattaaacatttgctaatgacagattaattaggcttaataaattcgtctcgcagtttcctggtggaatctgtaatttattttgttattagactacgtttaatacttcaaatatatatccgtatatccgatgtgacaaccaaacctaaaaattttccccaactaaacaagtcctgattagcaaacaaccttcttttacatcaccgtccgtacgttgcctccactcctccgaattgtgtccaagttgaaattttcacatgcaagtacctcaagggtgtttcagatatatttccttgtattccctctcttcaccaaacaaaatgaacaaaatagtaataactgtatccagtagcaaatatttaacttttgataacatctttcacgatgttctataactaaaaccacgaagtcacaatgtcaataaaaaatatcttattggaaaaaaaaccgttttgacaacaaacacacatgaaaacacttgaacaaactttgactgagatcttataagcatttctcacgataaccaatgggttcaaatcttttcgccatcatacgttgcaccggttactcttacaaataataaaacatcctcatctctgctattataaaaaattgaagatatttttatcggtacttttgatacatcatccgtgtttaataggtttttaagttcaatcgtttttagaaatacaaatccatctttgagtcggtttttaattttgttcgtttttaaaaatacagaaggagtcgtataagaaatctctttaaaaaatttacatgctaacttgagacgatcggacccctaattgcggcttatgattttgtaaaaagaatatccaagcgaatttccacgataaatttcaccttagctaaaccgtataataataataagattaaaatagtcttcacccgttgcaacgcacgggtatttttctggttgtataataaacttatcatgacagtaaattaaagattggagagaacttagctaatatggtggtggactcagacgtgggtgggtatgaagtgatcaagagtttatgctaggcctttcggcagccaaatacatagtgaaagtaagagcaggtataataacaggctataagtcggctgtaaatatattttaagaagataaataaggagagagaaaagcagcgggctatagatttgtagccatatgtagcacggactccaagacacagtgtgtgtataacaggtgagaccaggtgttaattgtgtagtatgtaactattgtatgaatgagttattagattggctatagatgaattggagctagtagttagctataatattaaacttgctctaagagtgtgttcgctagttcccaaccagaaccctccgcacgaaaaacggagcaatccattagcacgtgattaattaagtattagctaacttttttttttcaaaaaatggattaatttgatttttaagcaactttcatatagaaatattttacaaaaaatgcattgtttagcagtttgaaaagcgtgcgcgcggaaaacgagtgagaggggttgagaaaaagggcatccgaacacaccctaaggtagccccactctctcctaaacaccccctaaataaggtagcatgtgcttttacatcgaggcctcatagcggtccacccctgagactgagtctcaatctacccccggtcgtgggtacacgatgatcccatctgctagggtataaatttggtgctcatagacaatgtactattgatgtttttagataatagaagcattgttgtgctcagttaattaggaaaaaaagattcatacctggaatactcttagcctctgtataacttggacgcatgtaaccaagcatacacccacatgctagcttttataacaaaggaaagtatagaaaaaaatactaagtaccatcaatccacgtaatatactctcacctagcgaaagtgaacataattcaaatggttagtttttttaacctgttcatgagtatatctaggttttaagttctagaattagcacgtgtactcgtatttacgtctaattatttaatactgatgacatatctgttgacagtgaaacgcgtatattgaccaattcaacctcaagacatgcttataaagataggatgtgtcaaacgctgaaatgaacccaaccaaagtggatgaacgttcactaaacaaaacacatcacacgtcacgttcaatcaaactcatctacaggctgcaaccaacgaagaccgagtttagttctaaactttttcttcaaactttcaagttttacatcatatcaaaacttttctacacataaacttttaacttttccgtcacatcatttcaattttaaccaaattttcaattttagcgtgaactaaacacacccaaagtaaagccctatatcggtctcttcattctccacctcgatagccgccgagatcgatactttgggtctatttggagagctaaaatcacgagaagcggctggttggttgtcagctttataaaaatctagaaaactagaatttttagtttttaacttccaattcattctatagtctgtacaactataacttttattaagatttaaaaatctggataaaaaattagactgtttaagatatattgattcaagagactaggatgtatttagttcatactaaaattggaagtttgattgaaattgtgacgatgtgacggaaaagttggaaatttgtgtgtatagagttttgatgtgaaaagttttctttaaactaccaactttttcatcatttcaatcaaacttctaaattttagcgtgaactaaaagacatctcagacctagtagctaacagaaacgaaacagatcctttgatgtttcatccttatccgtagaataccttccattgcagctccaccactagaaagtctagactctagagtagctcgaaacaccgaagcaagcgaaagagcatcgccgtgccgcgcggagcttttaaaacgccgcaacttccttccttccttcctctcctcccacgcttcccacttcgatttcccaaccgcactccagcgagagaaaataaaattttaaaaggaaaaagaaaaaaaaaagatatatcagctcccgcctggggatgacgacgagctctcgccggcgatggactcaccgccgcaccaactagcactcatcgtcctcctcgtcgtagccctcgcggcgctcttcctcgccctgctgcgcggtcgctgccgctgtcgcgagggcgaggctcatcagctgcccgagcaggcggaggccggcgcgggggtggcggagggggaggagggcgggagggagaggaggaagcggcggaaggcgaggaggcggcagcggaagggcgccggggacgacgacgcggcgggcggcgagggggacgaggcgctgcagctgcagctgctgcggcggcggccgcggttcccgctcgcctcggtggccggcgcgctgcagcggcggatcaccgcgcggtacgacgacctcgcgcgggccagccaggcccactccctcaccatccatcaggtcagcagtgcgccgcgtctctgattccatatcacaaatgtcgcttcagatgcaaggattttgtgcattgcgattactcgaattagggatgtataaagatgtgactccagtagcatgcttgacttatatatatatacaactgggtgccgttcattgtttgtttgtttgttttgctaattgctttcatttcagactttcaagatagaatcagacttaggtttgatattatggatttaatgatgttggttggtacattttcactagtgcggcaagtattaaatcaatggttttgctgactctacatgcggcaagtttgtttaggacagaaataaaaaaactacactagtgttattcacactgacagcaatatatcttcagggttacagtgtcactgttacctgctgaaaaagaacccaaactagagcagtggtagacttctattttgctgtgttggtaaaactagataaatgcatatatgactttggcactatgcagtactcaggccacatgacagtggtt

SEQ ID NO: 47688 - DNA, 22618 bp, Oryza sativa
ttagtagtagaagtgcggttccatgctccacaacccggggtcattgacccaatcgacacacattcatggtgactgtgcacggcatatctaatcagaactgaagcttttaatgaaggaaagcaagcaaaagccattttcttttttagaaagcaccaaatcctctaccattgactcaaacaagtgccaagcaaacggagtcatcttaacccctcccccccaccgcccaccgcccaccgcccacccacctccgcacccacgtggccacgccctcctaggaacaaataaacaaaaacaaaataatcgaaatagatctagatatagcttgtgtgaccggctcctacggccctaccattgagggttcgcctccgatcttctgccggaacccatagccatgaggacttcccttgttcgtttcttccttactatcctcgccaacacgtttctccattccccctaccagcactcctcacctcctgaatcatcccaatgttcgacgccgcttggtagcgagagtggaggaaagaggaggcgggggaggagggggaagcagaagggcttgggtgaggtggtgtctgttcacgagaaaaaggaggcaaaaacatcacctttccccctcctgctgttgtgccgtgcaacgagacggcggatcacagaggtgtatgatgagatgtaccaaattgttcgtgctaaaaggaatgatactgcaaggttagtaatattttcttgtatttgtgatacagctagatctggtggatttatttaacagtcggattttagtttgagttgggaggttggtctgttttgagtatatgcaagaacaagaataggaaattttggtgaatgtgtgaagtgttcaccaccaaattattcatcgcctgtagtttttgtgcaattcaagcaggtgctatcagtaatttgcgtttctaaccagtgattcagtgaaattaaggtgccagtgtttccaactttctatttttcgcagatgaaccttgattttctattaaggtgccaattatttaaagaattccatttttatgcatcttatgggggaattttgctacctagctagagttaactactccttacagcctcactaacttggtatggatccaatgtatgatccatgtcataaaaagatcactcttagaagttagacccttgtctttacccaattaagtagtatggagtttctattgtgcttgtttcagtaaaaaaatgattcgtaaagaggaatcaaagtgtcgagtggagctcactaatgaaagggagacctaactgtaagttcataagtgttttttcttgcttttatggacataatcttctttattcatcactttgctggataatgatatgttgagcacgtactccctccggttccataattcttgacgttttggacaatgacacggtctccaaagtatatcgttgactttgttttcctattataatatatatacaataaataaatgcatgtttacttttcttatactttgaaagacaaatctatatatgttgttttagttcctttaaactaaatatttttgaagttattgataatcaaagttacaaaagtttgacctcaaccttgtccaaaacttcaaaaattatggaaccggagggagtagtatcttagctgcttgctctgttcctgggttgatcacaatattttggaccatataatctgattaaatggccacttcttcagtgattagattccttggtctgtgtgctctacattttaaccaactatataccagaaataggaatcctgtttgtcaaccgcctttttgtagtagtgttaagactccagaattttgtttcgagttaagagtgaagccaccaactcaaaggacaacacacaattcatatgttctgttatgctgcctcaaccaggtaatatgggcttgagacaacgttgagctgctcaaaagaaaccaaagcttcttttgttcagcgactatttgtttcttttggcttttagttttctacattctgtaacagcctctacgaattagattctaccctgtaatgttgaagtgtatcatgatttatatagcttttaactttttttttcaggttcacgagttcattaactgtttggtagatgcaagaaatgaactgctgcacaagtatgttgctatttgcatgaaatttagcttcagacatccattactccaaataatgtgttatgcctattaggtcggagatggttcaaagaagctgcagaataaagaaggccttactatccaacccttgtagtcgcagggctaacagttatgaccgcctctgcgaacaggtgatgcatttgacaaaaacaaatttcgtaccaacacgactaagtgatacatttgcgaccagaagatctattcatgcaaatctttgctaacaacatcttttgatgtctcttttatatactgacgtctcgggtattggcataggtgcataaattggaagccgagcacaaaaggctaaagaaggatgcggatatctacaactatattcaagagcagcttcagatgtcagagtcatacaaactggtaaacttttactatgttcttattaaaagcaactctgccctgttatattgaaatatgaaggttgtgataacaatgccatttaccttggcagttgattgagcttagtgcgttggtggagaaggccgaacgtgaggatgcccttgccaccgaggccgcagagatgacattcgaggagctgctggctcaggagaagagcgacgccgccttctggcagcgtcacaggaagctgacctcaatcttacccaagtagagtttgataactgaccgcgcgatttcaccatcgtcaatagtagcccgaacccgtaaccagaatttgttcctggtggagcttttaatgttgctagttgcaaccgtggtgtaatgcgcttgccaagctcttgggcgcctgaaagtccagagtccttgaccataaaacctgagagattcaggtggttggctgacgaccagcaaatgctctcatatatcctatctggtacttcggccatgaagatttcttgcctgtggatgccctgatggaattgagctttcttcaatgcagaaacaactgggaccgagccatttatgccacagcctgcactgatgggtgaattggtgatggcttgctgcttgcttcggatttcttgtttctcttttgaggaatggcttgagaaattcagaggcagtagaaggctactaggctagcagtatcatccatggtgcattgctgttcatctttgttcatcttccatctctgcatatagatcatcgagcattccgaagacatcctcagctccggtgagattcggcggcgcgctcccggcggcgaaggcgaccaccttgttgtccacttcaatccagctctgccccggattcttcctcaatccggcctccttcgtcatcaccctcaccttcttggactcgtcccacatgccacacatggcgtacaggttggtgatcagcatgtggttgccggtgctctggtcctcggattgcaggacattggcaatggtggcctcggccatggctgcatcaccatgaatcctgcaggaattcagcaatgctccccacacgcacaggtcaggtctcaccgcatcgtctcgacgagctccgacgcgtcccggagcaagccggcgcggccgaggaggtagaccatgcatgtgtagtgctccatggatggggagatcttgtgcgctctcaccatgcgatcgaacaggcggcggccctccgtgacacgcccggcgtggccgcacgccgacaggacggcgacgaaggtgacgccgtcgggctcaaccgtagctccggccatgtcggtgaacagagcgagggcttcgtcgcacaggccgtgcatgccgtagccggccagcatcgagttccatgagatcaggtccctcgtcttcattccatcgaacaccttccgtgcgccggagaccttcccgcacttcgcgtacatgttgatgagcccattctcgaccagcgagtgcctatctagctcggctttcatggcgtggccatggagctctcgacccagccgtaacgccagtaggtcgacgcaagcggagaggacggtcgccatggtcaccacgttcggcgagagccattgctgctgcattcgccggaacagctccagtgcgcggtcagtgtcgccggacgacgcgaacccgccgatgaccgcgctccagctgaccacattgggcgcgaccgtgccgccgatctgctccatctgggcgagcacgtccaacgccttgtcgcacagccgagccgcggcgtagctggtgatcagggtgttccatgtcacggtgttcttcgccgtcgcgtccctgaaagctttcttggcgtcgtccatctctccgagcttgccgtacatgcagatcaacgagttggtgacgaacaggtagccatgcatgaggcccttcacgacgccgcagccgtgtatcgccttccctttggccaatgcaaggtcgccggcgtaagggcacgccgagagcgccacggccatggactcggcgttcccctcgcagccgctcctttgcatttcaccgaacagctgaaggacatccgcgtgcttcccgctccgcgcgtgcgccgagagcagcgccgtccacgtcacggcgtcgggacgcgcccctgcggcggccatgcgcgcgaacgcgtccctcgccgcgtcggggtcgcagccgctggagtaggcggagatgagcgcgttccagtggaaggtcgtcctccccggcggcattgcgtcgaacacgcggcgtgcgtcggcggcgcggccgagcctggagtaggcggcgaggatctggccggcgacgtcgtgctgcgcgtggaggccgaggtgaagggcgtgggcgtggacggcggaggcgacgcgcggggaggcggcggcgcggagggcgagggggagcgtgtaggagttcggcagcgccggggagagcgcgcgcatgcggcggtagagcgcgagggcgaggtccccgcgggaacggccgaggtgggcgcggaggaggcgattccatgggacggcgctggtggtcggagggtggtgatggtggatcggttggtcgccggcggcggtggagagatggcgcgcgccgcgaggccgatggctgggacgagaggtagagccgcgagcgcgaaggagacagcgcatctgggagtgggtcccacttgccagtaaaagcaaaagttatgaactccggattatattataaatcgattgacttttttatttatcaaacttttttttaagtttaatcaaatttgtaaaaaaaatatattaatcaatacaaatatatcaaaatatatttaatattaaatttaatgaaactaatttaattttatagatgttgctatttttttctacaaacttgatcaaacatgagaaactttaacaacggaaaaaaaatcaaacgacttctaatataaactgaggaatggatggctgaattgaattcagggcaaaaattagcactgcaatctcgccgttaagtacctttttttttaccctcaaaagttaacaaaacacgtacaattctgggttgcttcacaaattacaacatgaacatacaaagtcagggaggggcacatcaatctggaacacatcagggtgtaggagagaatggaaaccaagggaaaaaaaaaaacaaggataaggtagatgagttagctgtgaagaaagtttttgtcagctgcatcggtggccgtcttctgaacattcagaactttgagatgatccctgaccagcagaggatgtcatgagtctctgcggagatgtagaatagaaccaagattagcatgaggcatataacttgcattttgcacaaacgatttcacaggcatagtgtactaaagagatgcttcaggatatgcatactatttactggaagtgtagagcgatcatgtccttgagttgctagacctatcataatatggaaaaaggttgagcagaactattctatggaacagccgttcaaaaaatgtacctgacgatcttaacatttctgaaggacagcatcacagtaagaatcaaggtaaccatcgcgaagcaaaggtgctccaaggaatggccgctgatgaagtaccggttcacactgtatacctttctgtcagcaaggccttcaaatcttgcaagaaggtaaaaacctgcaccaagatgccaatcaaacaacagttttcgttcaagcttttttttgtagaaagagtttctgctaacataaccttactacataagatgttaacggttacctgtggcaagaaaccaaaatcttgagtgtgtatattttggaggaaacaagaatagcattgcaggaattgcaatgcaaggagcggaattcaaaactacccataaccgcatatcatcaagaaccctgaaatcatcgagaacagagcaagaggactcattttattatctgatatactgacatcaacaatggaacacgctataggtgctggggcactattacctttcacatgcgctgctcaccagtatgagagataagagtgatagcaaacaagataacccagccctttcatcaactctttcaattaccaatatagacaacattgaagaagctgatatcatcatctgcgttcatagcatccagtgaacattcatatcgaggaaaaggatagatacatattcattaatagcattggttatgcacgataacatgatagtcagattggctgcctagcacagtagtatggaaactcagacacatccttttttttctctttttgcctatggttaatacttcgatgatattaaggacattcaagtaggtgaactgcattttttgaacatgaactacttaatacagttttttctcccaatggactcgaagcataaaatgacaacatatcaaaaaaaattccaagtccagaaaccatggaaaacaccacgaaataagtaaacagtagatggggaaattacagaaagatgagatatttagataccggcaacctgtcccaaattaagcggtcatcatctggtttgaggtgatagtaagccgagccaaatgctgctgctacattcccagcatagaagaggaaccatcccaaggcctcccatctcaagctgcacaattccacagtaaaaacaaaatattaaacaccagatcttacctgctgatctgtttttctgttaaataaggatagcaaaataggaatatctctttaagcatcatgccctcaataccagcctagttgtacaataagcagtatttcaagaaacatgaagatcacacacttgttaaataaaatttcaacatcaaatttaaagatttgagtacacggtttggtggaacaccctagctcaaattccattatatacccactctataatatagcaagattacagattattaaagcaattagatgaataagcatgtaatagctacaggcccaggcaaagttatactagcatagcagcaaaaatattatttcactggtcaccaacattacagtccatctttctctcagacagaagcagtttattagagccaggggagttcataaccaccctttcactttggtggtaactgtaaataagttcataaccaggggagtagtaaaatgagcagttatgaaacaattaggcacaagctggcctcctctctctaggttttcgagcataatcagggtaaattgacctcctatataattttgttcaagctcgtggtactcgattctcgaatactttaattacagctcttccctcgctgcaaatcacgaaacaatgtaacttcacgcacttctttataatcctttaggcgagacatttcaccgaacagcagccgagcaagggcaaagggcggagcgcgcacctgatgccgaagcacccactgccacagaggcagaggacgagcccgggcacgcccgccaggaggagcgggtaggcggtgagcacgttgagcgtgttggggacgccgaggaggttgcgcatgtcggcgaagaggtggagcgcgggggagtggcggagccgcggcgtggccaccaggagcagcgccgaggcgaggacggcccccccggcgagcgcgcggcgccggtgctcccggcggagcgccgcggccgcgaggtggccgaggccgaggccgagggcggcgcggccgccgccgccgcggtgggggtggtcggcggcggcgagatgcatgtggccagggggagtgctcagtggagcagaagaatgcggtgaattttttctggtgttgggccgccttgcggttgtgggcctgcttttcttggggattcttttttagccaggtcccttccattcatcggccatacaaattagtccctgggattcttttcaagttcggatgagtttatagaaaaatttagaaatatctagagcattaaattagttttatctagtagtattgaatatattttgataatatgtttggtttgtgttaaaagtgctaatatacatttttataaaatttggtcaaacttaaataagtgacttataatatgaaatggagagggaattgtatctttttaatcatcgaccaaataatatttttttaagaaatattgaatttcatgatcttaggattatacagatttgttgtccatctcggattgatatcttcttctccaactttggtgagctcaaccaactattttaaatatatatggcaccattggtttttctctaaattttggccaatgatattattcaaataaataaataaattgaataaaattactaatagatcatcataattaatttaaacgtgacttgtacctcaagtgtatttgcacaattatctataaaaagccaaattaagaaaaccaacgatgtcatatatgtatctaaaattggaaatgttgcatttcatatataggacatttggaagagcggtagagtctgagaaacaagttgcgaggtgtgtgcagtaaaagtctaacaattttggtagtttggagaagtgggagactctcttgaagcagatgtagctacttaaaaactcttctttgcacaacttttccaacttcactatattttctgcacgcacgtttcacaaacagttaaacatcgtgtttttcataaattgtttctctagaaaagctgttttaaaaatcatattaatttcccttttcaagtttttttagcaaattttattaactaataatgcgctaataagagatctcgttttattccatgtggaggagattaattagttcccaacacaaggaaatgaaacagcctatatggtaatgggcatgaggcatagggcaagaggtgtgttcatggcgtaccataatatgtttagggggtgtttagatccaccccaaaattttacaccatatcacatcgaacgtttgaacacctgcatgaagtattaaatataggctaaaaaataactaattgcatagattacgactaatttgcgagacgaatcttttaagcctaattgctccatgatttgacaatgtagtgctacagtaaacattgctaatgacgaattaattaggcttaataaattcatctcgcggtttactaacagattctgtaattggtttttttattagtgcccgaacaccacatgcgacacccagccctatataatatccgatgtaacatgccaaaactttacacccctagatctaaacacccccttagagaaatctaagattctcaaaaaacaagcaatttactagtgagaaacggccaaaatatttctctaatatatatatttctccaatttagattcgcaattgccgagtatcaactgccgagaaacggccaaaatatctctaatagcattaatatttcatatgctatattgtttcaaaaaattattttcatatgcgatatacttggagtcagggcaaattttactttggcgtaccacatctgctatataagttggggtgatcatttggcgttcaaatatgggaagttgggcggcgtcgcggcggtgaccgaaaatggaatgctcatgcaaccgcactgcccggctgcagatctccggttagatacgcagtactagtacttgtcacattgctatcccaatctttttcttaaaaattcagatcaccaggtactagcttactactccagtgatactaaccactactactcctggagactataataaacatatatatatatatatatttagatttattctctatcaatcgccttaatttgaatcaattatgtgcacatgttgtacaattaattcacgtacgcatcgaccgacgccggccgttaatttgtttcagttaattaaagctatcagctaagttattatgtgagtgcatatatatagtggtttcttgtcatgcgcagacagatcgagtgttccttgtgcaaacagaaagctactcgatcatatttcggtcctcaaattaattaccaattaattaattgataattaatcaagtcgttgttggaactaaacacagattggccagctcaaaagcaaccaacaatgtcgttgttatccatgtgatatatcgatgatgatgtgaatctccggtgtcgttagccgtcgtcgtcaattgtctttctgatgattggcttacatcgatcgatcgagctctccaaggtatcaggaaaaggccagagtttctttccccagattcccctgaaaatacccttggtttggttttccttcttttccaatggatcttgattggtgatcacgccgcctttccggattttggggtttcttgtttccatatggatcgatcgatcgatcttacgtcaattctggcttgatacacagtacgtgctggatgtggaagatctgtaagaaaagcgggtagatagctaggtatatactgtatatactccccctgtctcataaaaaacgaatttagatcggatgtgatacgtccagtactatagatctgcatagatatgtatattcaaattatttatagtgctagaaacgtcacattcggtactagatagttttttatgggatggaaggagtaaatatatatactgaagctgcagacgtcaaaccaaatgtgtacgttttttcttcgtgattatcttgcaagatcttcgtaccagatcctgatttaatcgcatatatcttatacggtgactagaaagtactacagcctcgatctttcggagtaaacgattgatactgtatttgtttacacataaagcaaacagctaaagctaacagatttagccgaaacagatcccaaacagtatcatacaaaataaagctagataggtctatatacctatataggtcatgatcctacatcagccaggaaaatgtcctgaattgatgcagtttaatacaaggactgagctactaggtgtatgtatgtgattaatttaaatggatatcataaaatttgatacgatagagtacgatgatacaagctcttacataaacacgtaaatctaaattcgaccaaaaataacaaatgctaattgcactgcagatgtttagcgatgtactacggctagctgatttaacttttttttcctagttgtaaaccgaatttagtttatggacttattttatcatcttaatcgataataactaattttatatttttttaacatacttatttaagtctcctgtaaatatcttaggtataaaataaagtaacttttgtccatatatatatactcctacacagttatgcatgcagtactgttcctttcagcggtagtaccatcggagatctggctcggatctagcttgtacacccaacatcgagcactaataattcaggataggtgacaagtcgtcactctcacagtacagattgctactgctgctgcatgtcgcacaaaatctcttcacgtcacaaatctctccacgtcttcatgacgtgaagagattttcaacgttggattttccatctgtactacgtacagcgctgtacgtacgtgcacgtagacgtacgggccccgttgtcacgtactccctccgtaaaaaaaaacttaatctaagagaaaaatgtaacccctacatcttctcccggtataaatttaaacatatggttgtctagattcgttatattaggaggtgccacattcgattcaagattgaatttcttttggactgatcgagtatgtgataattattagtataagctgacttcccttttcgtgagaaatactgtatgagaatggactttggagcatctagatctctctcccccaaaacaaaactctctcacacacacatatacatatacatatacatatacatatacatatacatatacacacacacatatatacatatatatatatatatgaatgaatttagatatacaagtattctagaagtaaatttttttttcttggacgtaaggagggatatcttactagcattcatatgcatggaaaaatattgcaaacttataatacatataactaagattaatttagtttacacccacaagacgacgatagatatgcatcatgatgcattcaagcatgccgtacgtttgagatcgacatgcatatgaaggcatccatgcatgcatgcaaattggctggtagtacactagtagtacgtagtactgtactatatatttacatacatgacctaattaattaattaaaaaccaacttcttctaatcatacatgcggccacacacacgtacttatcacctattagttggcatgcatgcatcacagtactactttgcctctccttttagtaggcaaacacactacttaattatctcgcactacatatatactactactccattatttatattagcttgactagagcattgtccattgatcgatctccctgtcaagcttaattagctgcagtgtgctataacgtatgcacagtacacccatatgtgtatgcatacatacgtatatatacgtgtatatatacgcatgtagatatgcatttgcatacatgtgtcatttcatgcgagtggtgacgtgaaaatcccctggccacgggacaggatggcctttggatcatacttgctcttccgctgcacgaatcttggccagagattggcaccgaagtgccgcttctgccactctgcctggctgccgtagtaaggcaggtactgcttgtaggctatcccggccacctcgcagaaacccaagatctcgtcgttctgctcctccagcctccccacgtcgccggccgccgccgccgaccgcaggatccccaccgtgtagaacacctcgtcaccgtcgtcgtcggtgatcactgccgacatgttactgtcccacctgaaacatatccaggtgtgtgtatgtttagttaccaccatatatgttaaaattaaggaaagtctattcatccttcaagagaacggacattgtttttcatgtcgtaaaagaaccataaaaatactctggaaatatataatataccacttcataaatatgtacgtttaaattcaagtagcatactagcataagtaaataaataacttagtacacactatttgcagtcaaattgtttttttactacttgtgcaagttgagtttaagattacaatgtttatatagtgatatataatatatttatgtatcatattaattttttatttaaacattttaataagttttcagacgacacgcacaatatgaggggtcgtcattttgaacgaaaaaatccaccccgtaaaaattatatacatgtgtatatgtagtaaagctttttattattattattacttgttgcggttcatggggtagatgaggacggggcccatggcgggggtgcggctgaggatgccgtggaagacgccgtcggcgaaggcgaggacgccggagcgggggaggaacaggttcagccatgggtgcggcacgtcccagagccccgcggcgcggagcttgagctcgccgtcgtggacgcggtccaggaacccggcgtacgccacgtcctgcgcgaacacgaacccgcgctcgtgccgcagctcgcgacgcagcacatccatcctctgcaaataaaatcaagcaaagaaattaaagcatatatgttggtaaaattcatcaaattctttgcagagagatcaccgaaatttgatcgagttattaattttgccagcactagcagcgtggatggacaggtggcgacgtgacgtcatgcaaggataaagtgaggcagtactttgtccacatgtgtgtgtgacgtgtcacgtgtgggcatgcaggatcttctcggatcacatagcaaaagctatagctaggaaatgcaaactgtatatgcatggaataactagctagctatctatatagagccaacatagttggtcggtcgtgttgcaaaagatgggggctcatgcatgcatatgcatgtgtgtgctaaagctggctagctagggttataaccatacaagctgatgcatgcactgtatctagtggcgcacagatctttggctggcctgtcatccatgagagatccatcatatccatcggtttccagcttctagcctagctagatacatgtaactatgatcaaaagctagctagctagcacatactatgtgatgtgtcaatggccacatgatgcatgcatggatggtaggtccaagctggcgatgctgatttctttctggcaaagctctaattcctcagtcccgtaataaggcagcgttcgtttggacgacattgagggagaaagcacctcgttttccgcaagtacgctttccaaactattaaacggtgtgttttttgtaaaaattttatataggaaagttgctttaaaaaatcatattaatccatttttgaaatttaaaatagttaatactcaattaatcatgagctaatggctcacctcgttttgcgtatcttcccaatctcctcaatccccttctcctcaaacacaccagtttatattttgctcattccatttattctaaaataagtttatttttaaaataatcattgcatcggagtttgtgaaaatagagaataaccgaaatttgtagtactttctattggtatgtgtgagatggatgaaaagtgaacttattttgggatggaggtagtacatggtattactagtatatgtccatgtctaaattcattgtattagggtatgtcccatccaattttaaattcttatattttaggaccgatgagtagtagttttgtgcagaacaacagatatgtgcgtagacatacactaatctagtctagctacatgctcaaaattgatactccctcactttaaaaaataaagtatttttatatgcatttgtctagatgcatataattagaaatgcttatattttaaaattgagggagtatatatatgaaccctctttggtcaagatgaaaatgtgatgtttaagtcaacttttagtaactttgaacatcaatatgtatatcttcataaacttttgattggttatatgattttccttaaaaatatacttttacaataccataattttattacctttatttttttttaaaaaaatataatacaaaaatacctgttaaagttgtgcgttctgaagactgtaacagtgtttaaaaagacaagtttttccttgatgtgctacaaatactgttaatgatataattcgtcctggtagctactacctacactagcacgcatgcttttcactgttttggacgaaaaagttttcaccataagtagctaaaagaatatgtcacgatcagacgatgcatatattttatacacctgtttaagcttagtgagagcgactaacctaatactccatatactagcttactaagttgctactatagtatctaatctttgtctctccgggaactaaggaagataaaaaaaaattaacacagaatcgaataattatttaattacttccagttaggtgtgtgatagcgagaggtgcatcgcgtggcagacaaaagtggtaggccaagtacgacgatgtcgacggcgcaagagacttcaatttcatgcaccgttagggtctgtttggtttccacggacttattccaagtccatgtcacaccagatgtttgaatactaatttggagtattaaacatacactaattataaaacatattccatatcttggactaattcacgagacgaatcttttgagtctaattatgtcatgattttgacaatgtgatgctacaataaacttttataattatagattaattaggcttaaaaaattcgtctcgcggattagctctcatttatgaaattagtttttttattagtctatatttaatactccaaattagcgtccaaacatccgatgtgacatgggctaaaaagttttagccccatctagaacaccccttaattgcatgcgtgcgtaagcgtaagccccaggtggcgccaaaagtttttgcagcttagttgttcccgccatcatcacgaggtgggacccgctctggtcggctcagcgcagagcaagctagtagctagctagtataccttgtcaacgtcggcggcggacggcccggcggcgccgccgaagtagatggcgccctcgaggaaatacagcacgccgccggcctccttggcgagcgcggcgacgcgggcctcgtcggcgtcggagaagaaggatgaggaggaggaggaggacggcgaaggcggctgcggctgcgtgcgccaggtctcgaccaggccctggttcaggtggaccgagccctcgacgtagtccatcagcccgcccaccgcgccggcgccgccggcgcgatcgacggcgatgaggcgctcctggtcggccgtcatcgccgccgccgtcgtgtacacgaaccgcacccaccgcgccctcgccggcgccggcgcgagcgggatgcgcgcccgcgtgatgacgccgaactgccccagcccgcccagcaccgcgtcgaacaggtccggcgccttctccttcgagcacgtcaccatctccccgacacctgcagatacatgtatacgtcaaaacacctataccttaattacctcgatcatggcggcgcgtgtcttagtagatgtgatggatctacgtaccggtgatgacgtcgagctctagcacgttggaaatctgggggccatggcggaaggcctggccgctgatgccggcgttggacagcgtgccgccgacggtgaggtggaggtagtctgtccacgacaccggcgtgagcccgtgcgccatggacgcgcgcagcacgtccacccacagctgctcgccgccggcgtcgacgtaccgcccctccactgacacggcgaggcgccgcgcgccgccgccctgcaggcggtcgagcgacgccatgtcaacgacgacgccgtcgggcgcggaggcctggccgtgcaccgagtggccacacccccgcgcggaaccgcgaacggcgccgggcgtgcgcacgacgcgcgcatcagcgcggcgatgtcggcggggcgcgacgggtagagcacggcggcggcggcggcgagccgaggcgccccgacgccggcgacggagaggttgccaaagtcggcggaggcgcgcgcggtgcccgcctcgtcggcgcggatgagcggcgcgatgccgaggtcgccgaggtcgtcgaggaaggaggcggacgaagccgacggcggccatggcggcggcgccgtggccttgacgaagcagttgagcatgaggagcactgccatcctgacctgctcttgcttcattatcaatcaatcaatcgatcggtttgtgtgtgtcagtgtgtgtgtgaatttgtgtgttcttgcaccattgtagaagggacaaggtggcctataaataagcagattcttgtgtagtttgtgtgctgacgatggaaggcagctgatagatagctagatagacagtagagctgtggtgaccgagacttgaggctctctgagatctgtgtgacaaggactgaaagatttggtttggtttggtttgtcgttttggagattaggggagagtctttttaaaggctaattaagggtgatatatatccttctagaatctagattacatggtgttgcatgcataccatggtttgtgagaggtaattaaagtcgatataattaaacacgtaaaagaattaatacaagtgggaatataataggtcacatatatacatacactaccggaatccagaattctgggcggccattaatttgtactccacaagggagttgtatgcaggcagttcggccggtaacacatttgaaccctcgagggatatcctattatgtattcgaaaaccattcatgaaaaattctcaaaagaatttaccactcgacaaaatttagtcaaaaaaaaaactaacttgggcctaatggctagcagcacggttagtatagccaccctaggtttgattccttccttctccatttttttttatattcagtccaaactagctagaccacacatccaaaaataaattaaaaaagttgagacaaattcagcatataaaccctatactattaacacattgagatgaaagagcattagacaaacaacccgttaattttacaaggacaaatatataagtgaaccagtaaacttaaaatggaagataaagaaatttcacatcccccgcatagaacgctaggtatgttcagccaattagttcacctaattagctttctcaaattaattagttattaggttctaggtataatatttttaggataaattttaaatagtagaaacacatcctttttgagacggatgcaatagtcgtcgttagcccttgcatccctaccatgcaatcgatccggccatagagaatcccataagaggatgagtggtatagagagattgcacgtctatgctgcatagtgtgccattacctatagcttctcgttcaccctgaagtgcagtgcctgcgataactaatcttcactattataaacattaaaaatatttttttatctaatattttggtaccttgctcgagtccatactgatttttcatccatcggccctggcccgattgtttcggtgctgtgtgtctttgtttccactcctaatcagtgtgcgttgtgagttcaagtgcacgcgttgcgcgattcagtcacgacgtccccatatctcctgctgtttccaggactcgacatatgtgcactttggcacatctcctagatggaccgaggaaaaacagaaaagacgatacgtagagccttattatacatacggaactggtcgaatattggtcaagacatgcttatgtgatgcattagcgatcaaatattaattcgtggataatttttttttatattttttcgtgccgacttaaaagctcttgcttaaaaataagctacgataaaaggaaaatcaaaatcaactccgaaaattaaatttgaaaatcagctatatttgttttggaaggggttagatcatgaaaatcaaaccgtgatcatctaaatgctaatgcaatattagttttccctttgaaatgcacggatcttttttccagtgcaaagaagaaaacaaattggtacgagagatgacattttgccttgcctcccattgtatcgcgtcgcgtcgcatgcaagagctgccaaaacgaaacattgtacgattatatatactccctccgtcgctaaatatttggcgctgttgacttttaactatatgtttgaccgttcgttttatccaaaaactttggtgaaatatgtaaaactatatgtatatataaaagtatatttaacaatgaatcaaatgataggaaaagaatcaataattacttaaatttcttaaataagacgaacggttaaacatattttaaaaaagtcaccggcgtcaaatatttaggtactagtattatatttgcgtggcgatgggagctactccatccgtttcaaaatatttgacaccgttgactttttagcacatgtttgaccgtttgtcttattcaaaaaatttgtgaaatatgtaaaactatatgtgtacatgaaagtatatttaacaataaatcaaatgatatgaaaagaataaataattacttaaattttttgaataagacgaatggtcaaacacatactaaaaagtcaacggtgtcaaatattttgaaacgggggaatatattggtcggccaaaacctagtacgtgcgtgcacacagcgaggcggattcgtagcgaagcatatgcatgcagcgcaccgacatgtagatctttgattctttggtcgatcgtttgtcgtcgtgcagggcaggtggcgctgtcgtggccgttgatcgatcgtggtgacagccaaacgcacgttcgatcgatccacggatccatgattttatttgccgctggcctgcgcgcggctgcagacgtacggccaccggccggccacctgatcgcgctctcgctctatagctctcgtacgcgacgcgcgcgggtaaccagccgcgtgtgcttgcacgtactcgatcgtatacgttgcatccagctgtccgcatgcattgcagccaggagagccgaggagtgtcgctgctggaggttctcgtacagaaactttttttttaataaaaaaaaacacaccgtttagcagtttaaaaaatatgcgagcgaaaaacgagaggagaaagttgggaaccagccgtgccgaacacacccaaagcttgtccttaacccttgtttatttccctcctctcttatgaatacatgccactctatacatttagttctttctttctaaaatatatataagaacctatagtatcggatggaacactttagtttttattactacgacacatttttgtgaccgactctggaatatatataactttaaactgatcaaattaaacggttcaaaactttgttgctaagttgattttttataattttaatttaaactgattaaattaagtgcatggttgagaactttgtttataagaattttatatgtagcagtgctcatccgagaaatataacctatcattatctaatcagtattacagatcttaaccaattaccttttcttacagcagaagagatgcacgtagatgagtgaatcatatatatacaagtcgcaatcaaagtaatggatccaatcaaggtgaaaagacgaggtgtggccgccgtggaaattctgaattaggagatatattgcttaacacagtattatatataattagttgaagatcgtatcctaattaagtcatgaatgaatgaatctctatagctacggtggtcgaccgtcaatggtcattcctcgacgtactaattaacaaatgaatatattcgattgtgtacgtgctagatcgatcgatgatacgcaattatttatgcttctttgtccaacatgactcatttcacatcctgcccgaatcttgtcgccttgacaattttggcacatgtacgtacagtggcgtcttgatctttatcttagtggcctctctacagatagatatcgatccagctgagaacttgtcaggttttatcgaggaccaagttgccctgccatgtgtatagtgtttgcggatggacagcttttacggtatgcagtccaaatatatcacataaatatacaaattgtatatttttcttattacacgaaagatgtgaacacatgtgggagttggtttcattcctttcccaatcaacctcactcgttttcatgcgtacgcatttttaaactgctaaacggtatgttaaattttatttacaaaaattgcttttaaaaattatattaatattttttttaaaaaatataacacttaattagtcatgcactaaacatcactttgttttgtgtgctaggagtgaaggttcccaacccttgcccccgaacttagtctaaagttctattaaaagtgcacctcctactatgtgcatgtgtatcataagggagtgtctaaattctagctacctgaaactaaattttctatcatttttttcatgcatgataatccaatatggttctcatatcactccctattatttattcatttaaataaaatcccttcttagtataaacaggttgaacaaaaaattggtaacatatatacaaagatttacaaaattacatgaaataaaaataaagtaaaaacatatataacaacaaaattgctgttaaaacggagtaaaattgcacatatatctaaatattctaggtgtccagcgcttgaaatcaaccaaataccatgtatgtgtcatctaactaaccctacattcatgcatgtgttgaaataatatgaaagttttttctgtttacgcgcactatatccgtgtgttgtgacggagataagaatttaagatcacaagttgaagaatggaaagcaataaaaaaatacaagagtggcggaattggtgcagagcatactgtcaccctccaattccaactcccccttttgaaacataatttttatatatttcgcacacatcatctcgatcagatttgcagaaacatatggtgcccagcatatctaaagcaagagatgcagatgacgtcaacaaaccgttcaatttgatgagatttgttcgtataagatcttcacgaggatcctgaataatcctgatgcaggcgtagacttaattacatatagcatccagtgagtttactcgcggcaaaaggtgaaatttgcgatctccaaaaggaaacaatactatatcaaaccagaatataaattaggacaagcagttcggttcgatcagtttgtcactgtcacacacgcactacatgcattttttaatacgatttcacgcaggacacattatacgatatgcatcaatcttcaggatggcgatagtacacatttt

SEQ ID NO: 47689 - DNA, 1671 bp, Oryza sativa
cacacgtggtgccaaaccacagggggtcggggcgccccagccctcggggccgaaacgggagcgcctgagccctcggggccgacacgggagcggcccaacccctcggggagacagagggaggggtggccacgtcaccctcgggcccgatcccccccccccccgagagggtcaggccacgtgggtgaccgcggctacccaagcctctagtcacgatacccccggccccatgtcaccgacacgtacgaaaccatataaaatttatcaaaatttcaaatttcgaatttaaaagactaccatggtttttcttttaccgtaccccgtggtaagcacgattatcggcgattttgggaaccttggatgttacatatcctaatacaaagaatttgtatacattccgttcgaggtttagtttgttttgggacgaataatagagtatgtctaaattcatagttagaagtaatctttttttttatggatgaagtatataggtcagtgtcacgcccagaaattcccggatagaatttcaagcagaatgtgcattaaaatccccgtccaggaccggccggggtacacaaacgacaatgttgacattcagatccacgtcttacaaacatcataaaagtcttacataaatgcagcggaagaaaagaaagacaacaagagctaagccttgactaaaactgaagcgggaacaccactccacaggcatcctcgacggcacggacaaagcctactcctcggagaaaccttcatctgacccgaacttgaactctggggttgggaaaagtagagtaagactgagtactacccactgtactcacaagtcataccggaataggggtatggtgcagggaatcatcaaagaagagctaaagtggttcatttgcataaagcgagcatttataaacagaaattgaaagatttaaacagttgtaataattaattaatattaatcatccgcttccaacgctatcccacgttgcgacaggcccagccatccacctaaactatccaaattcaaaagattacactaaggtgagactaatcacggtgaatctggttgaccgcccataaccgcgggcacggctattcgaatagttttactctgatcagaggtgtacaactgtacccacaagacacagccccacgacacgtttccgtgcgccgacatgtcaccacgacataccggaaagaggccgtgacaggacccttcgcataaccccctctaaccaagcacaccacacctcagatttcacccccactcctcgcaaggcagcgggaagtcccctctcgtgcctaggtgaatccggaagccgcataggccgtcgcagggcccatccaaactccatcacgcccacccttgcctggatgcgtcggctagaggaaagctacgctacaagcccagccgttgcccacgctggcttgtggtaagtacgataagttcttccagggcatcccgcgaaccggtccttaactgccatgggtgcgaccagcaaaaccatgcacccacagcccaccatgtgatttattttaattaaccaacaccaaagcggtgttactaatccaacaaaaccattagaaccaacagtctaaacattaataggatttttccccattgtgaactagttgaactaagcatggctaagcaatccctagtccaaactctaatca

SEQ ID NO: 47690 - DNA, 708 bp, Oryza sativa
agccctccgtgcccctggttggtggtgtcggctgtaaagcctttgtggcgagccttcggaacgtccgttggcccccaaggttccggcccaccatcgccgaaaaatatgacgggagcgtcaaccccgccgagtttctccaggtctacacgaccgggatcgaggccgccgggggtgacgacagggtcatggtgaatttctttcccatggccctgaagggacaggcacggggttggctaatgaacttgccacccgcgtccgttcactcttggaaggatttgtgccaacagttcaccatgaactttcaagtcacatatccgcgccctggtgaagaagcggacttacatgcagtccagcgaagggatgatgagtcacttcgctcatacattcagcggttctgtcaagtccgcaacaccataccatgcatccctgcacacgcggtgatctacgcgttcagggggggtgtgcggcacaaccgcatgctcgaaaagatcgcctccaaagagccccagactaccgtggagctttttcagctcgcggccgagtggctcgcaaggaggaggcctggacttggaacccctccggttccggtgtggcagcttcggccgcccccgggtccgccgctcggtcaggccggcgggacaggaggaggaagaagaggtcggcccattccgacgacgagggtcatgtcctcgccgtcgggctgcagga

SEQ ID NO: 47691 - DNA, 19182 bp, Oryza sativa
ttcctgcaccccgatctcagaggatcttgagaatgtagattggggtgttgatatcatgtgatatatttcacacacaatgccaacgacagtatagctggcgagtcatgtggaagtcgtctctgaacctgatccgaaacatggtacagattctgctgtagatgatcgttcaaaggaaggtgatccatatgtatcagtcatcgtgaccccatcgcatctccccaaagatacgatcgattcggagctttgtaagatggagaagccaccgtatacctatccatgtaactaacgtgagacttcattttcgtagacaaattcatgctacctccgttttttcatatatgatattgttgattttctaacaaccgttagaccatttgttttattcaaagtttttgtgcaaatataaaaaatttcaagttatgcttaaagaacatttaacgataaatcaagtcacaataaaacaaataataattacataaaatttttgaataagataaatgatcaaattaaaaaaatcaacgacgccatatattaaaaaacagaggaagtacgcactatcatgccaatagatatcttttatggatgagcttttatgtagcaggttaaggatctaggctcagttaggctctattcgggagcgagggttgggaaccctgtaaccctaactccccggcacacaaaacgaagcagtgttttagtgcgtgattaattaagttttagctatttttttaaaaaatggattaatatgatttttttaagcaactttcgtatagaaactttttgcaaaaaacgcaccgtttagcagtttaaaaagcgtgcgcgcggaaaacgaagatgaggagttgagaacttgtactaacaaacggagccttagtcgagggatgcataaatctagaccacccaagttttaagttctaattgagataaatttgggtgcatgccctttaattttagggtaagtcgagacatgtgatcgaagcaacaaaaaataatttgagtttttttagtcatgcccaatactccctcaattctaaatcaactttctaacgaatttagaaatatgttatatgcaaattcctatatgaaagttaatttattataggacgatggagtaacttataaccgagatatgagatcgaggcaacggaaaatagttttagaagtcaaatatgacaaagaaaaacttaaaatttaagcttgaggaaaatttgggtactgcatatagatcatatggctgcacatgtctttcccagctctccttgattcgttgttgtccaaacactgtactggtcgcgggcgtatctccatgtgaatctcgcgaggcagatgcatgtcgagcagtcgaggtaaaatagctagctaggtgacgtccctgtccatcaggagcacgtcacggctgtcgttagctaaatctagctggattgtattgctagctcactctttgtcactcagcttgcccgtctttgtctaacctggctaaggccctgtctagattccaacttttttcctcaaacttctaacattttcgtcacatcgaacttttctgcacatacaaacttttaacttttccgtcacatcgtttcaaattctttagacttttaattttggtgtggaactaaacgcagcctaaagttgactcgctagtacttgtaccacatgtgtcgcgcgcgtgcaaactcatcagtgcaattgcaagtgcaaatggcatgtgatttcgtcgtcgtctcgcaccggattggagagggaaagatcttgccaagatcgctgggagatctgtagggcgctctctctctctctctctctgtgtcagggagatcagagatcttgtgacggctcagggtgtcgttaattatatgctataggccacggcgacttgaccgcggccaaggctgactaattagcatgctgtaaatcgtcttgaaaacgaaaggtagttaattagcacgttaatcgtcttgagaagggaagatcgagtcgggcctgcgtgtgctcgtgtgattctttgacggtgttggccggaagaaatcgtcttcacaacgaggatttttttttactttgtagtccttttttgaaaacttaatttataaatatatacctaaaaaaaacttaatcttgaaatggaccttttttttatgacgctaatatcattggcgccgtggttcaacatgacattgcgccgtccctctttaccccttcttagaagctaagacaccgatacaaaggggtggatcagcaccaatgtcattgacaccaaggatttatttgtaataaaaatatttataaatagatctttggtacaagtgaaaaattcctggcttcaatctacctactgattcctgaaagagaaaaaaactccttttaaatcctatacgttccagtcaggattttaaacaactctagttcccaacagagataacctcgtaccatacagaatccatgctgtccattttgcacaccaacagtgatgcatacttgtgcccattgtcacactggacactgcgcttacagataatcactagttcactacagcaggttcacttgaagcagccatgccggtataaacatggcccataataatttttctagtagtactttgtcccacatgttcatgagaagtgctaaatcaccagcttaaaaagtctgctcctaacattactgctacagtacacacatacttgatacaatagatagttaatttggtggtagtagtccataaacacgacactctacctgcgatgatccttcttgatgatcttgcgaagaagtggaagcgagcagagcgcggtgtcaccctcgttcttgagcgcgtagaagtggcacagcgcgcggccggcgaccttccaggcgaagccacacctgctggcgtcgttgctccaccgtgctttctcatacacaatctggtagatcacgcagcttccgagaacacgtcgtcggggtccctctgtgtctgctcgaattcagatgcatcgtagagcatctgcagcaggttcaagggttcgttaggttaaaacgaaaacggcgagccgccaatttcattgaatagagaagaataaaaccgtacagaaaacaaacatgtacaaacatagggccacagcccgactaagggctaattaccgcgccacccaggcggcgagatagggttcgttaggttaaaaagctagctgtaattaattcgaccattgaaaacgctgttactcaggaaatttggatggatactcacatgcttgtacttctcgtagagttcttggaacttcatgttcctttcttctttatctaccattgcgcgatagagcattgtactgtcagtcaagtactcctcgtagcggtgttgccagaggtgcctggctgctggaggtgcttctctttccatgaaacatgggagcaatgataccccttattattgtaaaaaggaaaagagggaaaaaagtaaggcatactgttagagagaacattcatattatagtactattctcatcaaacatatgaaaccaatttaattgaaaccgtgttctatgccaaaatcatgtctagtgcttctgcagaatggtaactaacctctgcttctctcattgaacaattttgacatctctccctcccattcattttgttttgaaactaggtggaccatatgagtaaaaaattaacggttgagtgcataagtagatagtcttctccataattaaaaacagcagatgattttttttgtaactttttaatacaattttagaaataaatctttccacaacttatttctaggtctgaataagtgtaaactattataatttaagattatccttatgtgcgtaggtaactaattagaatagatgtaattgttcatcatcacttctataaataaattaatatatataaacatgaaactataatggtttattaattactatttccaattaattgactgccttacaattaatcattttttcatgcaatgaatgcaaaccgtttttttttaaaaaatggcatagaccctttccatgataccacatatgtatatactgagaacaacatcacattttctcaatatgcttgccatttggcaataccttaactactgcaagctcagctcataagttatagcctatgtgctacaagcagaacaaataatgtatgtcatctccctactgcagataaaactataaaagaactgaaaaaaggaacctaaataaaacagacaacataccgattggttgaacattacaagatcgcagagattctacatcttctgctttatcatagatttgtccaagtatggatgatgaatggtacgaaaaactgcggcccatgaagtgggggtattgttttaccatcagatcacttggaatattgacctgttgggacagcacataaactgttgaagtgcaatatgcattcccatgtaatgaactttggtcttacaaagcatcaaatataaaataataaagatacacctgcacatttcatctattatctttatcttgtagccctacttgatctcactgcttcatacgttaaacgtattcctgtcaccatgcaactattccaaccaccatggtgccctggacaccgggtagctggtccatttctaacttatattgaactatgttaattacaacattatccaataatcagcttattactatgtactggacacccactgcagctatccgtataaaatattggcagtttatgaatcattgtaatgaatcacgagttgttcagataactacacttggttcatccgttcatgaatcattgtaataaggattcagtactgtgtaaaagcatttgaaactgaagaatgtgtaagcccaagattggaactaaccttgttcccagtcttcggagcatccaaagccaaataatacaggtcaactaactttagcatcttttcctctattagtttcttttcaatttcgtcaagtgaatctgtcaatagtcggtccatatatgctaaccagctatcagctgccgtaccaagtgcaaaactgaaaggagaaaagaactccaaaatcatgttagattgtataaaaccaataaaggttgcatatattgaaatactacaggaggtcaccaaaactagatttttaaaaatgtactgatcaggttcatataaaaagaaattcaagcacttctagaatattgaattcaatcaagtgctgaactcctcaataaattgcctactaaaaactaaatgagattcatgctgctaagttttctttatagtgaaatggttctagttaccattccaaaaaggaaggctggtgacaattattactgtgcatcagaaaaatcaagcttggtattaatacctgggagtaaatcttgttttcaagaactcatgaaatagcagcctttcaagtttggattcattacaatcctgaggtttcttttgcttggtcttttttggtttaatagcttgtacccacggttcagaaggtttgaagtgttctaataactgaaaagaacattttcaggatcagtcagcaataattctttcaaaagttaaagacagaatgtgctgttattatatcagtaccttattatgcaagaattataatttaaagatacagtgaaacaacaatgccaaatttactaatgaatcatgcacagcaaatctgtaatcagtccaagaactagcaagcataattaaaacggataggtcaatattccaacacttttggccactgaacttgggcttcattagcgattggccacctgaaaccattctacattcgggccaagtttaaaaggtgaaaagtgaatggcttcgatagtctaaatttaggaaaagggtccactttttaggtctgaagatcagggttgtaaaatggacactttcctcattaaacatgaaggcatgcaatattatttagtttgggaaccaaattaacccctcatgtctaactggcatcccaaccaagccaacaccttccagctatccacttggcggtgtttatcctctatgaaaccttgcccataacacatgtttggcaaaaggtccaattttgcccttaaggtttaacaagggccacttttcttacaaagaagagagtgtttccaagaagactacatggatagactcaataaatatagaccatagttaaaatagcatcacggccatatggatggaacaactacactatgaacgagggtggaaccaagcaaaacttcactacggattttaatgagaatgaaagataatcaagcacaaaggcacaataaggcaaaatgtcaattagaaattaacaaacctttgggttttttgagacccaataaatgtcaccgtcaaaatcactgttggccatctcatcagccaaagaccgcggcccagaaatagggaagagtatagcatatttagcatatcccacatactccttttctagatccctaatatatgttgctttcaagacatgtatatcaccaaaatgtaacccaggatgtttataaacaagaacatctccagaaaactggccattttcactgttgaacagcagataaagctaataagtaaagaacaaaccagaatgcgatcaaacataagtgatacagtaccaaccaatggatgcaaggaagaaatatgacaaagaacattagttcttaacattgacaaattcaaaaccttttaataatccataatatcttctatttgagattttttttctatttattaaaaacagtcacacagatttcctgatgtctaaaagactacatgttcaagttagtctaaatttgggaaaatgaacttaaaaatgcaattgaagtcctgaagccccaaatacccagatgtatttagtatcataagttactagtctaaacattttctttagccgctgtttaccaacgaacttcacaattgcaatcaaaatcattgccagcaatatataattgtttgaatacaaaaatgcgttctcattgctaaaaggaaattgcaaaaactccatctcaccttgttaaagtgcaaaatttatggtgctaatcagcaagaacttggaagaaagcatggcaattttggtgcatttctactaaacaaaattacaagacattaaagcagttccagtggtgtccatgctggatagtggatattcctatgctatatggtgactggtgaatagtaaactgaggatcactgatacatataaaaaccgctgaaaggatatgcagatgcaaaaggggtaattctgtaactaacagtatcacgcagacttcattaggtctgagtgttccggtagggtctgtagtatccattagataatagcactcatcaattggtatctttccttgcttgattccttttctttcctgttgagccatgaaatccagcctatgttgcaaatatgactcttctagaggaattccagaaagaatcatacgtgctgacattgaatcttccatgtcagcatagctgaatgcaactgtaagaacaacatgagaataatagtccagatcaaacataaacaggtgactgaaaaacataaataaaatggaaatcttatgacaacatgtaaattgcactgaatgcaacaaatgtattttgaacttacttctcagtgcatcttcataatcgtaacatgcattctcagccccttcaattgcactttgcagaagctccaaaaagtactcttctggaactcctccatagcaaagtaatgttatcaagaaccttgatgttaatgtccttctgggtcgattgctgagcaaaaaaaaaaaaaaccatagtactgattgtgaacaaaaatataattgattaattgctgccaataaaaagcttaaacagtggaggaaaaatgtaaagtcctcaacatgctttaccaccctcccctcaaaaaacatgctttaccacccctatctcatcaacctaatcagccccaaccatgaagaacgacatgtgacagcacttggaaccccttaagtaccaccaaccgatgaatgaaatgcaccggacgtctgggctttcatacacaaacaaactcatcccaaaaaaacatgaactattaagcaaaggaaagtaatcccatttatagtacaaaacatgtgtttttgttctgatttccatgctatgccacctcatagaatcagtagcagttaaatgggaaaaagatatcaagtactcccttcctcgggggaactgtgcaaatgatcgtgacaaattcaggaaagagaatggcaaccttgacacaaaaatcaatctatcagccgcaaagtttcaaacagttcattctgctgaaagggaatctcaaaagagagatagaaagctagaattcactgaattttttactatttgtttaacctagcatagtatagattttacattgaattatttttggaatgcccggttatccatgaaccatgcacccatttcttttttttttaccttttgcaccttttcatggccattaatattgtgtccagggttcacctctccgatatggaccaatcccaacccctggcagtacaacagctttcaccaaatttcgctcgaatttactgtttcaaatttgaacttctcaaaaaccattcaaaagtttgctcaaaatctactttcgtcccatgccaaaacctcaatattatgtgaaccctggttggatctctaaggcgatgcacagggggaccagaagggtgggatgcaccggaaaaatatctaaacaaaattaactgttacttttactgcgctggtagaaagccagagcacaaaaaccagagcttaagtactaaaatgtattagtaaccaaggatgctctacatataaaaatagatgtaacaactaacaatgcaactcagatttttggtaccttgtagagactatttcaaaggaattcacggactgaacaccagataaacttttcttggcatttcgtgcagagactatttccgatgagttgacagaccggacaccagataattctggatgagtttctatttttaccattgatggtcggatgagtatagttgcaggaggaagctgcaacagaaagagatctattcttattcttacaaaatacacttgaatgctagggatagtagctaagataagatagcaaaagaaaattatctgtacacaaaattgtgtaaaaattgaatagattgaaaaagacagtgcatgatgtacaacaagaggatatctgaaaagatgacaacaccagcattgaacaaaatgaattaatgatcaacaattattagaaaacagtgaccttgtatgagataacatgtctatcctgaaagtatataaatcatgcaatgatattctgaatattgcttgaatttacacaatcatatagtattagttaaattgccagatccgtaatagaagatccgattgtattgctatcaggatacaaggaaggcacgattgcatagatgcttaagaaactatgaatcaaaattgggaacaagaggtgataacacaagagcaaacaaataacacaaaactaccaaatttcaatgtataagtaatatcatgtcaaaaactcagtacatacccgcctgtcaactaggactgttccctttacagcagatccattatagaacagacggaactgcataagaagaggctaggaaaatagaatagacaagaacagcaaactcattagttgaaaacacagcaaagtcagaaaagagtagatcggaacaacaaggcaatagttaatacagtacatgttcagcggtgagagatcgatgcctcttcaaactgttaggcctcatcactgtttcactttcatcacaagttgcaatgccctgaacaaggcataataaaaaaaaaagtatatcagctagctacaagcatggaccaaaacatcaccattaagtttgagaagcatgattgtccagaaaggaaaacataactaaaatataacataatagggtggtgatgtcatgtataacacacagtaacggaacttaatgttggttgatgttgattactggattttcgaattctgagtcagtagcaacaacttttcagtccacccttactcaatgcagtggacagtaggaaaaattcctaccaggcaattgttacagcagtgggcaggccattgcagttacttagcactttagcaggtaccaaattaggaataagtcaaataaagtactccctccgtcccaaaatataacaacttttagcccttaaggtttgtcccaaaatataacaacttcttcaccaacattctcttcttaaccaatcacaaccctccaccattcaattttctcacctacctccacttcttaaccaatcacaaccttctatttaattttacctactttcttaatacccatgtccaaccctaaaaattgtagagaatagaatagatgtctcaccaatgtgggggaggtgatctctcatatatatagctgaattacaatgaatgctagtgctgagatacaatcaatactagtgagttacataagaccaaaggtctagaagagtaactatctaggagagtaaaggtctaggagataaacaggcaaacagcctatagattaataaataatcctaataaaaatccttatattctgggacggagggagtaggagattatctcctaacaaggaggtttgttatattagagatcgagagagagagagagaggattggtttaatatttgatattagttccatggaaataaatctctatctctaagccaaaacaggatcagtaaattcctagtgagtgatgaaatgaatcaacaccagtacaaggtaaattaatataagaggtattttggttaggaacaggaaagaaagtcacacagcagtaaactggtattgcaatacaatgtgccaacaattaactgttcgcccatgaaggacaccaagtatggccgtatatatccggttggatttagaggccgggtaaaaaatacccttctctaaaaaaatggacaccaagtatcaatttaattaataagaaggataagacttaaattcgagctttagaggacccaaacttgggtggtgagggtgtacatccacacctcctaccaactaagctcgattcctggtctgcttttctctgcccacatgtttgaaactttatctaaaaatttgtaattatgttgcatagtatctttatgagcaactccacaaattctgctttctgcacattcatgagatgtgtttgtcaaactttattgttggtttgcatctgttcacattataaacaatcaagtaatccgaatttgcttattagtatgtaataacgccttcacaaaaccataaccatcaggggaacacaaacatagaatgtctgaaaggttaatgtatatattttagataatggacttttcattaatccggcctctatatccatcaaggaaatacacagccacaacatacgcgagttcttggagtccaacccacacgcagaggaaaacacataaacacacaaaaaaagaagcttgaagacttagcttaagggaacagaagtcttagattattcattcaaggtgtatggagtgaggataaagcgcacctgtggtttcaaaaattttcccttgaagatactcgtggggcaattgagagccaaatccacagatacaaggccagtcccatcagtatggatcaacggctcctgatctttgtgaacaacattgccatgtctgtcctgaaatgttacaataaagaaaaatgtgattccagaagcaaaaacaagtattggagaggagggaattaccatgcaaggttcatctttaatccgtctgacataaactgctgatagatcagcatcccatgtgatagttttggagagtatcaaagcaaaccttgttacaacagaaaacacaggtttcgtaagtaagagaacaatcacatgcaagcacgctcaagttgagtccaataattgtgtttttctatttagaaagcctaatagttcgatagcagcaataatgaaatgtacatggaaattgaaaatgtaggcaatggacttctggaaaaacaagcttatcttctgactaaataaatcccagcccttctatgcatctccttttgtatctaaaaacgatacgctgctatcatggtagcaaaaccagaattaccagtaaggcagtaactaagcttgacatcgaccagtacatatgcccacattgcatcaatttaattagttgacactactaaacaaagtcataaggaaaaacctggccatatattttgccaaggtgggggcagaacttatgtgcatgaatagttcacgggcctgaccaactgttctcccagagagtatataaggttcatccatgttccacccagactcagtgcgaacaaagtagcacatgacaggtgaagtgcatttgtttttgtcttctatcttctcttgtttcaatttctcctctttccctccatccttgtaaactgaaaggtacatcgatcaatgtaaatccaacaaaaaagcaaccaggaagcatgatgggagcacttggtaactaggatacaacttgtaaagtagaattggtgtctcttagtcaaattgacacgttcagactcttaatggatattgcttccaatttgtgtataactacagtcaatctattttttccagacaccttgcggggaaaacacatctatgccatctcacgcagccacgcaggaatgactggatggacctgttcacacaaccaaataaacccaagtgtgtcttcgaaaatccatgaccattgtttctctgaagccattagagaactttgaccctagtggtgttacatcataaattgcagtaattatgtattacatgcattctccagtctactacttggtaataaattcaaatagattcaatgatgcaagaaaaggaaacttaccgaaaaatcgatatcggcgcaaacccaaaacaataccatcttcagcaaccttatggtaatgttcacaatatgtagagaagtcagtcttggtgtctgacagtttccccataaactttactacaaggacattatcatcaccaacaactttctgtagatgagtccttgtattctcgatatatggtccctacattcagttaaataaggttacaaatttagcattggcacctgaagttccttaaaaaaatatcatgagtacggcatttgttgatatgggtgccttaatttttgttggcattggtcttcatactactactattaaaatcttatttgttggcattggtcttcatactactactattaaaatcttaggtggcctgcaaaggatgcatatgggtgatgtgcacctttatgtgcaagctagataggcaaacagtctgaacagcaatgaacaaattgaacactatacaatcacgattagtagatggtagaacatcaactagtaggccaactaaaaatatcgttattaaacaacgaacatcaataaacgctatcaaaaggctccacaaaccttgaaaattttgactacagtatcccctcttatcgcaacattacaatgatagacttttgtcatgcctggatctgaatcaaggttctgcaacaattaaaatggaggaatggagaatgatttcatcaggctcatgttataatatactatcagaggaaaagaaacagatagcagaaattagaaaaatgaaatgtcagtataatattctcatgatgttattgatagatcttgatgctcaagaatgttccaagttctagggaactgatgaacttacaagaactaggtatcattagcagacagtgtttctaataaggaacttttgaacaagaaaatatgcataagtgcatccctagaagattgtaaaagcatgatgcgttgcagaaaacttattacaggaaatggtttgtgatgttccagcttgctgatgaaccggccacagaaaatcacggtccaaaaggtggttttgctgcatttatcatggaatgccttgctagatgattggtaccgtttctatttgtttttgtagttctgaagtaaattaactcgaaatggaagtcaggaactacaagtcagtagtaccacctgtatggttctgctttcaacagaagcaggcttcttttcagcctttagtcttaaaaaaaagtcaaaagtgcatgtaacatacctagacactaacatcaaaatgaagaaaacatgatacttttaagatattagaagctcagatcagaatgtacaacagagtaagcatgcattatgtcctcgatgcacaagtaaattcaaggagaatgaacatgcataggtgcaaattatatatatttacttatggctccgtttagaattatccaagttctactatgaaatgggatcatcatctttgatcatttttagagatcgtcaatgaaatacaggaaatagaagtactgccattgaaataacctttgctctatccgaagctgcaatatacttgtggccaaatgttctccagatttgtgactcaaattgcgccatggacagaaacttcaaggatctaatatagtccacagacagaacattctctatcttttcactgaaacataaaagagaaaggtgtattagcaacagcaaaacacagacaaaagtcatctgacttaggaaataatgaatgttcaggtacaaaagcagtttttttttgttctccgttctatagaaaagcacaaaaatgaagagaaactaacctggcaaggtaagcaaaaaccataaatatttttctgaaccctaactcttccagcgctagcatctgaggactcgctgcctccctcaatgcattgtctgttgtatggcaagtcgttgtagggttttgcggcatcgccgtaatggggctcggcggacttactgaggggccagccatattctcaatgagtcttgaaatatcctgaacagagctcggggtggaaactcttcttggagtagaaatcatcggctggatggggctgtcaatctctatatagttctgcaggccagatggcatgcaacggcatggactaccaacttgcatcataacatcattaggcaccgcaggagccattgctcgggcaggactgtcaatctacagagccatttggttcaacccaggagaaaccattgcctgggtaggagtcccaacttcaatgcagccttgattctgcgacacagaagatgtatggccacatggactctcaactgtcagctgagcaagctgtggaaccaaacgagcaatttgtctgacagaaccaccattgccatgtaaatggaacggcatctgttggttgggactcccaacctctaccatcccatggtttgagagactagtagccatttcattgctggggctttgatcgtacatctgaacctcgttgtcgaacagttgcgtgtatactgattcctctgtataacagaagcctcgttagtctaacaagcattacagataaatcagatgattaaataactactcctctgtttcatattataagtagttacgatttttttcagtcaaactacttaagtttgacgaaatttatagatggcaacatctacaacatcaaattagtttcattgaacatattttaataatacgtttgttttgtattgaaaatattacttatttttttaataaacttggtcagaagtttgaaaaaagtcacaacttataatatgaaacgaaacggagtgaatactacacttcacaatttggaaaaaaaatgtaacagctacagatctacaacaatctgagcaaagacattagaaagaaacaacatccaagcgaaatgcatatgtaactgcaaaactaaaggggaaacaccatcataataacctgaaccaacgaaggcaaaaccagcaaaatcccaaaaccacgacctcaaccttaaggatggtaaatcaagaacgtgaacgactcatcgacaagcatgaaaaccgaaaaactcggaaggattctcctccaaaatgagaccagaaactgaaagcgcaaacagaaaaatggactgaaaatacaaaagcaaaagagaaatccccttacatagtgtatgaccttgtgattacgagcaagcgcgtgactaccagacgaaacattccccaaatattgtgttactgtatgcgctttgcaatgaaaaaaaaaagaaagaacaagaaaaaaaaacacacacacacacaaccagaggaagcagaacgaagagctatccttccactgcatccagtgccactaaacagcaaaaaaaaaaaacgtgtttttccctcacaaattggtgcaagcaaccctagttaacgagaatggcatcgcaacccaactccagaaaagaaagaaagaaagaaaccgaaaatgtcacgcggcgaactaaaagaaagccctgaccttcccgggaagggccggagatgaacgcgggggcgctgagggcggtggggacgccccgcgcgtcgcgcctcgtgatcgcggcctcccgcttcgccaggtacttgatgaagccggggagcgtccgcacccgccgcgactccgcgaccgcgcgcagcacccgcgccgccccggcctcgccgagcaccgcgaggtggcgccgcgcctccgcgccggcgagctgccgcagcctcccctccagccgctccagctccgcggccaccgccgccgggagctcggccggctcccgcgcctccgcggagccgatggggttgtacatgacgagggttcgggggcttctagcccggcccccccgcgcctctcggcggcggcggcgaggagagccgaggaggaggaggaggcgatcacgttggcgttcgcgttggggcgcgcgatggagggaggaggttgggaaatttgggaggaagacgcgcggaggtgttgaaatggcggtgggtgttccacatggcagtgggaggtggattgtcgattgtgggccatgcggggtgtggggcggggcccaaggaggagtaattcgggtagcttgctcggcaccctacccttcctctgtgcttgactgcggctgtggttgacacggtgcttgtgtgttgtgctgcggtagaatcggtacggggggattgaggattcggattccatttccactgtgtcatacatcgactcatcgaatttaatgttgtgtttagttccgtgtaaagtttggattttggttataattcgagttaatgtagctgaaaagttgtgtgtatgatatgttgatgtgatgaaaaatgcctgaagtttggatctaaactttggatctaaacatagcctaaggtggtgtttggatccgaactttggatctaaacaaagcctaaggtggggtttggatccaggaacttaactttagtctctatatttagacactaatttagaatattaaatatagactacttataaaactaattatataaatgaaagctaatttgtgagataaattttttaagcctaattaatccataattagagaatgtttactatagcatcacataggctaatgctcaatagattcgtctcgtaaattagtccaagattatggataggttttattaatagtctacgtttaatatttataattagtgtccaaacatccgatgtgatagggacttaaaagttttagtcccatctagacagggtctaaggctatgtttagatccaacctttggattcaaacttccaactttttccatcacatcaacctatcatacacatacaacttttcagtcacatcgtaccaatttcaatccaaacttctaactttgaaaggaactaaacacagcctaaagataaagaaggcatagcatgactggggctgtgttagttccctttaaacttgcaattttttcctcatttggagatatatataatagagtattaaatatgtaaaaaaaccaattatacagtttgcatgtaaattgcgagataaattttttagtctaattacgacatgattttacaacgtggtgctgcagtaaagattaaccaaggaggagtagcttgctcggcaccctatccttcctctgtgctcgtgtgttgtgctgccgtagaatcggtacgggggattcggattccatttccactgtgtcatgcatcgactcatcgatggcataggattaagtagctcccaccgtcccaaaatactctatctatcccactctaaatgcaaaatactctatctatcctactctaaatgcaactatgagttttttatccgattttgatcatttgtattattttaaaaaatttataatcagaccctgtttatgatcggtttagatgggctaaaactttttaatccctgtcacatcggatgtttagacgttaatttggagtattaaacatagactaataaaaaactaatttcataaatgatagctaatttgcgagacgaattttttaaacctaattaatccataattatcaaaagtttattgtagcatcacattgtcaaatcatggcgtaattaggctcaaaagattcgtctcgcgaattagtccaaggttatggaatgggttttgtaattagtctatgttttatactctaaattagtatccaaacatccgatgtaaataagtccctgtttcacaatcccccttagattctaatttttttttgaaacttctaacttttccgtcacgtcgaactttcctacaggttagttcccaactttttcttcaaacttccaacttttccatcacatcaattagtacacacaaacttccaacgtttccgtcagatcgttccaatttcaatcaaacttctaattttagcgtgaactaaacacacaaacttttaacttttccatcacatcgttccaatttcttcaaacttccaatttcggcttgaaactaaacacaacctcggttcggtattttttgctgttatgagatgataaaatatgaacggtactttactcgtgaaaaaacgaatctacgactggacgcgatatattctagtataatgaatctagacagagatatgtccagattcgtagtgctataatatgttatatccaatactaggttgagtttttatgggacggatggagtatgtttttaaattttttttcaattttttttaaacaagacagatatccgtgttcaacatttaaccgtatgtcttatttaaaaatttattaaaaataaaaaaaatagtcacgtatataatattattcatgctttatcatctaacaataataaaaatactaaccgtagaaaaaatttcaaataagacgaacggtcaaacgttgaatatggacagtataaaactgcattttgttgaccgagtaaaaaggagtacgcaaggattctttaaaaataaagcagcatatccccgagtatagtttcaaaatatactacccatcctaaaatac

SEQ ID NO: 47692 - DNA, 3716 bp, Oryza sativa
gaggaaatatatattcctgtgagatggcggatagtagcggaaaagggttaaggcatcagaatgtagtctaaaactagttcataagtaataaaatattccattcagccacctaaccacattatggaactagtccatagcaagaaaatagcaaaagccacacataagtatatgggctgcccatatagaataaaatatgttattttctctctctactcctaatactagttgctatctatatacattgtgaagataacaataattatagtccatatatgtgggtcctatctacatggactacttttgctatggcaaaagtagtccatagagatgggacccacgtatatgaactttaattattataacctacacaagtatatggatagcaaatagtattggtaggagaaaagagatagagacaaatgatatattttattctctatggacagcccatatacttatgagtagtttttgttatttctttcctatagttccacaatgttgctaggtggctgaattaaatattatattgcttatggaccacttttggagtacattgtggatacctcttagggcaagtactatgatagatgtggttgctacctccaaatttatttatggcattcaccaataaattaagatgcaagatatacaataagtcacctataatacacaaatatcaatgcctttagtactctcacattcttcttagagtttgtgtggaggctacctcttgatttaggggtggttcatcatctctcctcacttctctccttcatcttatcacctaatcctatgtgttatttttagagacagcacatgaagcactatagcacttgcccttagggcctagtactagcagagaggagggcgggggcatgccatgtcatgtcatcctggcgtggcgtggcgtggcgtggtgtggtgaacttgccagaaagcagaaagcagagagtgcactgattccttcacaaatctggcgactccaccagtctagagaggagtagactagtagtaggagtagtaggcatgctgctgccctgccatggaacagacatgagcagcgccgcgccgcgccacaccaccccacacccactgataccgaaagatatcgtgatcagatccagtgcagttgattcagggctgtttggataaattttagtccaatagaatgtttagcactaattaaaaatattaaatataaactaatgataaaacctagtactccataatcctgggctacatgtgctaattatatattatttaggattaaaaaatttatctcgtgaattagctctcatttatataattagttttattattagtctacatttaataattcgaattaatgttcaaaaatttcagtacctagatccaaacaccacctcagcaccacatgatgagaaatcaatgactcatatcaatgcatatcactgtagtaaaaatattacttttatacatcatatagtaacgaatgtgaatcgttagatcaaaatatggatggctcagattgcttgcagtttttattgtgcagttatactcatcaatccataaggaagtgtttggcaaatgtcaaagggaaatgatttccacccatttttaaatcctaaccattcattcacccttttccatttaatcctaaacttttattcatttctcaatctcaatcccaatgccatcctccattttccattatccaaacgcaccctaaaagtatgatagtagggcagaattaacagtcatacgaaaccgtatatttgggtgccgtaatctgtaatcagctcacatcctcaagcgacaagcttatacccaataaagtccctctcttctttttccaaaaagggaaaaaaaagaaatcagttaatctaaactctcacggtatacatgcattttttttcttttatcttctacaaattaaaagttgtctatacatgagtttttcccttttatctttaacaaattgaataagacttggccaacgggcaaagtgtcccaactgggacgaattcattcgggagaacggcagaagaagtgtgcaatctgctgaacaagtggatcgtggacaacggcacggtagaagccaagccgctacagtgagcgaaattggaacatccattccctccgctgtagcaaagattgaagatacagcacgaatcagcatgcatctacacactacggtatcagctttgatatgctgcagttcatcagatgattcggtgttagaacatgtgccatcacatataaaacacaaccaccaatattaaagtcgtttccactctgaatatgcaagctcttgatatttcatttagacttcacatgtcagtcatgcaagctctgaatgtgcatttgttcagtgatacatgatgcatgcatgcatgctgaaatgattccagagctaacgtagcaatctttagcttgactgcttgtgttcacttcaagcagccatgttaataggcccatcagcttagttataaagtctgtcctgacattttcctactaaaccatcagcttaagaagtccttattagtccgctcctgctcctatattgctgttacaatactacatacgccaaacttcatacaaattaactatccctaaatgcgatgctacttcacttgcggtacttcttggtaaatctgaagttgcggagaagttggagcgagcaaaccacagcgttaccctcattcttgaccgtgtagaaatggcacaatgcacggccggcaactttccaagcgaagccacatctggcgacgttgttggcagaccgtgctttctcatacgcgatctggtagattgcacaggcctcggagaacacgtcgtcgaggtccctcggtgtctcttcaaattcagatgcaccgtagagcaactgaatgttggcaagagcgattgggtcagaactctgaagctgttttccaaccattaggaaaaaaaaagctggtattcaaaagaatacaggacactcacatgcttgtacttttcatagagttcctgaaactttatcttcttttcttcttcatccgcctcttcggcatagagaagtgaactatcagccaagtactcgttatagcggtgttgccagagttgcttgattgctggaggcacgtctctctccgcgaaacatgggagcgatgatataccttattatcaaaaacaaaagagaaaaggaatgtcatgttacagagaacattcataaagtacttgtctcatcaaatatatgaaacctgcttgtgacaccacatcacaattcacatcaaccgtgttctgtgccaaaatcatgagttgttctaaatgttgcgaagcacaccacatcggatggcatggccaaaattttttgcagcgtttgtttttgaaagttaaatagaaaaaaaaagtgatgacatacagcataccatgggttatacacagacaacttattagaatagatgtaattgttctccattaattttacatataaattatacgaatatgatcctatagtctcacaaaactgacctagagtcctaaactctttccatgataacacatactccctccgtttcacaatgtaaaactttctagcattaccaatatactccctctgtcccataatataagggattttgagtttttgtttgtattgtttgaccactcatcttattcaaaaaatttatgcaaatataaaaaacgaaaagttgtgcttaaagtactttggataataaagtaagtcccaaaaaaataaa

SEQ ID NO: 47693 - DNA, 7262 bp, Oryza sativa
acggagggagtacatatagatgctaatgaatctaaacacatacacatgtctagattcattagcatctaaatgaatgtggacaatgctagaaagtcttacattgtgaaatggaggaaatatatatttattaatatcaacatcctcattgccaccttaactgctgcaagctcaagctaagttgtagcctactatgtgctacaggtagaatagagagaatgtgtggagtatccctactacagataaacaaattgaaaaaagaagggagctaaataaagacaacttactggttggttgaacattatcagatcgcagcggttttggatcacctgctttatcatagatttttccaagtatggacgacgaatggtacgaaggactgcggtccatgaagtgggggtattgttttaccattagatcacgtggaatattgacctgtcgggattggtgggcaaagcttaaattgttaaagcacaatatgcattcaataccctcacattacaaagcttcaaataactaaagatgcaattgcacatttcattttgtatcttgtaattttacttaatctgactgcttcatatgtcaaatgcattcatgtggccatgcatctgtacatataaaaagtaatatataagaaccaaatatgaaataccaacgagttattcccataactaagcatggtacatccattcttaaatcacgctaatataccgagagttaacacatatggttaaaagttcacacaaccacaatcaagacgcaactaatggaacaaagaatcatcatgttatggtatattaatttaataaaagagtgacttcataactatgtacatcaagaccagtgtagtgtatccacagcagatagcaacattcaggtgcatatgactgattttgctataattttgtagtacttactaccagaatagaatataatagcaactaataaccttcacacgcactacccaatagcatatatggattgaattggataggctgacttgtcagcacattcctcagtatgatttcataagtagttcagttcatatgttgacatgtatataagaatagtccaattgatttcactccaaacttaatcaaggtgttattaactaattattactacaaggtcttggttcaatttgtttccttctttccggtgtttatcaaaataccagatgaaagcataagttaataaggatttcagttccatgtaaaagcatttgcaacaaacattgtgtaagcccaagattgaagttaaccttgttccccatctttggagcatccaaagccaaataataaaggtcaactaacttgagcatctttttctcaattagtttcttttcactttcgtcaagtgaaacagttaatagccgatccatatatactaaccagttagtagctgccgtagcacgcgcataactgaaaggagaaaaaagaaatccaaactcatgttagatcgtacaaaacttataaggttgtatatattaaaaagctacagaaaattgtcaccaacattagatatttaaaaatgtactaatcggattcatacaaaaagatacccaagcacttgtagttataaaaatattgaattcggtcaagggatcatcattggcgcatgggaggacatccattgaagtattgaacacctcaataagttgtatatactagaagttaaatgaggtaaatttctttacagtagagaaatggtttcctaatgaaaaatatacattagaaaaactgagcttggtattaatacctaggtgcaaatcttgttttcaagaactcatgaaatagcactctttcaagctcggattcattaaaatcctcgggtcccttttgcttggtcccatttggtgtaatagctggaacccatggtttcgaaggtttaaaatgttctaacagctgaaaagaccatttttattatcagagcagcaataatctttgaaaagctcaaaagagagaatgtgctgttatatatcaaaaccatatacatgcaagaataataagcaaacatatagtgaaacaatgcaaagacacaatgaaacagcgatgcacaattttgcaacaaaaagcaaacatggcataactaaaaaaacagctaccctaggaccctatctaccttaagatggctatggatccacccaaatgggcgttcaaagctattataagaaaagcagaggatttctttggaaaggacaggataaagcaactgtcttttgtcttgggaacatgtttgccggccaatacagtattgtggtcttgacatacataacctagaaaggcttcaaataattgattcttctagaccatgggtcagcttgcctatccaagtatctcacaagtcacaatgttcatgcgctcttctacgtagctacggaaactataattggtaatggggagaacaccaagttctggactgatatatggctgcgcaaaacattggctgaattggaccctaaccttcttgagacaattccccgaagagtaaggaagcaacgcactgtggcaaaggaattggttaataggatatgggtggctgatattaaagaactcacaattcaggttatttgtgagtatctacatatttgggacttggtggatgggataatcttgcaacaagatgttctggatgagcatagatagaagcttacaagttctacacaagtaagtcgcatacaatgcttacttatcaatcaagtttgcaacttgggagcgaatttagagaagttgggttcctccacaacataatttttccttgtgattggcagtcgacaatcgatgttcgacatcagaccgtctagccaagtgtggcttaccacacctggcctatgtcatcaagaggatgaaaccatgaagcatattcttgtctcatgtgtcttttccaggaaaagtatggaccttgatcttaaattgggattggtggatgcggcccctcagcctttcagtatcccatttttcaggatggtggtggaaggttgtcaaggagattcctaaggagcagcgtaaggggttgaactcgttgattatcgtagtagattgggagatttggaaagaccagaatgattacatgttcaatggatcaagtcctctgtaggttgtgagtccaccaccacaaccgaggctagtttgtggtgtctagctggagagcatgcgctccaagagttcctctgtaggttgcttgcctcgggcagctaggttgtccttgaaggtgtggtcgtgcgtcaccttccgtggtgtgttttttgtgggagggttttcgtaaaccctcgtttgtaacttgtaagtgtgttatacttcttcttaatgaaatggattttttttctctcctgcgtttacgagaaaatattttcccaagtggactttactggtcttaaacaccaccctgaacttcaaaaccaatcacctttcaagttcaccccaaatgcagacctgttttggcaacatgacgatgtcacccaaggccgaaccaattttaaactgacttagtaaactatttcaaaacgttctggaaacctctaaccagtacagtggacctagataaagtataactggcccttcaaaaataatgttaaaaaataaatacctacaaatttatataaatgttcgactaatttatccaagttttcaatactcccaacaaccaatcaaaaagaaaatttaagtcatttagttatcataaaaaattcaaaaaccatttatacctggtgtatattttttaacattcagaatcagaaaacacctgaatcagttctggaaaattctcaataatattatggtgtatatatagcctagaaaatttagtacgagaaaaataaagtataagcatctggaaaaaggtgtgttcaaaactaaataagccaattttcatttcactgactaaaatatactctgtttcacttgagactaactatactccaaggtgcgactaaagaatttgtccatattttttatgtcaactcactaattccaaaaattcaaaaataatttcaaccttggcccttactgccaccttaatgaatgtcatgtaaaaacaatccgattcaggctaaggtataaagtgaatgattttgatcgtccagattttgaatagtgtctacttttgaggtttgaggttaatgttgtaaaacaagccttttcctcattaaaacctaagcatactaataactgaattcttctaaaagcaaaggagctatgacatttaatatcatttggtttgggtgcagtgaccaaattagctcctcaggtttggcgaaagagccatttttcctggagttataacatcggacacttctcttataaagaacagatcatttccaagagcattactggataaatacaatcgacatagaccatgggtaaagtagcataactgctgtatgaatggaacaactacgctgtggactaggggcaactgagcaaaactctgtcagggattttgctgaccataaaagataatcaagcacaaaaacaatattaggtgcatctcccaagacgatgatttccaataaacttcacggtaaaatgtcaatcaggaattaacatacctttgggtttaatgagacccagtagatgtcaccatcaaaatcactattggccatctcatcagccaaagaccgttgtccagtagtagggaagagtatcgcatgtttagaatttcccacaaccttctctatgtcgctactatatgttgccttcaagacatgtatatcaccaggatgtaagccaggatatttatacacaagaacatctccagaaacttggccataatcactgtttaaccacatataaagcaaataagtaaagaaagacccaaaacataacaggcacgctacaaattaatacttgtatattgatgcacatttatgcaaggaatatatatagcaaagaacaaagttattatctttggcaaattcaaaccccttttcgtaatccaatatactctccccattttttaatagctgacatcattgacttttggcatgacatttgaccattcttctttttcaaaaaaattatacaagtgtcatttattttgttgcaagttgttttatcattaaaaaaactttaagcatgaattatattttcgttatttacactaaattttttaataagatgaatggtcaaacgttctatcaataatcaatgtcgtcatctattgaaaaacagtagtatctgttggtagaattttttttcctaactattaaaaacaattaaacagatcaaattactgagctaaaaaaggccatatacagatatactcaagaaattcaaaattaggttgaatgaactaaagaatggcattaaagtctcgagggtccaaatacatgacatgtatttatgatcttatgttgtcagttcaatactttctttagactccatttgctgacaaaattcacaattgcaaccaatattgttgccactattttcggatagtttgaataaaaaatacagtccggttgcgaaaagagaatacatgccaaccaatctaacctttgagttgtgattcaaaattgaggattgtaaatagtaagaaaaatggtaatgttggtgcgttacaactaaagaagactgtaagacattaaagtagttccaatgatgcccatggtggataatgatactcctatcttatgtggtaacaaaggatcactgaagcataacaaaaaaacacacactcaaacaccaagaagaagcaaaagagtatttccattactaacagtatcacgcagacttcattaggtccaagttttcctgtagggtctgcagtacccatcaaataatagcagtcatcaattggtatctttccattcttgattccttttctttccagtagagacaagaaatccagcctagattgcaagtacgactcttctagtgggattccggaaagaatcatccgtgctggcattgaatcttccatgtcagcatagttgaatgcaactgcaagaacatgagaatattagtccggatcaaacacggacaggtgactgaaaaatataaagaaaatagtaactctattacaactagtaagatgagtacaggttctacagaatgaagaagcacatatatacaaattgtacagaacacagtgcaatgcaatgagggtagttcgaactaactgttcagtgcgccagcataatcaaaacgagcattgtcagcctcttcaatcgcagtctgcagaagctccataaagaattcttctggaactcctccatagtgaagtaatgcaattaaattatttgatgtgaatgtccttcctgatcgattgctgagaaaaagaaatgatattacttactgtgaacaaaaaatagaactgactgcctgttgccaatcaaaaagctttactaccccttacacacctacctaatgagctcagctttactctccctcctgcctctacctaaccggccccaaccatgaggattagacatgtgacagcacttaaaccacagtaaggaacctccaagtctggccaccagcccacccaaaatcccaaataccacaatgatttaaatgcagagttcgttcctttggacatctgagtttcatgtaccaacaactcatccaaaaacctaaactcaaattactaagcaaaggcaagtaatcctatttatagaaaaaaaaaagtgagtttcacatctaacacatcaaacgtattttgttgttctgatttccaagttatgccacctcatagcaactgtagcagaaattgggaaaaatatatctgggtgggttgtgtggatggtcctgaaaaactctggaaaagaagaatggcaatggcaaccttgacaaaaaatcaatctatcagcatcaaattttcaaatcaaaattcattctgccgtataggaaatctggatagagagagagagagatacaattcaccatttttttaattatttttcttatatattttttgtttccgtcttaatgaaatgaagcacaattctcctgggctttagagaagagagagagagagagagatctacaattcaccaaaatttgtcctctgtgtttatcctagcacatcatggattttaagctgaaatttcgtacatgcctgattatatcatgaattgcaaagccagtgttttccttgtttgcagtttttcatggccatttgcgttgcctaaaagaggatgcactggaaatactcaaaaaaaactaacagcgaccgtaggcaaaactaacatctcaaagtttctggcttcaaccacacttacgaaagatgacacgtgatgcgtgacgtataactaaaaaaacgaaagg

SEQ ID NO: 47694 - DNA, 1767 bp, Oryza sativa
gccattattcaccatacctaacatagcaatgcaactcagatatttggcataccttgtagagactatttcaaaagaattcacggactgaaccccagatagacttttcttggcatttcgtgcagagactatgtccaatgagttgacagattggacaccagataattctggataagtttttatttttaacattgatggtcggatatgtatagtcctaggaggaagctgcaacaggagactttattatttcttataaagtacactcaagatataaggtcagtcaagataagatagaaaaaggacatgatctgtacacttcaaaattatgtaaacaatgcatatattggtgaagacagtgaaggccactcggccagtgcaactatgacaataagaggatatcagcaaagattatgtcaacatgaacaaacaaagaaatgatcaggcggtcttaggaaatgatgagatgcaagaaatagcacacctatcctgaatgaagcacggataaatacggctcttcttgtatactacttttacataatcatatattatgaaattctcctgcgtgttctaaaaaataaataaaaaattatgaaattaaattgcaagacccgtactagacaatctccgattgtacggcacaaacatatggaaggcgctaatatatagatgttcaagcaactatgaaccaagattggaataaagaggtaatcctgaagaaattattttgataccaaacctgcttacaaactaattgtcttagaaaacagtgcatacccgcttgtcaactaggactgttccctttacagcagatccattgtagaacaggcggagttgaataagaagaggctagaaaaataaaatagataagaataacaaacatagaaaaaacagaaaaggggtaaatcagaacatcttatagttaatacaatacatattcagtggtgttgttagaccccatcaatttgcttgcagcacaatccacaatgtcctgaaataatgggaaaaattctcagatagcttaaagcgtggaacaaaacattgccattaaggttgaatgaagcacagtaaaataagttaatggcagctgatatttatatctggatttttgaattataagtcagtggcaataacatttgagcccaccctgaagctgaatgcaaaagctgtgcaatagatatgacagcaggaaaattttaggattggcacattcctacctaataatgaaatgaatcaacacaaataaaagttaacataagaggtacttcaattaggaacgagaaataatgtcacaaaacagtatattggtaatgcaaaaacaatgtaccaacagtcatttgcttcccatatgaggggcaacaagaacgaaaatggtatcaatttaattaagcggacaagttagagccaaagatgacccgaactaaggtggtgaggatgtagtggtgtacatccacacttcccaccaactgagctagggttcagttccttctttctgtaactttatcacaaagtcgtaatgatgtttcaggcatgtgtacatatgtatgagcaacaccatgattgttcctttctcttactagtatgctgcactttgatgaattgtgtttgtcaaactttttcactggtgtgcatgtgctcaccttataccttataaacaatcagataatccacaaatgcttctgatttagtaaaaatgcttcacaaaaccataaccctcagagtaaccaaaaaatgtctgacaggttaaaatatactactccgttaagggggatc

SEQ ID NO: 47695 - DNA, 5816 bp, Oryza sativa
caatagcgtcatctattaaaaaatggagggagtatatagcaacaaaagtcccgagcgactccctccatttcatattataagtcactttgacttttttctagtcaaacttttttaggtttgagtcgtttgaccaagtttatagaaaaatttagcgacatctataacaccaaattagtttcattaaatgtaacagaaaatatattttgataatatgtttgttttgggttaaaaatgttgctacgtttttctataaacttggtcaaactttaaacattttgactaaagaaaaaatcaaagcgacttataatatgaaacggaggtagaaattcattgaaggtaataagagtgacacaagttcacaaacatacctgtggctccaacaattttccctttgagttactataagtgcatttctgagccaaatcttcagatataaggcctgtcccgtcagtatgtatcaaccgctccccatctctaaaaacttctttgccatgttcatcctgagatattacaataaaaaggtgttacattccagaagcaagaccaaatattggagaggatggagaattaccaagcaaggctcatcatcaatgagtttgacaagaacttctgataaatcaacatccaatgtgatagttttggagactatcaaagcaaacctgcaacgttacaacagaagacatgaggtttaatgtaacagaacactcacatgcaagaggtgaaagcagagtccaacagttagttttcttctattaagtgggcccaatagttcgatagcaacaataatgaaaatgaacaataaggtaggcaatggacttgtggaaatacaagcttatctcccagtttaagaaatttcaatccttctaaaatgcacatccttctattttagagaaaattccttatatgccactgaattttcactgttttccttaaatgccataaaaatgagctattcctttctatgccatcgaaataaatttcagtgtcatcttctggcatccacgtcaccatggcactattaagaagagaaataatgccagtattgtcaaaagaatgacaaaatttgcccttggctccctcgtctctatccccactactgtcttccctaaatccacaatatttcccattggtattctccctttgcccaagcaccagcgtcttcccagcccgtcattggcacgtttctccacatgctaccagcatcatcctccctgcaccagcaccccctgctccagtcagcggcagagcggtggggtcccactcccatcatcccaatgccaggcactgttgtcctctgcatgcccattgcccccacagccgcctcccaatgcccattgcacagagacagcattgttgcccctcatgcaccggcgtgatcgtcatcctgcgcacatacaggccatgataattaatcatggtatgctgctccaaatctgaaatatggtatagcccttctgtcctaagatccttgtctcaccgccgccaccgtggatgaggccaacaccaaacaacacaaggaacctcttggcaccagaagctcagctcctccatttcctaggtccagctgatggaattaatgccatggctcagccagaggagtgtatccatatattgctggatgctagaaaagagggaaataaatcatgcccattaaccttaaccttggtttatcgatgctgcctacactacttgcagatacttttgttgagcggagctaatgcagttatacagaaaagcggaccttcaaaatgatcttttttttttgacagaggaaaatgaatccaggagagagaagggtacataaggtgaagaagaaaggcagatctcctgaaaaaaaaaggaaaggaggagagaagggagaagggtgattttgtacttttccttggcaactgaatatcatggtgatgtactgatgtggatagcataagagagcatggaaattctattcgatggctcaccattaatacaatggttaaaaggtagagcttctctacctttcgcgtcaaaaagaataactaattttcgatggcatataaagaaaccggtgaacttcccatggcatataaggagtattttataagaacacatgttgctatcatggtagcaaaaccattttctgcaactaagctcgacatcacccagtaattgcacccatgctgcatagattaactgatattattcaaaagtcaaggaaaaacctgagcatatatttcgccaaggtgagaacagtacggatgtgcatgaataggtcacgagcctgaccaatcgttctgccagagagtatgtaaggttcatccatgttccacccagactcagtgcgaacaaagtagcatctgacagatgaagtacatttcttgttttcttcttctctattctcttctttcattttattctctttcccgccgaccttgcaaactaaaaaaggcacattaatcaatgcagatccaatcatgaaacagtgacaaattaggaaccatgaaacataatggggacacttggtaacaatacaagagtttacaactcagaaaatggcactagtttctcagcaacaaattgacctgttggcaacctcatactggttactggatattgcttctaatttgcatataattacagtactattactagtaatccatttttttccgacaattctaaaaaaagcatgtgtgtcatccccatgccagttaacatgacccaaatcaccctaagttcatgtcttcaaaaaatctgttaccattgtttgtatgaaacattagagaactttgaccctaatggcatatcataaattgcagtaaccatctctacattatgtgtattcatcagcctaccactcgtattaaatccaaatagatccagcattgcaacaaaaggtaacttacggaaaaatcgatagcagcgcaaacccaaaacaataccctcttcagcaaccttatggtagtgttccaaataggtagacaaatcagtctcagtgtctgaagatatctccataaattttactacaaggacgttatcatcaccaagaactttctgaagatgagtcctcctattctcaatatatggtccctgcacccagccaatgttaaaaatataacgatggcaccttaagttccttacaaaataaattatcacagagtgcagcatttgttgattttggcgccttgacctttattgcaattagtctttatattagaacttccagaaaaatcttaggcagcttaagaaggatgcatgggtgatatacacctttatgtgaggggtagattcgcaaacagtcaacagcaatgaacatgaacattacacaatcatgactggtagataggagaacatcaaatagtaggccatctaaaaatatcatggttaaacaatgagcacgtataaaagtatcaaaagcaccacacaccttgaaaattttgacaactgtaccccctcttatctcaacattacaatggtagacttttgacatacctggaccagaatcaaggttctgcaagcattacatggagaataatttcatcaggctcaagttataacttataatagaggaaaaggaacaaatagtggaaaacagaaaaataaaatgttagcataatattctcataaggaaattgtgaatgaaaaacatgcacaattgtattgctagaaagatgtaaaagatataatggttgtggataacatgtcagccagcccagacttatcgtaggaaatgaattgtgacgtcccagcattctgaagaactggccactcaaaacctgggtacaaaaggtagtttttgttccatccatcatggtatgcagtgtcatatgattgtaatcaagtacccatttcaatttttttttgtagttattaagtaaaccaagtcgacatttaagttaggaggtacaagtcagaagtacatctagcaaacctggacactagaatcataatgaagaaagggtgatatctggaaggcatcagaagctgagagccaatgtgcactagagtaagcatgtattatgttatctacgcacatacaaaattcaaggacaatgacttgcgtaggtggttccatttacaatgatcatgatccaatatgaaaagggatcatcatgtttgatcatttttagagacctttagtgaaaattattaagagtactggtgttgcaataacctttgctctatctgaagatgatatattatcgtgaccaaatgtgctccagattcgtgactcaaattgagccatggacattgacttcaaggatctgatactgtccacggagaggacatcttctatcttactactttttggtgtagataatggaggctttactcctttcttattcctgtaacaaaaagagaaaatggtgtattagcaacagcataacacagataaaagccatattagccttagaaaatagtccatgttctgctataaaaacatctttgttctttattatgtaaaaagcataaaccgaagagaatctaaccaggaaagataagcaaaaatcataaatatcttcctgaactccaactctcccagcgctagcatctgagggctcactacctccctcaacacattggtcgtgtcaggacagattgctggaggaatttgcggcatcacccaaatgggacatggaggacttcctgaggggccagccatattctcgacacatcttgatagatcccgcacagggctcggggtggaaactctttctggagtagaaacgatcggctggatggggctgtcaatctccatatgtctctgcagcccagatggcatgcggtggccagggctaccaacctgcatcataacatcattaggcaaagcatgagccattggttgggtaggaaagttaatctgcacagccacctggttggacgcaggagaaaccattccacgggaaggcgtataaccttcaacgcagttctggttctgcagcagcacagaagatattcgaccatatgggctcccaactgctgggttagcaaggtccggaaccacacgagcaatatgtccgacagaaccgccattgtcatgcaaacggagcggcatctgttggttgggactcccaacctccaccatgtcgttgggtgtttgagcatccatttgaacctcattgtagtacagtggagtggatatagattcctctgtgtaaccacaagacttattagtaagaagtacttcacaatttaggatatgtataacagctacaaagaccttagaaagaaacaacatgcaaaccaaatcaaccataccaaatgggcgaaatgcaaaggtaaaaagaaaaaaaaatagaaaaatgccatcatactaagctgaaccaacgaggctaaaatcaaccggttaccaaaaccacgacttaagggtggcaaaattaaggagaaaaaaaatacgatcgacaagcattgaattcgaaaactgagcgtcaccattacagaatgttgctccctatcacaacttggcaagattctccaaatcgagagcaggaatcgatagcccaactaaaaacaaaaacaaaaaaaggaagatactcccttccgcctacgaaaagtgcattagcattaaacaggggcgtaggcgcaacaaaaaaaaaagagctgaaaaaatctcccaaacagtgcgggttttgcagccaaaaaaacacgctaaaacgcactgccataggaagcacaaacgcagctaatcctcctctgcgaccatccattaagattaaaattcaaaaagggttttcctcacaaaaaaaaaacgaaatgggcggtgaacaaaatattggcctcgcatgagaaaaaaagagtcggtgaacaaaaaatgccaagcagcaaaccccctcaccttcgcg

SEQ ID NO: 47696 - DNA, 1591 bp, Oryza sativa
agatcgaacgaggaatcgatcggtttggaggtttggagcgaggaaatttggaaaaggaggagaaggcgcgagcggggtcacgctggggggccaggaggagaaggaggtggtggggggggcccacatggcagtgggtgtgggaggtggattgattgtggggggtgactgggaggcgaggtactcaactgtgactactccctggcacggccacgtgtcgcgcttcggagggcggtgccgaatgtgggacccaggtaccagagagtggaggattgattccttttggttgcttggactggagtatggagtacacttccggcctccctgtgctagtgcgcttctgcggcagaatcggcagatgcagtgacgcgtcaaaagttactagctagccatctcatccgaagttccaaactatagcatccaaagcccttgtgtaggccatgtttttcaaactttttcaaacttagaacttttcatcacattacatcatatccaaaactttcctacacacataaactctaaccttttttttccaaactaccaacttttccaaacttctccctaatttcagaaactaaacacagccttagttccaaactttttttttcaaactttcaacttttacatcacatcaaaactttcatacacataaattttcaacttttttatcatattattccaatttcgaccaaacttctaattttagtttgaacttatctctgtagtggtagtaggaggggtagtactcctagtagtaatgaaaaaaaaaagtaaatttcaaaaaaactacaaccgtaacaaaagtaacattagtaatatatatttcaatttattgtaacgttaatatatgaaaaattatcacaaaactgtaatttttacgtggtatgcaacaataaaatatgtaggtgacaacagtatgcttgtgacatgtaaaaattacaattttatgataaattttcacgctattgttgtaacaaaccgataattttctcactatagttgtcattttctgaaaattactctaatgaaaacaaccaaggatacccgtttgaccgggagttttgtttttgcaatttaaatggcatataaaacaagatatgctatatcgtatgattaataaaatattaattattacaattaaaaatatgtatttgaatttttaaaaactatacaaatttctttaagaaaatgtacattttagcactttaaaaaccgcgctcgtagtaaaaaagaagttgtaaaagctaacaaaactacggaactaatagtctagcagtactagttatttataaccaatctaataactcacctatatataatagtttttttttcaaaatacaggacacagaaaagcataaacaaaaagaaaaggatagaattacatgtgtaaaacagttgtttcgaaaacatacggagggaatagcgacgggattcttatcaaggttgacaccaataatattgacacagtgaccttatacctcaacgtcaatgagattcgctttgagcccacgatctatttctgcaattagtttttagtgattttcacctggagccaccttctattaccaatgttttgctttaaaccatcctttaa

SEQ ID NO: 47697 - DNA, 15689 bp, Oryza sativa
  unsure (1)..(15689): unsure at all n locations
tttttcaattttttaggtctttttgaaaacttatttcacgaatagacccttaaaacttatttcgaaaataaacccttttttagaaccaacatcattagcgacgtgatcccatatgaccaccaattacaatggcatcatcccactagcctctccatagaaactaagctagttatgcaaagggtgcaacgtcaatatcattgatgtcgaggacatatgtgaaatatttttttttcaaaaaaagacttatttgtaataaaagaatatttataaataggtcatcggccagtgtcattgacaccgtgggcttatttgtaattttttattggaaacatgtcgttttcttatattttttattagaaatatgccattttcttatctggacagagagtctatctaaaatgcattgtattaggaaatgtctcatccaattttagattattatattttgagacggaagaagtaatccagatacattgtactccctccatctcataatataaggtatggtcaaatttgacacagtcttcaaaactaatgttatatactacaaggtttattgtaacaaaattataaccatctcaaagtaaatttaaatgtcaatacaatgatattaattttagcaaataaaatttaattttatattataataattgttggtcaaatgtttttaaagttgaatcttggaacgtgcgcatgccttatattatggatagagggagtaataggaaatgtctcacctggtcctagattcttatattttgggacggttcttatatttcgtaacagagggagtaatccagatacattaaggctgagttctttccccaagttcccaactcatctcaatcgttttccacgcgcacgcttttcaaactactaaacggtccgtgttttgcaaaaagtttctatacgaaagtttctttaaaaaaatcatattaatattttttttaattttttataactagcacttaattaatcatgctttattctatcgctttgttttgcgtgcggatgggagggggttctcaacccctccaaaagaacacagtctaaacgttccatttatagattcttatattttgaaacgaaaggagtaacattttaagtaattctgtatggataagccagaaaaacatataaaccgtagtgctgtgtttagttcctaaaattaggaagaaatttagaaaaaagttagtaatttagaaaaaaaaataaaagtttacatgtgtagaaaaattttggatataatgtgatatgatggaaagttgaaagtttaacggaagtttggtgtgccctaggcatggccttataatagacgtccgatccttccgtagttgggtactgaaaactttgaaaaccctaaaagcaggcagcacacgcataccctattgccctggacgggagtaggcacgcattcccaggattcgtgacagcttctgctgttgtgcggagcccgaaagttgtgctgcacatgtcactcaatataggacttgtttagttataaattttttcttcaaactttcaacttttccatcacaacaaaactttcctacacgtaaacttctaacgttttcgtcacatcgttctaatttcaaccaaactttcaattttagcatgaactaaatacacctatactcccaattactcctactccactctacttgctctaggggtgtgtttagttcacgctaaaattaaaagtttggttgaaattaaaacgatgtgatgaaaaagttaaaaatttatgtgtagaaaaattttgatgtgatgaaaaaattaaaagtttaaagaaaaagtttgtaactaaacaagatatctcactataccaaatcgctgccagtattgcaaaaggagatagaaagaagtactcctagggtgtgtttggttcaattttttgtttggtttgcatgatatggcgatccaatttcttttgtgttggaggatatagcatggatggaaaaagacaaaagttagtgagactcatttgtcatatatatatttttttatcaaaatataatcatccgagatcttgttttaaagatttaattgtaacaaatataatggtgtaatcaaatcataaattagataaacggtttaggagaaaaaatcatttggagcttgcttaacagaaaatcaaaccaaccacgaccaatcagaacaagacacatcacccagaccaaaactggatggcttcatccagcaaaatcagccggatacactcatccagcatattgagggaatattccctattctgggccgccccatccaccctgccatccaaccaaacaccacagaaaatcgggcagctatctcccatccaggctcatccacccaaccaaatacacccctaatgttcaaggaaaacctggattactggagcatttgctactgcggcaattaataaaccattgatctgaatgtgttaagccatacagccgcactgacagaaatttgttaaccacgtttagatcagataagtagtagtactccactacttaccagttaccactaagcaagctacagcgatgaagtgtcatagcagtccacaagaataaatagtcggaaatcagattatcattagataagagagcaaaatcaacagtcatgcctaccgcatatttgggtgcggtaatcagctcacctcctcaagcttactactcctactcaataaggtccatctcttttttttttctctccaaaatttaccaagtctaaaacctaatctcacggtacagaatcactaagtttgtctatacatgtgagcaatgcagttttgttttttcttttcttttacatattgaataatttatgcacaataaatcagtaatggaaatggttctgcactcattatacaaaaacaaaattagtctttcatcatattaacgttagctttggttagttaggatagttagtttatatttttgaaggctacgagtaagttaaagtttgcacttcaaaatccccccattatcttgtcacaaaaccggttgttcatattattagatcttaatcttacaaaggaccagctcgggaaaatgcacttcacgacactgatcttccatagcatatggagcctaaataaagattttttgcccatttttcctgcaaatagatttatcagatttatttgttatgtggagttcaaacaaggcacaagaagaaggtatagtcacctttacatgctggccaggaaaagcagatgttctcagtgtctcctgtgtttcatcgttaggctttcttctaggtatgctcaagatcaaagccacctggtcacatgtggctgctgttgcagttatgcgataaccactatcccagcgttgatggattccttcactcggatataagaaatcaagttctactacctacaaaagagatatgcgagataataaaatctcaagacttttacatattcaattgatagtcagtgtagcttgctgctaaaatgaattcaattttacaaggctcttggacactccaaacgtacctgatgtgtgaaaccagcgttccgggacataaccacagcccatcggcttcctgctgtggccaaggcagtgacatagaacccctccttccactttttgtttatccatttgaagggaaatgaatcacttactttgtaggattgctgtgcatatggcgttcctgagaagcattcaagtcagttcttggcttcttgctcataataaataccaacagtaaacattacaagacacccaagtgtttgcgctgtgaatggcttctcactacacatattaacggtggtactttctgaatactttgatgcatcaacatttaacaaatttcacctcaacagtaaacattacaggatacccaagtgtttgcgctgtgaatggcttctcactacacatattaacggtggtactttctgaatactttgatgcatcaacatttaacaaatttcacctcatccagtattatcttggtcaaggtaacaatattaagtggtatgtttatccaaatgttgtctagcagtttatagtgatttcatcatagctaggggcaaaagattgacagcctcatcggttgcccatatttcctaataagccaaaatgatttattagaaaataaaaattaatttataggtaaaaaattgtatatgtgttcttagcaacttaaaagccaatattaaaaaaactatgttcaaaatatcttaaaattaacttcaaaattaagtttgaaaattcaaattttggcttttgctttggcttattaggccaaccaatgaaaccttgattttatatattaaacccatgtcatgtactaatgttatcaactatatgctgcttagcatagtgttgatttaccccaaagagaacatttgtttgagaatttttctttattaaaatcaaatatttatcatggttttgattaatatccagttcttttagtattcgattacgtgtttcagtacacatttgatgagtttactgtagttcttctctgagatgaatcgttgcgcttgttacataatgatcctggcaccgaacatgcaaattcaggactaaaggcatcaaaatgaaactgtatacctgttgacatgatcaccaccgagcttccattatttgaaccagccaaagaagtaatatagtaatttctctcccactgctccattatccattcctatcaaagcgcacagttaaagttgtgattatacatttatctcagtgttctaaaagtcagctccaggcgccggttagccgccgcgattaggcattagatggtgcattaagaggctgaactaacttgggtggtgtttccttgctattttagtgttatatagtcttgtttttatgcaatatgcttgctaatttcttggatttgactagttagcctaacctaggcgccccccagccgccggactagtgcctggcaccttgttgtcccaaaatataggcaattctagagttcttcagggggttaaggagaggtgaaattaaaacagggatggttgtgattggttgagatgaggaagtagatggagaaattaaataagagatggcggtgattagttgagatgatggaatgggtgaagtagcaacattttgagacaaattttgaatgcaagaagttactatattttgggacggagggagtagaaaacaataccatgagatggcaattaggatagagctgagtatgcttgattagtaaccaaccacagataggaaaaaaaatacatactcaatagtaggatgacacgcaattatttaccttgtgaagaaagtaatgggagagttcatgtacttgggcggtaaaaccagtgccagcatccataattaaagcccacagatctgaacaggatgaaactgaacttataaacaaaccatcttcatttcctttttgaatatgtggtgctaatctatcatctgctacattgtagtggtatctgaaaaataaatgtggtcagacaatagagtattattttactgctaccaagcagattactgtgccatacctctgtttcattggccgacgggcattgtacacactaatccactgggtcgctggcattcccattctaatctttttcttaggttgctcctcatcttcagccgctgtgaggcggcctctcttctgaccaacctgatatacaagctggcagcaatccaacaaagcattatgcaggtagcccgctattacataaagaaataaggaattatttaatatgtcactagattttgccagttaactattttaccaccaaaatacatttgatattgaatatgtcactgtctctaaagaccaatctgatcatgtggtcttaatggcaggacattgactatgttttagtctatgcaggtcatactcgttatttggtgtttcatattacagaaagctaggacaggaagttcaaaggcaggttcacaattgagttgtttcatagtgggacatagatttccttcactaaaacctaaaagcacaaggttggcattgaactaattggaattcttgggaaataatattagttataacactagtgatgactctcaagcccaaggatagaatcaggtaactttaattatttactagtgctttgaattttgatccgagaaatagggaattggaactgagattcctacacgatcattttttctgacagatgatacagacgcagattaaaatggttgaaggaataatgtaccttctgggcaccatcggtgtttaatggtcttccatctggatttggaccaacaatgccatcaaaaagagcaatgcactttgcatagtttggctcttcgtcgaacttcaagttcacaacatactcaacaaattgacgaaatggtggtggaccaatgccacataaagattctggagaggttgccatctttttcttgcaaacaagaaaacctttattctctccctaagttcattcatgaattacaaaacgaaattagtgcatgtagcaacaaaaaagtcataaaatcaatcaaaattaacctggaatccttgccaaggcaggcggccacggagaaggaaaataagtgtgtatgcaagggattcaaggtcatctctcctgcatccagttcttcccaagtgggcatgcacactagcataacgaacagtacccctgtttacagtagcagacaaacaggaagagcgcatcaataaagtaatgtgcaaaatgataggcatcgtaataaactttctattcaaacctaaagatatcaggtctctggtcatattcaacatgctttcctgtaccagcatctttccatttagtagctgcattggaacaaaacaagttcataaggaagcaacataaataattacatgacaacaaattgacacaatataaagataaaagttgattaagaattacctagtccaagatcaacaagaaaaagtttcttcccttcaggggtatctggaggaccaagcaaaaagttctcaggtttcacatcaccatggacgtacctgtcataaacaaaatttattagctaaaacttcagagacgccatgtgaaacactcttacggaacatctgaagagcaggtcgagttaccctttagcatgcatcttctctagtatggagatggcctctatacctatacaagcaaccatctcaacagacatcctgtaaaagaaggccacaaattaaaaaattgaaaaggctgcattgaactgtcaagattaattaggaagagtcaaaagatgcccacgagtgggaattgttattccaaacatcccacaggctcggtcccaacatatccataacctgcatgaaaaatgtgtatggttagaaaaaacgtagttgataattcttaagagaaaaagaaaccaatcaaaccataaaccggaaagcaaaaaaaaaaaaaaatctagttcatgctccattaccatgatgtaaaacccgccctgctttcctttgtagtgtacccgtgggacaccatgatttccactaagagtactgcaagagaaggtttatcataagtaatcaatgtaaacgtatccaaataatttggtattcacaaagaaaaacttacacagtagagagccagaagaagaaatacttacttgtagacttgccattcatagggagctccatagctgcaacctttgctggttcgatgttcgaattttagcgcaacctgacagaaatgaacatgagtactgacgcaagtacgaatagtctcagttccaactacttcaatcattcaaggagatacactgacctctaatgcatttgcaccagaatttctgttaccatgagtaggagaggaaatacgccggccaacgtatacttgtccaaatcctccctttccaagcttcctctcaagcttatacgttggtgaatttccgatttgtacctggtccaagcacacaaccgcccaaaataaatatatggttatgataacatgatgtaaaatcctataaacatgtgaaaaaggagacaggtcagctattccatgcgtaataaaatgatacaaaatttcatcatcagaacagccattgcaacatttctgatcttttgtgagctaaacaggtttcaagcagtcaactctgagtgcaggtgacatgaggcaccttcattcttgcaacaaatcctgtataatgactaatcctgctttgatctaatggaaagctaccattatcctaaagaatgcctatacagtagcatctacaatatggctcaacatagtgcgcaataaaattaaggcactttagattctcccgttcctaggcagatcttttatctgcatgatggtagctaatcctaacagaccgatgctcaatcaaatctccgcttggaatttaacacaaacactcagcatgtgaattcaacaaatgttaggaataaaacaggaacagagaatacatgaaacagtaacaacactcagctaaccaattgaatttcgtatacatggcagaaatgaacataattaagcaaccgacaagatctacgttcagtaaaaacacacaccaaacaccagaaatggtatattcatggcacactaattataagtgccatcaaatgctagagattaactagatggagtctagaactcaagatgttagctatctcatcagttttctgcttgaaatgcacaataagcttctggtcaacatcacccggactgatgctatcctagatttacacaataagcattcttcattcacatttagtcaaaagttctaatttagttccacacaattctctacaaaatcagttctgtgcagctgctatttgtaatcaatacatctgctatcctccccttctcttgtcaccagttggatcagagttaattgaaagtaagctaagaatccagaacaactagtagttattttgccacaagcgtaaaactccaccatcccatcccgcgtgtacagtttgcatagatcaatcagttcatctacaccagcggcagcgtctattcaatcaatagaaccctaaaccaaaaaaacaaaacgccccctaaaaaaaaatcgacagccatatctaggtcacgcagcgggggagccaaggggggatagataatccgcgattaccgtctccgggagcggcgcggggctcccgtcgtcgccggcgccccccttgtcggacccttccatccccttccgctcctcctcccgctgcttcccctccggctgcctcgcgtccgctgggcccgtcggcggcggcggcggctgctgctgcttccgctttccacggcctcggcgcgctggcatgcttcagcggcgcacgcccatcggctcgccgggggatcgaggcgatcggccgcgctggggctagggcttggcctccgcgccggcggcgacgggtggggggtgagccggcggcggtgacgacgacgagacgggaggagggggagattgcgaggtagggcgcgtggtgaaaaaaatcctggtaccacagccgtgttgtgtagtaagtggggattacgccgccgactcgagcttacgtactgtgtagaatacgccttctctcgaacacatgcggatcataccacactggcgtgtagttgtaagtatgatggcttcagaagttcagattcgtcctatcaaaaaaggaaaaaaaataaaaagaagttcagattcgtttcaagaaagatcatatactactcgtcatgtttgggttagcttgtatccatgtggggattttgtttcttacatctcttgccactaaagattatactcatattccttcgagaaagattatattcctacttgagttcttttttcgaaggaccaaaaatcttttgtgactcatcattttaatctctagtatactgcatcattggtttcatattataacccttggccctgttcctttctccaacaaaagtcggataaaattttaaatactcgtgtcacatttttcaaaccgctaaatgatatgtttcatgcgaaatctttatatacgaaatttgctttaaaatatcatattaatctatttttcaagtttgtaataattaaaactcaattaactatacattaatatcaccttattttacgaaaaaaaacttaatcttcatcttcatgagaaaataacaccaccctagtactttgattattttcctattgaagcccttttatgttctaatattttttaaaaaaacaatttaacaacatctacaataccaaattaatttcattatatgtaacattaaatgtattttgataggatgtttgttttgtattgaaaacaatttgatcaaagttataaaagtttaactaacaggaagttaaagcgatttataatataaaccgaaggagtatgtactacagtggcgaattggatcgacttcaataaccaaggtatcatctacatttgggagaaaacaaaatttagtttactcgcatgctcaattgttgtgaaatatcgcgaaaagaaaaaatctttatgaactagagtcccgctccggtgcttttctacttagagtagaaattaatccgaaccgttgatcgtatttaatcatatggttgagatcgagttctactcccaccaaattttatgggagtagaaatgtggagggatatatttgtccaaaggtaataattcgcgtagggtattatcgtaatttgtttttatctaactcttcaccctctctctctatcctatcctaatcgatgccattctcctccatccccgcctccgtcggtgtccatctccttcgccgcctccgtcgccggtccttctccctctccacctccgtcgcctccagcgccatcggcatctccttcccctccagcaccgtcgcctcccccggcctcaccgccttctccgccccctccatcgccgtccgtatcccccgccgtcgccgccttgtccgcctcctctttcaccgtccgtctcctccgcccgcgtcgccttcttcggccccctctgtcgccgtccgcctcccccgccctcgccgcctcctttgacgccattctgggcctcccgttcacctctatcgtcgcctccgtcgcccgtccatctccctcgccgcgttcatcgcctccagcgccctcgcggccctctgccccatccaccttctctacctccagcgacctgtggcggctgcggcgtacgtgctcggcgcctcggcaagggcggcggatccacgatgtgctgcttgtatggcagtccggcggaggagaggctgatgatgcaacgtcgccctcatcttgatgttgccgttgattgttcatcccatctcttcggctgctactggttcgagaacaggtaacgtcctgtcccattttctcccatcacttcctgataaatgatacagtaatgttgtaggatcactattagatcctccaaaagtagcagcctgacgcgagcaaaattcagttttaacaccaagtagtacttcataagcacaacctgctagatttctactgaggttgttgtcccaactatacaaatttgaaatgtgtctgacaaatgttatcaaatcaccacatagataattcttctgtgaccattagcgagagatgatttccgcttgtgcttcattctattttagttgatgagcagccgacaacggtttaaatggttatgattttgcttcagtaaaattctagtactaattctggagttctctatacttcgtaaattacacacagatcgatttttatttgattcgttgcttgtagaaatagttccactccctgtgctacatcacataagtcaaatttcagaagatactactagtttatagtggttacggccagcatggaacagttaaggtccataattttgtaaggctctgcagatcattttattttggaggctttccaatgtgtataattttcttttcattttttcagccatgcagtggagctccaatggtgagtttgcctttcattgtcttgttggagattgcacgttggaattactggcaaaagtcatgcttcttgcattcaagagttgtatcctgttctgcgagtatgatctagcagcatggtatggggctgatattttataaaggacaacgaccaatgtctgaattgatatatatatatatatatatatatatattgtactcgccataatttaatgtctatcacagaagcagtaatatactcccttgcgatatatcccacgtggttttctttggtagacagtgttcgtgttttaaaacaaatgaataggcaaagatgatatatatttgcacttgggagttgccgtggatggttactgcaagatgctttaattttgtccatgtcgcgaggggtcaatcccagtaccacaccacttctttttttcaatcatctaacataactgcaactatcttttttatcttcacctaacagaaattaatctgcaatcaccacggttaatatatcctgaaacttggcttgatagagctttattttttgctaattacacccctgacctccacatttacatgcatatcacttaagaagtatataatcatctgaacaaagtctctgatacaacaaaataaaaggctgaagaaacgtcagtggtccatccccaaccttcaattgtgttgatgcttcttacatgctccctctcatagctccggcttgaggattacttcacaagttgcaaacatgttcaggaaagtgaacaattctgtgatacaagtgaatctgacagtcgcggctgctttaaaatctcatctcataatgaaaatattctagcagttaaagaatatatatcatgatgatttatgagaatgcttgtggacatacatggacaaattagtaattaacactataagttagtaactatatggaactgctccctaaaaaaacaactcaggaactgagtttctaattcagaaatgttccctcagataaaaactcaggaactgtgtcaacgatcctaaaattgtgagtattttcttttcaaacaatacttttagatttttagaaatataccataacagaaattaacagtcaaaatagtattttatacatactcaagttcagagattcagttgaattgtattttattcaaataatattataatagctagcacattacatcttcagaattaatatatactccaatatattgcatccagcccgaatcaaaattcagcatccatccatatcaaagtcacatccgataaatcgaattggaacttgtatacaacgctatacatgcaatctagtagcaatagcattagcatgttcctcttcttgtgcggttcgtttcaaaaaagcaggttcctcttcttatcaacaacgaagaaatcaaattcgattgagagcaaacgcacaagtaccatgataatcgaaaataaatactagctgttagcttgttcagtgggaggaggagatcaacgcggatgtgaacgcggtcgtcagggccgaagaaatcggcatggccgtggtcgatagggaggagatcggtgcagtgcagatgcgcgtggtcgccagcaacggaggttggcacggccgtggtggctagacagggatcagcgacatcgacggcgggaataccaggggtggaggatggcaggataatcgaggtcaccgacggggagataaaacggcggcggcaggatgaacgccggctgatcgaaatgggcgccaccaccggaatcgagctgtgcaggaacggacggcggatggatgcggcgagacggtcggagcaatacgagacttaaaagaaaaggaaaacacaaatacccaaattacccttaagcacataattagtaagtactaatatacccttccaaacagatggttcagatcatttctactggtagtagaatactacgagtagaaagcaccgtagtcaagctcaatgaactaacgttcaaagttataagactgtccgggtaaccaacaaaaacagtttggggaacctgactgcccatgctcctccccttcgtgcaaataccggctcactctttgaaggatctttggttttacagtacagtacagttttaccataagtaatgcaaatgctactaagatagttagctgtagctacctgtggaactccaaggtagttcaggtgagggctccaataaaaatcatcaaataagtgagaactcatgaaaatcatatttaaaagtcttataaatttatgaaaaaaaatttaaagataaatataccaaatcttaagtccaaactcaactttatttgagaaaaacaaaaaagacaaatttcagatgaatagtgttatattactattcgagtaaaatgcgttgcaggtactacaacttgcaaggtgggtacaatttagtcacccatcttgtaatttgctcaaataaatcactcaacttgtttggaggtgcaaatataataaaaaacgtgtcacgcgtattatttttgccaaggtggacgatacgatggcagacgtgacgatgagttggcgaaagtaatacagttttgtagaaaaacccttctactatattactctttgctaatttaattggtctatttagatatgttatgcccgtgtgctaagccatgatcgtaggtttttttgttggcgtgcgcacgggataggacggcgccagatctagcgagtcgcggtgatagcctgcgtggctgcgtatgaatccatcatcggcgaaattatcaacgctagccacgagcgctcctatttaatccatgaatatgatgtcaaattaccacattgaagagtgcatataaaaattggttttagcacaaggaacaaaccgctttatttcccaatataaagacaaacatatatccttgtacatcaggcaagattcagtactggcagcaaatcacgtattgaagatttggagtatcaaacaaacatatgtactcaaacgaaaaattgaaacaatataagggctaatttgcatctttgttccttgcatacaaggtgaacctgtcatgctgacgtggcgtccaccttggtacaaataatattgcacctctaaacaagttgagtgactttttttttagataatggaagttgagtgacttatttgagcaaattacaagatgggtgactaaattgcacacaccttgcaagttgtggtacctgcaacgcattttactcttactattcactcaaaagttatctcttttttccctctataatagagttgagtctaaacttaaaatttagtgagaatgtatttcatacttgcatctatctacagtattcttctcatgaatttatacactttttaggtctagtctcatgggttttcacttatctaatagtcttcattggatatgtcgccgttctgattagctcacatcaacttctcctttctgcaaagctaaaaaaaaagggacctatcaagtcttgattataactttgtacagcaacctgtggcggtgcgtacgatgatcacatcatcgcgattcactcatctttttccgtatagccatattccttggatgttgtcacgatagcacgagtgacaaaacaaactcggcaaaaaaaaaaaaagttcccattttagttcaccatcgatttcgaccgtggattttcttcgtgggtcatgacacacatcataaaaaaagaaaagaaaaagaaaaagatgaggtcgtatgcgtaatgcgttcactaatcactcgtcgaaatcaatggctagtggtaacaggctaacagatagtgccggccgctatctgaaaagattatannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 47698 - DNA, 1442 bp, Oryza sativa
ttcttgctcaaccagagagtttatcctatcgagaacctagaatcaaagttaatagaatagaattgttagcaaaagaaaaataaggtgacaaaaggtaaaattcataagggtttgtaaacgtacagtagggttacaaaaatttgcgttgtccaaaacaatccattcaccacattcaatagccctgatcaagtctccagcaacccattcaaatttaactggttggtgtacagcttcactctgctgcaagtaatagatagacctcagtgttttactcaaatcatctttattgaaggatacaggcaagtcaaacatttccatatcacacttcatatcctcaactatgtccctgaccaagctcaatgatggcaacgatgaattcttgctcatttcaacaagggttgaaatgcaaattgaagagaacttctttgcaattacaaattcaaaccattttacaaacaatgtcttcctgtctgcaaccaaactcttccactgtatatattgactcaggctgaagtattcatcaatataacgctcaacttgagatatgaccactttatagtgcctaaaaaagttatactgctcaaagcatcccaacaattctgacacatcagttgccgaagatagattaacttcgttcaatgtattgccagataactgagcaagcaagcggattaatgaggttttcccagatgaatgttgtccaacaagaatgcacaaccaaccttgattgatacagtgcatggcagcttcaaggctatggagggtaccagggagaatgttgagttggctattctgaactttgcaagagtggacgcgatttcttctaatagatgcacttccaaccaccaaacactgtggattaacataaagcatttttatttcatgaatgctatactttgtctgaaagacttcttcaaaaagcttgacaacttcttcgcgatcagctacagttcgcattcgttgaaggtagactgtatttagaaagcagtcaaccattgaggtttctggatatcctcttgctgtctcacaagcaccaactatcatctcacaagacctaataatatcacgtagattaaattcccaaggagatccttcttggccgcacttcttatgtatcatggtatccatgtagagtctattgttaaaggaaatcaacttttttagaatgtcatccttgattgatggatattgtgatttacagatgaatgagtagtcgctttctgataactcatcaacataaacctttgtgaagcggttcaagaaggacttcggaaggcctttccgcccaccaccttgcgacgaaggattctgacatgcaaagacacgaaaggacggtggacatttgtacgtctgaccaagctcaggaataaagacctcagcacggtggtccaaaatggcattcaaaccctctaagacagattggggagcgagattgagctcat

SEQ ID NO: 47699 - DNA, 30967 bp, Oryza sativa
tagaagaaaggacaggcaagtccttctcaattcagtagcctcagttttagaaacattcattcccaatgtgagcccgtctagtaaaacaaggaacagaccatgtattaaagcttgttgtggaccaagatttcgctctgtcacattgataaatgaaatccaggacaacaggtctcgtattgtgagcattcttccagtgtgcaactggttgaaccacatccagaaattaacaatacaatctccaaagcaagaaacctcagcatttgtgaacctctctatagctatgctcttaagttcatcaacattagtgacagcaggaacccacacttctgtgaaacgatttcttaaagctggagaaagctctttctttccatagtcaccacctggattcatcgtcgcaaggataaagaagtttggatgtgctactactttctctagcacagaaccacccttctcagccagtgactacaacagtaaaagtaggagtaaacattaaaatgaaactgaagttcaaaaaaaagttgatattttaacacagccttatgaatcaaagaatttcacgagtggatagacaagtgcatgataagatagacaaaggtacagtcctcacaaacaataacaatcaatgtagaggactagaagtaatcttccattgcttaatggtgggaccaagcaacaactaagcaaaactataaatggcttgtatgactcacgacaaaataggtataagatgcagtatctgacaagcatcttgtttagcaaggacaaaaaagaacttcaatgaagtatggtgtgtaagaaatatgtatcctgaatatttaaactgtgatggttggttcctcttaattaggaggtaaagatgcatttggtgatgtggtaggcttctgaaggtttacataatctttcatgttttaattaagtattaacaaataggaaacatcttacattgacctgcaacagaaatattttaccagaagttctaaggacttcctatacgtgggttccaaagcataccacaaactggcacataaatctataacatggattaaaaccgaacaattcagcaatgcacagattacctgcaggtagattgtactatgtccctaatagttatgttaaataggattgtttctattttatatagtagttctgtaaagtacacaactttattacttatgcccctaatgtgcaatttgatcaattaaatccttcaatctgcaagcctagttccttttctttaacataattatctcgaatgtagtgtgcactgctactttactaaaggataaagcatagagttcaagcagaaaatagcaacccgaaaaagacagcataccaattttctttcaggttctagaacactgttcagtcgttcaagtacgctatcgtcagctaaagaaatttcatcaattaggaaaagatcaccattcttcattgcttgcacaagcgatccatcctgccaaaggaaaattgcctgccacctcttgtgaagttgcatcaaatccaacttaatttgctccatggcggcaaaatcatgaggtggcacttgtgggaacagttccttctcctttatgtatctatcaagtatttcatcgatgtgattcaccacactaacagctccagatatatcagcaggaaatgactgcacatcatggaaaactagttatacatcaaatgtactatatataatctctactgtttaaaaaaatatgatctgggtgatctgttctatgcggaatcattctagatcttatatagacgaatttacatagacgtgtgtgttgtaggattttttttgtaattgcatttgcacgtgtacatgtagttttcagtcaatagtatgattatatgcatgctttttttcatattagagtatagttatattatattttgagacttatctcaatacacagggatgaaatatcatatgccagcaccaaaggaacataccatatctcctgcaacatgaatgaatattttcagctgcttcatttttgtaatcagatgtttgaactccatcgctatttttgacctatcacgtataggacagaatccctgccaataacagtcaaaacatgatgccagtgaaaataatgctaaagcgtgaaacaatgggatataacaaaacagaatcccagcaatgatttcgagataacaacccaccccaatgaaatctgaagtctcggtatattgatggcaatttaaaatgtgtagcttcactccaaggacagcacttaggacctggcaaacagttgttttcccacctccagtttcaccaacaaggaggacaggttcacgtgacctgtaacaacgctcaatgaggaagtatagcctccacatactttccgtccaagtgatgctgcaagcatgtacaaatacatattgcatcagatgaagagaagttaaaaggtgtagtatgttatatgttaaagtataaaaagaactcactttccaaaggtttcttgtactctcagtcttatagattcacgtgacaagttattgtcacagctgacttcctgcagtcacaacgaacctctcaatgatacgacagactaaaaggtcttgttgaagttaaatgtataaggattcaaaagcattgtgaaatatttcatgcaagaagtaatatatttgaaagagactttctgtagtttccaggcgaatgcacatgcaagagtaatcaaagagaaaaacttaggctccctatagtttgtgtttcaactcgttgttatgttttcacagtaaatttctacagtagcttaattaataggcacaacacactgtaatgcatcaaccacaaactcaatgttcaaacggtgctcccatgaggtctggctgctttgacgtcctgcaccacaagctcaccctttgggtatcgttcccaacagttagccaattcgctggaaagaggcaagcagtgaatggaagcatcaagctcccctaggcagccttggctgccaccaaaagatgaacaagctcacccttggtcagatgggaatgtcaactaagtgaaatagcaaacatacaacaaggtgttccagtagcatcacagtaaccgctttcaatgtatgatgaactaaatcaattccaccaggagtaaattcaatatcttgctgtgggctaatggtccagtggcttattttttaaaaaaaaaaaagagcaaaagtttttatcacagaggggtgcagttagcaacatcttctatatatttacaattttgaacccactaagtgcataaaggtattttttgaaattgtttagttagaatgccctagctatatagtgccagcatcacacatcataatatcacatcagcacagcaaagtgtaatttatgaataagcataagcattttttaaacactaatcgtcatcttccttaattagattaggcaaggaggttaacgaaacattagcaatatatcataaagaatgaaatggtaccatgttgtagagattggagatactgagtttaacatgaagatgtcgttccaatacttcttgaacaacagctttctcagtgtcatcccttaatctctctgcgagaagtaaatagccatctttagctaggtcttcatatgacttcccctcaaaaagtctgtaccgatttgcccagcgaaataaatcccgtggtgtaatgaaaccatgtttgccagcaaagactctgctgttttgtcgatgtgtttgtaaatctttcataacttgaaccattcgtgtggcataactgcaggcaattgaacatctctgctccaaaattgtgattagctcatcttctgggatttcatcaacatgcacttcaataaaacggttgcggaacgcccgagacaatattttacgtcccccatagagcacaggtggattttgagtagcaaagagcataaaattagggtgagcaggaatggtctcctgaagctctggcacaaagagctccctgttgtcatccaacagccgatttaaagcttccaagacatcagacggtgcaagatttagttcatccaacacaatccagtgtccctcacgtacagccttcaccaaagcaccctcctgaaattgaagcttcccatggctgtcagtaacatatgtaccaagatattcttgaagatcagtatgctcgtgattgttgatacggacaaattcatgaccagtttgtgctgcaagaaacctgacaaggctagttttgccacttgatgtgggaccttgcaggagaacagggtattttttaatgtaaacagcacaggcaaggttgacaatgtgctcagtgacactgttagttaacacatagctacgcaaaaagtcgtcagattcagaaccatttagtagcttaggcttttcaacgaagtagtcagcaaatgaaattctaggtggcactcttccatctaacaaaagagatactatcaagttgttgatgatttttgcacttggggcatccagcattgtaagaaagaacatacagaagccatcataaagagctttcttgaagccaaattttctctctgcgtttttaatataacctaatgagcgagaaagagacctcaaactaaattggggcttctgattagctccatcctgcagcttctcctcagactcctttttcgctgctttatagaatcgaacaatgctatctgcaactcctttagcagcatgcaggccatccagatatttactgacaaaaagacggagatcatcatcatcaataagatcatctacaaagaattcagtaaatcggctcctaaaggtgtatggcagctctcttttcccagcatcagttgctggattcatgcatgcaaacatccggaaacaaggatggcgctcaatatagtccacatcacccctttcagccaggcacaatgttccactctctccatccagtacagcgccaattctctgaagagtctccggaggtgccaggttaacctcatcaagcaaaatccaatggccatttcttaaagcagatacaaaagcaccctccacaaattgaaatgacatgccaatttctgaaccaatttgactacaagcggcatttagcctggatgaaaaggagtcccagtcagaaataacttgggcaggcaagggcctttttctcttcgaaccactgttagacctagaactcccatcaattagcttctgagctttctcaacacatttttccaaagcacgtaataacttcttccattttttctccattacatacacatcacaatggcgaagaatagcttcattgtcctgaaaaggttaaaagtttggtaaataagaagaagatcaagtcttcaggcttctacagcttatttggtgcagttaaatcacccctgtgccagctgaagtctacaaaagtagactataatacctgctacatttaatttctagggcttatctaatactccctccgattcatattataagactttctagcattgtccacattcatatagatgttaatgaatctagccacatatatatgtctagattcattaacatctatatgaatatgggtaatgctagaaagtcttataatatgaaacggaggaagtacgtaatagagtattgaacttctaatctactggagttacccaataaactagctttcaagctaacagtaaataaggtcaagcagacacacctttccagaaaaacttcgacaaaaaagatctttgaactctatataaagaggaaagcatattgatcgagcatctgcaggcttaaatccaccgagaagatcagaaatatcgctttgctggctcaagttctgaaaacaccaataaaaaatattagcacattataaatgtcaaagattgtgagagaatgtgtaacctgcaatatcaccactgaacatttttgacattctacattggtcacaccaaaagtgggaactcctaccatgttgcaacaaaaaacaaaaggaaaaaaaaggttccttgacatttattctagcaggcatcatgttgcaaatgacctacccatccttagacctgctctctgtcaatgcaccatgtacctgattctacaaggtagtgattgcaagggctcaactactagataatggagtaaaggaatttaggagattatggcatttatgtaatattattttgtttgcagtggcatagaggaaacaaccaagtgaggatagaaaaactcaattaataaatggtttcgcggtggtaaatatcttgagtaggttatgtaactacttgtccgtaccaccacagtaagcggctgtttaagccaggaagcaagattctgcacaagagtagtcttcccagtgccagtttcaccaacgagaagaacaggctcattgaactttattgagcaggctaccctctcaagaacttctaatgcacgccgaatatcagcaaaaggccctttctgaataagcgcctgcatatttgaagcacagtatcagtaaagtagccccaaaagaagttctgcaaatatgcaccagataaagatcggctaattactggtttgtcgctgcactgcagagtaactctaccaacttgcaagtcagtatgccgagcctgtgtattatgaatcattagttctacaaggagacaaataaacaaggtgttgtatataacaataataaacacatacctggataatgggcttgtcagaaggacttatggtttctgctccatgggggacacaaaatagtttagcaatttctcttgctacatatagccttttatccagagatgacaaagaggaagcaaaaatatcaacagcctgaattgaaaaagaaaaagagaaggagaaaaaggtgcctgagagcctggaaaaccaatggctgaatacaacttcaaggaagttacttatcaatgttcatgaacaataaaccatcatttcatctaggaaaatagaacgacaatattaataatcatgtctggaaaatagtttgttttaatacaggcccttacatttgtgacaataatgacagtacacaacttagtcactgttctgaaaaggtggaccctgggcagactaggtgccacaccctgccagcgacctagctctagaatattaaaatagtcctctaatgttatgtaaaattattgtgaactttaaaccctttttggctcccaggaattaacaaccatacatgggctcagaaatcaaaccagaggatcactcttttagtactccctccgtttcaggttataagactttctagcattgcccacattcatatagatgttaatgatctagaaacacatatatgtctagattcattaacatatatatgaatgtggacaatgctagaaagtcttataatatgaaacggaggaagtatgttaggaaaggtccttaaatctaaatttgaaaatgaagagcaataacaaaatagttcacttccataatgctatgttcctaaaatcagaataatactaatattgctattcgtcaaagcagtcttttgatggcatcaaggcacaacttttgagttttgaccataagtttttttttttacaacatagtgatatatctctggagagatgataccatttaggtttttatgactagaccaacccggatacagagtttaaaatgattgactgcagactttccatgatgacaagttgttgtgatcaagggaatatcaaactatatcaaaaggaagagagagcaaaaacctcaaaataaattaatttgcaacaactagatgacaatcctaggcccttgaagttgagatcaactccacgtattctcttgcaccatttgagcaggtccctggtaaataaaagttgtgaaggccgttcttatgaatggacaaataaagaatatatttcaaggtatatgcaccttaaggaaaatctttgcacgagacattcagatgaacctccagctaagttgagcccaccaaactggtaagataccagcaaattggccttttcaaaggtatctacaatacatataactggttattatacaatcacaacatagcaaataaagtaatagaagaagattgcatctaccaatgagtttagcggagatagactccaagcttggatagcacccatgaattatatcgatcatgtcttttcggttaggttcacccaccataacttttctccacagagcactaaaggttagtcttcctggttgaagaaaggacaaaaattgattgcaaattagcacagggcattaatttggtccttattgtgagctcgtggaaatgtagaaatgttattatggactgaaacataatatgcattagttattctgaagcaaaaggtgtaaatcaatagttctatgcaattttcaagtgcataactgcaagtcataactttatggaactattggacaaaccttccagggcatgtgaaacatcattctttgaggtggtgactgtagcaaataaacgaaaattctcagcaacttcaactgcctgcattagacattcaaactagtaaagacctccaggtagttggcatttatgaaaattattgcaaattatttctgaggtttgaagatataaagagaacctagagaaatagttcacctttcaaattataattatcttaaacaaaataaataaataaataaataaataggatattttcacctctgcatgaccaaccgaaaaagaacttgaaccttccaataaaggtaataagattgactgcacatcactgggtgctttgtcaatgtcttcaaacacaatccagaaacctttgataacagcctgctcatcacagtatggtcagagaaatatatgaaaataaaatccaatagtaggattatactgtgaatagcagtccctacagcacagacctgagtaagagaaccaggagaccacttgaattcaccaggtttttctgtgcaaacgtaacttcctattaaggtcctgccatccatttgttcatccatgtggatgaagagcactgcaaataaaaacatgcacagaagattagcagcattattggggatagcgtgattagtaaagaaggcctagaggtatccaagattttgaacaaagtagaaaacataaaaacatcgtcattgaatcatcaatgccaaactgagctattcaataataaaacaagaatgactctgacattatcatagaaaacttgtaagttgttaaaaccagattgcgaatgcaactttctcagatcatatgcacaaacaggcccaatgaatcttgcaactaattttacatttactcaactccctcatttatgctctgaagaaatgataagatcagagttcaaccaaccttttattctgttgtgggaatattccaaatgtgtcacattataattggattacatactcttttttattcatctaacggcaatttttttaacttgcataaaatacttctagcagagtccataaacatatacctcaatttatattggttataaaatagaaagcatatacctcgatttccaccaatctgtgcaagcttgttaattagtgctgtttttccagcaccaacaggaccatagagaagtatgggccacttctggttaactgccattaaagctacctcgtaactctttctcaaagtagcagtgagcacaaatggactaacagagggaacaattgaaaattagtgtaagcaagatgagtgcagcgagaaaaacagaaaaatagggaaataaaggaatttgttcacaccatatattacttccactgccatgctgccgtcccacagaaaactcatgccaatctggcaaagaatcagccaaacaagtgagtccatctgcatcagttttacaatcaacttcttcggcttgaagatacaaagaggctttctccaaggaagtatctgtgcaaaactccttccatctaaaagcataaccagctattataaacttatgttgatcaacatccaggggaaacaatacaagaaaagaagcattagaaggaacctcaagaaacatgtaaatgcttcgtctgctcctagaccaaaactttcaacagcctcatcacttgctttcagaaccaccatgagtatttgtatagcgcaccatcttaaatccaacacaacactataaagtgaatcgtcaactaaactgtagtcagcagtactatatacaaggtctaaaaagcaagaccagtcccattgttcacaaaatactcttggctccaattctagaaaccgatatgatacttgggtggcatcaagcaacaaatgaagtccctgaaaacaaatgaaattaactgtcaacagtcaaattattaagatcaactgatgacccagtaaaagttggaaagttggaaattatgggatcctatgaaaaacagcagatcaacacataagcaagaggatatgtgtcaatggaaagtttacacaaaataaaaccgtagacaatccagaagccccatcgacataaaactcccaaaccaatgaagaatatgcagatatatgtactttatcatgtcgcaaatactcttcctaagaaaaatagcatgtaccaataataatttctaagttttaagtacttcaccaacgccaagtgcaagattagcaggagtgcttgccagtattaaggtgagcaagttgcgatagtggaatgaattatgatgtgcaagcattggtcagataaacaggataaaaaaaacaaggtttcaagaaaagaaaagaaaagtaaccgttgaagatgccgcgggggtgtgaagagaaagaactctcataacattgtgccaatgaattttctcaaaaagaaaagatttgaaacgtatgggtatatcagcaatgattaacctatttgtaaagatcaagaacatactaagttatggtatcaaggggaaaaagttcaataggtggattacactatttaaagaaaaataatacgcctcatcttttttgtgtgtacatcagtgagtgggttggaatacaccccagggactattgcatttcaaacaagctgtagactagacataagttttgcaacaacttaggggataaggcaaagacatttgcttaacacatgaaaacgtacaaccttgattgggatttgtgacggaacacctccagaaagaaacctttggaatggtggtggagcaaacttaaagtagtttagtaaatgcctgccacaaataacaacagacagttgttagatcactgttatatatatggcatatttccacttgcatgctgtagttgcatagagaatcgtaagtgaaatggtcaagagatgaaagaaatagtaataattaggtacagtttgatatagaatttatctaaactccaaaccaaatgtgcactctaattcattatttgtgagcacgtgtaaaaaaaatgctactcgacaaaacagacaaaccagtacgtacaggtttttgtttcaattctttgtcactgatcctggtagtggctttttaaattactctttcagtacatgacatactgaagcataaaatgagtaagctctaaacatagatcagctgctagcttaagatactgagggattttttaagtccaaacacatgttagcttcttactgatccataaaaattgcctgttgcctgtttgaggattccagctcaccagaattgcgaacacaggagagcaaacttaaccctccacaggaggcaaggctttccttcagtgcagtcacttgacaaattagacttttaacacaaacagacctgttgttcattatgtccccagtatgcatcgtctttatactatagattgagtacattagctttaccttttgacaaatgggctttcgagtggttatacatcaccttagaaaatggaataggcacatagctctccactcagctcgttatttacaagtgcacaacttttagtggttcgtgatgcctgtttgttatgggaacatatcctatgcattcaagcttcccgtgcacaccaactagccaatgtcacaaaaaattctacaaaaaattggacatttactcctaatagtattacacatatctgcaaagctcatattcaaattcattatgttttagccgtaacaaaaaagtgaaaaaaactgacagttttaagggtccatgtaggtgtaatactactggaagtatgtgtacaattttttctataattttctgtgacatttgctagttggtgtccacggagtgtgcacgggaagcttgtgtgcataggatatattcccatttgttacacgtgaaattgtgatcgggggaaatatggtgtttgactgtgttgaaccagaccatacatcccatacgtggcagtgttcatcaaagataacaaagagaaagagacgtgcaatgctgccccaacaatcaaacaagcttaatcgacatagccccaaacttagatgaactcaaattcaactggattttgtcagttgtcacaaatattggaactacataaaatccatttaaattgactacagagcatgaaggctcatcgatcatcatagcctatcaaggcttggtgcctagaagaaggggcatttgttccgcaccagattgatgaatgacgagtccaattctgtactaaatgcagctgcaaacactgcccggaacttaaattccacctaaccatggcacgaacagcatacagtagggggggaagcggccgtcatttttaccggagcaggtagggggcgaggtcgagggcccgggcgagcgcgaggcacgcgatctcgtgcagccgcaggcccctgcccctggacaggtagaactccacgacccggaggtccccttcccccgcctcctccccctcgcgggccgcggggtcgtccgagcgcagggcggctgcccccgcggcgcggagcagcccgacggcgcggtcgaggagggccggggcgagcgggaggaagcagccgacgacggggacggtgtaccgcgggtggagcagcggctcggcgagcgccgcggcgacgtcatcgcgggagggccctccaccgccggcggtggaggcgagcgcgaggacgcgggggtccgcgcgaagggccgggcaccgcgcgaggaggcgcgcggcggccgcggcggcggagaagctgccgtcgagcgacatggatggcggagccgcggggagaggggaacggttgggttttgttgatgggagtgtatatatggtgggaaggcggcgggtttagggttttagggggcggcggcgcggccggtcggggtgttgggtcgggctcactgcgtgggttcgtcgtttcatcagcaaccgacatggttgatcaaaatcaatccgtgcatttctaagattggacggttttagatcgtgtcgtgaaggaaaaagttctagtatattgcttttggaaattagatggacgatgtagattttataatttgaattgtccttgataaaatagttaacagataatcgtaattgaaatttacaaatccaatctaaatcggcaatacaaaatagaaagttttaagtatatctgaacttattatcatgctagttgttagaacatcagtaaggggacagagataggaatagggcaactagggcggtagccctactcctggtcctaaatattcattgaaatttttttttagaacttcaaaaactagaagataaaggcaaaattatataaattcaactgattgagctttaggtttggaaaattttggctccaccactggataagatgtatcgagtaaaatataccgttcgctttaagggcatagtgtagagaaaaatgagacttaaagacaacgacaactacatcattttcctattcttttgctcatatcatcccatgttattccccgttagctcttagcccctactctcttctctcccatgcgtcagatccatcgtgagtcggtgaaccaatatcgatacattgagtcattgaaggagtgctgacacggtgacacagaatccatccaagttagaacaatgggagaaaataacataaaacactgaagtgaggtaagacgcggtctacaaggagaagcagcaatgtgaaggtattttttgagaggagagactcttaatatttgtgttaggttatctatttgaatttttggattggtgtgaatggaatttgagctttttatgagtcatattaggctacctttcctccttctcctatccatatcctaatcactattagtcacataaattaaggcgttacctcgcttattgtttaattacccctataaggcaacaaagggggtgtttttaatcatgttactttgccatcaatagtgagcgtcctcatgccaccttaatataacttgtgtagcttcatctacatctcaccgccctttcaataaagataatctagtcactcgatgaaagcacgagaggaacatattaatatgcaaaagatgatacatacctcgtcaatcttgagcttactatagcctaaaaaaacccttatggtacttttctatatctatgggtcatgtgtgtcttcaccacgttaaacaagaagccaagaaagcttattcataacatatagcgaccaaattccaaggccaataaattctctataatcctttcctcccaaacaatttacacaaatccacatccctcatgtaattcggggtactctcgtcgacaattacaaatcagtacattttctcaccgatccactaaggacaaacctctatgataagtttcaaactaaagtaattccttcctaatgtacctgtcggtgacatgggaccgggagtatcatgactagaggcttgaggcagacacaatcgcccacgtggcctggcaccctcggggggcgtcgggcccgagggtgatgtgttcgccctcctctttgtctccccgagggggtcggaccgctcccgcctcggccccgagggccgaggcgccccgaccccttgtgggttttgcgccgcgtgtatgggttaggtgagcgcagcggggctcacctaaccgcatttattgcggtttgggtgagcacgtcacgccacacgtaatgcagtacagcgcgctcgtttatccggtctgtgactggtcacagaccggtcagattgcgggttaggtggcgacgggcggtctgacgcacgcctcgccccatcccgtcaggatgagagcctccaagcactcgtccctagccggagccggcgtgttagctcctgggggtggcacgttggtcctggtcagatatatgccaggctttatcccaacctttataagcaagacgtttaatgaagaagggcgaacatgcagattgctaaactgacacgtggtggacaaaggtgaccggtctgtgactggtctgacactggttatgtcgccagaagacaaccgtgttcccacgttgcacctgcttccggcggagtggaggtaggtatgggccgtcccatcagaagggtcactcgggcagcagccgttgcaaatctccgcccatttatgaagagatgacagggtgatccccgaggtcagacgaacgaggacgcgtggccacactcaaaaacaggcagtgtttcagcttccaagagaaggcaagccaagttttactatagataggatgggctcccacccaaaaagagagagagggagaagtggtgcatgtggtatccccttgagatataaaaggaggaccttgcccacttaagagagggggctgaaaggggggatgatctggagagggtttttagaataagagctatctggctctccagctctttgtagcttcttcatacacagatccaccagaacacaggagtagggtattacgcttctcagcggcccgaacctgtatacatcgcccgtgtcttgtgctttttccattctcgcgaaccttccacacacagactaggagcttagaatctcacccagggcccccggccgaaccggcaaaggggggcctgcgcggtctcccggtgaggagccccacgctccgtcatctggtgcaccaggtagggggttctgcgtgtgttcttctaagctctcgcactctttcgtgtgcgccaagcttttcctgttcagcccaatggctgaacaagcaaaggcgcacaacctctctccgagtgttagcggtgacgacggggagccaaacccacgccgtcgagctcgtactccaccgccccctccacgccaaagtcctaggcgggaggaggcgctcgagagggtagaaggatctgcgacttcgacatccacgggtgatggagaaggacggcgagacggggagcgtcgcctcctcgtctacggcgatggcagcacgccccagggcgcactccaggctgcgggcgcgctcctgcgtcatccgcccgtcgtccccgatccagagtctccagctcagcgttggctggacgacgtggccaacttggtcatgacggcgcagcagcgcctaggtgccggtgggcggtcctccgccaccaaggcctctggcgctgctaccaccggctccgtgtcgtcaagacggagggcgcggcgagcggcggccgctgttcgctattcggccgccactccttcgtcagcgacaccgacccgggaagatttgcgcggggggccggatgctcgtattagtatcgagcgccggcgtaaccgccgacgtgctgcccacgcaacggagggcgcctcctcgtccggagtgtcacctcaacacggacgcggggatcagccctccgtgcccctggttggtggtgtcggctgtaaagcctttgtggcgagccttcggaacgtccgttggcccccaaggttccggcccaccatcgccgaaaaatatgacgggagcgtcaaccccgccgagtttctccaggtctacacgaccgggatcgaggccgccgggggtgacgacagggtcatggtgaatttctttcccatggccctgaagggacaggcacggggttggctaatgaacttgccacccgcgtccgttcactcttggaaggatctgtgccaacagttcaccatgaactttcaagtcacatatccgcgccctggtgaagaagcggacttacatgcagtccagcgaagggatgatgagtcacttcgctcatacattcagcggttctgtcaagtccgcaacaccataccatgcatccctgcacacgcggtgatctacgcgttcagggggggtgtgcggcacaaccgcatgctcgaaaagatcgcctccaaagagccccagactaccgtggagctttttcagctcgcggaccgagtggctcgcaaggaggaggcctggacttggaacccctccggttccggtgtggcagcttcggccgcccccgggtccgccgctcggtcagggcggcgggacaggaggaggaagaagaggtcggcccattccgacgacgagggtcatgtcctcgccgtcgaaggcgtttcgctggccacccgaaaggggaggcctgcgagcgacaaaaagaaggaagccgacgctccttgacctcggctacttggaagagcgaaggtggcgcgcggcccttcgagccgcgcgctaccagcagagcctgcggcgctaccatcagcgccacgtccgggcccgatcactctgcgtcgacgacctcgtcctacgccgtgtccaaacgcgtgctggactgagcaaactctcaccaatgtgggagggtccgtatcgagtgatcggcgtcccccggccgggctccgttcggctggccacgggtgacggcacagagctgcctaacccatggaacatcgaacaccttcgtcgcttctacccctagtgggggtcgggtgtcaggtcttgggctcgggccaaccccgcacccccccgggggtgcagggttggccgggggcttatcttttttctcttccgtatttcaataaaagcattttcgatttcctaaaggctgtgtctgtgcttttgtttccttttgaagaatcttgacttgaaataggtcactcgtgctcaatcctaccctcgggggctcgggtcggctaaaatcgccaaaaggggcccagaaccgagccgtgccccgggacgtggtgaactccgggggggaatcggcaaaaacccacaatcgggtcacccataaccctcggtcaccacgctcccggcctgaccagtctcgacatgtggatctccccaggcactagcctttacccgcgccgtttgaggctgggacctgggcacgagcccttgttcaagccaagacacagaaggaccgtggcacagaccatcctcgtctcatacacagaacaaatgaagttgacacaaaaatttcctctttatttgattgcagattaaatcagcctataacaagaagggggcccgaaggcctcgaaagaagaaggaaaagctattaagattggcggaggcctgggggctcactccgacgcgcctgggtagccggcctcgccgtcgctgttgtccgcaacgtcgtcaccgcactcctcgtcggagttgaaggcaaacgcgagccgagggaccgctcattattgtcggtcggttttcccttgctgatgcgcgcgatttgcgaccgccgggattctgcccgaagagagagagagcagggaggagaggcccccgagccgaacggcggcccaaggcccccgacggccggagctggccctccgcctgcttgtccgacggtgccaggcgcccccgacccccaggatggccccgaggccactgcgggaaggccgcgcctgtcgccctctgaccccgaggtcgtcggcacagaagccgagtgcgccccgcgtggcctctcggatggagagcgccctggagatgtggcccctgacgaagaagatcggccccgccgaaaggtgcagcggcccgtctacttcgttagcgaggccctccgggacgctgagacccgataccttcaggcccagaagatgctttacgctatcctgataacttcgaggaagttgcgccattatttccaggcgcatcgggtcacggtggttacgtcttatcctctcggccaaatcttgtataaccgagagggtactggacgggtggtgaaatgggcaatcgaactctctgaattcgatttgcgctttgaaccaagccacgcgatcaagagccaggccctcgccgactttgtggtggagtggaccccagctcccgagctcgtctccgcccccgaggccagctcgagcccatcgcagctgcctcacaccgccctctgggtgatgtagttcgacggcacctgtaggaaccggccccacctgtcaccaggccttagaagtggcgttacgcccgaccgcttccctcggggagggcgatcgccctggcataacgccgggggctactgtcggtgacatgggaccgggagtatcatgactagaggcttgaggcagacacaatcgcccacgtggcctggcaccctcggggggcgtcgggcccgagggtgatgtgttcgccctcctctttgtctccccgagggggtcggaccgctcccgcctcggccccgagggccgaggcgccccgaccccttgtgggttttgcgccgcgtgtatgggttaggtgagcgcagcggggctcacctaaccgcatttattgcggtttgggtgagcacgtcacgccacacgtaatgcagtacagcgcgctcgtttatccggtctgtgactggtcacagaccggtcagattgcgggttaggtggcgacgggcggtctgacgcacgcctcgccccatcccgtcaggatgagagcctccaagcactcgtccctagccggagccggcgtgttagctcctgggggtggcacgttggtcctggtcagatatatgccaggctttatcccaacctttataagcaagacgtttaatgaagaagggcgaacatgcagattgctaaactgacacgtggtggacaaagtgaccggtctgtgactggtctgacactggttatgtcgccagaagacaaccgtgttcccacgttgcacctgcttccggcggagtggaggtaggtatgggccgtcccatcagaagggtcactcgggcagcagccgttgcaaatctccgcccatttatgaagagatgacagggtgatccccgaggtcagacgaacgaggacgcgtggccacactcaaaaacaggcagtgtttcagcttccaagagaaggcaagccaagttttactatagataggatgggctcccacccaaaaagagagagagggagaagtggtgcatgtggtatccccttgagatataaaaggaggaccttgcccacttaagagagggggctgaaaggggggatgatctggagagggtttttagaataagagctatctggctctccagctctttgtagcttcttcatacacagatccaccagaacacaggagtagggtattacgcttctcagcggcccgaacctgtatacatcgcccgtgtcttgtgctttttccattctcgcgaaccttccacacacagactaggagcttagaatctcacccagggcccccggccgaaccggcaaaggggggcctgcgcggtctcccggtgaggagccccacgctccgtcagtacccaatgtctctcaatacatacgcacatcttatttccaccccacgcatcaaccgctagctcgtgctaatccttaatgttagggaggtcttattctaaaagggataattcgtgaatatctgcacaccatgagcacgcgcaaaacacccgtacttacatctagtaccggacgatttttatttatgggcaattttgtacatcaaatgaaagtttatatactaccaaatttcgatttggatctgaatgtttttttaaaatgtttccatatcaaaagtttctatatacaaatttatatgcctgcgatagcacctcatgggggctaggcgcacctaggggttgtttggttcactcccaaacattgccaaacctccatgctaaacatagccaaatttgtggcttataaattgatggccacaccttaggcaacttttggctaaaagatgagtgtatgacatgtgggcctttgaattgaaaaactttggcatgccacaactttggaagtgaaacaaacaagtatcctagaaaatgtggcaaagtttggcaaagtgagggagtgaaccaaacagccccctagaccagacttaacatatttgagcgccttgacacgtgaacattcgcacatttgaccttcccaatctcgatctgtatacccatggctcagtatgaggtagaacaatgcaacttagtagcatttaattaacccaaggtctgaaatagaccagctaaaattttttcttccttccgtgggggatccaaattagaccttatgtaagcttttgttagcaactgcaattaggcccatgggctgtacccatcctcttacccggataagtaaaacagtgaggggctctctcacccggagaaattctcgaataaacccctcaccacggcggcgccgcttccgcaactctcctcctctcgccgccgccgccgccgccgcccgccgcccgccggagcccgaagccgggcatgacgacgcgcatcgcgcccggcgtgggcgccaacctgctcgggcagcactcggcggagcggaaccaggacgccaccacctacgtcggcaacctcgacccccaggttagggttcctcccccttcttgctcctcccatctgtcgccgtagctgtagatgtgttcctgaagcctccacagggaggggcttgtagcgcccatggctctgtgggcgttcggttggtgggggtttgtgtcgtcctgtcgccacgagcaaagcctgaagtggaaattgtgccgatgttgttgtgagttccgttggtacttgatggattaacgatttgttgagcccgttgagttaattggtcgttgttccgtggcgaaggtgcgtgtccatcgttgatttgttcagctcattgagttaatttgtcacttttcgacgacgaaggtgtgtgcccatgtagctagatttgcgttcgaataagcttaaatgaagtgttggcagttaatttccatgtcggctgtgagtttggaaagcattgtacatgaaagaatcgtggttggatgaactgtgcagattctcctaggtggtctgtttataaactatcgtgcatgatatagcagcatagttggtggaactgttcggaatctcctagttggtctgcttatatgtcctaaaatctgaaagaaatacttgtagtcctagttggtctgcttatatgtcctagaatctgacagaaatacttgtaaattgcttgccaagttagtgtatgatatttaaggagacggcatgtttccatgttgaattatgttagttttggactttattattgtaggaaacatctgatagctaccattctttgccctccctgcaggaaattatgaacactttatctatgtgattatagattaacgcaaccactaaatcaattgtcttctatcaattaacaaagtattatacttgctaaatgattttatcttttgtgtacaaaaaacatattggtcttacctttcgtgtgtaagataatatatgatccctttggaaatcttatttccatgcgctcacgctgataattctaccggtattttacaggtttcggaggagttactatgggaattatttgtgcaagcaggccctgttggtaagtatcagtttgttccttgatagtttgactgattttgctcggaagtatctttcagcattatgtttctgttttatgtgctgtttgtgacttatcgcctccctgtgccagtgtgccacacatcatggatttactattatggagactgattaatggagttcctttttgtcaatttgtagttaatgtctatgtccccaaagacagagtaacaaatctacaccagggctatggatttgtagaattcagaagtgaagaagatgcagattatgtaagtctatcttgggtgaaggcaaatagtacttttctactgtacactttcaatatccattcaatatagcttttctgtttcttatctatttatttttttaggctattaagattttgaatatgatcaagctatatggaaaaccaataagagtaaacaaggtaagtacctcttttataatctcctctgcctcttttcagtacttctctcttgtatttctagccaagggtgctcgtgggtcccttgaactgctgaatttgctgaattttatgacagatggttgatagtttaatattactatattagtgtatgagtttagatgattcttcctcaaaacatcaactgaacagatactctgatttgttagtgcgtgcgatgattttttcagaaactaatattattctgaaatgaacatctgggttcattcaacttaatactgtcacattgtggtttagtagactttatttgcagggatctgtagtttacgttcaattctattgatttttttttcagtatactgcttctaaaactttctttattatatctaaacattttcgaaatataggatttaaatatcacatggtaacatgattatcttttcttattccaggcttcacaagacaagaagagccttgatgtaggggcaaatctttttattggcaatctcgatccggtaaaaacttgtggtctagcttttctttatcagctcgtttgcatgcgaagagtggctaatggctttgtgttctgtgttcaggatgttgacgaaaagctcctgtacgataccttcagtgcgtttggagtgattgtgactaatcccaaggtatcattcaagaaaaccttttactgcatttgtccgcttatgtaatctgttctgtgcacactaggctttagacacttgcatcaagattacttctcttatgatctatagctatgcagtaatctgacttgtgagcattcctccattgagaagtcaagaagcaagcttgaacaacctcttgagtggtgcttaagataacctgatattcctaatgtgttcatcatagttcacctgatattcctaatgtgttcatcatagttcagctaaattctaatggaccttgcttcagcagagtttttgcataacagtatttagttccaaattggcaaattgctaggagcttatcagctcagggcattattcatattaattcttatcatgataatattacagatatttgatatgttagaatcttctgttctcttttcaattgccatgctgcacaggatgtgttcttagtcccatagcatcaatctatcttgccaagtaccacgtctgcttcaatcagataaattaattatctgattttaacatgtactacttcaatcgtttaccatgcagtgttaatagtgtatttccagtgttggcatacagtaatttgctttgattttttttatttatctttatagataatgcgagatcctgaaactggaaattcacgaggctttggctttgtgagctatgactcctttgaatcatctgatcaagctatagaggtaacacaattgccacaataagttctatattttgtttcttccatttattgaatgtgtttcaccttatgtgccacaattttccaggcaatgaacaaccaacatctatgtaaccggccaattactgtctcttatgcctacaagaaagacacaaaaggagaacgccatggcacacctgcaggtattgtgttttcttttttctttttcccatctatttgtgttccttgccctctcagacacaccgatgtgaatattcacttgaatatcttgaattgactctctgttgcctacttggttgttccatatatccatgccaactttctgttcttgattctgaaatgataaatttcccgacattttccatctttgtgccttggaaatgctagggttgagtttgatgaggagttcttttgtggagttgaatcttttgtgctggcatatttaaccctgtttagtgttcaattattagacgttgaaggttcacaaagatgttatataatttcttggattatcttattttattttgagtatccatagattggatcttgatataacatgttacagctattactagacccatctaatttgtcatatggaaaacgattttcattcttttcacttattcaccattgccgttcattcaattgtccattgaaattctgaattctgactacattgcggtttactaaagttttgttccaacatattgttacaatcataatgattgatatattcttgtgttgacagagaggttgctagcagcaaataaccctggttctcagaagaataggccacacactatgtttgcaagtggcccgcctacgcaagggcttgcaaatggtgcacctgtgcctcgacctttttccaatggggcagtgccacctcagattcaacatgttcgaccgccgccacctcctatgcaacaattccctccaatgcagatgaatggtcagcctgtttggcctccgcagaatacacagctaccaccccacatgccacctcaaatgcattacaggcctgcagtgagaccacctccaccaaacatgatgccaccccctcctcttggcatggtaaggcctccgccgcctccttccagtatgccagctccacctatgtggaggccacccccacccccacaacaagctggtggtatgccaccacctcctatgtccatgccaccgccgccaccaccaccttctggttaaacatatgctggtgaaggttccataccatatggcacattgtagctgtagactgagaatgttggtacctttcttatatttccatgtaacttgcaaacactaggagaggatcagaattcagtgagtttagctgacactgatacaaattctcgaggttaactgtattttgttggaaatacatgaattttgtggttaactgtatttttgtgatttcagctgctgtttattaagcttagtgatatggtagttttgtttgcagttctactacctgcggctcttcaatcatcgccattctcgaaagctggagcagtttgctagagcccaagtcggctctgtctgggttggtttaggctcaatactcaagcccagcagcggaccacattcccagatctaaatcagtgcatataaaagcccatacaaaaaattggccaaccgatgaccatgaaaattaggcgtcccaaattatgcccataatcgaaattggtatacacctctgaacaggagcaaatttgcccacccttagaatttaaacgattttgggccacctctcaaccggatcaaattttcttgtcacaagcacggccaaattacggtttctttctagcatttgctcaactttgtttatccattaaaccatagattcgttacccttcgacagagattacagagaggttagagttaatagcttaagttagtctgaataatcccattcccctttgcaacaactacattggctaaacctgcaatattcccatccatgtgctcattacatggtggatatcatctcactgtaacactgttgcctactactccctaagtgtcaactgtcaacaccttttgcttcctttttcttctcccctttttcctaacctttccaattgaatcataatgaagcatcttacaatcacaatgggtgcaagcatatgagagcaaagagtgcaagaaacaatgaagtcaattgcagtgtcaggtcagctcggcagctccaattgccgccgctgccatagaccatcccgagataaccataccccatcccgccggcaccggcgccgccaccgcctccgccgccggttccaactccggcgtagttgacgccggcgtacgccgccgcctcgccgttgtccctgccagatcaaatctccaaaaacattagcaaactatcttatattctcttctcatgtactaccatgagagagctagtagctgccagtatgtcattagcaaaactggcacaagttgtagcaaaaactttcaagtgaaactgtacttaaggtgagatctactactgctgtctgtcacaagtgcatatgcacgctgcagaataaggaattggatgccgaggaacatgggtcttctcctgcagagtgatggacagaacgacaaaaagtgcacgccattttctaatggatcgttgcaaatggaccctcaacgttctcttcttgcttggctccatccgaaaaggtcatcgcattgcaatatggtagggtctccagtacaggacactgtttgagatccaaaacgcccaaagaacacagcttctcgcagtactagaataattcagcaacaactataatgcattgggccagtttgtgtttgtgtgtactagcttcttttgagccttttttttcttttctggctatcttttgcaggattcggcgacaaaacgaaggggtcagtggcgagcaagtggagaagaagaaggcaatgcatggtgagtgattgccggcctaccgtgatccctgggttatgcaatcgatggatatagcacgcatgttgctgagcatgcgacgatcttttcgatcccggctacttttggcatcgagcgaagaggaaaaaagaccggccaccatctgtggattcagttgatggctcatcgacatgaccggctaccaaaagataacactggtccattattttttattcataatccggacatccggaggcagattgactgaagagagtttatgtgccaacgtactagcattgcaatgtattccctcctcgtcgtataaaaaacaaccctaatttccgtattagtttattttttagaaacgaatggagtattaaagtctaacgcaatgatgtacactcttcgttctttaaaaaaaaaaatcaaattctaaagataaatccggtcatgcatttgtctagatttttctttaaaagttgattttttttaggacgaagggagtaagtcattcatgtaaaaatgtactccatccgtcaaaaataaacatatacttattacgaatacgatctatccagattcatactaggtcacatcgttttgtttattttatgatagttggaaggtttttgtaagcttgacatgagtagtctgctcttgtcttgccatggtttcagaggaaagaacgggagaacgaaaatgcaacggcggcagtgcatttgcctgcccgtgctgcccactccccaagtctcgcgtttcgcccatcccacacgagcagagtctagttcgctgtctaaaaagaatactagcactagcagtgtaccagaatacaagtactgggcctactggtagtacaagacaaagttgctttataaacttttatcccggtgtttaatcaacccgactttgtcagtcagccgctagtgttagtggtacggctctctattgagtgctcagccttgtaatagtaatcatctgttaagaatactttactttggccctcctaacctgtcctgccttttaccagctaagggtctataaattgaggatttggccaggaaaataattgtaggattatcgcggtaggacgccgacatggttagctcagttccagtcagagtgcttgtacaagtccacctgcatcgccggcctgcatttcttactgtactgccacgcttgttgctagctagccaaactgctctgctctcatgctctcaggcccgtttgtttctgactaagatcatactactagattctatcctaattttcattagcactttttttaaactgttaaataatatattacgtgcgaaaaatttttatatagaagttgatctaaactagtatcaaataaagtttatttttaagtttataatatctactccatctgtcctaaaatataagggattttggatggatgcgatatattctagtaccatgttgtcaagattcatagtactatagtacgggcctgtttggcacagctccagctccaccccttctagagctggagcttggccaaacagtttcagctccactagaactgggagtggagttggatggagctctcacaaaatgaattagatccactccagacccaactcctctaaatttaggagttggagctgtaccaaacagaccctacgactcatccacccaaaatccattatatttttggatggagggattaaaaatcaattaatgtgtgctaataactctcgtcttacgtgccctttcctaatcttcatgcttccaacgggacctcaatgttaccaaatcgacgagctgttctaccgcaaatccctctctacccatccaggtcgcggcaatggcgccgacaacaactcgacaagcggcgcccctccggcgaccggaggtggcagtttaaaggcgccgctgccgcattaaaaaaaagacggcccaacccaaaagaaaaaaaaatgcccacgtgggccccaccagtcagcgagagggatccggcggatatttcacgcagtggggcccacacacccacgctgctgctacatgtcggattcattcgaccgtgcaaaaggagagcggcgagccggcgaggcgatgacgatgcaatgtaggagggatgggtgggtgccgtacgtacctggggccgccgaggacgccggcgccggcggtgagctggtcgacgagcgccgacgacttggggtcggtgctggaggccttgtcgtagatggcctcgaggccctcgccggaggggacgaagaaggcgccgttgaccatcatgtccccctccgtcctccagttccaccccgcccactgcccctcctccgtgtccacccgcttcgtcacctgcacgttttttgtcccagtgtggggcccacatgtcagcctcaccgaatcttgggggagggtgcatctcatctcatcgcatcgcatcgtgcggtgcacgcgcctgcctcggatgctgctatcacgagggcaagggggaaaaacattcacccaaatttttgctctttaaagaagaggcgctattatgatgatgctccaaacattcgccctaaaagcgtggcaattcacatgaccatagagcgctactcacaccttaaaaacaggtcaaacgacttgagaaatttttctaaatatggtcagattgctctaaatttcacaccccacttaaaccaggaattcatcccaaattggggcatcaaacagctgacaagtgacaacctcagcaatttgagccaaaatgagaagcaaacggaggaaaaccaactaaataaaagacattttttttcctttcataagcaaaccaatgaacagaacaagaaataaccacccaataaaataaaatcatccaaaaatgggcatcaaacatccgacagcatcagcaattcgagccgaaatgagaaacaaacagaccaaaaccaatccaacacacacacacacacaaaaagatttttcttttttccttctgctatcacatctcacgactcacaagcaaagcaacaacgaagagagcaagaagccaagaacacggcaaacaacaatggcgtcgcttgcttacctccttggcgttgggatcggcgggggcgatgtagcggttgccctggctgttgatggtggggctcgcgctccctccaatggcgtacatctcccacgccgtgtagtcgttgttgacgatgtggaagtaccccctcctgcaccgaggcatccgctgcacgagctggatcccgaagtggttgaacgcgatggtcacctgcatcgccgagtccggcaggtacccgtcgctgtgccccagcagcatcacctcgttgtggtgcgagaagtagctgttcgacacggtgatcgccgtggaccccatgatggcgtcgatgaggccgtcggcgcagcgcgacagcgcgcagtggtccacccacacgtcgcgcgccgagtagagcgagatgccgtcgccgtcggagcgggtgcgccacccgtagtgcgtcggcgaggcgcgcacgttggcgttgccggcggggacgcagtcgtggacgtggatgttgtggatgatgacgttggagacgtactggagcgtgatgcacgcgccgccggcgccgacgtggacgttggcgccgcggccgtcgatggtcttgtagctgttcacgaggagctcctcgttgaggcggatggtcatgtcgccggcgaacacgatccagagggggccctcctggatggcgccgtaccggagcgtccccggcgcggggttcaccgggtcgccgtcggaggggtcggtgacgacgtacaccggcccgcccttgccgcccatggcgttgcgcccgaacccgatgccgcagtccgccagccgctgccggtcctgcctccagtccgtcccggcgcaccgccagcagtcgtcgatggggttccccgtcaaacacccccc

SEQ ID NO: 47700 - DNA, 20173 bp, Oryza sativa
ttgggtggatttgggagtggagaactggagatgcagtggatttttatagcaatgcaggagagtgtggagcacagtgagggagtggaaaatggtggatttggagagagaatcagcagctgggtggtgaagttcttgagatttaatttggagcttgggattggacagcaatggtggggaggaaggggagaactcgctgggggaggagagagagagagagaggaggtgaaatggaatcacctgggggagatggcttccttgcttgttaaaagagggggtttgtttgagcctttggaggagggagaatggagaatgtttcatggaggggaagattggcatcaatggagtttgtcaaattgagcacatgatgatgatttgttgtgttcgtgtgttaatgctgatctcaagtcggcatagaagcgctcgcaaatcttctcttattggtgcctggaaggtgaattgagatggcgaatatcagggaaggacataatatcaaataattagaatgagtgaggcttcgaatccaaatcatctagtccatcaccttgtgaagccagccggaagacctctaacacatgattctgacaggaattgaagtgtaaaacagaggattgtaaaacacaagaaaaacataggaatggtcgtttgattggagcgcaggaaaagcgcaggaatcggatgagagaggtggactccaaggaaattttcctagaggtttgagctcttgctaaatttcttctaaaatccacatacaatgtgtcattccatagaaatttcataggatttgtaaagctttaatcctttgaatcaaagagcctttaagggagaatttagcctattgtatggaagtgcttaaaataccggtagatccacgactcaatttacataaaaagtaatgttgacttttcttccttgtttttccaagtaataaacgcaaaacaacatcttcttccctctgtatttccaaaggtgcaccgcaagtccatttcttgcgtggttgaatttccgaccgtccccgtttcagatatctagcgcgaagaaaagcatacgtagcatttggcaccaccgggaaacagaagaaaaagaaattcccccattactaaactataaaacttttcttgtcccaaactaaaaaacgaattccatcgcgaaccgcgaagacaggcgcgcacgaccaggaacccttttcccacccttcccttctaggcaaccgtgcgaagtggagtacaggagtgtttgttttttcagttaccacgaaccccgaagacgacttctgctgctagcctgctactgccggtgttgctttgttcagagttcagacatgcattgctttggttggtccttgttgtgtggtcgactgctcgtgtgcatgcaatatgcaagggtgtaaaattgaaaatttgattgaaattggaatgacgtgatggaaaagttagaagtttgtgtgtgggtgtgtttagtttacgctaaaattggaagtttggttaaaattggaacgatgtgatggaaaagttgaaagtttacgtgtgtagaaaagtttttatgcgatggaaaagttgaaagtttgtagataaaattggaaacttacctaattaagcctaattaattgggaaatgcgagacgaactttttaagcctaattaatccatcattagcagatgtttattttagcaccacattgtcaaatcatggagaaattaggcttaaaagattcgtctcataaattaatcgtaatctgtgtaattagttattttttagcctatatttaatactctatgctagtgttcaaacgttcgatatgatatagtataaaattttagagtgggatttaaacagggccatagtttcatctgacacgatatggattactaaggccgagtttacttccaaactttttcttcaaactttcaacttttccatcacatcaaaactttcttacacacacaaacttctaactttttcatcacatcgttccaattttaacgtgaactaaatacaccttaggcattagggagcatgaacacaggcaaccattgttgctagagcatgtttgctgctgtaatcatcccacggcgaggattactgcagccgcaagaaacccccttctccgttgttgcaacttgcaacttgcaacgtccgattcttcagaaacacacacacgcactctctctctctctctctctctcttatccactcttggcctcttgctatgcccacacattcccctcatccaccgccaccaccaacatcatcttttgccttccgaaaagaggtctccggtattcgttacatccggaccaggaatcggcggcgcgtaagccacaagtcgctttaatttgttgcccatatctcaaaattccaaaaccaaaaactgggagagaagtttccctctgcgaggccgaagaatggcaacgtaatctatcaacgtcgtctgaactttttgggttgtatcttcatctggtgttaaagttggtaactaatatggcttttataaatttccgtgcaaagggagcttgatctttgagttggagccgtgtcagatggaatgctggacaagtcacgcttgtagaacttgacggtggcggcgatggcgaccgttgggtaagtgtgctagcagaatgaaccagtttttcagtttcagtttcagtttcggtgtgtgctagctaaaaaaaaatcaaacgacttaggccatgtttagttatcaaaaacttttcacaaaaacatcacatcgaatctttatatacatgtatatagcattaaatatagataaaaagaaaaactaattggcacagttagggggaaatcgcgagacgaatcttttgagcctaatttagtccatgattagccataagtgttacagtaacccaaatgtgctaatgacggattaattaggctcaaaagattcgtctcgcggtttgcaagtgagttatgaaattagctttttcattcgtgtccgaaaacctcttccgacattcggtcaaacatccgatgtgacactcaaaaatttttatttcaccaactaaacatgctcttataatatgaaatagatgtagtacttgttttgtctgttgagtttaaatcaagtattaaggctaatgaagtccatttcaaaacttcatagcaagttttattagctttcgcgcattaacagacgaggccatgagagtgatatgtagtatactttaatccaacaacattcaatcaaaaaattaaaaagaatatatggacttaaagtaagaaatgccaaaaaaaataaaaaaggactcaaacaacgcccaccgtggggctcgaacccacgaccacaaggttaagagccttgcgctctaccgactgagctagacgggctttgctggtgccctgaaattcacactatatagatttcaaactgaatgaaaatgatcaagcttaacgcaaatccacgtatttggagcagtgattgtttagccttttcgtgcttgctttgaccgctggaacatgctccaattctggcaccaaccgaagtgtcaaatggtgaccgcgaggtttgcattggtctatggcagagcttgagcagaacctacaatctacagaatatatccacttctccagcatgaaaacattatagcatctccaacagatttgctaaaaaaatactcttttggccagtcatctaaaaaattagagagccaaatttgtcttttactccaacagtttctccattatctccaattaaacaccgggtcccacgcatcagtctatcagtcctcttccttcctctccttctcccaacgcgacctcaacacgaagaaatcggcaacgcaacctcaacgcggcggcggaggacggcggcgggcgcgtcggacgacgccgcggaggtcggcggcggcctcggcagcggtcgacggcggaggagccgtcagcgcggcgacggcgcggagatcggcggcgggcgcgtcgggcgacggcacggagttcggcgaagagcgcgtccggcgacgccgcggaggtcggcagcgggacggcggtggtctcggcaggtgcggcggcggcctcggcaggttgtctcggcggaggggcggaggtcggcggcggcctcagcaggttgtctcggcggaggggcaaggacggcggcggcctcggccggctgtctcggcgacgccgggaaggtcggcggcaggagacggcggtggtcggcaccggcgctggatctgggagcgctgagaaaaagcgatgcgggaggagaggaaaaatcgcggatcggacgggagggagagagaatagaggggaaagcggtggggcccacgattggccaggcctttttggctggctatatttggccagtgcaaggggaactttggccagtaggatggcttggccagccggttagccagtctattgaagcacgaatttgagccaaaattgctacaatttaacttagagaatggaataagaaggctgttgaagatgctcctagaagcctatgttcttttatccactttcccaacttcaccactcatttttcatgcatcttatgatgttctttttataaaacaaaatctttagaatagttgttttaaacttatattaatctatttttcaagttttttaattaatactacctccgtttcaggttataagattttctagcgttgcccatatttattgagaagttaaggaatctagaaacatatatatatatgtctagattcattaacatatatatgaatatggaaaatactaaaaagtcttataatataaaacggaggaagtatttaattaatcacaacctaatggataataccgttttctctaccggggagagattacggctgtgttcgggaggcaaggttgacacggagaacgaagcacacgatttagcaagattaattaaatattagcctaaaaaacttgaaaaatagattaatatgattttttaaaaaacaactttcatataaaaaacttttacaaaaaatacaccgtttgacagtttgaaaaacgtgcgcacgaaaaacgagggaagggagttaggaaagaggggaaaagaacacagccgtatacctaaaagaacacagccgtatacctctccttcggaacaactactactactctagaatttcttggtgactggtgtacactgtatacagccaatgtcccagattgaatgaaaaacatgccatgccccaccctcaacacaacaaagaaaatgcagaccatcatgatttcagagtttcagcgcaattcctaattcgcgcgtacgcgcccgcggcgcgcatttttgcccacacggtccacgcagcaccatagaagctggtgtcagtttctctttttttttcccgtgaaattaggcgctagttttgtttttccggtaatcgctcctttttttttcctctccacacgcgcgcgttttgtgatattttataaattgaatattttaccttcaatatccattgagagttttgaatttgacttgaaagtttcttaaattaaagttgaatgttttgaattttgagatgaaagttttcaaatttaaatcgagtattttgaatttcgaggtgatagtttttaaatttgagttaaaagtttttcaaacgtgagttaagtttttcaaatcttgacttgaatttttttaattttgagttgaaagttttcgaatccaagttgaaagtttttcaagtctgagttgaaagtttttaaatccaagttgaaagtttttaaatccaagttgaaagttttcaaatttgaattgaaagtttttaaatctaagttgaaaagtttttaatccgagtttcagaccacgatggccatttgtttcgggtactagacacacgggacagattccgaacctgattaatccgcagccgtcgattcctcctacgtggctcaatcccatccgtccgacggtgccatccagccctccgatttgaacgtcacgctcctcctccctcaaatacccccgtcgcctcccgcaactagccgttacgctttccccttcctccttccgcctcccacccacccaaaacctaaccccaaaaatcccccaatctctctcgcctgctcgatcccccaatccatggagttcgccgtccctgtcccccagcaggtctccagcctggcgctgccggtggtggtggcggaggcggaggcggccgccgccgccgctgctgctccggggaggaggggggcagcgggcggcgtgagctcgataccgaagggcgctggggctgccgcgaggaggaagacgctgtgcgacatcaccaacctgaggccgcggccggcggcggccgtggagcaggacggggcgacgtgtgccgcggacgcgggcggagtcgcgcaggcgcagcttgtcaaggcaagatcgccgatcctgtgcttgccagtttgaaaatctcggggtcgttcgctaacggtgatgttttttttcggaattgtttgtggcattttttcaggagaactcggaacttgtgaggctcctcgaggagagggagtacgtccctgaaatcactgatttcttgcatcatattcacttattatgtttttgagtggatggagaatttgattatatgtgatcttgttttgacttgtttttgcttgatttcgtgcatacagcaagatcatagagttgagtgggacagagttgcagaagttgcggctcgctaactggcagctcgcgcaggcaaattcccagatgctggcagtaagtttgcccctaatttttttctgattccttccactattcagttgtcgtttgaaatctgtacagtcagttattgtttcacccatcttcttgatggaacttgattgttgtctctttttgttctccaggagctcaaccttgggagagatagggtgagttcatggctctctgatcattgtgaatcttgggaagagttttggacttttgattgttgatggcattttcaacacgcatctgattagccaccatctttcttcttttgaagctaaaaaagctgcaacatcaactcgcttgctcgagagctgttatcgcaacaaaaacatcagaattggaggtataggaactgatgctaatgtcgttcttgctccaccttcgtttcataaattccatggaaaatgttgatgcaatttgctgttcttatcctcttattattgcaggaggccaagaaggcgatgaagcgcaataggaacctgccactgccagagaaggctcctcctgcaagcgaaacggcgcagcagcagcagggttctgatagagcggcacagatcaaggatggagatgtcgtcaatccagagcccgccgcggcttcagacgcatcgcatgcggcaagcaccaagaaactcagcaacgccagcaggaaacggatgcaaagatctcgatgtaacaatggccgctaaccattttgcttgcaatgacctgtactaattctcatcagcatggctcactgattgattgatctatgctttccagctctaggaccagctgcaacgacgaaactagcagcgacaccaaaggagaaggagaatgtgcagagaaggtggacgaaaatctctggagtgccaaatgattcagcaaagtaacaactgatgaactgaattgactgaaatcgcctgtgtgtttctgcaggaagtccatgagaacaccggtaccacagccgagcgagcatagggaggacctgttcgagatcgaggacctccagctcgcgatcggcggcggtggcggcggcggcgacagcaaggccgggaccagtgaccctcctgagcaagcggcggtggcggtggcggcggctcagttcccgcggaggtcgtcgctggggaggccgatcaggagggccacggagagggtggcctcctacaaggagatgcctgtcaacattaagctcaggaggtcctagcctagcatcctctcctaaggccagaatgtcttatagtctgatagagctgcgtgctgcaatgattctttgcagtttagttagttagtgtagcatgtcattttgtttgttggaatggttgttggattgaattcttgatgtaccatgtgtgtattctgagctgtgacacatttatttacggttaagagggggtgctgtgtgtgaagaattgctcgggatctgaccaatttggaaatgaaattatgattaagatgcatctgcacttctgcagcatgttcttctgcctgattaacgttgcataagtgaagaagatacttgtgctacactttgcataggtgaagaagatacttattctcccattcagattcaggcaccgagcatgttgcacaagcagatagctaggcgagacgtatttaatgtatttgacatctttaattggttgtcacaacttggtgaagtggcaagaatcgcaacggagtcggatcatcaccaagttcaagctgaaccatcgttctgaactttatagttggcagctgcaaagtgttctttcaccaaagcaagagcttttcccctgtgagatatttgattcttcactgacttgggcatctcagcgtagctgtaatacacgtgtgtcagtatttgaatcaagaggggtgcacagaaggtagtacaagctatcatgaaactcacgtttgatcaaaaccatctggttggaatactgggtcccatccaaaatcagcaggtcctctagcaggcacaatctttccctgtacaattagaattacacagttcaacaaccaaaccgtctaattttaatgtaatctatgttttgtattttttgtaacaaatgtctaaaaggatggtaccacatcctgcagaattatattgcgtcagtgtgacagaataggagtatatagagcttatctgtctgtaccaaaataaatgcactggagttcatccaaagttccagggaaagaatgatgcatggaagtatatgctacattaacaatgcatatggaaagatatctgacaagagtaacaaaagaatctagtctccttggtgatgctaatattttgcatggtacaaaaaaatgtgatatcaaacagtgtttaatataatgatagctctcaaataaaatgcagcaacacttcaaactataaacatggctgaacataatacatcaatatttgttggttttgacagaagaattattattcaacaactaataagcagaacttctctaaaaacttcacaagaaaaaaaatggaataaacagaaaattgatgtcttactgctgttttcccaacgaatgtcattggttcttctcctggtccaagagcaagagaaaagatgcacatagcaaaagcagatttatcttcataggctagcaacaaattgttcaaacctatgatgtgaaaatagtaaacatgaacttacttagtaaatctctgtgaaaaaagtaccatattataaaatgaaacaagcagatagaaaaaaggatggtttatatcaatgaccttcatgcccagttttctcaaggaaccattttctgttcatcgtgtgtcgagaagcatccagaattgcaaattaagaaaaaagaggttagcaatgacatcgaggaccaagatgtgattagatatctggcaaacagtctcttgatgagtcattgaagtgaagtatgtttttgtgtctaaaagtccaaataactcggtgacaagaaaataggttcaacttacacctcgacaggaaaagcacttacatgtagggccctgcatcaaaagggtaaattatgtcaaattgtgcattctattttgatttaacaagtgaagatgaagaagagtgtaaatcaatcacctggtaagcctttgagtgcattgaagcataggcaggtgtcctcaacaagtacaggcccattcacctaatgtgaagtacacagtgcatatttcacacagagtcattaattttgttgattgggtttatgcaatagcattagcatttaaaaacatgaagtacctgggatgcagccattcgtgctttctctttagatatgtcctccggctcaccttgcaattcagggactgcaagatttaacagaattataaacacaaattcaaaacatataataccgtaatagagaaaaaactaggaacatgacattattaacaagaacatcagtcttcagttggaacagtttgatatttcggaaactaaaattggaagttccatagggttatagtataaagtaggagtccatcaacaccaacgtgatccagaactataattgggaacatcttactctatgaaaatctaatgccggttctcctatgatcctatcgctgttcagctccaattctggtactaggccaccatgaattttacaaatcaatgttcatacttcccgaagttcttaaccagtactaatccaattatcccacacttcaaaggaaaaaaaaaactttaggctatgcgatgagcacaaatcaacattcaaccttttacctactcacaaatcacaattcaacctaactcccgttgagaacaaaaattgaatcagatcgaaatcccacaatctccagtctaatctacgaaccacatgctcactgctatcctaggaggctccagttcagtagaccaccaccgtatcacgcggcggcgccacaactgggctgctagccagcctgctactctactaccctaccgtcagccgagcagattcacacgggactggagacaaaagcgagaaccgagaagcggagacggggaggctcacggtcgagcttgagggactggaaggggatggaggagccgaggatggcgcggacttcctccagcttcttggcgttgcccgtcacgaaggtcaccgccttgggcagcgcccgcgccgccgccgccgccgccccggacatgcttgctgcgctccggtgttggccgctgcttccgccgggaggaacggtgatgcggcggaccggaggaagagattgattagcccagcaaaatagtactcactcagtatgacgccgttaactttttaacaaatatttgatattttgtcttattaaaaaaattatgtaattataatttattttattgtaatttgatttatcatcaaatgttctttaagcatgacataagtatttttatatttgcataaaaattttgaataaaacgagtggtcaaagtcaaacgttgattaaaaagttaacgccgtcgtacattaaatacggagggagtagtagctttaggcccattttaggcagatgactttggccgtgtagaactcgaccatgattttctcctgaggtaaattttacacgaagacatcgtggctttggttgatttattaacttctactcgctccgtccaaaaaaacaacatcgcactaagatatgagtacaacaaatttggacaacgttgaggttggcttttttttatagagggagtatggtaaaagtcagatcatcagaaaagatactcttagaatatttgttactagatatcttgtatgtgtattaaaatatgggtctgtctatatatactgtttgattgaaaatacccctaaaaatcttgcaaattgtagacctttcgatttgcttttaagatacatgctaggcaaactaaccacaaaaccccttccttttcatccttctcctcccaacatcccttcacgctgctgccctctcaccaacgctcgatctgtgccacttccgccccacgcagcactgcctaacctcgtcgcctggctgtaagggataacgccatcggcgaggtctcccatcctatcgtcttccgggtctctagcggctctcttccgcccgatccaccatcaccagtcgccgcctcctaaccaaatgcttgttttgttctagctaccaatgtcggcctaccagactaccaccctcctccatcccccgcggcttcaaagctatcgccggtgtcttgcctactcatgcccaccacctaccgccaccccactaagcccgacgatcatccctctcctcctcccaccctatcctaaaccaggaccctaaaccctaacatcattgccttcgtcggggtcaccaaggctagagaagaaggtaccaccagagttggaggagaatagctagggtcgctggagtacgaatcgtgaagcaaatctcaacattagtaatatgcatgattttgacaaaaaaaatctatcatcaactatttagccattttgttaaaatattcatttttagttgagtagaagatagaaacaatataaattgttgaaaatgtttaaaacgcatctaaccatggttgccacattttttccctcccatctcttgtcccctttctatgttgcccccaggggtagagatagagtatcttataggggtgcccagaaactcagtcaagaaaattttttagctatactttacctatcacctatgtcaatttaaactcgatgtaagtaaagtaaattaagcagctgacatccctctatatttcgttctagctccgcccctgtaaacactaatgtggtgcaccaatgtggtggctgccgcagaagcaacgtggcgaggacaacggtcacatgccgctcgatatcatcgacgcacgccctatggcacgagggtatcgagcaatctacatttgacggggaatttccgcacacaaaaggaagaaaatatgaacatgattagacacttgctgatcatctctgagaaaaatctcggctattactcagacatttttccaacgacatgaatacccacgaccgtgcatcaggtcattgctaaccattattatcacaaggacgacgatgtacagagttttgctgcattcattatgaatacggatctctcggacgaccaatataattacgacactagcaataatcataatcgaaagctggtcaagtcaccttcgtggtggtagcccttccatgtgttgggaacgtacgtccacaactaaggctttgttcgctccagccagatcccaacccaaaaacaaaacggaatagtacattagtgcatgattaattaagtattaattattttttaaaagaaatggattaatttaatttttttaagcaacttccgtacagaaactttttgcaaaaaaaaagaaaacacaccgtttagccatttgaaagcgtgcacgcggaaaacaagggagaggggttgggaactaagggtgccgaacacaccctaattaacgacatactgtagtatccatctttggtgtcgatgttggcggcaaaggtgctagtagtgacctaggtgatgaaaaaagacgcggatattagggaatgacctaatatcaaataataattagaagggatgagactacgaactcaggtcgtttagtccaccagcttatggagctagccggaagactcctgagtatttttcgacctaagtgatgcacacgttgttgtgttgcaaggacatcgatcaagggcgaggagaggacaaacatttgttggtcaggactcggacttttactctggaagatccccatgttctcgcataaaagttttttatgtgacatatataccaacattattttcaagcatcaaatatattaataatttttatatgtttcagtgagtcaaaatatgaaggttaagaaattagtagaacgttatgtatgtgagaacaaggttgagttatgtgacatgacaaatacacaccatcatcagttagtactagaacgtagcaattgatttgttatcggatctaatgttttattctctatcagcctcgtaacttatttttatgggcttagtcaatctggtctactactcgcaatttaccattgcttctcctgaagttccttctcctcctcgttttccttttttcgaggaatgaagtccctccttgctgctcattccacagttttcctatggagtgggatgccatcatcagctttgggtctattttttttaaaagggaacttggagaagttttttcagcaaaattataaacagttattttttaagattataagaagcttagtcgtaaaatccaaaaataaactataaatcagaaactatacaacttctctaattttttcagaatctggtaaccaaccatattacccaaatagccacttcgttcctcaccgtaacgaaattccaccaatccggacgcttctcatcgttagagcaagtttaatagtatagccaactagtagctccaattcatctatagccaatctaatagctcattcatacaatagttacatactacactattaatatctggtccacatatcatacacatactatgtcttggagtccgtgctacagctggctacaaatttttagcccgctgctcttctctctcctcatttatcttcttacaatatgtttgtagctggcttataacctgctattgccctgctaccaagccaggccaaaacgccaaaaccccaggccaaccaccgaccccaccgtccacccacgcgtccgcgtcccgcacgccaatcacacgcacggagaagagagtccattttttttttctaaaaccccgcgtgtcccgcgtgcgggcggtctgattgccgagccgacccggcaaacgaacagcccgacgcccccgacgaccaaaacctcctcgcgcgatctcgcctcgcgtcctccgtccgtcctcgtcaagtcgtcacggtcctcacggctttttcacatctcacatctcgcactcgcatcgcagctcccaactccaactcaagtgggctccttcttcccccacaactccacggaaaaaacctcgcagtacacggccacccaccacctaactcccttccttcctctccctagaaatattcccgcatccgcatcccgcatcccgcctggtttgtgattcgccgaacagctttgccgggagaaagcgaggaaggaaggaaggagaggagggagccatggagaaggcgatcaacaggcagagggtgcttctcgcccacctggagcccgccgcgagtcccgccgccgccgcgccggccatcaccgtgagtccacctaccgccgcgttccgccctggggtgtccagatctgcgcggcgtgctgatgtttttgattgttggttttggtttggttggtgcaggcgagcgcgtgcgccgcgggggacagcgccgcgtaccaccgcggggcgtgcttcgcagacgacgtcgtcatcgtcgcgtaagtgagatgtgtttccttccccccgcggcggttctgccctttggccatgccaatggcctggattttatagcttctgattatagataatttatttagatcggtgaaattgattcaagatggatggctgtttttgtgttgaccgtgttcttctcccggtcgatggttgtcgggtcaaatttagttatcagcttattacgaattaaacctggacgaaaatagtaaaggtctttcgaaaaatatctggacgaagaaaaaaacggaattgctatatttgtgtcgctacaattttgttcattttattgtcagatctcagaccatccattgctgctttgagatttgcctgttgcagttgattatcttcaaaattcatgctagtattcactttcacttggagattaaactattatcactcatggataaattactcatactaattacatcgtacttattgtaattttgggacttatattgtaaatacactaaaattacatatgtaatttaggaacttacaatgtaaatacatgccgactattttttggtgaaaaatatggcgtcttaaatatagctactccccccccccccccccccccgcggcaaaaaaaaaagctatgaaagttatgaataaaattgggctacttgtttccgctaatattttgaagaccgcatgttgaataaggagaatgatatataaacatgaaagttttagcattgccaacataggggaaaagggtgtcatagtctgatagccgttgtgtcatatggtctggattatataggatagttagctgccgtaagacaactcgtgttggcctagtttctttttctcgatgtaatttcattgctaaataaaatacccattatctaaaaacatatgaaaaagagagccaaaaaagctgtgaaaaacacatgtgattgttgcttggtttaccgttagattcagtggcaagtgatttttttccttatttgattatcataagtcataaatagaagtgaatcatgggtcttttgtgtcttcagtgcctataggacagcaatttgcaagtccaagagaggtggtttcaaggatactcccgcagaggacctcttggttccagtattcaaggtttgtatttgttatcatatactcattttctcccaacttgacaattagtgaactggttgcttctgtctcgacctttggtctcattctcatatattttgcctcccaactacaggctttgatagataaaacgaagttgaacccaagtgaagttggtgatattgttgttggtactgttttagctcctgggtcccaaagggcaattgaatgcagaatggctgcattttatgctggattccctggtaagagtcataataaacattatcatgtttgccattaatattggactgtcatcattctcaacttgattaatttgttttgtatgctccagataccgttcctcttatgactgtaaacaggcaatgttcgtctgggcttcaagcagttgcaaatgttgcttctaacattaaagcaggactttatgacattggtatgatccgctggtggttaatcttaagaagtcctttttgtgaggagaagtttgaaaaaaaaattcatggtgaactgacttttgttatttattcaaggtattgctgctggcctagagtccatgacagtgaaccaagttcgccttgatgggcaagtgaaccccaaagtatgtgaaacatgatggtcaatgcagcaagataatctttggatgcacgtgtaaagatatttgagcttgatttttttttggctgaaatctcccgctattttaggttgagctgttttctcaagcacgcgattgccttctcccaatgggcctcacgtccgagaatgttgcaaaacgatttggcataacacgaatggagcaagaccaggctgctgtaggttgccttatcaattctttctttggacatgtgtattgatacacagtgaagtgttgcacaatatgattctttcccttattattttcatatattgatgtttaggttgagtcccacaggaaggctgcggctgcagctgcttctggtaaattcaaggaagaaattgttccagttcacacgaaggtaatttagcagcttggttatcttcctaaaataactgtctgaactctttaatattattgttacatgatagtcttctgtttactgtgttatcctgacatgatcattgtgttgtgaagattgtggatccaaaaactggtgaggaaaaggagatagtggtctcggcagatgatggaatccgaccaggcacttcattggcagtcctgtcaaaactcaaaccagcattctctaaagatggcaccactactgctggtaacgtgtaatgaatgtttgttaggcacaactgttgattagttgtattcacctctaaagattagtgtttgttttaacccataggaaacgctagccaagtaagcgatggtgctggagcagtcttactaatgagacgtgacattgctatgcaaaagggtcttccaatagttggcgtcttcaggtattagtatttctctatgactctatatatcatatcttgggtcacaactcacatctataggcattgttttcagcctaattaaaaaagtaccaaagaacattaattttaagtttttaacaaggtggttcaatcttcccttcttagtcatgaaagcaaataggcatatggtacaactaactgtcgcaaaactttgttaagaaactcagcatgagctgaatgtggaaatgtaggagctttgcagcagttggagttgatccagctataatgggtgttggtcctgctgttgccatccctgcggcagtgaaagctgctggtcttcaaatagatgatgttgaccttttcgagattaatgaggtatactttcatccattcatcgagtttctccactagacaacagatctgccttgtaatatttatttgctcttgtacacaggcctttgcatcacagtacgtatactgctgcaagaagttgggacttgatcctgcaaaagttaacgttaacggaggtgcaatggctcttgggcatccattgggtgctacaggtattttcttgctgctatccttgatacttatcgtatagccaaactgttattttagtatcagtaatctataattaagcaaatgtgccaattgcaatgatatttctcatgtttcctcttggcaggtgcacggtctgtcagtacccttctcaacgaaatgaagcgacggggcaaagactgtcgatttggtgtgatttccatgtgcataggtacataaccatattccattggcctgcatgaaaattcaaaataattctttcagctgggagtaacttgacaagaacttctggtgaacaggttctggcatgggggctgctgctgtctttgagcgtggggatgcagtggatgagctcactaatgctcggtgcatcccgacccataaccggctttcgaaggacgccatgtaactagaactatatatatatgtcataaaaattgtgcaactgccactattgtttgaaatatcaacacaagagtagggaataaaacgcttgtgtatctgtaatctcatccagctctgaacttggctagttggagaatccttgttaattaggaaattcatgcataataactcaaaagttgtcccttgtcagcctgttcatctgattaccttttgctttcgaaagttatcagatgattgtctatttgtatcagaaaatgttgtgaagcctgatgcatatgacgcgggattccggtgaaaggatagaccaacttgtctaaaaagaaattggcaccctggtttttttactttcccctgttcaaatttatgcgtaaaatgaaggggggattttctccgggacaaaacatctttgttgctagttcgatgcctaagcccatgcttctcttcaagtagagaatgggaaaacttcatgttccatagacagtgaaaatatcatgggctgtttgcctcttttggacgcattgccataaaagtgtggctaacgaattattggccagacacttttctggtgagatgtggcaaaaaaatgaatagcacaaacttaaagttacgcagggattgtttttgtttggttacatacaacactttgttacgctaaatgtcaggcatatttatgtagcaaatcatgccgtctaaaactctgtccttaaaaaaaaaaagtaaactctaactatgccgtctaaaactctgtccttataaaaaaataaactctagctatgaatctggacacgcatatgttcgggttcgtagctaggattggacttttatatttatgtggcaaatcatgccgcatgaaactctgtccttaaaaaaaaggtaaactctagctatgaatctggacacgtgtaacaccctgaaaatttgaccaataaaagcaaaactctaaaaatacggaccttcgaaaacttttaaattaattgcatcatgctgatcttattcgcctattttatttggatttgatttcgaagttcattaatcgtgagtaaagaatagttaattaggaataaaccctagaagtaaattggtaaaataaatataatttaaaataaagattagtgtggatagaaataaataaaatattatcacgatcatattcgtatcaattaaatttaaatgcgatggaataagaattaaccctaattaaaaattcaaataaattatacaaataaaatatgagtaatattaatctagggtgaattcattagttgagataacacaaatattgagtaaacttcatttatgcaagatttataaattatagaatcaaatttatatgggaaataatctaaaatcgggataaataggaaaatacactgttcattatggcgtaggtgtttgatgcggtccctaaccttccccctcctctcccatctctgcccctagccgccccgagcccgcgccgacgcaccatcgccgcctgccgccgcgcgctgtcgccccgcgccgcgcgccaccgccgtcgccatcgccgccttgagccccgcgcgccatcgttgtcaccgtcgcgtcgtcgcctcgcgccccgcgcccctgcctcgccgcgcgcccgtcccatctaccatgccgcgcgcgcctcgcgccccgagccgtcgcgcgctgtcacttcgccgctgtcgcgccgcgctgccatcccggcgtaccacgcgcccacgcgccccgtcaccgccc

SEQ ID NO: 47701 - DNA, 20053 bp, Oryza sativa
  unsure (1)..(20053): unsure at all n locations
gccccgggcagccgagccgctgtcatttcacccctccccctccttctctcccttttccccctctctcccctataaaaaccccggccccttcccccttctccaccccactccattccctcctcctctccctctccccttctccatgcaccaccgccgtcgtgccgccacgccaccgccctcgtgctgtcgtgccgccgctttcgtgcctctgcgccgccgccccagtgtgccgcgccgtgcgccgtcgtcgccgccgcctctgccccccctgtttgtcgccgtgccgccgggtagagaaagagccgagagagagaggaagggagaagccgagggagagaaagaagaaagaaggaaggaaaaagagaaggaaaaagaaaagaaaagagagaaagagaaggaaaaagaaaagaaaagagagaaaagaggagagaaaaagaaaagaaaaaaataaatagaaattagagggagattagggaagtttagaaaatttaaaataattagaatttaattatagattaattatagtcgtagaattgcaaaaattaatataaattatggattattcttggtaatttctataagaaatcaattcgcggtagtaatttagatgtaattaataactaaacaaatagatgaattcttatagattattatagattatttttgggtaatctctataagtaatcgattcacggtagaaattcggatttaattactaggaattttagccgtgtattatatttaatcgtttagtcatagactaaattaaatcgtacaatattataagataattttaggattttgtccgatatttagctcgcgatagaaaattctaacctattatatggatataatgctcgggtagattaaattaaaaacttatggtaacaaaatatttatacccgcaaaaatagtttaggatgtataaatcaaaattgggtttgccctagttcgcgaatagtaaagttaataaaaaaaaggatcgactttcgcattcgacttccatttggatttatttggatttttatttgaattctaaccgaattcaaatcaattttcgcacgtaactatagagcccgagggagttgcggatccaagtgaaggccaagacccgcaagactttgagcaaggcaagtcatcactattccttgaacatgttgatcccatttgcaaaattattttgtttacaaataaaattacatgcaatgataaacatcctacttgtgattatgccatgccttaattattgtttacccttaaatccttgtaaccatgatttacgtataagtccctagtcaactatgacaaatgcttagaaatgctactctagatttatgcatactcatatttatcaaaagctatatgcttgggcatatggagacatgagcgccgcattgccatgatgttgatgacatgatttgtgaaaggagaaataaaattaaacaactgttttcgactggggcggacggaggatttgggtggtatccggaaaaggctagcaccgtccccggtcaattaaggaccgagccatgaagttaagcatgaaacgacccccgtacaaccgcacttctcgtatgggtatagacctagcggaatagatagctgagcggaggcagtatccatgcatagtggtttcttgatgtgtgaggcaggggctctacggtggggcagccattggtagaaccgtgaggcgggtgtctacagtggtgtcgccatcggtaggactgccatgagagaatttaaacataattataacttaatgcatgtgtgagtcttcccttcccgggtgcgccagaactcctctcactgctagaaaccgtgtacgcctagagtgcatgaggatgtaaagttcatggagcgggtactgccaatgcgaggttatcgaaaagctttgccgtgacgcgtctcatgtgttgggacgaggctcatgtgttgggcagtcgcggagtgcgggtaaagtgtacatccactgcagtgtgagtaaaccaaatctattcgaatagccgtgctcgcggttattgagcaccgggacgtgtattacacttggctagactctaaattcttaacttgtgtgggatgggatattgcatgatgatttctatactgatggagccacttcttgagaggcgggaatgtggacgtcctcagaaaaccatgacgactcaatggcgggaagctatccttgggatcacaatggatggtggacagaaccgtcattgtttaatatgaacactggtactaaaatttgatcagtctatgctaggtcttaggcttgtgaaaagaattacaaaacttgctttgcgcaaaagaaccatagccatcctttgaatacccctgtcatatgcattgttgctgtggtggcttgctgagtacggttggtactcacccttgcaatatacaaacttaatcagaggtcgaagattaagcttcggaggatccctacgcttattaccaggagggtgatgaagacgatggcgcttagtaggtcttagttacggtcgttgcctgtggcaatggcatgccgttgccttgactccgctgccttacctacttctgtttttggaatgtattccggaccgctcggtccgatgatttaagactatgcctgcgggcttatgatgtaataattcgtactagacactcatgtatgtgcacttggtatttcagctatgaattcgtgtgtaccagactacttgatccagggaaatggtactgtttacacgattnnnnnnnnnnnnnnnnnnnnngggtccacaacacgcatatgtccaggttcgtaactagaattggacttttttggggacttaggggtacgctgctaccacattgttagtcatatctgtggtaaagtttggcagaatgttctaagtttgccactcaactaaacaaccttcgttgtatcagacgggataacatagaaaccgtataatatgatttgattatgttttatagaccgtcatcagccatatatgtcaagttggttcgtgtattcatacggtttgtctcgagagggacaaaagagaaactcctataaaatttcaaatcctagcttcccaaggcaaaattaaggaggaagacaaaggatcaaaatgtacctgattaatattaggtaagttgtattgatggatgggtaggtgagggtatttaaaggataaaatttatcgaggcgtccacaaatcgggcgcccaaatttttttttttataaaaatcgggcgttgttcctccaattatattggaacatatttcactaagtagatcggaaattttcggtcgtttaaaaagctgaaacacaaccaaatcatctcatgaaacatttgctacaacatatgaaaaaacggtttctaaaaaatcgagtgttgtttcaccctatataaaataaatgtttcagcgaatagcgaaatgatgcttcaattcactacaacattcgatctatgcatagtgaaacatcacgagtacacttactcaaacattattggtggaacaaaaattgaaacaaattcctttaatagagcgtttacatagtatgtggatgatttgttgcaacggcacatgtggtggggcgtgtggtggggacggtgcggaggcccaggaggcgcggtaagcgacgggtgcccgatttttctggcgctgatcaagcacccaattgctgttattttccaaaggatcaaaatgtaactgattaatactaggtaagttgtattgatggatgggtatgtgagggtatttaaaggataaaatttatttgatttgtgaatcgatggtaggtaagaaggtaaaagttggtttattttaagataaaattcaaacatagaagttgatttattttgagacgatggagtaggtgagagccatccaggaataggagaggttagtcgatgagacaatggcacgttgtcaggtaatgcctcggtgtagcaatcgtccatttgctcaaggaacaacaggtggcaaggtagcgagagtacgaggcatgggttgtggcatgactggtgcagggccaaggtttgggtacgacgtcttgtttaagagatgtgggcacattgccatttctttaattatacggatgtgcaataacaggcacgttattccgcgtggatggtcggatcaaccctggcatgagatcgaagaaaccaataagtaattaactagaaatcaagaggggctttatgcaaaattcatgttgtagataaatggaaggaaatgcatacaagttaaaagtttgaaggaactttctagaaactccaaccataatagataagtattgaattccgacttggactttgtgcaacctttccttagctataaaaggaagaggggaggggatttggagggacagatcggagataaaagtagttgatatattatgctaggttcttggctatataaaaggagaagaattagggggagagacagaacggagaggctactcatattcaacctgcttaaatcaagttgaatttaagccggttgaagtcgaattcaattcaagccggttgaagtcgaattcaagcggattgaagtgaggaagctacttgattccttcaatttctgggcacccgatctgtagaggtaatcacccaaactaaaatataatagacctactctacttgtttgcatacatagggtttttggggcataaacttgtctgcgtacttaggttttttttgggaacatagactttatgcgtgaggagatctacatgcatgagattttctttagggacataagttttatccgtgagannnnnnnnnnnnnnnnnnnnnntctactcatctacacaatagttttaagggaacatcaattatggatctttaacccaagaagatctgaagccgtatagaaatagatctatctatacctaaaactcacccatccaaaaaaatcatctattaaggatgcatcttcatcaaaaattgattattttggtacggagggcccaagtttttacaggaaaaaatatcttgattttgagggatctaaacacatacaaaagtatggtatcattgtgtcttctacataaactagaaaatcggtgtgttgttagcatgcttgctaatcacttaaaaatactacataataaaattgatgtgctcactaatttaaaatatatatatatatatatgtttttcttaaataagaaaaataaatgtaaattcgttattttaaatttgttttttattaataattctgggtttactatatattttagagttatagaagtagtactgagtaggcatggtatatttatagaagtaaaagagcataagtttgtgtgattggaaagggaatatagttttgaaagcctctaaaaatccatatgcatttttctctagatttttccttacgtatgattgttaggtattttttctctggtataaatttatgatttttcttactttaaaaagtaagagacgccaagtggaccaatcaaaagctagcaaaagagccagttttagattattagatttagggtcaaagtattattgtttccaattatctatatcacttacgtattcaacttttttaattatcgataatttcctctcaaccttacggatctatcaaaccatatgatgagattcaccagcaccaaaatcgaatcacagttgtaaacaaagtccaaccacctaagaccctctttgtttaggcttataagccaacttataagtcgaaaagtctaaaccaaaacaaacaagcagcttttttatttggttttttttaaagtcataagccactctaacactattaagccaaaaactaggttggagaagctttttttggcttatatgagatagatgtatgactccagcactaaacttaggacattaaattcactggcttataaatcatataagccaataagctgacttaaaaatctaggccaataagcctaagccttaaacaaagagggactaaatatcctaaccaagttttcacccatgagtgggccaaaccaatccttaaaaagaaatctttaaaggaaagctctatccccatccataaaaaaaaaataaatccaaatctgaaacaactttctgccatcctgccttcccagatcacaaattcacaatcctaaacaacatccggtacaatctttttttctcagcccaccgaactactagtatactccacccgaacagtgaaatcccagcgaaaatagccacagtagattcaaaattcaaattcgatccacagaaatcgagagatcaaaatcttggtgggaagcctgtataggacaggacaggaggagggaagttgaaaaagcgcggaccgggagagtggtcgtggttttttttttttttttttcaatcgcggttgggtgaagaaacctttttcccggcgtctcctcgcctttttttttcccacccattcgctcacgcatctcatttttaccccctccgccgctttcccccgcaaaaaccccccatcgccgccgtcgccgccgccgccgtcgtcggtcgccggagagtagcggagggtgtgctcctccggggcgggccgcgcgagggctggccggggcgccccggcgcggcgcggttttttcccgaggtaatcggcccacagcttcggtgtctccggctataggctctggtggtgttgcttggtgtgatggcgtggtgttgcgatcgtggtcggtttagctgcagcgtccgtggatgtgtgtgtgttcgtgtctgcgttagctctggtgtggtgaagctgtgtgggggtattttggaggataaatgtgtggtcgttttggtgggggctggggattcgtcggatcgctagattgttctcctctggttcgtgttgtatttttttttattttggggtgttccgtggtagtgctgggttcccaatttggcgccgcgtgcttcgttcctggcttggagtgcctgcaatgctaactctgtttgagagaatcacaggaacattttatttagcaaagtatttttttttaaatttttgattcttgtgtccgcgtttggactgttatttagggtttagtgatgtgcaagctcagttttgggttgtgttggggtcgttgtaacttggtgggttgaagctgttcttttctggttgcctctgtgtgctttttagtcatgcttatgtgattatgtcctctgccgctgcacacattcttgagtaatttatggttcattaatccttcaatcgaagcctactattatgtactccttttactactactgcctcttggcctgattgactgtgtaaacttgcatttttgtttccctcaatttcaatatctgtattctctatgtgcagaaaaagaaaagagttcattaacaagaatggcacagtttatgtgtctgtagctgcaattgatagtgaacacaatggatgagaatagaaaattatctgatgacatgtccaagaaaatggaacctattcactctaatggagaggcaggggaagataaaactataattattgaacctgaaagtgatgcaaataaacttgaagtggaaactgacgcaagacatggtatctgtgaggcgcacaaggcgcatgaatatggaacaatggaaaatgatttgcatgaggaagcatccaccaccgatgatgattcagagaatgactcatatgaataccttcttcgggaatcggataatgagcaaacttcagagtctgatgctggtgagggagacaatgaggtatgtactattgcagtatctgcgggtgggtaacttaagttttatcttgccctgttgatgtttatgggatctaatcctttccaatcaatgtaaaaagtatgatcaacattggacacattaagcaatatacccactcgaggataactcttttgatatgccctttgctatagttgctctcattatatttgcacaacctttatgttacatcactgtcaccgtattagataaacatgtttatcagtattgttttcaatgctattacttttcttttggtcgaacagattgaaacatagaacttgctggtatctgttctgcggttgcattgtgttctgttctgttcaactgctggaaatcttagtgtggcttgagttgtcatgctttctcttttgtgtgtaatttggtaccatttttctgaaaattgattccttataggcacctctcactgatgaagaagttgaaacattaattaccgaattccttgacgctgagagcaaggtatttgccattgttgttttattcattttttgttttttccccctaacgttttccatttcatcctttttattctttggaaacactaggctgctcaagcgcaagaatcacttgaaaaggagtcactggaaaagattgaatctgaagtaaggttggagctatcggagagtctccaaggaaatgaggtccgtaacactgtcaatatgcttataatttattctataatgcataatgcttcaatgattaatctatttgtgtattgtatattttttcttaccttgagtagttagagtcagccgtttctactgagatgaagcaatacaagaaggaatgggaatctgaacttgatgatttggagactcacattgctgttctcttggtatgtttttgcctcaaaggggatcattttgcccattagtgaataataattatatttatctgttaagtcaatgcttgccaccattcctatgtggtgtgttagatgcatgtcctaagtacttgttccatgtaaattattgaagcacttttatatgaaaccatattgatttatcaaaatgaaggccaaaatatttctttatcttgtttatggttgtactcacatttatagtgtcaatgaattaagtatacattttacagtcccttatttagattaattagagttcttgaccttgaaaaaacactagaacaataagtgattattcttatagcttgacctgtcatgcctgtaccaaacactgcagactgtaatgcttgtcatattaatttaagaatctatataaatcaagatatgtttatttggaaaaattggttccatacaacgaatgatatccactttagaaacataccattgaatatttcatatcactctaactttcacctgttacaaatttcaccatttcatatcttagctctttcccaatttctatgattttagatagaaatattttacacagaaaacttcaatttttactagaagcaatttatgtagaaaagttcacttgtattttgtgtgtgcaagaaatgggtatgttcgagtgctatgtaaccaattttacgttttttaaatttccaagttctttgttatgtgttttgagttacctgtaatctcgatgagttatttcctttatgaaatccaagaaaagtagtaggcgatacatttgaaattttgaatgcaggagcaacttgatgctgctggtgtcgaacttcccagcctctacaagtctatagaaagccaagttccaaatgtttgtgaaactgaagcatggaagaacagggctcactgggctggttatcaagtgcctgaggaagctaataaatcaatcagaaaagctgatgaatacctccaatcttgtagacctgtaaggaggtaatgttggggccaaatttagtgtgttcctgtgtttttgtttctcaaatctgaccttgattcacacacttcaattagaaaacatgggaggttgctggaggaaggtgctagtggctttcttgctggaaagattcctgttggggatgatggatctgcacaatgccatgagaaaagttggaatgcattcaatgaacttaccaaatctaaggaatatgctgaaagttctttcggaagtagtaactgggcatcagtttatctggccagtaccccacaagaagcggctgctttaggtctccaatttccaggagttgatgaggtgtgacttagactgatcaactgctataattctgtactattgttatactccctctgtcccaaattataagacctatatttttttacacggtctttagtgacatactttgaccattattttattccatgttatgtttccaacaaatttgaaattagcatcacatgaaagtactttaaaatatgattctagtaatataacatgcataatacttaacatatatatggttagtatgattattagtcaaaagctaccaagtttgattttccttaaaaagggggtgccctataatttgggacggatggagtacatttttattagatccacaagaaattcttgagacaaaagaaactagggtctaaagagaggcaccaaggatcaaagtagtttgtattttaggccttgaagcagggcttaaacattgaagagcatagaaacatgtgagcttagttaagagctccaatatggtttgtgcttgtggtatgggttgtatgtgatttaaatgacttggtttaacactgtcagctgccaggtctttctatgttgaacacatccttgagtcatgtacattactgtgtaagttgtattgtgtcaattcagggccacatacatttagattagaatatttcaattagtttgttctaatgtacatatcaattagaaaacatttagatttttttggttttcattgtcaatactaaaaatgatattgttttaggttgtttttcagtcatttcttatatacttgtaaataattggctcagcctaccatttcccattatactgaaacttctgtctatacgtaaacccaacttttcacttgtttttaatctgtctttcacatcaatacagttccattaaatctccaactctcattgtcctacaggtagaggagatagctgaagttgagggtgctgttagtgacataaaaggtgtcgatgaaatagagctttctgaagtacagagaagaaaatacagaaaggtaagttgaaactagttttgttgtgctacagagctatagttaggccttgtttgtgctgctgttcttacccattgatgtctcctgtgtgcatgtttatagtcattttactgtgtttatacttatttctgttttattactttgatttattgcggtgtgtaaacacctgaattctaatgttggtttgttggccgatataactcctttatgctatcatttttgcatttataactatttcagttgcatggtggatgatataattttatttctacatggccataatgattctctgatgtgattgcaatacaagtatcacagttcttgacttcttgttgaacagctgatgttttgcttttatgttgtctggtaagcacttctatttcactttcttcatattttttccccaaatgttgtacatctctgtaggtaccagaagaggatgatgcaaagatgacaaaacgtctgcagcgccatttgaaagaaagaaggacaagacatttgcataaggtaactggcaaagttttatttagtttgagtctgttttgtttatttatccattttgttatctatatcattgttgattttttattgggtgcactgtttagcatttcatctactctgtcttgcttttcaggagaacattggtttggcgtcatcatcaaatggatgctgtgagctgcctcccaaaaaactcaaaacatatgaaatggagtttctgttgagctagcgaagcgcacacgtgaagatgatgttgagtttgacaataagaggtcaaaaactgtaattattgaaagtgatgatgacatgcagactgatagcaagccagattcagcaccaagtgaaaatgcggatgagattattgatcttgatatcttcccatcacaaagccctaaacttggtgataaagttcggcctaaacctttcaagtgcactatttgcactgaaatgttgaatgtccctgaagtgcaccgccacccagtattggatgttataatttgtggatcttgcagatttctagtgatagagaagaatcgtctcgaggtgaatacataccacttctgtagatttcaagataatttcaaataacattgatttttttatggaaatgtattatgcaatcataatcttagatgtactcgttttatacaggatcctgtgtctggtggttattgcacctggtgtgtaaaaagtgaacagcttcaaagttgcagctcttgtaaactgcttttctgcagaaattgcttgtcaaagaattttggtgaagaaggcttatcggaagctagagtagctggttggcaatgttgctgctgcctacccagtcaactggaacatttaatttctgactgtgacaaggccctaggtggtgttgagtcttctgatcctgagaatgactttgcagagctttctgtattagagagcaatggtccttttaggtatgccctttaccattgtattgtttatttcatcacaattctttgcatttggtttactattacttttgttgatgcggattaaatattgaaattttttccttgctaactgtttacacaaaaataatcagcaagcataaaatgaaaaagaggataagaagaatcatggatgacgaagaacttggagaggaaacaaagcttaaaattgcaatggagaaggtctgtagtatttttggatttgataaaccttatctatgtttgtttgaagctattgaggttataatctaaacattcttttgtaggctaggcaagaacatctgaagtccatgcaagagcagtctgccagcaagttaaagagcaacaatatcggaatttccttggaagcaccatctgaggtttctgaatatgttggggatggacatatagtaaaccttgcccgcgaggaagatgaagcacctgttagaattccaagcagcatatctgctaaactgaaacctcatcaggtttgctttttcaaatatactgaacaacagtattgctcattcaccttaaaaattacatttagtttgaaactctacactgaacattgcaatgtgtcttcgtgtgttgaaacatcaaatagaaagtctgatatgcgtcttaacttccctttcttatttttgcttttaaactggttaattacctgtttgacgttcatgtgccagtatcgcatcaccatcacactggtcatgatttctgtacagttgtacctatactgttacaggaagctaaaatatatcatgatatttcaggtatcaggaataagatttatgtgggaaaatgtgatccaatctgtcaagaaggtcaaatctggggataaaggttttggttgcattttggctcacaacatgggccttgggaaaacttttcaggtttgtactgacttttgtcctgtaatatatattcttgatttcttcattacatgattcagccatattatcatattttttccatggttattagatcatattctaggatctatcgatctattctttgggtgtcagtttacctttaattgttgtacttgtattgctggatttgttaactataactatgtgccgattgtttttcgatcattcaaggtggcctttgttttccctttcctgtttccatttcacaaaagaataatggaaactgtattcttatatttttgcattttgactttgcaggttattacattcctgtatactgttatgagatgcatccagttgggactgcgcacggcgcttatagttacccccgttaatgttttgcataactggaagaaagagttcatcaaatggtgtccagcagaacttaagccacttcgtgtgtatatgttggaggatgttccaaggtgcaggttaattattttgttacttatcttgtcttatgtttgcaagtatgcactctggaatttataattagactatgaaactcttgcacataggtttgaagcaacttagcacaaaacttagctaacggacaaggaaagatctattagatctgcctatatcaattaggaaatccagacctaagttatttctaaaatctaatgataccctcaatcgcttgaatcattctttgtagaccttgctttggatcatccatcaaatgccgtcttatgcgatacatgatactccctctgccccaaaatataatttgaactagaaaggtagctatattttgggatggagggggtactaaatttgttccctaattcatgtaacctagaacctttgttataccatcttgtataatcttattttccctactgcaatactagataattgacacgtgccagcctcaaaataaattataccctgtgagctataaggataaactcaaactctgcatctgttaatctgttactctcaaacctaaaaacataagttagctagccaccctaggttcaattcccccaaatctcaagaaaaaaactgttcatgtgtgtagactcctttgcaacatttggaaggttactggcattaccctttatttcttctctagatttatgtcacaaatctcacttggttagatgcgattgatttttcctaatgctgaaaacagaaatatgaaacgacatattcagtatggtatgatgttgataaccactaatgaaagctatgctcctgaaaatcttcaatttcacctcagcagcattaggacattgctgtcgagcttctttttattgcattatttggtatttcccttttcatgaccttgcattagatgtgtattgcacttgaaagctattgttcagcacttcagaacctttggcagcatgtgaattgctttagcttcaaggcatctttctaaatgcaacggaagatgaaggttccaccatgtccttgtaccgataggttcaattgattacctgcataaccaacctgtggctagatgtattagttagggtgaatattcttgtaagcccttttctgctgatgatggaatgtctgcctgtgtcaaaacttctatatgctgtcgaaataaggtttcattacgattatgatggggtgttctatttttggcctgaaaggactccccttccacttgtggtttttgcagggcaaacattcagtatttactaaaaaagtggcgaataaaaggtggcgtgcttctgattggttattcatcatttagaaacctttcccttggaaggagtgcgagggacaaaactgttgcaaacgagatcaccaatgctttgcaggtgatgttccatttgtcctgttgttattctgttatatttcaagcttttatgttatgtcaagtcataggcattttcctttttcatccatatcttatacccctcctttccatggatatactaatgtttcaatcaccattccactttatgtggtaatataacaatcatagatgttcatctggcatgagctatgcatcattatactgtatgtatgttttcttccaaccttgttcttttagatgtgggttttgatacagtccatttacatatgtcacaatcagtgtgggccagatattcttgtatgtgatgaagcacatataattaagaacaggagagctgacactacacaagctttgaaacaagtaaggacacagagaagaattgcgttaactggatctccattgcagaataatttgatggaatattactgtgtaaggaattatgcactcctaccctaaacccttgctactttaccttccagctaccaacagtattttgatatctgactgtagtacttttctaatggcttttgattttctggttaacagatggttgattttgttagggaaggttatcttggaagtagccatgagttccgtaacaggtaaattgatgctctgatctcttttactgtggcaaattaatattctggacatttgaatgatatgctttgcattatcaggttccagaaccccattgaaaatgggcagcacacgaattctacatcagatgatgtcaagatcatgaaccaacggtcacatattctgtatgaacaactgaagggatttgtccagcgaatggacatgaacgtggtgaagaatgatctaccagaaaagaaggtttttgttgttactgttaaactctctcaactacaaaggaagctgtacagaagattcttggacgtgaatggtttctcaagcagtgctgcttcagaaaaatcttttcagcggagtggcttctttgccaagtaccaaacgttagcgctggtgcgacatttttgcatctttatgtctttattagataacatgccaatgttctgttgtactatcatatttgtttacgttctttcttctcatgcccgacaatatgcttcaagtgtagatatggaaccatcctggtcttctccagatggctaaacagaaaggaaatttgcgccaagaagatgtcgagtcctttctgatggatgagagctctagtgatgataatattgaaaattacttgccaaatggaggtaatttattattcacagaccttccttttgagctcttttttttttctatttgtaattagtaaaatataatactcgtataattttatcagtgtttgattgactattttttggttcagaagtcagaacccaaacttctgatatatttcaaattctccttttttttttctgtgagaaattaacacttggtcacctttgtgatttgtacagagaagctgagaagcagaaatgatcagctatccaagaaaagttctgatgttgtaaatgaggtacttgaatatatattggctataaattgtttcaagtttcaaattttacagtattttaggaattgattgtcatgtaattcgttcatgcatatcatattttaatattatgatttctagctgcacgctatattttgtctgatagtctggtgagtctggtcttacctgtgcaattatgtttaatttaaaccaaaaacagatggttaaggaacataactttagtatcgcacctacacccacacgttccagtatttttgtttatgtgcatatcctttattgtaggaaagtaactggtgggagaatcttttagatgaaaatgcttataaggaagcagattatagtggcaaaatggttttactccttgatatcctgtcatcatgttctgaattgggtgacaaggcattagtgttcagccagagcttgagcactctggatttggtggaattttatctatctaagttgcaagttaatggaaaagagggcaaatattggaaacaaggcaaggattggtacaggtgcactttcacactctatgcattttattttttatacacaagaacaatacaactatcagtggtggtttcataagtgacaattttctgttactttgctttgttattttctacgcacctagccctgtttggactgtatggagtttcacaggtatattggcaagcgatactaggaatttggcatcaccttatggataagtgtatattttgttatttaaactgaatcctgaaaaatctagcatgataataaaataggagaaatatacttcatcactttctacttccgcttaatcagtggaaaaagagatatctacatcatctattgtgttgcattgtgcaacttaaccaaatcatcatatgtataatagagctgttataattgtatatcaaatataataaaattacctcttcagatataaaggttcatattacatacaactctattttcaaatgaattgtattgtcactactgagtagttaagaaataaagacacacatccaaacactgcaagcttgcattttatgttctacgagcatgaattcactagcacagctgctgcttgcaactgatcataacatgttctttctgcctatgtacatatttttgctggtcagtagtaaactagtattacctctgtatttaaatatagagttaatatcacaaaatcctgagtattatggttcaagttgcacaaaatcacatggattttggcatgtggcacataaccctgggtattgtggtcctaaggtttcataataccagtataccacactgttaattaatctaactaaatattatagcaaattaaaaaacaatcaacttagatgattacaacttttttgacgatgggataaagaactcgtattttttggacataagtacttttacaacagtttcgttagatattattgttttattctaataaaaaatagtggtcaaagttgcacactaaagaccaaataaagtcaggacgttatatatttaaatatggatgtacagtaattatagcaaataaaccataggtgtatctagacttaataatttactctgaagcacgcactagtgcaccagtgctaaacctgccagtataagtgtataacctcagttatgcaaaggtgatacttcatcaccaaaggctttgatatacaagcattattgatatttagttatgcacaagtgattgtctgtgccagcatgtagttctgcaaatgtgctgtttatagttactgcctcaacacaaaatggaaaaatgaacattgccttttgcatcacaaggctttgacagggaagaattgctgatattttcttctgcaaagatagtgctgttaccagcatttaatttggcaacggcgatatttatatttaaaagaagcttatcttattctgcaaatgtgatcttgttttctgtcatgttgaataggattgatgggagcactccatcttctgagcgacaaaatcttgtggagaggtttaatgaccctgaaaacattagagtgaaatgcacattgatatctactcgtgctggatctctaggcattaaccttcattcagcaaaccgtgtgattcttcttgatggttcatggaatccaacccatgatttgcaagccatctatcgggtttggaggcaagaacttgttgcttgatttttactagtaagttgaacaatcatgtgattatttgtttactcaccgtatgttctttccaggtatggccagaccaagcctgtgtatgcttaccgcctaatggctcatgcaacaatggaagagaaaatatataaacggcaggtaatttggcagttgccttttcttgtttaaaactctagttgtgttattgacttaattcattaattagtattattaatataggtgacaaaagaagggcttgcagcaagggtggtggatagacagcaagtgtctagaacaatctctaaagaagagatgttgcatcttttcgagtttggtgatgaggaactactggagcagagcggttctaccatgaatggtcacagtaaagttgggactgagaagccacctactcccaactccagtgaaaccactgaacatttacctttggacaggctcatggtgaacctacttcatgaccactcccggtaatgcttatattttttgctactcaacctaacaggatgtcattctataaatcttatagcgtataaactataaaaatcatataactcaaaacttgtcaaactcgtagtgcttatttccccccatgctcgcctttgccaaacattaatctttgtttttgggatttacaggtggatcgcaagttaccatgaacatgaaacccttctgcaagaaaatgaagaagaaaggcttaccaaggaggagcaagatatggcatggttaagctacaacaagttgctagaagttgccccgaggaaagctacacatgacgccgagagaaaaccaagtactgttccaacagagagcagccttatacaaccacctaaagctacttcaagaagccggcaaccccagcagcctaagatcacttcaaacaaccaaaagaagtgtaacaacctgagccacttgcttactctgagaagccaaggcaccaagcctggatgcagcacgagttgcaaagaatgtggccaggatattagttgggagacgctaaacagagacggtagatcaaggtgaagtcaaatgacttgttgttagcttactcaagtcattgctgttacacattttatacttttgtaaaggttacctttttcttttgcgtagtatacatcctgtatgttaggattatcagtgtatagaagtagtgaaggaaatggaaaaagacattttttgggttcacaagataagctgtatcagtttgcaactggaatcttcacatgattagcaaattatgatgccagaagatgcactttacttcctgcccctttgtcttattaattaccttattatacatacgatttcttttgccgggtcagccaaaggttagccgaccaatttcattaagattgggaggaaaaacatagtaaaagtttacaacgacattacaatgtcgtggcggccaaggaaggtccctagccagccaagaatgaaaagcaa

SEQ ID NO: 47702 - DNA, 9678 bp, Oryza sativa
aacgccacaccgccgccgtgtaatcacacgcaacgaacaggtggtggcagttctcatcatctcgctgacaaagtgagcacagatcatcatgtggccagtttcgcttggcgaggttgtccgcaggcaacggtcctttagcgcaagccacatgaagaagcggactcgcgagggagctctggagtgccacagcagctcgccgaatgcacaattttccgtagccatgaagaacatgtcgtaggccgacgccacagaaaattgcccatcgttcgccagtttccacctgatttcatccgtcgaggggagcaacaacacatcatgaatttcgtcccaaagctggaagaactcgcccatcgcctcgttggacagcgccccctgcagtgtgcggacccagcgattgttggtgagagctttggcaaccgaaagcctgacacggcctgcataagagtgcaggatcggccaccgccatgcaaagcatcccttcccagtccagtttgctgtccagaaatcggtgtcttcaccattgcctatgatgtactctgtcaccgagcgaaatatggcctccacatcacaaccaggcctgaaagatgccatcgtccagggtctctccctttgctccagcgatttcgccagccattttaatcttaaagcctgaccaaagaagttcaggtccttcactccgagaccgcctttcgccactggagagcacaccttccgccatgagactagacaatgcccgccgctcacctcctcttgccccttccaaaggaaaccgcgtcatttgcgctctatgtccttgactgcccatctcggcaattgcagcaccgacatgaagtggacgggaagagccatgagcactgacttgatcaagcatagcctgccatcgatcgagagcatcttaggtttccagtcggcaactttcttagctaatttgtcaaggatcggctgaacttcggcttttgttggctgtcttgttcctagcgggaggcccaagtaggtgatggggaaatcttctactctgcaggagagaatggactcaaccattgcccgttgttgatcactgcactgaatcggggtgatcgcactcttgcagaaatttgttttgaggcctgttgcctcgccgaacaacgtcaacagtcccttgatcgcgcttgcttcagcagccgttggcttgaagaacagaacggcatcatcagcgtacactgagatgggaggcaaatgccttcttgcatttagtggtgacagcaaaccagctagtttcgctcgattctccctgcctcggtccccttgctggcttgattgggtcggtgagtgccccatttatcaagatgcttgtttgttcagtgaggaaaatagccgagatccacggtctccaatttgggccaaatcccctgaactccatcatagacagcagaaaaccccacgatacagtgtcaaatgctttggaaatgtcaagcttcaacagtaccattgccttcttttgcctatggaattgctgaacgagccccttgacataaacaaagttctcatgaatgcagcgccctttgatggaggcggtttgagaataaggaattagaacatccagcttcgtcgctagtcgctgtgccataatcttcgcagccagcttagagaaactatgcaccaagctaatcggcctgtagtctttgagtagagttggcgattccttcttgggaatgagcgtgactattgccgtgttcaatttttctagattctgactattgccggtgcaaaactttgccagtgcgttgaggagctcgggtttgatgatgtcccaacacttttgatagaacaatcctgtataaccgtctgggccgggtgatttttcgttcggtaagcagcggatggctgcccagatttcctcttcagtgaaaggaacatcaagctcagtcaaatcagcagcagccagcccaatttgttcaaacagcagccttcttgtagcactgtcctccgcactcatcactgattcaaagtattctctgtctaggttttgcatgtcatgttgtgttgaagctattctgccctcatgttccaaccgtgggatcagtaatttccttcgccttgattttatcttcatgtggaagaaagccgtgccagcatcaccttccctcaaattcctaatcttagccctttgcctcagccgaattctttctaacgacgccaaagccagacatcgtcctttgcaggctgcacgaagatgtcgttcgtcatcagatagtaaccgtgactcttgggcaacatcaaatcttaggataatttcattggcgatctgcagctgaagcctgtatttgctgattcttttctgaccccaggatgatagtttcttacatagcctagcgagcttcacatgcagaattaagtaagggtcggtggcatccacttcttgttgccagctttcttttacaacatccatgaagccctcaagttttgaccagaactctatcaagcttctccagtgtagggcgctgctgctcgttactccatgtatatcttccaagaatcctcttgctcggtagcccgatttgaagagaaacaatcgggctccttgctactgcatgcatgcaagatgagtactaactagtttctttttctttttttctcaacacttcaaatattttcttctaaactacttattcgatttacgatccgatcgtaccattgaatttgttacaattaaatctatacaatgagatattaaatgattatattttaataaaagaaaaatatatggtttagactgttaaaacttaatgtttcctaaatagagcaatatgttttaaagtgtgcattcactacttgccccaactttctctctcctctatccatccatgcatggatggatttaacaaccttcaaaatgaattttctcctaaattacttatctaatctaagattcgataacaccgtggtatttgttatattaattcttcataataagatctcgcatgattatgttctgatgaaaaaaatatgtttcagtctgttaatacttaatgtttcatacgtgatagcaacatgtttcaacgtgtgttttcactttgtttcaaaaaaatatttaaatgttgcagtgactgatttttttcactgtgtataacttaatgtttcactagtggtcaactgtaacatttgacggacgaattttttttgcccctactatctcctctttatccatgcatgcatgcatggatttagcagccttcaaaatgaattttctcctaaactacttatctaatctgcgatccgataacaccgttgtgtttgttgtaatttaatcttcacaacaagatatcgcatgatcatgttccgataaaagaaaatatgtttcagtctgttaatactcaatgtttgatacgtgatagcaaccggccctatttggaggtacctccgagaaattcgcaaaagtgaagctggattttgcattctttgtctgtaaccaaaaaaaaaaaacagcggacgaacctatgtatgtctccaagatgggctgggatttttggacattcaagcaggctgtgaataggccgaaatttaggtccatacccgtatatgggccggattttgagcccatacgaaatgctctgaatgctcgaaagttaggcccatcatttggcccatacacgtggttgctcacccgcctcgtcgcccggcactccggcgacggcggcggcggcggcggcggcggcggcttccagcaaaatgaacggctggtccgccgtcctcctccatcagcgtcggcccatgccggcggcaactcgccgccgtggcccaagtcgagcgcgaatgctggcttcttcgtcggggccgcctccgtccgctccgggcgaacgcggcgcgcggcgcgcggcgggcggcggcaccgggcggaccgggtccaatgcgctggtaagatgaaccaccacccccgttctctgcttgttcttccgattcgaacagtttgtgttgcgctatgcctgccactggattagctatgggacctgggatgcaacctcgatttggtgcagaaacgcagtgataagtgatactaacccccagccaatttgagtgcagagattgaaatgcaaattcaattagatataacagaacataattgattgcttatagaaagcaagtacatcgattgatagtctcagcattacttgcatagcagcaatgctttaggaaaactagctagtggccggaacaacagcgcggccaattttattacagcttcagttcggggaagaacactgcataaattaactgcaaacactaggaaattactggaggatctctttgtacactatgtttttcaccattccttcacccgggcattcttcgtcggcgatcaagatcttcaggccatctctgcttgtgactctggagactgccacatagagctgcccgtgggtgaaaacttgcctaggtaaatagaggccgaccttgtttagagtttgcccctgactcttgttgatcgtcatggcaaaacacaccgagaggggaaattgctttctgtttagcatgaacggccatttcggttcggttggtgacatgatgatttgtgggatacataccatatcgccgctgtgtgttccagttataatctgtgcctcaataaccttattgcctagtcgcgtaattgtcattctagtgccgttgcatagccctgcactttggttgatgttacgaagaagcatcactggcaaaccgactttgagcttcagttggtggtttggaattccggagtgattcaagctgtttagaaactccgtaggatataacatttccatctcatggctgtaagacactgatttgctcacactgtcacggctaaggtaggttaccttgtcaccttggatctggtccataatatactcattaagctcattgacattctcattcactggacacaatattgctctttcttctagataattctgcttgcagcaattgtcttgtaggtcaggataggtactctcaatgatttgagctttcgggtcatctcccttttgtaacagcaggtcactaggcatcctcacccaacctttttcatctaacgaaatcgtgtcaccattgccgatttgtagtatccactcagcgaattctgcagacttctgatgctctgtttgatctttggacacataattgagtcgcatattttttgtcaaattgaacacctcgaaatgttgccagaggtatgagcatttgatcgttgcatttacagtgtgttcccttcttccttttggcacaatagggaggatctgcctgaagtcccctcctagaacaactgtcatgccaccaaagggcttttgacaactattctcatttctacacctctgcacgtcccttaggctcttgtctagtgcctcgaaacagtttctgtttgccattggagcttcatcccacagtattagtgatgtcttcattaatagatcagctatgtgcgagccttgtttgatgaagcatgtatattcatctgttaggttgatcgggatattgaatgctgaatgtgctgttctacctccttgaagtagaagtgccgcaacgccactagacgcaactgcaagcactatctttccctctgatcttaaccttgttgtgattgctttccaaaggtatgtcttgcctgtcccaccataaccatccacaaatattagcttgcctagtgattgatgtgctgattctattattgcatcaaatgcctttttctgctctatgttcagagtgtttagtatttgcaggtgctcgtgcttcaacttctctttgtcatagttcatctcttcaattataaactgttctcaatttcacttaactttgccatatttggcggttctattccagcgtattcctttagtgattttccagcttgtcgcatgttcttctcaatttctattaaagcacatttccttctgtgtgaaggcgtgaggcaggaggtgggaaagttcaatgcccaactttgtgtgtgctgtatatctttggagagtttctcccagctggattcccacaacctctttgggtcagtaacctcgcaatggcataaaacagttgcaaataattgtcgtaatttcatcccagatgcccagcatgatgcttccttgatgcactcaatccattcgctatcatcgtttagaaatcctagtgcatggcatgctgatttgtatgatgagtgcacggttccatttacagtcctgatatcttcaaatgttgtgcaaccctttgccgtgttgaggataactctgagataatacctttctccacttgctggatgggcattgtagatcctgccaattttcatccctccttttcgccttacccatttcttcacattcttatcccacgtccattttgtaggaaattctgaatatgttaattctctggcatcttcatgccttttgttcgtttccatccactcagtaaacatagtgacccctgatcttggtcgtcttacgatttcctgtaggtctgttgagtcaggaaaaatcacatgttgctcattctcctcgtggaatgatagcctctcaacaggtggctcttggtagtgtagaggaaatttgaatattcgccaacaagcttcagttgctgttgtgtatttgcatcccaggtaccttttaatctcatcattattcttttcgtcagtttcttcaacaactgctgttgcttggtcatcttcattgcatatgctcttaaataggtatttgattgacctagaccggttgaaccactcgacattcatgtgtacttggaatttcgctaggagatctttgttgtatggaacaacgaatccattgttcagattaactcgtcccttttttatctgtctcccatcatctcgtctcctatatattgggaagttgacttcatcaatgattgtctcatcagaaaatcctcttgggaagaatctattgcatttatggtctaccatgcacggtgactttgggtttgcttctccacatggtccatgcatcatgaaattcttgacagcttcaaatgtttcaggatccttgtctctgtcaggaatctcagcgcatatcagttcatcaatttgtgagggctctaggctctttcctcttttatcaaggaagattaggatatgggcatgtgggagtcccctcttctgaaattctattgtgaagacaactgcaatatttattcaatatatgtgttagcaattacttttcattaaaaaaattgtacggatgagtgctttttttgtctcgtcacttacttgctttagtctttccaaaatgttgattccttttaatatctgacattaattccttcagttttatcatgaacactcgaactaaaatatcagggcgttctgatggtttctggtatccaactttatctagcatgcactggatctctggccactttgggttgcatgtgaatgttacaaacaagtcaggatgtccagcccaacgacatattgccatcgcatcttggtagttttgctctttatttctaggacctcctgtgaaacttgctggaagtactatcctcctccctacttgctctgttcttgtgtctcctcttctgagtgcatcttgtagcccaccataaagttctgttcttagaactccttgattttgcctgatccagttgagcctaatctgttctatgcacgcatgagcatcgaccatgtattgcattgagaggtttccacacatcagtggcaacattgattggtcttggcgctgttggaggcgatacgcataatattcaagcatagtgacacatttcttgtcatttcttacaccttcctttccgctgtattttattccaggtctataaccatcttctccataagggaagagcagtgggtattgcatggccattaattttggatgggtttctgatatccttttaggtctcatatctttgtactcaagaacaatgtcgcgtccatagctttttttggtcggatctttgactatcaagagagcaacttctgatgctgatggcatattgtcttgccttccatcttgatccctattatcaagtaatctcagagtgtaattgtgatagtcatcttctttaaatctatctcttgccattcggaatgtctgggctagtgtgttgttctcatcaagcatttttagtaggctggcaatagttttttggtctaatggggcattacttgcaccagattttgatgcttcaatcctattttcgatctcattctctgtgtcatatacgtacaattgttggaagcgaggcttgttgctaccttctggtagcagagttcctatgtgatggtgattctggccattcagtcggaaaatataaggtccatgcccgttgtttatttttctgtcaacggttcctcccattgatgtaaatgcaaacatcgaattgtatgatctaatgttctgttggtagtttgttgatcttcctccatctcttgtcaataaactcgtaaggtaagggggctgttcttttaacggtggcaatgctaccttcccttgcttgcagcagagtccaaaggatggctgtttgactgttgaatgtagtgatctttctgcatgccacataagcgcatggcagtgttggcacatgcatgttggccccccaaagttccatatcttactatcactggaaatgatctctttcgttattacatttttattggttctagttccttttctgctcctcttgagtgtgttctgttctttcctcttcattcttgctatttttgctaattcttttgcccgccttgctttcttcagttggctgtatattattgcactgtttataactgatggttccttgagttgcattagttgaatattgcagtattttggttccactacattcttgatgtttttgtaaattccgttgggtccttggcaaagtcggcacatgcattttggccaggtcatgttccagctaagggtatttttcaactccatattgctgatgtaagttggatcagctcttcctttttcttcatttccatcagttcttgcacgcttcatgccccgcttgagttgcatgtattctttcctcttcatccgtgctgttgttgcgcattctgacattgtttggttgtacttcctctaccccccttgagttagttttttctagtagattacttcaataccaatccttcatttggttgactttctttccctttccgctcctcttaagtatgcttttctcttcaagcttacaatcactcattctcgttactgacattgattgcattcacaatggatcatggctttcctgcacacatgtaaaatattcttggattgactaacgcaaaataatatgctaaatatctacatgcttttgatgaggtacatcacagattgagtcaattagcaatgcatttcttaaaatggtaagattctgacacgccaccacaaaattcccaaagccctgtataccgtcccttgtgtcactcacatgtcaaatctatgatctacgtatgtacaagtgatggcaatataaaggattgtaaaagtgcagtggaaaaattgaacctataaccaaatatctagaagctgacttgctcagcggaacgagctaggtcatgttggagttagcaatttactcttaaagtctacactagtgctttaagaatcaatacacttatggaccttcaaattagactcttgttcttacttaattgagtgcaactatttttttttcttcattcttgcttatctttctgatgttaccata

SEQ ID NO: 47703 - DNA, 3901 bp, Oryza sativa
gggctggtgggggagagcatagcgctgcgggtgcgctcctacggctgcatccgagtgttcctcgccctgtccctgctgctgctcgctgtcgagtttgccgcctacctccaggggtggcacctcgaggaggtggcgttgctcctcgccgtcgacggcctcttcgccgcctcctatgtcgggtggatgcgcctccgcctcaactacctcgcgccgccgctgcagttcctcactaacgcatgcgtctttctcttcatggtccagagcatcgaccatgaagggtagtatttgtgatttttgttcaagttttgtaatttcttagtatttgtgaattgtttttgttaaagtaaaaaaatcacaagagatgctcatatttggtcgatgctcatcacacaagctgaaatcacaaaataggggcaaaatcacacaaagctgaaaaaaataggggcaaaaatgcaataaccaccaagggtataaatgtcaatttttctacaactagcaccgttaaactggctattagaagtgggggtacgcggctgattcagattcaaaaggtggggtaaaactgcaaaccctaaaaaataggggtaaaacaacaattggcttcgaaagtgggggcacagatgcaattgccccataaatttttttatggaaatcggaattggagttcccaaattcggacacccaaacctcgagctagagaaaaaaaaatccatcccttgccaagacgagaaatttgtttgaaagcattgcaattaggaggggactaccgatcgggcatgcgatctagacgtacaaaaatcgggcgctgatgttagcatgatgtcagcgccacccatgcgtgcaaaaccactttaaactaattttttttcttaaattatttatccaaatcatgatccgattgcaccattaaattcgttgcaactaaatcttcaaaacaagaccacacatggatatattccgacgaattttttttagcttgttattgaaatatttttaaatgttgcacaatgttccaccaagtatatcggaattgtttcactaagtagatcgaaaatgtttcaatcgtttaaattgggcgttgtttcaccttatataaaaacaatatttcagcaaatagcgaaagaatgttttaattcactgcaacattagatctatacatagtgaaacattctgagtacactaggtgaaacatttttagtggaacaaaaaataaaacgaattcccttaatagaaggtttccaaaatatatgggtgatttgttgcaaaagaatatttcgttcactgcaacattagatctatgcatagtgaaatattgtgagcatagtgaaacattgtgagtacactgggtgaaacatttttggcggaacaaaaaataaaacgaattctcttaatagagggttttcaaaatatgtgaatgattcgttgcaaaaaaaatgtttcaattcactgcaacattagatctatacatagtgaaacatgtttggtagggacacgtggcaggtggaagcatgacaaatggtggggcccagagggcatgcgcgtcgccaaggaggggggggagcgcccgattttgctcccccgcgctggtcacccgaggcgaaggataatcatgcaaattaaatggcatattatcaaatctctacaagtgaaaagtgaaacttgatatgattctagaataagccacgtcactcagtcaataatagccgttggatctagctgaaatcattatgaaccgttggatgaaggatgaataatgggaattaaggttcctgtaaataagggactatagtgtgttcacgtgacttcttcggttggaaatatcacctgcgttttttagtctcccaccagttttacacatgcacccctataaagatcttttattttagggtcctctaaataaataatatttttacaggtaatttgctccggtccttttacgataaagatacatagtagtatttacctagaaagccattgaaatttcgtattttcaaatttcaaaagtaactactgatgcaagtcagtagcgagagttgccacttgccagccaggtggtgagattgatatacgtcaatacgtgaagtgctgggattatttactgaatatatagacagtaaactcgatataatgacatgcacatagtatcttttttttaaaataaatttgctttgacataagaatataatctttgtgatacattttacaagtttgacataatcatgactaattattgttattataataatattgcttatttcaccaggtcaaaaaaattgcttatttcatattaataaatggaacatttaaaaattaacaatgatggaggtgatgggcgtgaaaacatggtaaattattaaatgtggtcgtactattgttaactacgaatcaagataaatttgttaatgctattgctaaacctacaactcatccatgacaagtatattctaccatgctcctccttggaataagtcacgaaatcccaccgtgctactccttgaaataagtctattttgtgtcccttatctctttggttcgtgccatgccgggctggcccatcatgccgaggcagaggcctaggcatgacccaaaggtcggccatgaacccgacaccattcgggccgtgctgtgtctggaccgggccaaaaacccgtggcatggcccgggccatgccccgggctgtttggccatctatatggtcacgcgaaccgtataaactagtagtttggaataagttcatctgaggtctctttaattgtcaacgaatatgattttcgtccttcaatcggaaaccagatataacgggtctctcaactattaaaactggtgcaacataggtcctatggcagtttgtacgacggttttagctgacgtggcacttacgtagctaatttgactcggtcttaatctgacatggtattgacatggcaatttgatttggaaaataataaaaattatgactccacatgtcaattacacaaaaaaataattaaaaatggtggctcaccctcctcttcttcctcatttctcccctctcctctctccacgtgccatggggaggcagcggcgcgcggcgccctataggagacgggagaggagcggtgcgcggcgaggcgtgaggggagggaggaggcatggaggccagcaaaggccgggggtcgtgggtgggggctcgacggcgacgggcagagggagaggtgcgtagcgggtgacggacaacagagagaagggagaagggtggttaccggcaagggtgacggccggtgagagaggctcacggtggttggaaggtagaggctcacggtggccccttcctcttcctctcgtcgctgcagccgcacaacgccgtcagaccatctcgatctgcggcacatccggagttgaggaggaggatgatgacgacgctgcagtgtcccgtcccaacctcgcgcatatcttggacccgtcaccgccgcccccttcccatgctcttgtcatcttgtcctaacctcaggcagcgacaacactagggacaggagttgaggcgcgcgggtagggcgcatcgttgtccgcctctagaggcggcgtcccattggatccttggtggcagagcccgccggccgatcgtccttctcaccgctctcccccttttctacaagacgccaaggtggccgaccagcgtagcaccgtccctcatgacggccatggtcatctccatctttcacgcccgtctttgccttcctggtcggccgccacccttctccccctctgtgtgcgcttgcctgccggcgaggccgcgagggagctcgaggagaaaggatggccgggagggagagaggagaaggaagcgctgtcgtgccgtcgttcgtggatagagaggaggatgggacccactgacatgtgggtcccactatttgggctgcag

SEQ ID NO: 47704 - DNA, 3691 bp, Oryza sativa
  unsure (1)..(3691): unsure at all n locations
tgtgggcctcatatttttgttttagttttaaatttttatattttgctttcagtgccacatcaccgccatgtaggacgaggaccaagtcaaaccagaaacccagatgccacgtcagctaaaaccaccatctaaaccgctgaaagatctcgtttgtaccggttttaatagttgagtgatccgctgtacgtggttttctggttgaaggatgaaaatcagattcgttgacaagttaagggacctcaagtgaacttattccaactagtttctcgtgaaatttctctgccacgtcccgcacgagcaacggccaccccatcgaggtcagcttccgcgccgcccgcccgccggccctctccgacttcgccgtccactgccccgccctgcggctgcaagagccagccgactacccctccatggtgcccaaggccatcgccgtcgacggcgacctcttcctcttccgcatcccgatcgaccgcgtcggcaccatgtccctcactcacaacgactacttcgtctacgcggcgcggcctccccctcgccgcccgaccctagatctcctccccaacccgtcccacgacaccctgggagacagggagatcgccctactcagctgcagcggcggcgatggcggcggcgacggcgagccgtgttacgtggtggctgcgctcaggaccatccccggcagcacaaccatccacaggctgcatctctaccgctccaggccgggcggcgagcaagggagatggacctcgcggatggtgtccgtggacgaaccgccgccattgatgagggacgtggtgttccccatcccggagacgtcgcaccggcaagtgcaccacgtgacgagcaaggcgatcaggctgggatcgggcggagacggcacggtagggtgggtggacatctggcgcggcatcctcctctgcgacgtgctccacgagagccccaagctccgcgacgtgccgctgccgccgccggcgaaggggaacagccacagggccttccaaaaacaccaccgaccagtactgcgccgacatcgccgtcagccgagacaggaggttcatcaggtacgtccagatggagatcgtcacgcccaggatcatcgcgagcggcacgccaccgggcgaccgtgatcctgacccgttcctcgaatggctgcgacgtcgagaatccaacatgcatgtatgcacgtacgtgaaagattagagtaactttcctattatgtattgaatagactttgtttcgtactgataaaatttcttttttttgataaatctacaccctttaatttatattcattgtaatctaacggtgtagcttttttctctttttctccgattaatgtgggaatttctagcctccacagcgaacgtggtgccttcgttcaaagctattttaataatataatagatgattatattttgggatggagggagagaggaggggtaaaatggacctttcgcatggtccgatggcaagagtggcaaaaatggttccaatatcctgcaagcgtaaggcctcgtcgtagcgtaatactttccctttcccctacctcgtaaccgggaaactgttttaatccctcgaggggatatctcctcgttctttacatgttacttaaatggttataaaaagattaaaaaaatgggaagatgtattaacatgtgatataacactccacaaacatgtaagttcaaattcatcttgtacatctcgtaacgaaaaaaacaaattgaacagcagctagttaatgtatattcagagtcaaatttgtttttttcattgcgagatgtagaagttgaatttttacttgcatgtttgtggagtaatatatcacatattaatacatcttcttaaatttttttaatttttttcataaccatttgagtgacacgcaaacaacgagggatatcccctcgagggatcaaaatcctcttcccttcgtaaccctatcaaaccgaagatcccagatccaatcctcaccaagatcgatcaagctcctcttctgattggatcctcgattgatcggttgccatggccgccgtcgcctcctcggccgaggtccacgagggcacccggagctgcgtcctgctcaacgtccgcggctacagggcggcccgccgcgacgccaccaccgccacgtgctacacgagcaacggccatcccatcgaggtcagcttccgcgccgccctcccgccggtcctctccgacttctacgtctactgccccgccctgcagctgcaagaaccagccgattatccctccatggtgcccaaggccatcgccgtcgacggcgacctcttcctcttccgtatcccgatcgaccgcgtcggcaccatgtccctcacccacaacgactacttcgtctacatggcgcggtctccccctcaccgcccgagactggatctgctcccgaacccgtcgcacgataccctgggagacaaggagatcgccatactgagctgtgccgatggcggcgagcagtacgtggtgaccgccctcaggaccatccccggcagtaaaaccatccacaggctgcatctgtaccgctccaaaccgaacggcgagcaagggagatggacttcgcagatggtgtctgtggagggaccactgatgagggacttggtgtgccccatccctgagacggtgcacaggcaagtgcaccacgtgacgagcaaggtgatcaggctgggaacaggtgcaaatggcatggtagggtgggtggatatctggcgcggcatcctcctctgcgacgtgctccaggagagccccaagctccatgacatgccgctgcctctgccggccaagagcaacagccacagggccttcctcaacaccaccgaccagtactgcggcgacgtcgccgtcagccgagacaagagcttcatcaagtacgtcgagatggagatcgtcacgcccaagatcgtgagcgccacgccaccaggtgactgtgatcctgacccgttcctcgaatggctgcgccgtcgagaatgcaaggacctgaaacgcaccttggtccatggccgctggaaggccaccacatggaggatgccgatcccggtcacctcatgggacgattggtgccgcgactgcgctgttgaatctgccgagctcagcactgacaacccaaaggcttatgagttgctgtgtgctgtgagcaaagaaagtcttaaagaggatgatgatgataaggccatggaggcggcaacgacaaccacgacgaggttgccattgggacgcctgggcatggcttaccctgccatgagcatcgatgacgatgtcatttacgtgctgacaaaacccgtcatggggaatggcaaggcggcatttctgactgctgttgatgtgaggaggaagaaggtgctggcagtggcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 47705 - DNA, 14350 bp, Oryza sativa
  unsure (1)..(14350): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncagatgtggcacttcaagattatgatcatctccaggtgccctgtcagtattgtgttcctctttttgcacacggttttcatcctccatggaagactgtttgacttgcaggtcatcgttgatttgatcagctgttgcattacccagtgcctgagaggtgctctgctcactgtccggcacataacgaaattcggtagcactttcatcatcaatatggtgttcagcttctggttgatgatcctgcgtatcagctgagactttggcccgttctttccagtccgccattgcatctccaatgctcctaaaaggatttgtctgtttgatctgcgatggtggagtatcagtctgcaactctggcttagagttagacaataacctagagccatccccagagttgggcatagatatttccagactagggacttcattgcttgaaaaattaacagaaggagcagcagcactgttcatatcagtgctgttagccaagtttgattcagattctctgttatagtccatttcggcattatttggttgtatgccttgtgaaggatgctcaagtgactcaatattatgaagttctttctccatgttatttgtctccatctgtccatcttcagcatgctcctgctcaccatcaatctcattgtcaccatgttgagctgcatctacatcctccacatcgtctgaagcatctaaacacccatctgctgctagcttttcctcttctggactgagttcttcaccatcagcatccatttcatcaatatgttctgtcccatccatatccacatcctcagaatcatcctttggttcagggagttcaggtgctgttcgatcatcataggcatcagctttgtccattaagtcattcgtatcctgatcaacatcctcacaagtactaggatcatcctccaaattattattcttgccttgctcatcacaatctgtctccatgggatcttcttcaagagcaccttcgtcctttgctctcagttccctatcattcttctgtgtctccttggctgatgaacccgactcatacttctcagtggatctgttaggatcatcatcttcatccttatcccaagatttcttgccgaccatttcacttgcatcaccagtatcacccatctgattctccaagttcgtgtcatcatcctcatcgcctgaatcattgccttcagggtcctcagaaacatcagacagttctgcattaaaatcgtcttgcatttcaactgcatcatcatcattcttaggagcttggtctggcttacgtagagcatcctgttcaacatcacaaaaaatggttaggctctgtttttatttctattcaaactcaaaaggaagaaaaaattgaaatagagagacaaccgaggaagcattgtttgatcacactaaccatttcattagctgtcccctcaagttgggatatatcatctattttagaacttgcactctctttgccttcaccctcacccatgccagttccagttgcatcctgctgtggtccatctgaagcatcttcagttgtatcatctgtggaaccaaagccttccgcaaatagatgaatcaaaagatccccaagtgcatgagtcatttcagatgtctgaaaccatcagaaaacaggattaggaatttttctgaaactgttttcccaaaacagggaaaaagaaatgagaacaaaattgtctaagcatgaaatacttacagttctatgagcttctaaaagttcagaaagaatgccttcagctgctgataggaccagaccaagcaaagcatgaagatgcattaactgcatccctatactagaaggcaactcaggtttaatgtcgaccagcctcctctgttggtgatagatggagtcaagtaatgtagcaaatatatctaattctgtagagatgaaaagatgatgcgcaaaaagtgaaggggcataccactgaaacagtaagttttttactagcatcaaacaaatggcccatttgaaggttcatgacatatgtctgcaaaatatctttccacaaagtaatatttccttccaatgaatcatgagttccatcggtggatattccctgatcagtgagctttccaacaacaccaacagccagtgaaaagatttccttaaaagcttctgcatatgaagcttcaagattgtgtaggacatcggaggatagcatatgcttgtcttcatcaacttttctggataaaatcgccattggtgaattcccctgcaacaggaatgcatgtttaagcaccaaaatatccagaaaacagacaagaaataaaaggtaaataaaagcattttgcaaaaaaaaagtatgtgtaaagtgcatagaattgccataaaatatagggtataattgcgaccagccactcctaaaagaatacagtagattaaagaagctatgaagttttctgtgacattattttgtgggatctatagcttccatgtccagtaataaagtgaacattagtgtgtgttacagtcttagcatcagaatacaagaattctacatatgttaagatctctatacatataagaacataccttctccagcaactcttcaaaccgagagagcagaactttcttaacagatctcatcgaaacatcctggtggcatagaacttggatatcctccctaaacatgctgataagctggcaatttgcagcaacaagttgctccatctctcttgtagcaagaggcatattcttgtgtgagccagcgatcatataattggatccgagtaagtatttgtctaacaagtcctgcaaaatagaatagagttactagtcacatattgcttaagtttgcatagcaatggtattcagggccttgcttgataaaggtgtagcttctccaataagcaacttgaagtgtcttaacgccaacttatttgaagcttctactggaaatagagcttattattcttggaccagaccacaaatacaagccccatgtctcagagatcataggagtggtcaaacaggaccaataagaaggcagaaatgaacaggtttaccttagattcagaaaatcttgcgatgaacttttcaaaaagcgttgacattgcagaaacttctacttggatgttgtcacaaggatcatgatgacaatcgatgaagcttctgagcagcaagttggtatccatggtcgtagccagtatgttgtcaaaaaattgctacataaaaatgcaaaaaggatacatcaaactataaaccccaattacccaaataactgtaagactttcatactgcaaaccttaccttttgctgccacatggaattcagcagtacactttggcatgacgaaaggtagtcactatcacctacaaaggatttgtaaaagttactacatggatttcaaaacaagaaaaggaatgtacagatcacaaaataagtacctccagaacctaacaacaaaattgcatgccgaaactcattcaattgctcaaacatattgtaagcaaaatgtctttgttcagacatgatggataaaagatgatccataaaagatgtagccctattaacctgcaaattttcaaacaataaatgccaatttgatactataatcactaagtacattaatactagaaggaagactaacctcttctaaaccaagatctttgttaaatttcaaggaaatttgtcgaagttgttgcatcattgccaaacatttgaagtactgctgatttgcatttttccagttatttgtgctcaagagggtagcatgagcaacgctagcatcttcaggcattttcttcgagatcacttgctggagcaaatgtgtcgtgatatacgactgctctaaaaatgggcttggtgcagccaactcgtttccctgtattattttcaatttcttacgtaaatgtgcacttgacaacaagtggggaatgaagacaagctttttgacaagtaatatacctcacgacccattggtctgtgcttcgataatccacattcctcaagtgtcttgaacaaattggatagagcagttttcttctggttcttcttaccacttttcagtatagaaccaaaatcagctgcattgcaaatccgctcaattgcagcccaaaagaaatacaatctgtcctcaagttcactttcagcttgttggcagtttgtattgtggaaaactacacgcgcaaactctgtcaaaaaaaattcagaatctcattatggaagataaaaaggagaaaatgattaacaaaattacaattttgacacgcgagaaagagagagagagagagagagagagagagagagagagagagagagagagagagagagagagagggtgcagcctagaccttcattatgaactccaatatcagtagcatttgtatgttgtaaagcttgaaatgacaatttggcctgatttgcccacttagtgtaccacaaaaacctggcacaatgaacatagtagattaagtagatgatataggtggttaaaaaatttccatactcttaaagccttaatgggacaaccttccgctaagtttcccaaggtcaacaggaaactctgattcaggcatctgttgatcaagccaacatggaacttttcttgccacagattcttgatttagcaggaccatcacaggtttttgcaaaatatcctataaaagcagaatatccaattaaatgcatttttctaaacagttaatgaatgcccacatcaataataaacactaaacacttcaggtaactttctggtaacttacatgattgctattagtaacaaactataccataaagagagatttaaaatttgggccagtcaactagagattttatggcaacaattacaacatgtgatggcaattatctagaaaaactgatagcaattatgaatcatgtatcagttagtgcttcctttcacataaaaaaaaaagactaaacaatcaccacatacattgaaacactgcagaagcttaaaaactttttgcctcgtcctcttgaaattctcaatagaagcactgtgtggatcttgctcccaacggtaaagcttgacctgatctttcaagtccttttctattgatcctttaccaccttcaatttccccaagaacactgatgtcatgaaaacgttagttataacccaccatgaagaaatgaacaaggaaaaacttcacataaatcacgaaaagcaactcacagtggcaagaactgcatgtagtacccaaacatgttgtacagaatattctggattttcttcaacgagttactgtcaagaaacataaagtcagaaaatgatgcccattttcaaaacaaagcacacccagttttcagaacagtgaaaaattataatgggcaattcaaaatgaaattaacaatcatgctgtactaaacaaagtggaacaagactcttgatctcaccttgaataagcaccaacaccagcaccatcagaaagttcaccatggaaggccagtaggagatgcaaccttctcttgaattcaccaatgcttgatgtttgaacaaactcctcaacactaaatttaggttcaacaatacattagaaaatatacagagagccaaatagagagagcaaacacggatggacaccttttgattatagatatttcctcgttctttgaaatatcacaggattgtgtgagtaatgctcgcaatggaaaccatagctgcacacacccaagaatattctgtcagccaaaaatcaagcaaaaataaattattaacaaatgtatattcatagtagaactcacttttagagcattgctctcgtacttctccagcacctcctgaagtagtataggccaacattctaactcaagcctttgccatgaagacacaatgatgaataattgtggaagatggtctgtggagaaaaagaaaattaataatcttatttgtaatttgtcaaatttgataatcaactatgtttgatgagttatctattttgtaacagtagggttctttgtaatttctgtcccttttgtgtttcatgagggctcggtcaactgtacttctggaatttattaatagcaccaaatcttttttattacaaccctatttactgaatacctccatccggtcataaatatttgacatataggacaagatacagtcaacttttgaaattttatatttgaataattttataaaatttagtgagtctatgatattatgatagtgctttcaaggcaaatatacgcataccatttttttgttttgtttttaaactaagcgtttgaaaatttattgatggtcaaagtttcaaaagtttgaccaaatcttatcatctacatcaaatattgtatgtttagtccttgactactggtcttgttaaaaaaagatgatattttaagacttccaaggggtctaaatctgaactagaggtctagagcagctgttgtaaatagaaagtaaagtgggaagtgtgtgtgttattctcggggacatgagatcaataaaactttcaaattcagcacagtaatcactaatcagcattctatgttttatactcctgccacctgagcaacagagattagaaaaaagatgctaaatatactgcaaggctccaagtcctgctaaaataggttactcaagattcagcactaccttttaagaagaacttggagtcattttcttgcaatgtttgtgcttttccaaccaaaagttgcaatccaagtaataccttcaagaataagaaatttgtgtgataattagttgcaatccaaataagttatatacaaacaaaaacattttatggataccagacctttgaaagtggagtgctcaggggaattgccaaaagggaagtaattatgtctaatattttcagaagacctggatgaccaggccactcgtccaaaaagtatctaactttttcttgaagtgcagtcaatggctcaaccattttgaacaatatagaagggtttggatcctgcaaaaggttatcagatatgctagtaacaattgggcatcaaacgtacagcttggaatatcctgtaccttgtaagcgttataggtgttgcattctaaagatggtgcacaagtttgtcgatattccagacaaacacgaagtagatgctcaggcatgagtttctcatcaaatgttgaagatgtcaattctggcaagtctgaaaaaataatcataaaatactgcaaatcaaaatacagaactattttcttgcaagtcaaaatactgcactgcttgaaatgacatggtacgttacccttcagaattcttgctcccagttgatatgagtccataaaagattgaattttcaggtcatcactaatttggcatttactaggctgaaataaattcaaaagaaaaactaccaattagctatgtacagaacaacactaaagcaattattgaacaacagctccttaaacaatactaaagcaattattgaacaacagttccttttttatccttcttttttctaatagatctgagagaaatatgctgtgccagaatgtatagcgttatttttgtttctcgatcctcatggacatccaaaaattacaaattatagtgccatacatatgattatgagttcaagaagttcacagaagatcatctctttctcctgtcactatttaccttctcaacaaggtctggcgaaccaaataactggttatgtattgttacaatacatttcagaatagattctggtatgagatcccacgagtcttcaacagcactatttttctcatcagttctctcctgaaataaacaggaatacggggttgatacataaaagtgaaaagaaataaaggcattggaagagaatcctcaaacatatgataccataattttaagaaaatcctgctctaacttttcttcagtatctgctacagcattgccttctgcatccatatctgaaagtgatggcacgtctcctttaaagatatcatgtatatcaatgatacgggacctgaacttgtaatactgtgaatcatcattttccctggccttcaaactagatttcatgtcaacccacatgcttgtaaactggtcaaatgtttcctttagcgactgcaaagacaaacaggtaaaagatcacacatttcctttcaagtaattgtgaaaatgagaatgagtacataccagataagatgttttatccaggataagggaatagcagacacggtatgttgtccgtactaaagaaatatgatggattgatactagcatctgagagtgagacctctgtaatgagtgcaaaaaggcattatgaaaagcttgaatctctacatttgaataactaacgagacagcatgaattgaaataagaagggaaacacttccatttcactaaccaatttgtcagccacttcaccaacatgcaattgactcgacacagcagctagcttcttcaacatagcaaggtcactgacctcattgtagcgaatttccagttgatcatcatttacatatttcgttaaatcgggcatgtccactgaaacattgccagtagcagatccacttggaaattgcataatagcaaaaattgcaccctgcagcaaagaaaaagattaaagtagcaccgtcagcatcattgaggactgtgcacattctctgtcactaatcaaggaaagtacaatctgtttttacagtgtatatgtattacacatatggaaacaaaatagcatgaagtttatttattactatcagctactgtttgatgacacagatacaaatctggtcaaaagaagtgcaccactaagtatgattcaaacatagctgcaacacataccagagctcgttcaatatcatcttctttaatcttcttcaaatattccctctcaagataaccagacagagcaattgccaacccaagtttcatttcatatacagcaacttgaattggttgaatcaaatcaacatattccacatactcctctgtcagtctcttgatgaaatttctggatgttatctgccacagcacgattatagggccaatcaatataattgagcgataactgccactagaacaaaataatccagctagaagacaaataaaccagtcccaacaaacctaacctgccaattgcagactctatcaatctctaattgcccaactccatcaccatttaaactagtcaacagagacttgcattcagacaatcgttcctcaaactcacagcatgccacaatcaggctcttatgcctagattgtggaggtcgaaatacaacctgcaaaaagtgagtaaggatatatagttatcaaaacaataacagattacgtaaggaaaataataaccaggtctgtagtttatattaatacatattgagtactaacacctgttgaacggctgtcttgcccaataggcaagctcaatgatctaaaggtaggatcaccaacagaacaaaatatgtctataactaacattgaacatacccacctagaacagaacagagccacagatactgataactacagattgctatgacatttttaggagtcctgagaagattcatcaagggtgtgtttagttcacaccaaaattggaagtttggttgaaattgaaacgatgtgacggaaaagttggaagtttatgtgtgtaggaaagttttgatgtgatggaaaagttggaagtttgaagaaaaagtttggaactaaacaagggccaagttgctgcattcatattcaaaacattaatatagcatattaaattattatgtcccattctttgcttgtgtctcgacattaacatatgcctgttctcaacaattgttggaataaccagtgaaagaaatactagcagcttggaagaaccatcatgaactttagaaatagtatcataggatggggaatatttaaaacttcaaattatgtattaagcaatggattagcatatatacctttgcccggatgctcttctcttttgttttgagttcttgcaataacttctgatcatacccatcttcctcagagctagacccagccaattcctcacactgatgacgaacctattacacaacaactcacagaataattagccaggctttatcttacaaatcttactagttgtgatttttttcgtccaagataacagactaagatacagtaccacagttaacattgtactactaccattctcaaatagatgtcatttttaagaatgtgtccacccaaatcttaaaattagatttgtcatgtgaaaatgacaatagtatatctcatgaaaaacacttgtttatgccaccaaaatattttgttaatataagataaaggcaaagtgaaggtcagatattgttaatatcctaattaacacaagtaaaaaagaaaggagaaaacagtttacatgccacagcattctatgtagcatgttaattcattcattatgcacccaagaaataagagaccgttcacctttccctcaagctccagtagtgaaatcttttccagaatatgagagtgcatgaaagcggattcgaatgcaggatctggattatatgagctcaacaataaccggaagcgcaactctccaatgtacacccaagcagccccaagatgcatcaaataacctgcatgccacaaaaggttaaaataagcatgcaccgttcagttgaaataaacaaaaactcagggaaaaatcaaagcaaaagtcaaaaccacagtgcctattggaacaaacaaagactaaaaaacaaagaagaaaagcataagaagaaataccacgcaatagaccattcatagtacaacagcagggtaaggaaaaacaagtgcataggatttgtcatagccatgctacatctaaatgctgtcagcaatgtctccagatatcacaatgtcaaaaagttaactagaatacattagcttcaatttcgaaagtcaaacaaaatatgatattagtatctacacaattttagattctgttcagggagaccataatggctaacaagctatgaaatggagattcaatcattcattgagaagagataaaaaagaacacaccctgtgagaacggtgagtgcaattccagaagtaaggaccctattagctcatgcgagccagcgagtgaagccaatactccatgacttgaacgtgataacagcgcacaggcagtgtcaagatcttctttctgcaacagaacaagacagaccatgaaaatacgaaccaccagcaaagaaagcttaaaagcgaaacagataacttgttaaacaatactgctgtccacaaagatgctgcaatggtcagagtggaaattgttcacagaaaagaagaaataacaagacaaaaatgtcactatggaatacatttatgggctgtctggtttgaggtttgagatgattcattgaccatttgatcctaaatagtttgtttggtctgaggaatggaatagactgatccatcatcacctcatccctcaaacgtacatactaggtgaagcaatgagtggagccatcccaccgtatttgaggaatgatcccacaatgggtcatcatcctagatgctttggtacctcaaacataactgcctcttaaaaaatagcttgttgatcacttgattaagttcatatatgactacaaaacacagttacaaagatatctgattataagttgactaagaactgaagcaaccaccatacaaatgtattaagctatccttgtttcctagtttgggaactgcactcatctgtagcattgtgagggttatattttgtcatatgtggcactgtgtctgttcaaagtgactatgttatttgtcattttagcttcacatacacacaaatatctactaacagatgcacaggaaatcaaggttacagttgtcaatccttacaaactaatacgtccagaactttccaaaacagaacttaacatgttccaacaaagcttcagtccccttaaaatgaacaagaatatattgatttctacatgacttagagctaaagaggtgggacagattaaaaacaagaatataatagcatgcaatttgcaaaaacatgtggtacatgagatctaaaatcacgtcagaagaatgacgcacaaacctttacacgatgttcagactgttggaagaggatggactctaacttgctatactcttcttgcttgaaatgcttcttatggacaactatgatctgcaaataggacatcagaatatatattccaaagggtgcatcaacacaaacacagattaatggactgatacctgtttaaagagggaatcagcagcagaatgtagactaagaacaaagtttcccgcaaacgagacaccttcccagaggtttcttgatgaaattcgaagcactaaacggttcttctgataatccatcacacgtaaatcctcttgactgcagaaacggagggtattaagagaattctttgcaattggtatcccttaaggcagaaacatctcagcagcccagaaggaaggagcagagaaatacaatagcaatcaaaaggaaagatcccttcactgtttctagcacaaagggaaaaaatggacgaaaataaaactcatcatacaggatggtatcgattgcatccatttttgtcaggtgtgcaaggtcgcaggtttcatcatgggtaactgagaactgaacctgaaaatggggctaatcagataacaaaggaatcatgaaatctccatataactctggaactgtatgaagagtcttgcgaggaaaaaccttggtctcccagagcaatatgtccacaaaaaagtatggtagttgtaccacatttcaagaatagaactagcaacttttacatgcactgcagaacattcgagtgccaacttgtaagctaaaacaaaaacaaattgatatgttctaatcaaaatgcagagatcatcttttaccgttatcaactgtggcccaagcatgatgaatccaccaaatgatctgatgttgagtaaactcaaagggagatcttgaagatgatcccaattggaagtccatagcatacttgagcatatattcaatgtttgcaataatctgtgtcataagagaaaattactaggcaaatatgcatgccacaaaatctgaagggcagttgttgcagatgaagtaccaacaacatgatacatgagatgattgcagatcaacaaattctataagctaaaatccgaatacagtttaacaacacagagacacacatactaacatagggaaagggggaggacctgatgagattcagaggagtccaattgtgcacacttggatagccgttgcagtaacacagtatccaggttcaggctcttcaagttgagcaaaggaagacttgctacccaaccatggaaaccgtgcatgttacataaaacatctgatgagacagagcaacagaattttacttcagtagttgaagccttggacaaaaattcaagatttttcttctcccagtcaaccttctcaacaagcctctgcataaagaaaatgcagtaagtcaataaattttaggggggtaacatatcatataacattacaccgagtacaaaagaaccttgtgaacttcatccaactgggccaatactgttgaatcttcttcctcggtgatagttgcagcaagagaagccatagaaagaccttggcataaagttaaaaacagtaataagaaaccaaagttaagtaatgaaatgcagctcttctgcgttttcgagggaaaaaagaaaccaaagctaacactgcaaaattaaataaaaatgcacttcgagcatttaagtgtgcttccactgctttgaagcattcgagcaatacagattaaaaatagaccacaaaaaagaactctacaaacacagaagctgcctctgaatacaggcttatagaagcaattccaatgtacagcctcaaaaagatctgttggacaaatataagagtaccttccatcgcaaggtttctaagatcctgattggctgacaacatagcatcaacgaagtgttggttgtctgcaatcaacaagatgattagatctggaagatttataaatgttctgatccataatatataatttaccatcaaaatgtcccttcagaagattcttccttggccaaacagctgcagaaaatgctaagatgtcttggattttgtagaagattctaccagatgatggtacaatagggtggccaccataaacccacaaagttggtttgtcataatgtaaattgaaatcttggaggctgttgagattgacactttccatctgtataaccatgg

SEQ ID NO: 47706 - DNA, 1411 bp, Oryza sativa
aaagagtgatgtaaacagtagctacgaaaattaccataccatctatctcttcagttttgttgaatgatgtaaaatccaacaataagtattttattcacccattttacactagtacagatcattccatctgtgacggcccataacaagactggaatttgcgggctgtcacaaggaagtaatctcaatcaggccgaagtttcgcccgattgagatatggtcgcacagccatggtatacaggcataaaactaaagcccatcacggatgacacttatctgtgacgggccatagttgaggcccgattgagatgagggttccatatctcaatcgggccctaaaagaagcccgtcacagatgagggtcatctgtgacgggctccaactagaggcccgattgagataagtttaatgcccgtcacagatgacactcttttttgacgggcttttattaaggcccgatagagattacttgtatgcccgtcacggttcattgttttagggccgttacagatatttgttgcacagtataaatacccccccaccacctagtgtaactgtatcccactgttcactattttagtgggaggctgtagggggcgattttttgtcttttttccaaggaaaacagaaaattcccaaaagtgatcaaaatagatctatcaagtgagtaatattaatcattaattgagcaatttcatcacgtcttacttttgtaatactgatcttataagatgtgcatgtaatttgtttttttattttgtaacaattgatcgaagttggatgtatgcgaaaaatttgaaacgtcattctacggagtacagaaagggcgtaataaattttatgaacgccgcggaggaggatcggaaaagaagaaacagtgattatatgtgttgtccatgtgcagattgcaagaatgagaataagtttgatagcggagaggacgtacacggtcatctgatacaacgaggattcatgaagggctatacatgttgggggaagcatggagagtaagaatcaggaaatagagcagcagcagacagaagtggtgcgcataatcaagaagatgaagatgagcatgacatgtttaaaccttctccattgggcggtgaaatggttgatgtggatcacgatctactgcaagacatgttacgtgacgttgaggacctagcccagaatgagagagatggaatgaagttcagcaggttggtcgtgattccgagacgcctctgtacgctggatgcaaagcaaaacacactaagttgtcagttaccttggacctaatgaagctgaaggcaagtagtggatggacagacaagaatttcacagatcttttaggaattttgaagtctatgcttcctgttgagaacacattgcccgagacgacatacgaagcaaagcaggttctgtgtccact

SEQ ID NO: 47707 - DNA, 7401 bp, Oryza sativa
acatacacgaggccggtggctgaagaaatcatgaaagatggtatacatgggtcatcggaggtgtctcccgctatgtcacgcatttagaagaaagaagaaaatttttaacggtaagagagaacttcagcctggtcctaaagatttgtccggagatgaggtccaaaatatggtcaaggacataagcaatgagtttgggaagaaaagaaaacgtagcaagacaaagtagaagggtatgtggaagaaaaaatccatattttggtggctaccttactggaaagatcttgatgtccgtcattgcattgatctcatgcatgtagaaaagaatgtgtgtgagagtttggttggcctgatgttgaatattcccaagaagacaaaggacgggttgaacacgcgtcttgatctacaggacatgaatattcgcagtgaactccagcccatacgagatgcaaagacaggtagagtgtgtcatggttatggatatcacatacctaatagtagttgactaaatctcggcaggacccaccacataccatgtcctatacggaaaccgacttcagatatggagggagttccggataaggaaagacaaccagagttctacatggaaacgacaaggactactcggattgtatccatattggtttccctagttctacttggataagaggacacctatgggtataaatacaagcccctaggaggatagggggacacacacggaccatgagacgatcaacacgatcgggacgaccacttcatcaacacccaacacaatcaacatacaagcctatatacgccaagacacgccgccggatatcgacttcatggataggtatggctattcccctacggtgtctctggataccgtcaggagatacgaaagcgctatctctaatcttgctgggcacggattcgaggagtaaggctaccctgttgtcgactacgagtcagaccttcagaccgacatgtcgacaatagttagataggctacccacatattgtactggtgtgattatggtgaataaaagcaactccggcttcggccaacaggatgtagggttattacctgactgctcagggacccaaacctgtataaaaatccctgtctccgtctcttttacctcagtctcgcgtatatcctagcatcaacgatccccatactgtccaaataccgtagtcgagacatcaaacatcgacagagtgtacctccctctagcctgccacacattgtcgaaggatgagaagattgcaatgttatcatgcttgaaggatattaaagttccattgggctattcagcgaggataagtaagtatgttaaattggacgatctaaaacttgttggaatgaagtctcacgattgccacgtgctaatcacacaaatcttgccagttgctatcagaggcattctaccatcgaaagtgcgtcacacgatccaacgtctatgcgccttcttcaatgcaattggacagaaggttatagatccagaagatctagatgggttgcagaccgatattgtgaataccctttgtcacctggagatgtttttcccactgtctttcttcgatataatggttcatctccctgttcatctggtgaagcaaacaaaactatgtggcccgacttttctaagggaaatgtggccgtttgaaaggtacatgggagttctgaagtcgtacgttcgtaacagagctaaacccgaggggagcatcattgaaggttacacgaccgaggaggctattgagttctgtgtcaattacatgtccgatgccgatcctatcggagttcctgcgtctcgtcacgagggaaggttgtcaggtgttggcacaatcggaaggaaaagaattaggcccgatcaagcgtcgtacgcgcaggctcattacgctgtgctccaacatatggcagaagttggcccatactttaaggagcacttagcgaaaatccgagatgagaacttggggcgatctgatgcatggattaacagagaatataattcttggttcaacgaatggttcaagaatcttgtgacaatgtccacggatgtcccaaatgagacagtatagttgttggggatgggaccgtcttgcactatagacacatggcaaggatacgatataaatggatacacattttacaccgtcaaacaagatgacaaaagcacagtgcaaaatagcggcgtccgtatagatgcattccaggatcaagttgggtcaaacacatactacggtcgcattgaagagatctgggagctaaactacgccaagttcaaggttcctttgttccactgccgttgggtgaatctacgcactggtgtcaaagccgacaaggaaggtttcactttagtagatctatcaatggtgggatacgccgatgaaccatttgtacttgcgaaacaggtcgagcagatattctacataaaagacccttcaaactagaagatgcacatcgtgagggatggaaagcgccgaattgtaggagttgacaacgtcgtcgatgaagaagaatacaaccataatcttcatgtaagacctcacattgaccttgacgatgatccccaagagcctgtggcatatgctcgttcagatcatacggaaggcataaccttgtgaccgatgcatttgtacttatctattgtaatgaatgaagtattttgttttattgttttattgcaaagacttgatatgtgtagtcattaatatggctaattttgttttattacaaatgaccaaaagaaaagttgtcgatcttgatgagaggatcaactttgttgttgaccatatttccatttgaaatcatttagtatttacaaatgttgtttatatttgtcatatattcaaatttaatttcaagctgttgggaaaaaagttatatagaaaaatgaccaaaataaaacttgtagatcttgataacctctacaattttgttgttgaccatatttcgatttgaaatcatttagtatccgaaaatgtattatgactaataaaatgaattattatacagcagctatatattttgtacgcacaaatataaagacttgtttggaaaaatggaaaaatagtcatcgttgacgggccttagttaaagcctgatagagattaatctatctctatcgagcattatcttagggctcgtcacagatgagtcatccgtgacgggcctgaatgtcatctcaatcgggcattagtatggagcccgtcaccgatgagccatctgtgacgggccctatggcaaagcccgattgagatgactcatcactctactataactagggtttctcagatcggatcgaaaatttttctaagtcccgctacagtttcccgcctccttagaaccctagcgccgccgccaactcctccttcgccaccgtcatcctcccttgccgccactgccaccgagaccgccgccgccgcctccaccgagcctgcccccgccgccgccgccaccgagcctctacaccaaccggcgtcggccttcctcgtcgtcgccgcctgcctcttcaccgacacgaacagctgcccctaccgagctcggcgacgtccttcctcatcgtcgtcgcctactcctcaccgacgcccgacgccgacctgcccgaccggcgacgccctccaccgagcccggcgccgccgccgcgaactcctcctttgccgaggccgccgccgccgccaccgaacctgccgcctccaccgagcccggtgccgcctccaccgactggcgacgccctccaccgagcccgacgccgccaccaccgagcccccctcccctccgccccgcccccccccccccccccccgcccggccgacctcaggtgagtcctccatcgcgccgctctctgctacctgcatgtggtgaatgatgaaatgtagatgttgggatgaatttagtgataaatgattttagtgattgattacatgatgatgaatagatgaaatgtggtgcattaatgaatttagtgatagatgattttagtgaaagatgattttagggattgatgatatgtggtgaacggatgatttttttgattgatgacatgttgatgaatagatggaatgtggtgcattaatgaatttagtgatagatgcatgatacgtggatgaatagatggtatgaggtgaatttatgattttaggatttgatgatatgtttaatttatttatatgtgacattcaattcattctattactgtgagatgtgcaatttagtttatttatatgcttcgtttatttataagtgacattcaattcattgtaatagattgtagcactgaattgtgtattttcgttattttgaaaaaaagaagacgatgtctcagcaaggcctgctctcaaagacgtgaggacgacctcctcacgaaagtgttgggcaacaaggaacaccgtggacggacacggggcgttgggtcttctgttccctggaagtatggatttccagactacgcgtggcagtacaagaagcagacttccaacaaggcggagaaagatgcacgccttgaagccaagatccgggcgtcgataagagctgagctgacatctgaattcaatgaaaagctcgagtcgatgagggccaagattaggcaagagatccgagaagagcaacagaacccccaggccgccgctgctgctgcgcacgaagagttaggaagtcccaccaaaaaacgcagcagttgcgcatcaactgaggtggcggaaaatccaacatcggtcgacagcgccgtcgaccacatagcggtaaaagtttcgtccacaatgcatgaaagacttaacgaatccatatgatatataatattattaaaaaattgattaatctatcgcaggaaccaacgagctgcaccctcacaattaggttgatgccgaccttcacggttccagcagccgagggacttgcgtacaagccgaccccagagacaagagtgcatggagcgcaactcaagggcggccgtgcaaaagttcaagtcgactcggtgaagtcggaatacaagctattcccactaaagtatccaccgaacgacgaggtcctctcactaggaaatgcccgtggtaccttcatccaatggcccaaggacctcattgagatcagggttacagcgaggctgtcacgcccagaaattcacgaaccagaatttctaagctgaatgtgtattaaacccctgtccaggaccagccagggtacacaaacgacaattgttgacatacagatccacgtcttacaaaaatataaaagattacaaatgcagcggaaaaagtaaaatgagctaaacttgaaagcttgacttctgcagcggggcgactccactccacaggcaatcctcgacggcagcgacgaaaccgacctcaacgagacagctccaactaggaaaatctttagctctggtgtgggggaaaagagagcaagactgagtactacccactgtactcagcaagtcataccggaagaggaggtatgatgcaggatatgtccaagggaggctaaaggttcttttgcataaagctagcatttaaaagcagtagttgaaagcagtaaaatagttgtaataattaatcaatattaaccaatcactgtccaacgctacaccacgttgcaacaggcccaaccaaccacctgaactacaccagttcaaaagctaacaaggggtgagactaatcacggtgaatctggtcgaccgcccataaccgcgggcacaactattcaaatagttttactctgatcagaggtgtacaactgtacccacaagacacagcgccaccacacgtttccatgcgccgacatgccaccacgacataccggaaagaggccgtgacatgacccttcgcataaccccctctaaccgatcgcaccacacctcagggttcgcacccgtccccagcaagcaatgggcagcccccctctcgtgccgcggtgaatccggaagccgatcaactggacaccccggccgaaccaactccatcacgcccacccttgcctgggtatgtcggctagaggaaagctacactacaagcccagccgttgcccacgctggcttgtggtaagcacgataaattcttctagggtttcccgcgaaccggtccttaatcgccatgggcacgactagcaaaaaccatgcacccacagcccaccatgtagtgtattttaattaactaacaccattacggtgccactaatccaaagctataccaataatcaaagtctatgcattaatgtaattcccccattgtgtactagttgaactaagcatggctaagcaatccctaattcaacatctaatcattttgatacccaagttatcaatggcataaggtaaccaatatatggctgagtagtaggacccatcccacatgatactataaaataatgcaacatttaatagaaatgcgggacatttgtaaattgggtacaacatgatcaattgtaatgcatgacttgccttgctctcgcactgatgagaccacaacaacgtattcgaggaaccgtggatcgacgaaacggctgaaatctacgtgacaaacaaagcacacaagcaaaatatgctataagtctactgaaacaggaaacaaaaccatttttaatggattctatacatttttatgaatttactgagacttgaatggacttaattggagctcggatgaattagatataaattttagaagattaaatgtgtttttactataaaagaaaaggccttaatggatttcattgcgcaacaaaggtccctgctgacatcatcagggggggtggtgccgacatgcgggacccacgggtcaccggcacaagaggaggaggaggtggcaccgactttgggtgggccccaccgggcagtggctcaaggggagggggaggcgcccagtcggctcggctcggcttcaaaccggccggccggccggttaggcgttgcggtggcggcaagcggccactgacggcggcaaccggcgagaagacggtggcggccggcggcgcgggcggcggcgcatcgcgacgacgcgtatgcggggagcggcggcacgcgcgagaggaaggaaaggggagagaggtgccggcctggctcggtttggcttcaaagccgaccgacggccatggcgaccgtcggcggcgcgcgcggtcgccggcgacggcaaccggcggcgcgggcggtgtgaaagacggcggcgaccggcgcgaagggcggcgacgcacggcgtggcccggcactaggagagagagaggaaggaaacagagggggagggcacctcaccgtgagttggccggcgtgggggaagacggctgcgaatggtgacggcgagcaaccggggaacgacggcgatgggcggacgagcttcaagacctcctagggaacaaaatgggagggattagagggagaggggtggtccacggcgggcggaaaccatggccgaaatcggcggcagtggtgg

SEQ ID NO: 47708 - DNA, 5733 bp, Oryza sativa
tgggacccacgggcccacctgtcggcgagagggagagaggaggccggttgggggaggagaaatagactttagggggggaaagagcagagggggctgagggaggggaggacttgggccaagcccgaaaggaaggaaggggaatttatttgcttttctttttatttaaattgatttagtgaactttgtggcattaaaattatttcttgagctccgaaaattcacggaaaaatctagagagtgtattagggcacagagaatattacaaaatattcccggccaatgatttttaaaggaaaattttaattctccaattatttcacttaattatattgatttaacttttatttaatttctagaaaatgcattatttaatgatttttaatcctgaacgaaaatcggggcgttacaaaggccaaccactacaccaggcggtcgtctaccaaagagacccgcctctgctccttcagcccctcttgctcaagatcgtcatgcacaatcttacgatgtgcagttgcagtacgacacggattttggggaggaccgaacggaggccgacagcaaggcgattcatgaacccccaccgatgaagaagagcaggaaggcacactcttcccctcagagaattactctcgataaacccgaagcaaaggggagaggaaggggaggaaaggtgcagtcctcgcttctagctccaaggaagctagatctgggcaagggccaggaagagactaagggcaaagaggtcaagaagaaatacgtcgctccacaggacttccaactaggcatgccattggttggagatgatgtgcttgccgcaatgggcaccgcttgcaaggaccttcacgcatactacatggagaaatctaacgctaggaagccgaataaagctaccgatatccttggagagcacgatggaaagccattccttggtccaacaaattatatcgtcgtcgacttcaaggatctatttgacctctgcaggctccgagcggtggacacaagcctccttaagtgctactccttgtaagtattgtcgcccaactcaatctggtaataacaatcggattaactcgcttacaagatcgtttatcctgtgtgtaggttaagttggcaatggtgttagaagaatgcaccggaagttgccttccttgatccacaagtggtcactgtcacaaatctccagaatgaccgtcaaggaatggtcaactacatctacgacaccttgtggtcccgccaagacaaggagtacattatgtacgcctataatcaatagtaagtgtgttatctaaatatacacaacagcatgacacattccttcagtacttaattaactttcactatattaatgccgcagtgcccattggatccttctggtcataacacctaagtggagtacatgtcactacttgaactccagaattgataagaacgcatatgattggaccccaatttaactagcgatagatgaagcgtgggcccaatacgtgcaaagaggaggcctcaggaagacaggacatgacaccctcatccacaaaaaggatttcccggtgaagcaacaaataggtgaccagtgcggattccatgtgtgccacaacatgcgccttctgtacagagaaaaggtgaagactttggctaagtttgaggtcggtggtctcaattgtgatagactaactacattttagtacttatatatgatcgatcaactaatctggaattatgacaatgtagggcacaataaccaagtctctacctaccagctttgaggaggttcgtgagaagatagccagcttcatcctccgcgaaataattaaccccaaaggaatgtttaggcttaaactaaaatgatgaacaatgttgaacttttatgtttaggcaatgatgaacacttattatgcaactgtgatgatgtaactgtgatgcttatatttatgtatatatttcatatgtttatgttaagacttgctaaataaatatttgatccaattaactcggttttgcaggtgaaatatgataaatatttgaatggatgtgaaatatgtgaatggatgtgaaatatgagatggctatgaatgtgtggttgtgtgaaatatattgatgtctgtgtatgtgaatgcatatgtatatgaatgggtgatgctggggagctggggatattggatatctgtatttgtttctatcatttctgcagcgggcatggctagcaaaggcctgaggctagccaaaaaacaaaattttttttttttttgtagattatagtcatctgtgacgggccataactaaatgcccgattgaggtcagtagtcatctgtgacgggctctagtttaggcccgattgaggttagcggtcatctatgacgggctctagtttaggcccgattgagatgagtatcatctgtgacgggctctagtttaggcccgataaaggttagtagtcatctgtgacgggcgctaattgtggcccgattgagataggtcatctgtgacgggctatagtttgactggtcgtctgggtcaaaactatcggtgacgggctttacttagggcccgattgagatagattcatccgtgatggccgttttcccgattgagataactcttcacatcagtgacttctagcctgtgacgggacgctgtgcccgattgagatggggcttaccacccgattgagatgagggtatccgttctagtgttatcaaactacaccatacattaggagttcaacagtggccacggcagattatgcgaaactacatacttccttaaaaaggcgaaaccaaaaagtggccatgaacagaaaacattctatagtatcagtgcaaccaagaaatacagatggaccagcatgcaattcattttgctataaccaaatcacattgaagggcacattgaacaattacgaaattttttaaaatttcctatatgtctagagaatgtggaatcaggatagaaatgtcagcgagatatatggtaacaagtcttcaataataccattattgggtggcaaattctcaagttgacctttcgacaactacaccggaacatatgatttccaagataagttaacaaagaatttataacgtaacagaatctataggcatggtcaaacaaaaataaatcatatagtagacaagcaattcaaacggcatttttcatcatcaaatagcactaactggcaggtcgaagaataaaggaagtaacaacaagatcgacaagctccagaactagatattgacaaagaaccttcatcagaaaattaactcgcacaaatttaacaatgagttactactaaatgcgattcattcatagcatgcatgcctcacatagtctcaatgaagggcggcattaacagatcaggatcagggctacatagctagtcaattaccaagtagatataactgatacgaactgatagacacaaatagatacacaagtgctgcaactgcaagatattaggggcataaagataagctggaaacaacatagtttgctgatcagatagaaatcacggtagctgatactagctaatactacatactaatcgatccatagataatagagataggtaagggccagctgaatctatcattatcctgcagccaaagtcagtcttgtactccaccatctgtgatcacagcgagcgatagcaatttgggtcgttgaagtcgtcccagtcagcgcagacgacgtcgctccagtcgatagcggcccatccttccttgagctgagcctgcatttcggcctaatcggtgtagtagctctcgtccaccatgtagcagccattctcctcaacttcgcggcggacctcgtcctggaattcctcgaagctgtcctcgaactccttgcccatggcagccatctcctcatgcagctggcgctgctccggcgagagaagcgcccagtggacgtcgtcggggcagggggatggctccctcttccacgccaggatgaagtcgacctccgcctgcggcaagggctccttcacaagtggcttctcgctgtcttcacctgctgcagtaccactggaggccgccattgccgcatcggcaaacgttgctgcaaccgccgccttcgcagccgcgcctcctccccctcggtctccatgtgcttgatgcccatgccctgctgcttcaacgccaccgccatcggaatctgattcgccttgccggagatgtggaggacgtacgaatgagcaagatgaggcggcggcggccgatttataggggacgcaaatcctagtaggaatcgaactcggtctcgggatggctgttttttagtcggagtcggaatcgagtccggctcgatcggcctctctccgtaattgggccaggcctatcctcccgcggaatttaacccgtgggaataagttcatccgaggtcccttaacttgtcaaggaatctgattttcatgcttcaaccgtgagttcctcaattatcaaaaccagtgcaatataggtcccatgatagtttggactcggtcttcatctgacgtggcataagatgtaaaatttaacacttttaaaattataaaacaaaatatatgagttggtcaaataataaaattaataagacaaattttgctacaggacatcgtgaagcctacggacaccgcacgaagtgacttttggggaagacactctcaaaatatatggatatttgctggtggaaaccgcacgcattaaattaataatttccaggtggaaaggagagagaaatcgcgtgaaatatcgaaagtgcccttggacccacatgtcagctctgctattccccactctctcaggcggcagcaacatggaacggcgacggcgatgaggaacccgcggaccggcggcggcggcggcggcatgaggctcgggtgtcgctgcggcatccccgcacgcgttcctccttgctacggcctccactcgggtgacacggcgagcatccccgcgcgcgttcctcctcgtcgccgtcacaagcgaaggtggcgctgtggcgttccacaccttgctactgggatcccacactaggcgctggatcacgccggcctcactcaacacaggcgggagaagggggcggtggcagcggtgaagacgtgggtaatctcgtcgggcatattatttattaaaaaatgtgagacccacctgtcatactctcttcccctcttcctctctctcttctctctctcgcgggtctcgcggcggcaggtgttcggtgccgcgagacacggagcgggcggctgcggtgaactccagctgaggcggcggcggctacggctgcgtttgcactaatggataatctcgttactgataggcgatgatggcggagtcgcgtgcggcacggtcctgcgcgcgcggcagcctcgcgacggctgcggctgcatctgcgctgatggacagccttgtaactgatacttcctccattccaaaatataaggcataaccaccataacccaaagaccaagaaaataattattatcatcttatagtttggatcatcctaataaatacaatgcatgcatccaatagaattagagaacatgagagtggaggatttaaaaaagtaataatttaatggagaaggggtcatagttaatcgtctacatgcatgcatgccttatattatggaacatctaaagaagtggttgtgccttatattatggaatggaggaagtattaccgtttgtttttaaaaacaaaaataaaaggcgcctgatttgtcgataatgattacaaccaggcgcccgacgcgggggga

SEQ ID NO: 47709 - DNA, 2139 bp, Oryza sativa
gctccccccgcgcggccctcccccacacgcctgcatatatgctactgggccccaccatagtgcctgccccacctgcaattgcaacaaatcaaccacatattttgaaaaccctctattaaaggaatttggtttattttttgttccaccaaaaatgtttcacctagtgtactcacaatgttttactatgtatagatctaatattgcagtgaactgaaatattccattgcaacaaaaaacccacatattttggaaaccctctattaagggaattcgttttatttttttttcaccgaaaaatgtttcacctaatgtacacacaatgtttcactatgtatagatcaaatattgcagtgaactgaaacattctttcgctatttgctgaaacattgtttttatataaggtgaaacaacacccggtttaaacgagtgaaacattttcgatctacttagtgaaacaattccgatatacctggtggaacatcgtgcaacatttaaaaaaaattcaataataagctaatttttttttcgtcggaatatatccatgtgtggtcttgttttgaagatttaattgcaataaatttaatgttgcaatcagatcatgatttggataagtaatttaagataaaaataagtttaaagtagttttgcacgtaaatcgggtgctgacgtcatgctgacgtcagcgcacgattttttaaagatttttatcgggcgaccgatccctagtcatccccctgatttgtttaaaaataaaagacataagttagttcctgtttttcagttagcgttttcttgtgactaagatctcgctgatcgatcgtgggatggcgcggtcaagtgcgcgattttggtatgtgtttccgttttgtaacaaactcctagagttcggagtataaataagagatgagaaccgggaaaagctgctaagtcgttcgctgcaccaaaaaaccctgtgttttgctctgtttcagtttcgtcagagttcttcagttctctgtagctgttcgacaacctaaagaaacaacgagtttttcagtgaagtccaattagagagcaggtgagattcgagtgctaggttagccaattccaacatgcaccatggcgtgcgcgtcctccccggcaaacgtctccgacgtgttcgggcgtggcgggcttgtccttggccggcgccgtctgcgccgaccacccccgccccgcgtccgcactgcggcggcttcttgctccctcctcccgccacctgctgctgcttcgccggttgtctaggtcagagaggacggggaaaagcggcgaaggttgaggacgaggtgcgtgatgcgccgaggcggtcgttcttcgcgtggccggcgggcacgacgaggagaagaacgcgctgcagtccacggtcgcgtacgacgccgaggccgacgcatgggtgccgctcccggacatggcgacggagcgggacgaggccagggggctctgcgtcagtggcatgttcgtcgtcgtcgttgtcggcggagacggagctcgctcgggcagccacgacggcgccgcctctgccatgcacgccttgctcctcgccgccgcctccaccatgtacggcgtcggcgggcggcggcggcagcggcgtcaacacgccctccacggcatccgcccggcggcgcaaccacgaggatgaagacgacaacgatgacgagtagtccggcgaggggcgcgtcgtcgaggcctgggcaaggggcccggatgagtccgtctccgctgccgaccgtccgggtgagctccgcctccgccgtgcaggccttgcgtggttgcgccagcgagagagaaggtatgacatgtgggtcccaccattattgtaaaagaaaatgctgactgggttgtcacgcgtacaccacataggataaaactgccctggatttggtcgagggggtattttgtccggtataaaaagttcggggttagtgatatctgattttcgtgtccagggagtaattcggttgaccgcgatagttcgggaggtaattcgtactttttttcctaactattggagtaatactttttatgtcatattggtcccaacacaccataaatcatatttttgtcatttgaagtttatagagcgcacattgtgttttcttttttttttcactatttctatgg

SEQ ID NO: 47710 - DNA, 6987 bp, Oryza sativa
acctcgacatacttttttattagaccggagcaaatctcggagaaaaaagaactcaacggacaacgggagcccatatatgcttatcttttcattgaaagaaaatcatacggttatatgccctattcccgcacaatagacacatgtgctctctttgaagtccagcacaatggcgacgtatatgaatagtacgaatggaaggtatcgggtgcttaaatcactagatttcgttgcatacttgctctcttgctgccggacaaatatcacacagctgagcaaggagcaattgccaagacggaaattgttgttgtcagacatcatagagcgatggaaatctagtagctcatgaagagcatattgtccccagcaatgtgtgcacaagtgcacaacacttgggcatgcgcaacgtcggattgtatgtaccggttagacaaaggggttgccacatgccaaccagtattaatgtagcttttttccaataatgagatcagcattttcagtctgtttggtcctttgccattgtttgccttgccaattttgggcagtggcgagatttataatttaccaaaattttgggaaaggcgcttgttttagattattaattgcttccaaatttttattcaatgtctatgccaaacttaattagccaatttggtaatgataaagttttgctagaaatcaatggtagagagagtatacggcaatcccaaatgtatttgatatgatttagtttggctaagatccaaaaaatctcattccgtgtgacatcgtatagttgtcattgtcagtcatttgaccggttatgttctaactttagggtgtgtttagttctttggatataaagtttttgaaatatacggacacacatttgtagtattaaacgcagactaataacaaaacaaattacatattccgcctataaaccgcgtgtagcgcccgttccgtcgtggcgcctagtgggaaaactatctcttaaaaatcctaaatgcgaaaattgtttctttgtttgttgtctagtacccgtgccattccagatctcaaatccccaatccatcatcgaatccaaaccctaatctcaaatctgtcccaaatcaaatcctctcgaaaaagtctgttttgtctccctcgagttcatgggccgatctcttctccccggtccatttccctctcagcccatctctcctctcccctccatccttgcccgcacgtgcgaggcacgtgcgccgctcgggtgctgagcaagagagagggctcgctctctctttctcttctccctccctctctgctctcgctgccgcttcccgccgacgccgcccaaatcgccgcgccgttgcttcccgcgcgcgcgcgcgccgtggtggccgaccggccagtcgccgccgccgtcagtgcctgccgcgcctgagcccgcgcctgccgccctgtagccgcgcccttccaaaccgccccgccgtcatcaccgtcatcatcgacccggtcccgccactccacgcgcatgcttccaaggaatggaggcagagctcctcctccatctgcctcatcgctctctctccctctttcttttcccaaagaggcaaggggcaagccccctttcttccttcttttttcccttttatcttcctccgccggcgtcatgccctctgtcgcagttttggcctcgaccgccgagcgccaactcgctccttgaccaccctaggtcggtttccaaaccgacattgccctcctattaaaccaaggtgccctcccttcctttccctctcccattcgcctcgcaccaccgcgccattgctgtcccctctgtctttctatcgccaaccgccgccgtcgcgtgtgccggaggagccggtgcgcgctacgacgcggaaggggactccgggcactcgtcttcttcctcttccccggcccgaggccggagagatcactcccgtgccgtcggcctctcgtcacagcgccccgcctcgtctcggtagggcatccctccgttctccctcctcgctccatctcttccccttagctttgagtagcagctcgagtaataccccagtagctagttggcgccaccccaagccgcgccgccgctcgcagtaggctcgccgccgtcgccgcccgcgctcggtagtagccgcccgtcgccggccttcctcggcaatgaccagtccaatccgacgctagaaacggattcccggagtcgcgtagatgctctagctcgcccgaatcgatctcccgtcgcgccgtcgccgttttcccattctctcgccgccggttgctgccgccgcaatccgccgccgtcgagcctcctccggcgaatccgagcagttggctcgtctcccctcgtcccgtgcaacctcccggtgcgctcgcccttgcctgcatcgctgtagatcgccccgccgctcgccgccgccgtccgctgtctattccggccgacgtcgtcgtcttcctctcgtcggcccacgtggctgccacgaaggtgccacgtcggcgccacctcggccgcgaccgggtcaagctgaccccggtccgccgctcccctccgcctcgctcgcgcgcgcggtccaccgcgagccatgaggctgcacgtgggcccgctgcatccgcacccaccgcgagccgcacgcgtgcatcgcgccccgctccaaaccctagcgccacatcgcgtgctcctcgctcacggtgagccgagacgccgacaagcgggtccactcgggaccacgcgagttggacccggcccaccggctccctctctcctcccctcccgcgcgtgccttgggccgccttctcgggctggctggcctattcagcttggccgagccgcccctttctctcgggccgcgccctagccgcctgagggaagtttgtttcccctccctctttcattgctaattcaaaaagggtttaaataaatccttttcttttaatccaaaaatccaatgatcttagaaattcaatatcttttcaaccatacatccgtttgactccgttcaacttccaaaattcctcaaacctcgagatctatctaatggcatgcttagaggtcaataatagagctttaatttcgccgtttgttgagtcgtctcgttcgcgtgtagcttcggagcccgaagacccggagtgcgcggttttcgaggatcaagctcaagatctcgagtaaggcaagtcacctttgatcatcttgcacctataatttaaatctaagtatttctttttcgcaaatattgcataaataggattatcacgagtaattcggccacggcttgcgagatagcctgccggcccccaatcctaattgctacaattaccctccttgaattattgaacacttaaacctcctttgtcgaccgttgtgcttcgatgcacgggcctataggcacgcgcatcggaacacctcccctcaaatttaaaatatccaacgatgggtaaaacttgggttttacaaaagacttggaaaacccgacacctgggtcggtgcttgcgaactaaatgaatttccaaaatcgcagatcagggaatataccgggagtacggtttcctgctcttgcacttaaggaccgttttccttggaatttcatctgaacataaggcaagtgcgaccacatgggtggaatgggacgcccctggctgagtaattagctaatcggaggagccatgatgccaagagacatgtggattcaacggggtggtgccgggggaacccccgggcttcgtggcacagtatggtctgggacctaacctgatgtcggtctgggacccctctcgttggcatatggtgaacctgtgtcggctttcgaaatgccttgtcatgaaagcctcaaggtctccagtcgtggccgttctgcacgggctgggtgatccgggttagtaatgtcgtgtgggtaaagtgtaccccctctgcagaggttattaaactattcgaacagccgtgcccacggtcatgggcggacgtgaggtgactcctagcgtagttttgtttgactactgctttgtgaaactgctgttgtggaaagggttcgatgttgggaaaatctgcggctgatgggatcagctagggccgggtggctgtatgaaagccgttggccgggtgccaaccttgaatcaattaaaagactgatacattgcacatactccgaccggacgagacgcactgtcttatccgtgtcgtttgagaagcactcacttagttgtttcaaaaaggagtttaaataaaatcaattgcaaaaacaacagccttttctttgaagcctgcattaaacacttaattcccatggcttgctgagtactcatgtactcacccttgctttatataaataatcccccctagttgctgaagaagatgaagtggatcccgctgacgaggagttcttccaagagcaagtcggctacgatgagttttagggtttcggtttagttcccaagtcgcgcctgtgatgattggtccaagtcttggcttccgttttcccttttgtaatgcagttgtgagctcgggatctgtccgcagcccaacataactgtactcctactctgtaataaagaaacttctgttgctgtgatattctgtcttcctgtgataccagcactgtttcctaggactggtatcgattaacaggttaatttggagcgtcacgggctagttccgttcggggctagttcggggcgtgacaccgcgagacaaatttattaagcctaattaatatgtcattagcaaatatttactgcggcatcacattgttaaatcatggcgtaattaggctcaaaagattcgtctcgcaatttacatgcaaactgtgcaattggttttttcccacatttaatgccccatgcatgtgtccaaacatttgatatgacgtttttgttcaaaattttctaggatctaaacaaagccttagattatatagaaacttgcttccacctcacatattccagctctcctttttcaaacttaaaaattttgttactaactcaatattggtagtaggctagtagcacctgagatcctgggttcgactccccatgggagcgaattttccaggatttaacggcgttgtgctttcagtggtagccgacttacccgtcgacggtgagacgcctgtggtgacttcgtcaatttctctaggatttgccggcccagtcttcgaagatgctcataggggtagggtttgcgtgcgtgtgttcataggggtgagtgcgcgtgcgttgtgagtgtgtgttgtactgtgtaattctaaaatggggctaaaaaaacatatattttcacacacaaacctcagataagcatgagatgggcctagccttacaccgttacaatatgtacgtgcatgcatgaagcatgccatccgcaatataggtccatgaggccacacgccgtggtaatgttgcgttcaatttgcagcccactctgtcgcagttgacataaaggcccagagcctctttttttttttaagccaacaaaacatacatacacattataacagttgctagctagcctatcagaattgagaaatttcatgggtgtagttatatttatggcgccatatttttcatcaaaaaatagtcggcatgtatttacattgtaagtccctaaattacatatgtaattttagtgtatttacaatgtaagtcttaaaatttcatatgtaagtactaaaattacatatgtaaattcgaaaattacatactaattacatatgtaagtggggtgtaaatgaggtgtaactactgtgtaagtggctgaaagaaaattgactgtagcatatggcgtcatatttctagcaactccgaatttcatggtttgagaaattaagtacctcaaggtacataaattttatactaaaaaatttagtacaatgtagtagctaacaaaataaacatattaggatatacattagaaactatagtagctcttgatatcttcttaagaatggtaaaattacccatcaaatttggtagtactattgaaggtttgcatttttcaaagtactgtcagaatttaataagattgcaaacggtcgcacgcgtctacgatcagaacccggtgctaagaaacaaaatgagtatacatatacgaatacaagatcatgcggtggagtagatctagagacatggagtatatagttattaggatcgggagtcattgggagttcatcaaatctgcctcagcccatacacccttgcaggtcccattcatcctgaacaacgagtcccctctgttcctgcaccggcgaatcgcgtgatctccacggtggcaggcgatcggcatctgcagtggctcttgcgaccgttcgccttggaaggcgttcaaatgatgttccagaaggtgaggcttgatgtcagctatcaaaattgctcggttggtgtttccgcggttgtttcaggccatgcaccgaaattcgatcaaacactagcttgcacacatttttgtttttcaaatttgtatcataaaccggcactggacggccagatcacacgtgcatcactctttggcttccgcccttggtgaggtgagttttggagcaagcaagctagaccagtcaaggcttaacattgctctcctaaactacagataaagtttgggtctgaaagccaaaacttggttgaaacatcaacatgtgtaatataactgttcattcaaatctaacaagcttaagcctaaacaaagagggtcgtaatttatctcccgttttattctctttcttcacttctctcttctttatgttgatgtgaattttttagagtctgctgactaaacttattttacccgctctaacaaatccttctcatttaacagttcgggaaacgtgcgcatgaaaaatgaggtagtagaagataaaaaaaagggaagttccaaacacacagtaaagcaagatgtaatattcagcattcagcaattgttaagtcttccgacattttttagatgaaccgttgtgaaaacacaaagtggaacactaagcaaaaaagtggaaatcaactaggaaattttagcttagtcacaactag

SEQ ID NO: 47711 - DNA, 1368 bp, Oryza sativa
acccactcctattttgtcaaaaagaaaacattggacgacagaagttctgccagatatattataagaaataaagaatgccattgttacaatcaacagagaggaaaaaagacatgtcagagaccagagctctcaaaacagcgcaccatatatatgcatcgccttacataactgcaagatttcttttaaaaaaattgttaagggcccctttgaatcacaggattgagaaaacgtaggaataggaaaaagattttgataggactgtaagtgtaaaacagaggattgcaaatacagaaaaaacacaggaataaccgtttgattgaaccacaggaaaaacacaggaattggataaaagatatagactcaaaggaaagttagcaagaggttgaagctcttactaaatttcctccaaaatctctataggattgtccattccataggaatttcaaaggattagataggattcaatcctttgtttcaaagggcttcataggaaattttcctataggattaaaatcctctaaaattcctatgttttttctccaaatcaaaggggccctaagagattaggccctgttatatagtcttggagtcacaaatccaacgaggtggtcaacaaaaactgagtacgtacctattaagaaggtgcagtgttcatgaccatatattccaccatgcaaattgttgcaactagatttaggattgggagttatcagaatctcgcagcacctggactccatgtatttaactgcattatatcgatccaagttgaacattgaaggtcatttggtttcgccaatatagatgggtggcgcagtaagagaacaatatggaaaggttcatgcgcaaactacaaggagacaagaaaaatttgggcaccgttggtacacacaacgtatatgcgcacaaaatttttgaagtgatgtccatgtttaagttcccaggcaaaaaatagccattgccacaaaccaaagtatgtcatctaatctccatttccatgtatccgcgacttgtctgaccgaaggaaaaatttggagattgagtgaatctagcttaggtcctgtttaagttcccatgcaaaaattttacacccggttatatcgaacgtttagacacatgtatggagtattaaacatagataaacaaaaataactaattacacagtttgcgtgtaaactacaagacgaatttttaagcctagttagtccatgatttgacaatgtggtgctacagtgaacatttgctaaagacagattacttaggcttaataaattcgtctcgcagtttacaggcggaactgtaatttgttttgttattagtctacatttaatacttcaaatgtgtgtccgtatatcggatgtgacacgccaa

SEQ ID NO: 47712 - DNA, 12132 bp, Oryza sativa
aacaagcaacaagccaaagtcaaggaggcctctaccgactaaagtcacatacaaacaaccaatcgtagagaggtagaagcctagaggatgaatccaatgggagataataggttataaacaatggcgaccatgcatatgaataattagaaatggaaggtatcaggacctcaaagcaacggacatcattgcattgccacactcttgttctcgtaactgtgccatctatgctgatcctttgtgtacccaggcatttagctagttaattagaggaggtgtgtcggaagtggccaacaaaatattgggatccataaataggagaaccgttggaagagtgggtgattttcagccccaattgtttttgatgatcctaattcaagattattggggttaaattttagatctctcttgcagatgctcttatctaaagtagtgaaaaaactaaactttttcaccaccagaatgcgccacatcatcgggaaaattatgtccgtcctatgtaccacacattcaatccctaacgttgcatctaaaagagatgtagtcaaaaggtggcttgggcttcgacccaaaatatgaagaggacaagaaaaatcgtactatgcctcgagcttacactatggaccatggccacaggcgacacttccttttcgctctccgattgagttgaggaggaagtgctgacgcagcccttgtcgctccaaatgtgggacgcatgccacgatgctcaccgctcaccgcacatgtcctccgcttccatgtcgaggccgccggtgcctcacatcgtgatctcgtccttctcgtctgcactgcctcctcggagacttagtcgatactttagccataagttcacaccacaggacgaagatgaggaaacattaattggagccccgtgccccctccgcggtcacctaatcctcatcaccggccgccactcccttctctcccgtcagatccgacgacgagttggccgcatcatgccctagctaccacggcagtacggcataagcttgagctcccgatgaacttgctgtgtcgggctgagtccatcagcctgtcctctcaagtttaatcgcgtgaggtgaggattatcttatcagagaaagggggtgaagagacagataatgtgagagggtgagcggtcaaaaagataacaaaagaaagaagctagccagtgagtcgtcatgtagttccgtgtctggctgttaccagcaagagttactgtggttagaaaatagtactacaatgcaacaggtgcgtctcactgagataattgatggcattatcccagtaacaggcatgatgtagtttgatcagcaaggacgctagccaatttaagtgctttctaataatgcattaattaaatacaaaataacactgatttttttactgagagtaaatttttgtaaacttgtaggaaaatatattgttgcagtgcaacaacatgattagaataacagaatataggaaatataaataaagaaagaagggagataagagggggaaaagagagagggtggtgatgtggtctctctgacatgtggagctcacgtgggtcccatgctgactcagccgtcacgtcggataaaactagggttaaaattaccaagggacataaagtgaatggttttgtaagttgagggatgtcttatatcttgttttgtggtaactcaatgacaaattgagggaccttcggtgtacttttttctattctaacctgacaatatatccttttcgatttagaaatgcagcccactctggatgcggcttccctgttcctgtgttatgttcccctccctgtccctgccagatgtcctctctctattggctactgcttttctagtggacccaggccatgcgctcgttttcttttttaacgtaaacgacgttaacatccaggatggctcgtttctgattggtgccgaggttgccgaccaatgttccacgctccaaatggtgagctgtgacatggaagcaacgcagccggagtggccgacgccgccggaggccgcggtgaccaagacagggtgtccagggcggcgctcatcatcttgagcaagtgcggtgacagcacggagagtggcagagatgcacccaccgccgctatggatccatgaagtaaaaaaaaatcctagcgcctaggaaatttcgaagacactcaatcccccaccgaacgcccgaacgccacgacttctccggcgagatcacttgctcatgtgattcttttagtttactagcacatatcatcttaaattcttaagtattaccagaaattgattgcaggaatggtcgaaccatgcctggctacccttgtctccttcatcgtcctctccaacaacgatatcctcctcatcaacaaatcaacaattaatggcctcaacttctgtgtgtcacccgcccgaggtcgggatggatgctatgggaggtcacattcttcaacgttagcttcaactccctcgctggcccgctcccaccggaggtgcccgggatgcagaaggtggagtagctcgatgtcgcgcacaaccacctcttgggcaccgtgctggaggccgtgcggcctccccctgctcaggaacttcacctctcctacaacttcactggtaagcagccgtcctgcacacgcatattgcccatcgatggcaatggtaagcactggaaattgccttgcctacccaattgccccacctagggcacgccgctgcagtgtaagggaattagggaaagaaaacggagattgctgctgtttgcttcaaaaagaaacggagaggttaagccgtttagatgaaaaaaaaaggagcgtaaggccctgggcccgctggaaaagcgatcgccaatagagcgaggacacctggcaggggacagagatagaaacacacagtcagaacaggaagccgcatccgcccactctgtcgcagtttgacatggagatggaggcccagaggccagagccatgcaagagatggcatttaccctgcttcagaagatcgccggcctcctcgccgccatcgccagcctgccgtcgcccgcgcgcgctcgtcgacagctacacgaccggtgccgcggccagcgacagggcgacaggatgcccgtgcgcgccgcgcgccgcggccgacgtcaccgacctggagctggaggcgcgcgatcgacctcgccgcgtacgacgtggtcttcctggcggcggccgcggggaaggttgagggcgccgtacgtggcgcacctgggatgggaaaccacatggcggctggtcgatagtggacgtggagcccgcgcgggccgggttcgacgtgctggccgtgtgccactacccccgacggcgcgacgcgcgcgatgaccaactccatcatcctcgcgcgcaaggcggcggacgatgagccacgacggaagaaaacagtcagtcgataaattgagggggtgttgatcccacctcaaaatttaaacacatgcatgaaatatttaatatagacttaaaaaaatagctaattgcacagattacgactaatttgtgagacgaatcttttaagcctaattgttccatgatttgacaatataatgctacagtaaatatttactaatgacggattaattaggcttaataaattcgtctcgcggtttactaattgattctataattagtttttttattagtgtctgaataccccaatcgataccctatataatacccgatgtagcatgtcaaaattttatatcctaggtctaaacacccccttattagtagagcattttgtataactcgatattgggctatggatgtggactggagcttcaattcaaccagggcgtgcttgactctactgtcacgtgctattcgattgcttcaactctctcttgacttggaaggacgtgtccaagtgataaaacgattggagcatatcaattttgctatttgctcaccaagatgcgtgaattccactttttttttcactctgataaggattcacctcaatgttttttttcaaaaaattttaaatactccattggatgagaggagttttgtaagaaaaggagggtattaattaatgaatgcaaaagtcatacaaaaatcatgtggtacaaaggaacccaaattcataacgttctttgttgctcttaatctataccatatgttgttggatctagcagttacaaattctttccgtaagaggcgacacctaaaatagcaaaacgcatgtagtaaccttttagataatgtgttgatcttaggttatatcggcccaatcatatgaaaaagctcataggagtagggagtgtattcatatgggtaagtttgtgtgcgtgtaggtgagcatctgtgttagtaccgtgtttcttaataaaaagattgcttcctccgtatttaaaatatatgggattgttgaatttatttagtcaaacttttaaaactttgataaatggaaaatatacaaatcatatgggtagatttttcttcataagtatttctacattattatataattatattagatattatcgttatttactaatggaaggatagttgtcaaagttgcagactaacatcagataaaatcaagagtattactttgataaatggaaaatatacaaatcatatgggtagatttttcttcataagtatttctacattattatataattatattagatattatcgttatttactaatgaaaggatagttgtcaaagttgcagactaaaatcagataaaatcaacagtactggaagtaaggtctcattttgacaaggaggtaacaaagggtggttattccagttggtgcacgcctaacttataccaaagtcaggcgtccatgtggacaaaaattgagtccatatatccagcgtgtactcttaggataagaatattgcctgttattagttaaagatgacagcctaagttcatatgtaattgttcagttcaaggaaaaacgtaatcagagtgaagatttatacgacagtagtatactatataggagtatgtacaaagaaacacgaggaaattttatttttagaaattaaaacatcaccaaacagtggtaccgataatatccaacaaaatgcaacatcattatccaaacaaaaagaagaaaaatgctataccaccatcttaaaataaaacaaaaatagcgaaacaaaacgaagtgctctagtctagtctagttctatggactaggaaagtatagatggacacggcgattcccatctccgtgtgctcgttttctccctccttttctcctactattcccatcccagtatcccacccattctctgttccgtacttccgttgcacccatggctcccacgaagcagaggagtcagccgcgcgcggccaggcgcgtcgcggacggcgacggcggcggaggtggaggtccaagaacccaccaagacaccgtgttcgcgccggcgacgacgaaccgagatcttccgcgccatcccggtgcgcgatcgatcgacggcgagcacgacacgtgaatacgtgaccctgccacggggggcgcgcgggcgagacgcctcctccgggaagctgagcgcggcggcgtcgtagccgcgcgcgtcctcggccgccgccccacttgcccccacagccgtcacctgaccccgcgctccgccgccgccgccgcatccggcgccaccactgatccctcgcttgcttcgccgggcgtgactacctcgcactgtacacgtaaaacatcggtagacgacacagcagctagccacgtacgtacgtgagcatccgttcgctagccgggagcaacgcgggagaggaaacggaggtacccgcgccgcggagacgaccccgaccagctcctcctccggcatgacgcggcggcacgaccaacgacggcgcgggcagagcggcgcaccgccgcccaacgtcgcgccacctccacgtccgtcgtcggcaatggcgcgcgtcagcgcagccacgatggccgccgggcccgtctccgccattgaactgctgtgtcccccagtgacaagcactagcacatgaccttgctgaggaaatgataggtgggcgggcgagtccaatttatagtggactttgtcagtgaagccgatgatctatctctatctggtcgggacgggggctcgatcggtgacgcgtggccaacgcgatatggaaaagaaggtagggaaattcgtgcagacacggtggcatccatgagtatggaaaaacatgggcagcgttcccatggaatggaacttccagaagctgctcgtcatttcccagctcggaagtcggggacggatggatttgtcacctcagtgcaattggcagggagtctttcagaagatatgatttttattagtggagcatatggaagcttcctaaatattttgtaggtgtgtcatatattgtctgagctttaataatatatttttggatctttaaatttattcaagatgacatataggtgcaaacctatttcaatccactccgtacaataacgtggcatattattgtgatgtcaaatatgttagtaggacctaaatatcagtcacataaaaaaataaaattcaaaacaagagaggagaaaatgatgttattatttttttaaaataaaactaaaagagagaggagagagagaagtaaaggacagttcttaaattgtttgtacatgactgccatgtaggttccacctatcaccacctgagcaccttcatagtataaccaagtcagccgtccacgtggataaaaattagggagtaatgtactcttatctgaagaactgattttgtaatgatggtcgaaatttatgaaattatccagttcaagaagaatctaaacagaatgaagatgtagacgacacgaggatatatgtacagagaaacacaagtaacttttatttagaaatatattaaaacatcaccaaacagtactaccgataatatcgaacaaaatgcagcagcattatccaagaagaacgaaaagaagaagaaaagaaaaggctacaccaccaacttaaaacaaaataaatactactatgccgaaaaaaaacgaaatgcgagtctaattcaagttctgtggactaggagtacccgggacgacgattcccatctctccagccctttttgtctcgcgcgctattccctcccgttctctgctccgttgcctccatggctcccaccaagcagagtcgtcgccgccgccgcgacggaccgcgatggcggctgcggcggtccgaaggtccacgaacccagaaagcgagcgttcgagatcgacggcggcgagcaggacatgtgatcgacatcgtgaccctgccacgggcgggacacctcctcggggaagttgagcttggcgcggcgcccgcggaagcgtagcgcggcggcgtcgtaggcgcgcgccgcgtcctcggcggtgcggaaggtgcccagccagacgcgcgccgcttcctcgggtccctgatctacgccggccacttgccccacgggcgccgcctaaaccacgtagtacctgcgcactgacaacagcaccgtcaccaccacccacaccgcggccacgcttgcctcgccggtgtgatctcccgctgtaaattaaaacatcgcagcacacaacacaacacaacacatcatcatcatccgttccgggtcgagcagcacaggatggagcaacaaacagaggtaccggagacgacgccgaccatctcctcctcccgcgcaacgtcgacgcgccgcccgccgcccgttcccgccagcggcggcaccaccaacgatggcgcgggcggcggcacgccggcgccgctgcctccacgcccgccgtcggcaatgacgcgcgtcagcgcagccacgatggccgccgtctccgcggcctcgaagagcgccgccattgccggcgaccgcatcgatcgatcaaggcgacgtcgagatcgaacgtgcacttgatcttgctgagggcatgatcgatacgtgggggagggaggcctatttatagtggagtttgtgagtgaggcgtgtgtatgatatggccaacgcgataaggaaaagaagcgtatgggcagcgtttccagttccatgcaatggaaggagaagaacttccagaagttgctcgacttttcccagcttggaaacggacggatcatgtatggcttcctgacctcactgcaattggccgggagtgctttcagaaagtgttttcgtgctgctttttcttattatttcacgacacctacgacatatttttaaattcctctaggtttaccggattattagtactacctccgtcccaaatatagatatttttaggatagtgacttatctcaatttctgcatctatcatcttctattgaccaatcataaccattcttcatttattttttttatttttttcctcaatcaatcataatatttctacaaccatcttttagtactttattaatacacgtgtccaccaaatactggcattttgggatggagaaagtagaatcgagtgacgttggtcaacgccttggtgatgttcgctccaagcagaagaggaaaagtatacaatttttcacgctcatgcttcctaaactggtaaatggtgtgttttttaaaaaaattctatagaaaaattgctttaaaatcatataaattaactatttaaatttataataattaatactcgattattcgtacgctaatggttcacctcgttccatagccttggccactcttaaggctgagtttgattctacgttttctcaatttctactctctcggattctgcacatacatttctcgaactaaatagtatgcttttttgcaaacaatttatatacaaaagttgtttaaaaataatactgctagaattttaagtgttttttttctaatacttaattaattatgtgttaataaatcgatcccttttacatgcatagatgattggaaaccaccacatttgttgaacacagcctaagttgttttttcgagggataggacaggaaaaaaatttcgaggcaattcctaagctaaccattggactctgagctttataattaattttcatgtactaaaaattttacattaaatttgttttctaagaaatcaaaatgaagtggtgataaattcagtagcaacttaactctaatttggtggtatcagggcaatgctcaatttcctactattgattgaaaattagagtttgcactagtgataaataaataaataaataaatatatatatatatatatatatatatatatatatatatatatatatatatatatatatatataattattataccacttaactaatattagttgactaaatctcggcaagacccaccacataccatgtcttatacagaaataacctttgggtatagaagaggttccagataaggaaagataaatagagttctacatgaaaacgacaaatattattcggattgtatccatattggtttccctaattctacttggaaaagggaacacctatgggtataaatacaagacccctaggaggagaggggggacggaacaatagatcaagacacaagatcaacatacaagccaacatgcgccaaaacaagacgccggatatcgaattcagagataagcatggctagtcccctccggtgtctacggatactgtcaggagagacatagcgctttctttaatctcgccggatgcggattcgaggaggaaggctaccctgttgtcgactacgagtcaacacttcagaccgccaagtcgacaacagttagataggctaccccaaatattgtattggtatgattatggtgaataagagcaacgaccggcttcggccaacaggagtagggttattacctgacaattcaggggcccgaacctgtataaaaatcctcgtccccatctcttttattataatctcgcatatatactagtaccaacgatccacatactatgcaaataccggaatcgcgacatcaaacgtcgacatatatatatatttgttactttggtcaaacgattaaatgcatactaagaaagtgtatatctaatgtccaacgagcactacggtacatggatgtatccggagaggactatgtgtaagagggagcgtcccatgtccgatggaagggaaaaaaaaatcaaaagctgctgcagtattagcaccatactaattattagcacatactaccccggttgtttttttttcttcccaagcgactagcaatcaggcgcttacgatattttggagaaatggaaacttctctccttcccacttttcctactaggtatgtagagctctaacatattagtctctctatgtcacgcgtctacacattgcatgcatgcaccaaagcatctctcactatctcttcctaaacacttttttacaaactttaaattattttttctcttaaattattgaatgtatttattatagttaaatatttataaaagatctcgcgtgactatattttggataaaaaatatgtctaaataattaggcattgtttaaccacgtttagaaagttgtttcatcatttgataaaaatatttttatttcactttataaaatactttagagagacgcaacatttaaaaatattgactgcaatatcatgaactactatatgaaacattaatccactatatagcattgagtcccaataatgaaacattcaaaaaaaacatttgaaacatgcaatatatttgtagcactttatattattgagaaacattgttaatcatgtatgaaacattaggttctaactgttgaaacatcataaaatacttgctgaaacatataaataaaatcatttgcaacacttaaaataatacattaagaaaagctaaatttattctttatcagaatataaccatgtgtggttttgtttaattacaataaatttaatggagcaaacggatcttagattacataagtaatttaagagaaaaaatagtttgaaatttatcaaagaggtggttatatatagggacaatatatagacagaagggagagaaggaatactgcacgctatagttgtagcgcttgggggcaacatgcagagagtgcatgcgcagcagtaattataatgaatacaatggcattattatattataaatcgaataataagtagtttaggtgaaaaattattttgagaattggtacaaagttgttttatcacttgggacagaggaagcggtcgtaacatgtattgacgcttgctgtattgggcatgcagatttttttttcttaggttggaggactgaggagaagacttctctgctatacactactgcaattttcaattctttttgacaagaaactagactagaaacacgtagagtgattccctttgagagaaacaaggttatgaactttctagatggataagatatattagaagtttagaacacctcgtcattgtaccacctttctatctagaaacttcgtggcggcactgcagctcatgttcagacggctttcaaatactgcagtataatacaaccctctgaaaagcaatggttgtcgtatatcagaaggatatttataggggtgtttggttcaatacctaaaataatcataaaaatatttggtttattacatggcaacaaaaatattttggcaagactagacaaaaattaactttgccaaaatcttaatatcaaacctaacgacaaactttgctaaaattttgtcacgtcccaaaacgaccctaaaatatatcctctaaatggtgcctagaataattaaaatccgtgtgaaagcctccaacaattaaaatgtgcaaagttaaaagtcaaacaaggcttagagggtttttgtatatttcctaaaagcctaaaatgcgtaaataaattttagtggaattttcagagtacaaataataattattaagaaataaacaaagttgaaaaggttttataaaaaaaaactctaaaaagtcccctttccctccctctccctctcgggccggctcggcccatctccctccccctccctctcctctccccgcggcccatccggcctctccccgtgcgcgcgccgctgacgggcgggcccgcccgccaccctcgctgacgggtggggcccacccgtcatccccttcctccggccgctcccgctgcctcgcccgcgccctagcgccaccgccgccgcgaatcccgccgcccccgtcctccccgtgtgcaatcaataggggggaattattccccgtgattccct

SEQ ID NO: 47713 - DNA, 3409 bp, Oryza sativa
  unsure (1)..(3409): unsure at all n locations
ttcgggcgcaccgagcggctgccgcgtggggcccggccgtcagccgcccgcgccctcgggtgcggctgacgcgtggggcccacggcaccggccggtgtgagcccgggtgcacccggtccaccgtggaccgtgaggctgccgcgtgggccccactcccgtggacccggtccgcgcgccccctcccctcggctgacgcaataaaccctttttaaattaaaatttaaatgaagaaattcgcaaatattcatttaaagagcatataaacttcaaataaccataacttggccatttgaactcggaattggaccgttcaagtctctaatttttccttaagaagtcaagaacccatttttgtgctttgttcctgcttgttatatggagtttattagagtaaaagccttttcttttccgttggtcgtgtagacgctgcagcttcggaagatccgctcttcgtggaagttgaagccgacggttgggaaagcgagcaaggcaagtcacatcatccttgaacatattgaatcccagtttataaaattatgttgatttaaattattgcattatcgctttatttaaattcccgcgttatcactgttttatctagccatgcctatttacctttgttatgaccttattattgttattgttattatttccttgttcaccctagaataaacaaaaccccaactagtgggcactctactcatggtactactagtatgattttagttagatgcttcgccgcttaattaggcaacattaggtggttttacaactctagactttgggatattcatatcacctggacactatagaattgtcggattattgtggaattggattcacacctccccctctcttcaaaatcctcaaaatggttttaggctgggctcggggtgcatggttttgatagtagcacctcggccatataaggaccggtcttcgggcctctgttgcaaagcactaccgtacttccacatgtctagtgggtaaggcttagtttgtggctcagtctggttataaataaaagtacacggatggagatggacgaagtcgggggtcgatggacatctctaggacaaatgaaggctacacgagctgcggcccggtagtcgagatgtcatggcacagggccggtgtcctgctgctaggggctcagtcctgcctacctgtcccgggggttccggccgtaggtggggttgggtcggtactcttgtctatggctaggatgggttggaaactatgtcacgtcttccgtccgtataccgtggtggtatgcggcacgtggttacacgtgaggaagatgtgtcttgtgggtaaagatgtacacctctgatcagagtataatctattcgaatagccgcgccctcggttatgggcaagcctagcaatgtacccaagttagtgttttaattcttaaaacctgcttaacaactaaaatgtggaatggttggcctgggttggcttgggacgagctgggacccagggtcgggttgccagttcggtctgaatcatcgtaggccttgggttaaggcaggttcgtgtgggttcacggccttgattaataatatggtatagctctggaatcgtgtttacaaaatagctttgagcaactaagtgtcttttaatgctgtttacttcaaaccctaaccctttatattataacccccttgtactcccttgcatttatcttgcacttgtgggtgtgtcttgttgagtacggtggttgtactcagtcttgctcaatttttcccaaacccagaagaggagcccctggaagatgaaggctttggtgtctagctcgtgcctgccgtcaagcgcctgtggtcgtcgccctagtcttccgctgtttctcgtttgtctttgtgtgtgctgggccttcgccgcccatgtaataaattaactatttacgcttccgcttgataaactctgaaatgtatcaacttttggtgtaccttacctcctggaacaaggaataatacacgcacgtaaggaacgcctgttgggttaattccggtcgtgacaaattttgacattataaatttttagcttgtcaataaagttaagcatggctacaatccaggtccatacttgagtagtacactacagtatcgtcacgactgaatttctagaaataaaatatacttcaacctcttgtggggcatctagaaagttcattaatgtcgccttccctccatgagaacacaccattccttgtatttatataggttccatgtattcttgatttggtttctggttagacttaaaaacgtttgtgttatcagttatcctcatcaaactaagcagtggcattgcttcattgtatccggagatatactgctaaaaatatgctagtagattggagaatacttcggattgaacgcctgatctgaatgaaaagatatcaggcgccctcccccacactcccggctgctacgggtgacctagatgctttgtatagtgctaatgcatgatgctcgatatattaacaatgtacatatgtactaattaatcatttttttatcttaaatcgtttatcctatcaacgatccgattacactagtgtattcctcacaattaaacatttacaacaagatctcacacgtttatattttgatgaaaaaaattgaacgttgtttcaccacatatagaaaataattgatcacttggtcaggtttttcaattcactgtataaaatatatcagagagatgcaacatttctcaaatactaactgcaacaccagcaaacattgtatgaaacattaagtttcaacgagtaaacacatggaaaaaacatataaaagatacaatatatcccaaaaactttatattgttaaaacatttttatatcatgttcgaaacattaagttttaaaatacttactgaaagattcctagtataccacatgtaacatttgcaaaataattagtgtagcatcatataaatattagttgaaacttttaacaaaaaccatgtgtatatttaaaaatatgcataaaaagctaaacaaaaacattgaaataaaaccatgtgtggtctgattgtaaagatttaattacaataaatttaatggtacaattggattattagttggagaagtaatttaagagaaaaagtagtttgaaatttgctaaaaaaaagacttaaaccaacttgtaactatcacggtttattcttgtacgttatgcgtgcatgtagactttgattatcagctgcatgcagcttacctagtcagctgcatgtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 47714 - DNA, 7294 bp, Oryza sativa
ttagctgccttgttttcagtgaaccatgtcatataggagcactgccctgattgtgatttttaaaggcagcgccaccattcaagtaacatggcaacaacaacattctaaaaattcacatgagatgcacccgcgacaggttcccagtggatgcatgatgtattcgagagatgcactcacgacaggctctagtggatttatgatgtactcgttagcctgattctagttggaatagtgatgaatcaacggggctatttggtacagctccaactcctaaatattacttcaggagttgagtctggagtggagttgttgagctatctaaacccagctccacaactctagtatattttgtgagatagctccatccaactccactcccaattttggtggagctaaaactgtttggctgagctccagctccaggaggggtggagctggagctgtagctgtgccaaacaggcccaacatattaatccctagtatataatagcgcaataaatataaaagtgaagaatatactacaacctacttgtctatctgatcttcttttcctctctctccacacccttattttaattaactaactgatgccatgtgatgtcatgtaagtaaaaaagcactcctcatttaagctcgggaattaaatatatatggatggtaaccaattgtaactagtttatatttttgttttgttgcgggtaaccagtttttatagttagtggactaaaatcgaaggaccatagtcgacggatcaaatatgtacttttccaaaaaaaaaaatgtccggagaactgttaattgctgagatgcggaatattgcatcttgcttccttaatgatgtactgatacaagcaacttgatcatatgttagacatgaaaaattctagcaagtttcaaatatgataagcacaagttgagtggaaccaatacaatggagggctttttctcagaggatatgcatggataggaaggagatcctctggcgtagaggcttatatgttagagggacgtccaactttggatcgccgtttgtagcgcattcgactgcccataagtgcaacaaacagctacagcatgctcggtttctacccattcacagccgccgctcgtcatgttttcatctctcgctggtggaggacaatgtaagggtgaaaacgatcggaaacggtcggaatcgatagcatccctatggaaacgatcctcgatcggccggtaattgatcatatttatcattaaactcctcagtatcgacattaatatgatgaaaaaaattagaaaaaacaaaataaaaaatagctaaaaacggtacgatcggaaacggtaccctttaaatgaaaagggcgcccagtcgatggggaatcgccgaaggcacgggccgatcgacgggcggcatgcatgcgtttgccacccgctggcgcgtcgaacgctgttgttgatccgtgcggcgctcgctcactcgatcgggcgccggaatagacgggagggcacgtacggcagatcctagccgcccaatgcgatcggatttggtcattgccgcgtcatacgggccctataatcgagtggcgcatgacaaccaattaagatggcaagatgcaccccctttcatcactcttaacaatcaccattcaagtggcatatgttcaatcttattgagtttaacaaaaaagacacgctttgacgactatgcctggctagatgacccccataagataaaataacgacgactatccaaaataactgccacaaatccaaacagttgacatccacgtcaaaccggtgctgccctccctactactgtttgaaccataatcatctatacttaccatattttttttaagttcgcacatttagaagtttgaagaaacgtgtgcatgaaaatcgatagagtaaaagttaagaagatagtatagatcacaccctaaaagattatgtaccatgtaaactagcgaattaattttcgaactcaattttacatggagctagatttttttttgacattaacatatataatctttagattatacgcgcgcgcacacacaagtagttcttataaaacatatcttcaaagtataaatgaaattggtatatatatcttaattttctttcttcataaatagaatcatattattctttttttacccgttgcaacgcacgggtatttttctagtagagataaaaatttggaagcaatccaaacaaagcacctttgcaaaatttttggtaacatctaaatctcgctaataactgcacaaaataggcaaggcaaacaatattggcataaaaccaaacaaactgaatttgctgatctgcagccacaagcccaaacatcgcccactgcgcacgttactgcgacaacccgcatgctctccatgagatactgaacttccattacttgctcttgttcaaccgtgtggtattttgccatcatttgctttcagcgcctctccgctaactagcgggaccaacgattctatggctcgtctcctagcacgcgccatcgtgaaaagagcaagaggtgccgggttgtattatgaaacggtgctttcagtttcagctcccaataccttccatccctatactatttgtatgcatatcgccattgtgatcagggcgcctgtaatactctaacatatcggattgattgtcgatcaagatgctccatttcctcgtctatctctctctagtttctatatatgatcagctgtttgcgcgggtctctgagttctaattacacgaaggagagagatgcctatacatcgtttggctcgttgcttattaaggccattatgtgttctagtactaccgcttgcagtggtgtaaatatttatgcaacattcaagggtagctagctagctgggccgggcttccctccgccctatacaaaaagttaaactagaacatgatgtgatgatttctagcacgatgaatctgaatcgtagaaaacatcacatctgttctaggttggttttttatgggacggagagaatattttgcaacaatcgtgcatataaccgaatatctttctttatgtgaacagataagcatatatatggttcttctgttgtgtactaattcttttactatatatatatatagtgaatttctatgcaaaaatcatttttaaaaaacagagagaccaacatttaagacagggacaattttgtatttttcaagaaacatgccattccaaaggttgttgtgtaatgccagatatatatttaagagtagtgagcgtgtgggagctgatgatggaaatagcaaagcaaacccaatatatgtggcataaacttaaagtgacaaaatgtgatttacaatacgtctttcggagttgacaccaatatgacgcaaaattcataatggcaataacatcctactgttgaatgggctttacttcaagcttgggcatgatcgccaaactatttagctttgtcaaacagcttttttgcacatgttagatacacaaagtaaccagctggtcctggttcaatctagctagtcactgctacgaagaaaggtttttcgtggtgactaaaatcagtcctttctagtagttagactaaccgtctgcaactaacggtcaatgaaaatctaaggtcttcacaagcgagacttcaaccgctagtgacaattgattttcactggcggttgtgtcacgcgagccaccagtgataattcatttttcatatggctgtgttaagctggccgtcagggataatcgatttcacggcaaaaaaatattgaaaataccccatgcagctgccctctagctgcgagcaaaaatgaaaatgcctacataatgttgcccagcattcccaaatccatatccccaaatcccaaattcacatcaacgagcacaagttccacaaaaatggtttgattatgatcatagagcatggagcacaaatattccactaattcacatcacagtatacaaattccacatcatagattgatcacaaaactttcacatcacatcatagagcacgaggtcaggatggattcgtgctcccgaaggaggcgtggatggccggtgctggatctgatccccgcgccgctgccgcccccttcgccgcgtcgctcccgaggcccgcgggggtagatccactttcccgaggctcgtcagcaccggatccgctccttgtcaccccctttcccgtgcagctcacaaggcccgctggcgccggatccccacctcgctgccccgtgtcctgcggctctaccgtcaagaaccatcgatgcccctttccctgctttgttgccgctgcctccttccttgcgccgctgagccctttccgcgctgccgctctctcccttcccacccgcgagctgcagtagtagcgccctccccactcgtgagattcggcggtgtcctccccatccgcgagcatcaacggtgctggcgctggcaccatatataaccatatccaatgggctcgagctcaaggactgcatccggcaccacgctcgtcgccggagaagctccatccctcctctttctctgtattcactgtgttgttggatgttgatacatgaatgttaaaatgtgttcttggatgttaaatcaaaataaggggcaatggggtgatggaatctggtcggggtgaaggggagctactcgattcatcggctcgacttgagctgaccattctttttttctattactgatattttaaatgtgttggttcctaaacgggtatctttgagcccttctcaaaggggccgcttgctaggtgtcagttagaaaaatccggctcctatgtccgattaccaaccggcaacactcaacttttgtagtagtgcaaagaggtgtggtaaattgtggctcgctgcctatggaaaccacagaacacatttgaaaaaaacatactggtggcctggtgcaaagcttgcctctagatagacacggcaccgccacggatgcgtagagacacagcgatgagatgatactcacgtgtgacaatagatcgatcgatcaagagttcgccttgcaattacgtcaaaatccgcgctagctagaggccgtgtttagttccaaagttttttttcaaacttccagctttttcatcacatcaaaacttttctacacataaacttccaacttttccgtcacatcgttccaatttcaaccaaacattcaattttggtgtgaactaaacacagccagagctaaccagctgccccgattgccgcgatctcatcagggaacagcgccttgtcgctctcttgtatgttgtgtgatcaactcctataattggcagtgcatgtcggtgcaatcactctacctcctctattcaacgtgcaccgtgttcacgcgctcagtttacttatagcctcgctgcatcggtgctgcattctcctgattactcaatcctagctacatttatatataccggagtcgtggacacaaccgttactccaattagtacgcactcattcattttgcctctgatcaccttgttcgattatatttgtcgctgcagtttaacaagctagcccggcatgcccatgatggcacgattttgctgttgcttttaattaacaccaaaatagtctttgcttccactggcttcatcacctttaacaaagactccactgttttgtgattgaaccaacttgtctcggtccctggtgttaaatctccatccattaatcatataacttgtgtaatgggttactcgagcatcaggacctcttgctagagcaaacaactcttctgatgtatctggagatcctttggaatgtttctcaaatatctggaagaatgtttatacaggttacaaatagttgtaaaatctaaaaaaaaatacttttattatggcgtgtacatacatgattcttgaaccatacaaaaaattctttgtcatggcacttttccacacctttactgttctggatgctaagttggtctttgtgaatgctgcaagacatgtacatgtatgttaaattttgacagcatttacatattagaaaatgagagtaagtagtagttgtttactctgcgtattctgatatttcttcacaattctttagaacatatatccgagctttctccaactcattcatatccatctggcagtatttgttaccaaggagtggcctgccaatagtaccaaatatctgaaattttgtactgctgttgtcactctgcacgtcctcgtttcgacttggttgattgattcttgtttcaactccttgcaggtacatagaacaaaaatttacacattcttgcaaaatatatgcctcagctatcgatccttcagggcgagctttgttttttacaaaagacttcaaccttcgcaaaaacctttcaatgggatacatccaccgatactggacaggtccaccagtaatagcttcctgggctaaatggattggtagatgcaacattacatcaaagaatgaaggggggaaaatcatctctaacttacagagggtaacagcaattgatgatgcaagcttcttgagaatttcagtatctaatttcttggaacaaatttctctaaaaaagctacatagctcaattatagcctcacaaacatcagcaggcagaactccacgaatagaaagtggaaggtatctgtgtaaaaatacatgacaatcatgacactacatccctgatattttagcttttgttgcatccacatagtgtgaaatttttgaagagtatccatctggcacttttatttctctaaggaactcacaaaatgctttcttctcagctagtgtcattgtatagcatgcaggatgaaataagaacttcccatcaccagttggaggtgcatgaagttcaggctgtattttcatgagttccaaatcaaaccgggatttaatattgtcctttgtcttcccatctagatttaacaaggtacccacaatactatcgcaaacattcttttcaatgtgcatgacatctagattatgtcttatcgataacgtactccaatatggcagctggaaaaatatactttttttcttccaaactccatacaatgtgcttgagcgttttctcttattgttatgtttcccaaatttaacctgaatgcataaagtgatgtcaacaataatatactactcatattcttatactctataatgtaataccaaataaggcatagaatagcaaatagtataataatttactttcagatataccagataggatacaagcataaatatatcataattagtagagtacctgattgaaattttgatattgacgcataatgtcatctcctgacaacgcttttggggcgctacgtctttccttttggccatcagaagattttgcattgct

SEQ ID NO: 47715 - DNA, 5619 bp, Oryza sativa
gtcttcattagagttcacatgaaaaaattatgaattatttttaaatataaagtctttagaccgttctatttgacccagatgatattcaaatccaagtttagagaccggggtgacacaactgaacaagttggaggacctaaacgagtgatctgtaagtttagggaccgggatgacacaattgaacaagtttgaggacctgaacggtcaatttgcgagtttagggaccgcgatgacacaacagtacaagtttagggaccggtgatggactttactctatttttaatttcttctaggataatcggtttagtagtacacccccgtcccaaaatatagatattttcagcatagtgacttatctaaatttctacatatatcacctcttatcaaccaatcataaccattcttcattttttttttcatctactttcttttctcagtcagtcataatatttctacaaccattttactttcttaatacacgtgtccaccaaatactagcattttgggatggagaaagtaatatcgagtgatgtcggtcaacgccttgctgatgttcgctccaagcagaagaggaggaaaagtatatcatttttctcgcgcatgctttctaaaccggtaaatggtgtgttttctaaaaaaattctatagaaaaattgctttaaaaatcatataaattaactgtttaaatttaaaataattaatactcgattaatcgtacgctaatggtttacctcgttccatagccttggccactcttaaggttgagtttgattctacgttttctcaatttctactctctcggattctacatgtacatttctcaaactaaattgtatgcattttgcaaacaagttctatacaaaagttgttttgaacaataatactattccaattttaagtgttttttctaatacttaattaattatgtgttaataaatcgctcccttttacatgcatagatgattggaaaccacacatttattgaacacagcctctaagttgttgtttcaagggatagggtaggaaaaaattttcgtggcaactcctatgctaacaatcggactctgagctctataattttcatgtactaaaaatttcacatttaatatttttctaagaaatcaaaatgaggtgtgataaattcaatagcaacttacctagctctaattcggtggtaggcaatgcttaaagccatacttgtgtatgtcaaaggtccaacgagcactattgtacatggctgtatgagttatcaaacgttagcacataattattagcacatgcttaggttttttttttctttccgagcgactaggaattgggcgcttggtagattttaaaaaatagacactccactcctacccactttccctactaggtatgcatagctctaacatattagtctccctacgtcacgcatctgcacattgcatgcatgcaccaaagtatctctccctatctcttcctaattaaacattcttttataagctttaaactatttttctcttaaaccattgaacataccataaattaattattacactattataattattataattaaatatttatatctcacatgattatattttggatgaaaaaatatgtctaaataattaggcgttgtttaactacgattagaaagttgttccatcacttgataaaaatattttatttcactttacaaaatattttagagagatgcagcatttcaaatattgactgcaagaccaataactactatatgaaacatttagccactatataaaacattaaacattgagtcccaacaatgaaacaatcggaaaaataatatctaaaacatacaatatatttgtaacacttgataatatagtgaaacatttttacatcatgtatgaaaacattagattctaactattgaaacaccataaaatacttgctgaaacatccaaataaaaccatatgcaacacttaaaataatacattaagaaaagctaaatatttttttatcaaaatataaccatgtgtggtcttgtttcaaagatttaattacaacaaatttaatggaccaaacggatcttagattatagaagtaagttaagagaaaaaatagtttgaaatttatcaaaaaggtggttatatatatatggggggaatatgaagggagagaaggaatattgggagagcttacggctcggacgtccggcatcacaccaaaaatcgaacgtctagccaggcaacgagcgcatgtgagaacgaaccctgtcactgtaacgtatgtgcctagctgtttcttttcattctttcctcctctctttaaatatttttttctcttaaattacttatccgatctacgatccgataacaccgttgtattcgttgaaattaaatctttacaataagataccacatgattatattacgtcaaaagaaaaacatgtgtttcaaaccgttagaataaaatgtttcatacgtgatagtgatatgtttcaatatgtgtcttcggtgtgtttcacaaaaatcctgaaactacctgctactactctctctccacctcatgcatgcatacatgcatgtattttagcaagcttcaaaatgatttttcttttaaattacttattcgatcaatgatccgaccacaccattgtattcgttgtaattaaatctttacaacaagatatcgcatgattatattttgataaaagaaaaatatatgttttaatccgttaatacttgttgttttatatgtgacagcgacatgtttcaacgtgtatcttcaccatgtttcataaaatatttaaatgtttcaattgctgattttttttcaccatatataacttaatgtttcacttattggtcaacgctcgcccccgcactgccgctcgcccacgttgctcccgtgccgcgttgcttgcctgcactgcatgtgttgcttgcgctgctgcttgcatactctctctccctctccctcctaatacacgtgcctaatttttcctcaaattttaaatatttttctccaaaattatatatctgatctaaatttcaattataccattaaatttttgcacaaatacttaattatgttgaaatatttttaaatcggacgctacaaatcgtacgtacaatatttttttcaaatatcgaagctgctcctcgtctgtatgcagggacgcgttggagaagcgaggttgtcgcacgcatgcatgcaggagtagagctggttgccaaggtggcctgaggcaccattactttctctctctcttaatcaaactttaaacaaaattttaatctaaaatatatatccaatctataatttataacaagatctcacatgaatatattttgataaaaatatatatgtgctctagaaaaaacaaacttatgttgaactatttaaaaataattctttcatcacttgtggagatgtttcaacccacttcacaaattattccaaagaggtacaacatataaaaagtattgactgcaacaataatcattattacttgaaatattaagtcccgactagtgaaacatttttttatatttagattgaaacatcgaattataattattgttgaaacataaaaaatgtatttgctgaaacatataaaaaaagatagcatgaaatattgctaatgcattagtgaaatatcaacaaagtcttgttggaacatttcagtaacaatgtgtgcaacatttaaaaagtaaaataaaaagtcatcggaatgtagtcatgtgatatcttgttataaagatttaattgtaacgaatccaatgatataattagtttgaaattcggataaatagtttaagagaaaaaatcatttaaattttgaaacatgtttgcatgcatgctccgttggcttgtcagtacacctaaccaattatttcaccatgcacctacactgttgttcttttagattgagacgtccgattttttattcctagccgaacggccaatggtaagtatttccgggaatattgcacactgtacaattgtagtgctagggggcaacatgcagagaatgtatgcagcagtaattataacgaatacaacggcataattatatcataaatcgaataagtagtttaggtaaaatattattttgaaaattggaacaaagtttttttatcacttgggagagagtaagcattcctaacatgtattgatgcttgctgtattgggcattcggatttttttacctcaagctggaggtctgaggagaagacttctccgctatacagtatacactactgcaattttcttttgtctttgacaagaaactagactagcaacacgttgagtgattccctttgagagaaataagattacgaactttctagatggcaaagatattagaactcctcgttatggtattatctttccatcgagaaacttcgtggcggcgctgccgctcatgttcagatggcttttaactactgcagcatgatactaccctctaaaaagcaatggttgtcgtatatcagaaggatatatatatagggggtgtttggttcaatacctaaaacaatcataaaaatgtttggtttattgcatggaaaaacaaaatattttggcgagactagacaaaaattaacttggccaaaatcttaatatcaaaccaaacgacaaactttgctaaaattttcacattataaaatttttaacttgccaataaagttaagaatggctacaatctaggtccatactcgagtagtacactgcactgtcgtcacgactgaatttctagaaagaaaatataaatcaaccacctcttgtggagcatccagaaagttcattgctgtcatcttcctcgatgagaacacaccattccttgtatttattataggttccacgtattattggtttggttttttttgttagatgtaaagacgtttgtgttattggttatcctcacaaactaagcagtagcaattcttcattgtatctggacatatataggcacatttttttaaggatcacccgatcaagatatattgctaaaaatatgctagtatattggagaatacttctgatggaacgtccgatccgaacgaaaagatattgggtgctctcccccacactcccagctgctacgggtgacctggccgctttgtatagtgctaatgtatgatgctcggtatattaacaatgtacgtatgtactaattaatcatttttctatattaaatcatttatcctatcaacgatccgattacaccagtgtattccttacaattaaacatttaattttaaattgtttatatgtgactggccaaaatcttaatatcaaaccaaacaacaaactttgctaaaattttcacattataaaatttttaacttgccaataaagttaagaatggctacaatctaggtccatactcgagcagtacactgcagtgtcgtcacgactgaatttctagaaagaaaatatacatcaacaacctcttgtgaaacatccagaaagttcattactgtcgtcttcctcgatgacaacacactattccttgtatttattataggttccacgtattcttggtttggttttttgttagatgtaaagacgtttgtgttatcggttatcctcatcaaactaagcagtagcaatgcttgattgtatctggacatatatatgcacat

SEQ ID NO: 47716 - DNA, 1426 bp, Oryza sativa
atcttagggaattttgcctacagaatgatagtagatcatacgaacaaacaatgtacaaaatcatgacagcaaaaagaaaacaaaaatgtacaaatgaaatatactccaaccagatgacataccttcaataaattccaaattgatgacatggttccaggaaaagctttttcaatgactttccacttcttcaccttaagggggacctcttgtcgcacacagacagtgacctcacttttaaagacacttgtgtgcctaccacagacttttccaaactgtgcagcaaattgaatgtctagcggcacaccccttgctctcagttttgcaagtgttccattaatggtgagacccctacctttcctacgtttgagacctaattgaaggaagaacttttaatttatttgcttgtgaaggaatagattaatgaagtgaaggtaaatatgttaaatacctgtgtttccggttggtcccatccgtccctcattcctagtattgggtatgacttgtcgagtagcatcatccgaagtctccatctggttcacggacggacgaacttgggaaaccattttgacctacaaaataagaaatgagtacaaacagatctactacaagattacaaaccaaattgactaagatagaaatccccacaaaacaccgatatactattagattgagaaccaaattaactaagaaagagaatcccaattaaaaatggatattaagttgcatctaattaggaaattaacacaaatcataaatgcggaaaaacaagacggagagagtggacgccagaaggggcaggtcatatccctgcgacgccacgctatcatcaataggactgcagtgatttggagatgatggttgtgtgattgtgtcctggcagtggtgggtgtaatctctcaaagatggatgtactctagggctatgcagtgaataaaaattggggaatgccgaatggatcctataggattgcgaggatagcaaagagccatagtatatttgtttctttacctttgactgcaagtgtgtgcagggatcgagaactctagatgcgaatggattgtactatatgggcagccttatatagcgaggtaactctgtcaatttggcgggagtaaaattttgctggcaattactttttgagggaaagtatgttttgctggccgatttatgcgtgcgtgcataacaaattagtttgtttgtgctgatccaaaatatttgttcaccagcatttgttaacaacctctcataaacaaatatggcaattgtttaatgaatcaataacctgtggagtgaaaaaaaatgatacacacatgcacattaattgttgatgtgggttggcaccagccacgtgtacctagagatggacacgtttagtgttgcacacatgctcagctgtaatttatccctttcataatccaggcttcag

SEQ ID NO: 47717 - DNA, 1431 bp, Oryza sativa
tgtaccatggaacatacgattggtagaaacagaagcagggcctggagaaatggagatgacaagcaaactgcaaaaataaccatttcaaatgtgctatcgatggtgttttttctatatatttcctgaaacaatcatccaaccgtttttgcttcactggtggagaaaccatctttcgtcggtcggctgaattccacaatagtctcggatgcaataaaaaccagggctaaagataatctttagtcccggttaaaaagggtaacggcatatttgatctttagtcccggtagatcatctttagtcccggttcaaatgctgtcagggcctgtcaggcccccaccaaccgggactaaagatcgtaactttagtcccggttggtaataccaaccgggactaaggatctcggggatctttagccctggttggtaacaccaaccgggactaaagtctcacccctatatatatgtcttcttcctcgtccagctgcccgagcaaacttcaaaatttcttcaaaaaagaggggaggtcatgccaaaatttctagtgaatttattttggtgattacatacaaatcggaggtgcctaaaaggtttgcaacttcatcctccaatgttttttttgtcatattacatttgcagctatgttttgcacacttttttgtctccaaaatttagttgtaagttgatgagagagaaaatttgtgtggggaagaaataatatatagaaatttagttgatttgctaaagaaggttttataaaatagttgagaaagaaaatatagtgaaagttaatcttaaataatagaaaacaaactaaaatgaaaattaaaagaagtaaaacacattaaaatttgtttaaaactttagaaatagtaaataagaattatttggtgtaatattttatgatttttgtatgaataaagatatgtcattattgtataactgttgaaagagtttgtaattatcttataattattgtatgactgtcattattgtaagaataattatttgtgtacgattttttttcgactcatgtagatggatcggcaatggatgtacgctgaccggcggtccaaagagtttattgacggcgcgcactattttttgagagtggccgaagctaacaggcaaaggggttttatttgttgtccatgcaataagtgtaagaatcagaaggagtattctgcatccaggactattcatttccacttgtttgagtcggggttcaggccaagctataattgttggacatcccacggagagcaaggtgttgaaatggaagaagatgaagtggaagacgacaatattccggactttgctcagtacgttggatttggaggaaatcaaacgggcgaggaggaaaggatgcggatggtaacgacgttgcggatgatcttggtcagatgttataggacgccaaggaggactgcgaaag

SEQ ID NO: 47718 - DNA, 2901 bp, Oryza sativa
cggtgaggagtacgagaacctagaagcatgccctgtttgcaaagcactacgatacaagattagacgagacgatccaagagaagttgacggtcagctaacaaagaagagaattcctgctaaggtgatgtggtatttccctataataccacggctaaggcgtttgttcaggaacaaggggaatgctagaatgatgcgatggcacgctgaagagcgtcaacaggacgggatgctgagacaccccgccgatggttcgcagtggcgaaacatcgacagaaaatttaaagaatttggaaaggacgcacgaaacatacggtttggtttgagtacggatggcatgaatccttttggagagatgagcagcggccatagcacttggcccgttacgatgtgtatctacaacctccccctggctatgcatgaagaggaagtacataatgatgccgattattattcaaggccccaagcaacccggtaacgacatcgatgtgtacctaagaccactggtcgaagatcttaaactgttgtggaagaaggaaggtgtccccgtgtgggacgaggacaaacaggaggagtttaacttacgagcgctgctgttcgtaaccatcaacgattggcctgcacttagcaacctatccggacagtccaacaaggtgtacaaggcttgcactcactgtatggatgaaacagaaagtacgtatcttaagcactgtaggaaggttgtatacatgggtcatcatcgattccttgcagcaaaccacccggtacggaagaaaggcaagcacttcgaacataaggttgaccaccgtacgaagcctaaacatcgcagcgggaaaacagtgtttgctatggttaaagatcttaaagtagtgttcggaaaggggcctggaagccagcctatagagagcgaagatggtcacacggcgatgtggaaaaagaactctatattttgggagttaccctattgggaattcttgaacgtccgccacgcaatcgacgtgatgcacctcactaagaacctttgcgtaaacattcttggcttcctaggtgtatacggaaagtcgaaagatacactggaagcacgtaatgatctgaagcatatgaaacaacgcggcgaccttcacccggaaccaaaggagaaaggaagccattacttgcgtccagccagctacactcttagcaaggcagagaagaaaagtatgtttgaatgcttggagagcatagaggtaccgtctggatactccaccaatatcaagcgaataataagcacgaaggagaagaagttcacaaatctaaagtctcatgactgtcacgtgttgatgacacaactgctaccagttgtaataaggggtatccttccagacaatgtccgggcaacaataacaaagctatgtgcattcatgaacgcaatttcgcagaaggtcatcgatccggatagattagaagcccttcagaatgatgtggtgcaatgtctcgtcagttttgagttgatatttccaccttcatttttcaatataatgacacatctgctttgtcaccttgtcaaagagatcagtattctcgggcctgtgtacctacacaacatgtttcctttcgagaggtacatgggcgttctgaagaagtatgtttgtaaccgtgctcatccagagacaagcatcgccaagggatatggaacagaggaggtcatcgaattttccgtagaatttatcgaagaccatcgcccaatcggggtacctgaatcacgccatgaagggagactacgggaaaagggaactctcggaaggaaagcaataatgacggtagacaacaatttattccgtaaagcccatttcacggttctgcaacaatcttcattggtagctccttacattgaggagcacttggctctagttcacgccaggaacatcggtaagtccgatgcatggattacacggcatcacattgatactttccccgcatggctacgataacatctcatgggtaacgagtcgatcaaccaacaacttgccttcctggcgaggggaccgtctgggtcgatcgcgacattccagggatatgagatcaatgggtacacattctacacgagagccaaaacagtgctgttcgtgtcgatgccatgggacacgatggaacaactggcacgtattacggtgccatcgaggacatatgggaacttgactatggtcctctcaaggtccctctgttccggtgccaatgggttaggttgactggtggaggcgtaatgattgatgacagtgggatgacaacggttgaccttaacaaggttggatactcggacgaaccttttgtcgttgcgaatgatgtaacgcaagtcttttacgtgaaggacatgtctagcaaaggaaagaagggcagagggcctgacgagcctaagcgtcacgtggttctcccaggcaaaagaaaaatcgtcggagttgaggacaagacaacaataatttttcgaagtaattgtcattaatctttgtactttaaataattttaatgcattattttctattttagaagcacatatgtaatggaaaataatattcagtgcgcttatcagtagtcccagttcttaaccctaaccgggtttaaaaagaatttggaaatagcgggaaaatatctttactcccggttgatgagaataaccggaagtaaagaaaagaaaatatcttttctttagtcccggttgttctcaacaaccgggagtaaagatatctttactcccggttattctcatcaaccaggactaaagatctaggggtatatatattcccatgcgcgccctcatcttctacaccaacacttagaagtttttgcccgatcgatctctctcggctcctccttcgccgccattgcctacggcatccccgcgccgacgccgccgccgtatctcgccgt

SEQ ID NO: 47719 - DNA, 17014 bp, Oryza sativa
cgtgtacgagaattaaacgtgaaagaacgaacaaacgtgaacgaacgagcgtgaacgaacgtcaacgaacgtgaacgtgaacgaacgtgaactaatgaacgtgaacgtgaacgaacgtgaacgtgaaatgcaatataggcaggtgaatgaacgtgaacgaacgaacgtaggtgaatgaaacatgaccttaacgagaacacgaacgtgaacgaccgtgaacaaaacgtgaacgtcaaatgcaatatattttacttcgcgtttatcctaatacatctttttgtatcttgcagaaaagacgttgtcggagtcgtccctcaagccggagtggtagctagccctcgaaggaattcgcgcaggcaagtgacataattatatatatgattgttatatttgtaatgcaattaagactattagatttaatatacgacacttagacttagcatatatcactatttgagtttcagtataagattattagatttgtaattagactttgcatataagattgtgtagggttctaatatacgacagttacacttagcatacatgactatttgagttttagtataagattatttgagttttaatataagattattatatttgtaattagacttagtatataattattgactagctagggtcctataatatatgtctcctagacttagcatttatcactatttgagttttagtataagattatttgagttttaatataagattattatatttgtaattatacttagtatataattattgactagctagggtcctataatatacgtcacctaaacttagcatttatcactatttgagttttaatataagattattagatttgtaattagacttactatataatttattgactagctagggtcctataatatacgtcacctagacttagcatatgattgttagcatataagattgttaaaacataaatgtctcatgacttagcagatgtttcctgtatgaacagatggctgattgtgatgaggaacatatattgtacgatacaatcgcggagggaagcagccagtactggaacgaagaagaggggaacgaggatccaaaccagtatttgaacgaggaagggaacgtggagagggatgcggaggggaaccaggaggggcacgtgaaaagggatgtggaggggaaccaggaggaggaggctagtggaagtcaaccctccgttggacagaagagggcacgcgggcaacgaggtgccgcgaagaagcttgagggtcggcacatcataacggaagtgaatgaagacggccgacctagtgccccggcagaagccgccaagaactatgtacgtcacagcggttgggttgtgcgggataacgtgcctgtcagtacggtgtactggcgcagaacaagggcacgcggagatcatgagagctttgtcccagattcggagaaagagatgctgtggactacaatgctcgagacattcacccttcccgcgggtacagaggacaaagtgaaaaggtggactctgaagaaaatggcagaacagtttcagagcttcaagggagatctgtaccagaaatatatcctgaaggggcagacaccgaacttcgacacattcccaaagctaagggatcactgggacgagtttgttgcatataagacaggtgaacaagggcaggcgatgatggaaagaaacaaagaaaatgccgccaagaagaagtaccatcaccacttggggtcaggcggctataccgtcgcgatgcctaagtgggaggagatggaggctagcttgcttgagaggggtatcgaaccggccaccagtaattggccggaacgatcgaagttctggtactatgctcacggtggaacgctcaacccagctgatggctccctggtcttcggtgatcagatacgcgaggctgcgcatcgactaacagacgcagtggaagcctcttctcagggcacgttccgaccggacagagagaagaacgagttgtcactcgccctgcagactccagagcatccaggacgaacacgagggaaaggggtgattccttggaagattgggttcaaggagggcatccacacgtacaggagtcagatgaggagcaagagagataccgaggcgaagattgcagatctagagttcagggtatcgagctacaagctcagcatgcaagaggaggtggcaaggaaggttgatgaacgcatggccgcacatcggtcccatgatcccaagctgaccattcctcctgcaatggtgagcccgtcaggaaaccatagcagctgcgcctcaacggggcaggtaggatcatagagcatggacgccatgcaaacccaggacgaatccacctgccccgttgatgacatcactcagcgaacaccatgtgagctgcatattcctttcaagaacttatcaataaaggtaagctcgtagtttatagattttagattttgccattccgctagttgctgcttatatatgttgattactaataaataacctctcacgacatgaaggtggcgtcgggcatggccatcccaacggacccttcaggtacttaccactgcaggccgattccagcaggatactccaaggtcgaagttaagttggtcgaaggtgcgtacgaggacctcgagctggattaccctggaggagatggtgagacgcatctacgagacacaagtcacgccattattctatggcgcaagcggtacatcatcctccctgggcgacaagcggcgtctcgtgcaccatctcctccggcttcgccatctcctcctcaggctcctccaccgtctcctcctcatgctccagcaccgtctccaccttaggctcctgcaccgactcctcctcaggctcctgcaccgactcctcctcaggctcctacaccaactcctccgcaagctcctcttccggcaccttccaagtcaagggccccccaagctccaccgcctgcccccacaagggcaacgaagaaggcgaaagttgacgccaccaagaacaaggacccggggtacgattgcacgcaagaggagcttgaagcttacgtggcatcagaagtcaagagacaattcaagcctcgaagtccagaaaagaagattcctatagacccgagtgtcaggaacttcttcaggggtatgtctgcacctgccaaggaggccataaagctatcggactatgagcgaacgctcaagaaagcatcttctggaaagtccaaaccagtccctcagcttggagagcaaccaaaccaggagatcgagccgttggtgaccggtaaagattttggaatacaagaatttattaatgacaccgggctaactacggatcaattgctaggagacgcaccaatcgaaaaggcggaagtgaaatacatgtacgaactcggtaaaccgcttgtcaagcctgagctgctgcagtccctacccacacaaatatacaagttccatcagctgtacatggagatgagcgccaccggtagagagatgatcggagcgagggtcagggacacggacttcttgcaaggagatgacattctctagatcaatttcaagggaatctacgaaatataccagctggacgccctcgacgtctctattatgagttgctggattttgtaagtatatcgttcagttagatttcttactacgtctcctttaagtaattaggtccttttatataagtagactatatataatatatactcccttttatcgttatagaatggagattcaaagggctcaacggcggggggttttcgatactggattcatcgaccctcggaaagtaaacgtcgcaatgctcgaccaatatccgcaagccacagaggacaatctcgtccatctcctgaaggcgcagcattacaagacgttcatactgttgccgtacaacacagagttagtttaattttactgtcttcctataccaaatttcattctcgtacgaacttgctaagtgtttcatatgtaatgcatcccacgcactttgcagattccactgggtgcttttactcttcgacctggaggcctgcaccgtcaacgtatatgactcaatggataaaaaagagtctacgtttgacaaggttttcgaacttatagacacgtactgtcataagttcctatgttaattaagaaaatcttgttatattaattgctactacgaatcatagctttaaactccatgtagggcttggtatcggttccgtcatttggtccgcggcaactggagagaaagacttaggcggaagttcaaattttctgtgagtacacatgctctatatttatatttctccgattcaaatacatacaagtgtatattaattagatctctcatcgtttgtcatttatttatagtgcgcaaagcaaaagcagggaactaactagtgtagctactacgtgtgcgagtattgccactgccttgcagaccaaatcatcaccacaagagagctcgatgtacgtataaataaattcaaaatttcattacgtatcgatttgttgttaaattactaatcaatttcatacattcatatagtttattcgcatgagggataacctgatcacacacaaggaatttatcgcggcggttcaagaacatctcataggattcatcaacgaacaaatccttgatcccaagggtgaattctactacgacggaaacacaattcataggtccttagtttctaagctagcgactactactacgtcgaaatcgtagctagctaggacatataatggattgtaattaatacatgactatgtttctatatgcatgtgtacacattttctataatgtaaatatatattttggtcatatatatatataatgcataacatatatatgtataaatacatatatattatgcatgtacatatgtattgaaacatatataaatataatattatatatatatatatatgcatatattattgacggagctggtggctcctcaccgggagaccgcgcaggcccccctttgccagttcggccgggggcttagggtgaaatctcaagctctcgctctctctctgtatgtggaaatatcgtccgccagccagaaacacgagacaccggcgatctatacaggttcgggccgctgagaagcgtaataccctactcctgtgttttggtggatctgtgtatgaatgggctacaagtgtgagctgacttctcccccgttctaagctcacaatctggaaaagaatcaagaaaaaaccccttctctatgggcaaggtcctccttttatacttcaaggggataccacacgcacccttctctttccaaactggactgttctttttctcttgaacgggcggagatcagcacggttgctgtccgaatgacgctccgatgggacagcccacgcctacctccacttccgccgggggtgagcgcgtcgtgggagcatggctgtgcgctgacgatatgatcagtgtcagaccggtcacaaatcggtcattcttgtccaccgcgtgtaatcttggcaacgtgcatgtttgcccttcttcactcaacatctcgcctgtaatggttaggatgaagcctggcatatatcgtccggggctaacgtgtcatctctaatagataacgcgcctaactccggcttgagacgagtgcctagaggctttcgtcttgacgggacggggcaaggcgtgcgtcagaccgccagtcgccacctaacccgtgatctgaccggtctgtgactggtcacagaccggataaaggaacgcgccatactgcgctgcatgcagcgtgacacgcttgaccagactgcaataaatgctgttaggtgagcacagctgtgctcacttatcccatatatgtcgcgcagacttccttaaggggtcggggtgcctcggccctcggggccggggcaagcgcaacccgaccccccctcgggggaaatcaggaggagggcggacacctcaccctcgggcccgacgtccccgaaggtgccaggccacgtgggcggttgcgtctgcctcaagcctctggtcatgatactcccggtcccatatcaccgacagtagcccccggcgttatgccagagcaatttcccttcccaagggaagcggtcaggtgtgacgccaccctgtgacaggtgggaccggtttccgtagttgggcaaaatacccaacggtctcaattcacgcacattggtattggtaactttggttgtccataatgggcggtctattcaagactgccacaccacttgagcagcgcgcgaatctgggtgagcagatttgtctcgcccggagatacggtaacgccgcttcggttggcgagcgtaattaacgcgcgcacgatacaatccgtttcgattgccacaactgcacatccacttcaagcgccgtaagcgggcgaatgggattagtggaagcgtgggcacgggaaacgagggagcgagatagcgagatacgagggagcgaggtagtgggcgcgagaaacgaggagccaggcccagcgatggcaagggtataaaagcatcgagaaaaggatttgctcccttcctttcgccattgttcctcttgccttcgctgcctgagctctaactctttctctgccacgccctactttcgccacacgcgctcgttcccaatcatctcttcctccaccgccatggcacggggctctgctctgctcgacggcagtgtactgccgccttcccgcatcgtgaatgagaggcacgccggactgccgcgccgcttcatgccggagtccgccaccggtcgggagatagtgatgctgggcgaggggcgcccggcaccagactacccggggcggtccatcttcttcctccccttcgcaatggctgggctggtcccgccattttctcatttcttcatggatgtcctggagttctacgatctccagatggcgcacctcacccccaatgcggtgatgacattggccatcttcgcacacctgtgcgagatgttcattggggtgcgcccctctcttcagctgttccggtggttcttcaccgtgcagtcggtgtcaccgccatcggtggttggcggctgctacttccagccgcgggggtcggtgttgaaccgctacatcccctgcgtcctccgcaagaagtgggacgactggaagagcgactggttctacacccccctcgccgacgaagcgcgcctccgccttccaagccagcccccggcgcaggtctccagctggcgggcgccggcagatctgggggaggagtacgacgccgtcctcgaccgcctggcgggcctgcgatcccaggggctcaccggggccatggtgtacggcgattacctccgtcgccggattgcgccgctccaacggcgcgcccggagcgcttgggagtacactgggcctgaagattacatgcggacccatcagggaaccagatgggattgggctcctgaggacttcaagatcgtagtccaaagggtgcttaatcttagctccgcggaggcgtctcgccttcctcaggagatcctccccctctgcatcgatcccgaccgcgtctccattctatccattatgctgggggttggggcctcagaggagagagcccctaagagccacgatggcgcgggcgagagccgccgggggaaacgatctgccccaggagggggtcgtgcttctgggccccgcgtcgggggctcggggagcagccgtcctgccgacgccccggggaagaggaagctgggaggaacacctcccccatctcctccccgagggggcggggcggtgcgtaccagcggtcagcgcccggagggggccgcgccgacgtcacagcccgagggggagcgcaagaagaagcgcctccgcaagatgggggagacggaaccagcccggggaaacttaatttcccctccaaggtggtcattcaaccgaccccctcgcaggttcgtctcactctcattgcaaccatctttctccaaaaagaagtttttttcttgctcattttgttcgccttctggttttttcttctgcttcagcgatgtcccgtcgcattcctcccgccaccccaagtccggccagtccgaggccgaagatccagcggccgcagaggagcggaggcgggagtctgaccggcgtgaagccgcagcccgccttcgggaagctgaagaggccgcccgggaggccgcccgggttcgccaagcggaggaagctgctcgggaggaggccgcccgggcccgccaagccgcagaagctgcccgggaggaggccgcccgggctcgccaggctgaggcgacagcgtcacttgggcccactccctcgggcggccctcaggcgacatcctccgaggcggctcgcgacgaggccgcgggcgcatcgcctgggcctacctcaccgggcgacgcccaggaccgaacgggcccgggggacatccccgagctcagcgtatcctccggggggccaagccgcgtcgccttttctccaaggcggcttttttcctcatcttccgtcgccccggtgagcgccgagcccattatgcaggccttggccgccgcaaacaccgcggtgctggatgggttcaacacccaggtggaggccctgcgtgcagaacgagcggagctcgaggccgcatgggcgcgcgtcgaggaggggcggcgctcggtggacgccatggtggaggtgggccgtaaggcccatcgccgccacatctcggagctcgaagcccgcaaggcggcgctggcggagatcgcccgagaggtggaggaggagcgagaggccgccctcgtcgccaccaccgcgatggtcgaggcgcaagacaccctccgtcttcagcacgcaagctgggaggcggagctgaagagcaagctcgacgccgcccaaggggttctcgactccgccgccgcccgagagcggcgggcaacggaagccgaagcggcgtcccggcggcgcgaggaggcccttgaggcccgtgccatggcgctggaagaacatgccggcgccgtggagaggggcttgatggaccgcgaggccgccactgctctccgggaggcgacgctggtggcgcacgaggccgcctgcgccgaggaggagtccgcgctccgccttcgcgaggatgcactcgccgagcgggagcgggctctcgaggaggccgaggccacgacgcgacggctggcggacagcctctccctccgcgaggcggcgcaagaggagcaggcgcgccgcaaccttgaaagcgtccgtgccgagagagccgcgctggagcagcgggctgccaacctcgaggcacgggagaaagagctggccgcgggggcgcgcatcggtggggcggctgcgggcgaaagcgacttagccgctcgcctcgcggctgccgaacacaccgtcgctgacatgcagcgcgcgctggactcctccactggggaggccgaggcccttcgcttggcgggcgagattgggcccggcatgctttgggacgcggtctcccgcatgaagcgcgccggtcggcaagcaggcctctggggaggccagacgacggtgccccccaccaatctggaaggcctcgctccgcacctcaacaggatggcctgggttctcgaacgactccccgaggagcttgagaagaccattaaggcatcctcgagggacctcgcccggggggcggtcgaactcgtgctggcaagttaccaggcccgggatcccaacttctccccatggatggcgctggaggagttccctcccgggaccgaggacgaggcgcgcgcgcgggtcggggatgctgctgaccacatcgtcaacggcttcgagggctcggcccctcggctcgcgttcgcccccagctccgacgaggaaggcgacaccagcagcgaggacggcggtggcgacgaggccggcgacccgggcgcatatgaatgagcccccaggcccccgccactcttaacttttttcttgttctttcttctaaggccttcatgcctcttttttgtacaatctaacttaatctgcaatgagaaatgatgaaaaatttttgtgttagttttattttgctatatatatgagttgaggatgatctgtgccatggtccttttgcgccttagcttgaaataagggctcgcgcccaagtcccggtcctcgaatggctcgggtcggggctagtgcctggggagatccacatgtcgagactggccaggccgggaacgtggtgaccgaggggtatgggtgacccgattgtgggtttttgccgattcccccccggagttcaccacgccccggggcacggctcggttctgggccccgtttggcgattttagccgaccgaaccgagcccccgagggcaaggttgagtacgagtgacattatttcaagtcaagattcttcaaaaggaaaaaaacggcacagacacaacctttaggaaattgaaactgcttttattgaaatgctgaaaggaatatatgtgcatgtgtggtagcccccggctaaccctgcacacccgagggggggtgcggggttagcccgagccgaaacctgacacccgaccccccccttcaggggtagaagcgacgaaggtgttcgatgttccacgggtttggcagctccgtgccgtcgcccgtggccagccgtaccgagcccggccgggggacaccgatcactcgatacggaccctcccacattggtgagagtttgctcaatccagcacgcgtttggacgcggcgtaggacgaggtcgtcgacgcagagtgatcgggcccggacgtggcgctgatggtagcgccgcaggctctgctggtagcgcgcagctcggagggccgcgcgccgccttcgctcttccaagtagtcgaggtcatctctacgaagctgatcttgatcagcctcgcagtacatggtggcccgaggagacctcagggtgagctcagatgggagaaccgcttctgcgccgtagacgaggaagaaaggcgtttccccggtcgctcggcttggtgtggttcggttcgcccagagcaccgctggcaactcctcgatccatgaatcgccgtgcttcttgagaatattgaaggtcttggttttaaggcctttgaggatttctgcattggcgcgctccacttggccattgcttctggggtgggcaggtgaggcgaagcagagcttgatgcccatgtcttcacagtagtcgccgaagagttcactagtgaattgggtgccattatccgtaataatacggttaggtactccaaaacgggccgtgatacccttaatgaatttaagagcagagtgcttatcgatcttgacaaccggataagcctcgggccacttagtgaacttgtcgatcgcaacatacagatactcaaacccgcctggggcccgtttgaacggtcccaggatatcaagcccccagacagcaaatggccacgacagcggtatgatctgcagggcctgggccggctgatggatttgcttggcgtggaactgacacgctctgcatcgccggaccagatcgactgcgtcattgagagctgtcggccaataaaatccttgacgaaaggccttgccaaccagggtgcgcgaggcggaatgggctccgcactcgccctcatggatgtcaacaagaagctcaacgccttgttcctgaggaatgcacttcaggaggattccgttagccgcgcgccgatagagggtcccttctaccagcacatagcgtttggaaatgcgttgtacgcgttcactcccttcgcggtcctcaggtagagtcttatctgtgaggtatgtttggatctcagagatccaagcaatcaatctaagggagcttggaacgctctcttcgggtcccgaggcctggactccgacgggcctcgggtgccggtcaggcgcatccgtctcccctgaggggtcgggtcgcgccgacggctgggtaagcctttcttcaaaggcgcccggtggggtctgggctcgcgaggacgcgagccttgagagttcgtcggctatcatgttgtcccttctgggtacatgccgaagctctatcccgtcgaaatggcgctccatacgccgcacttggcgtacgtaggcgtccatctgtgggtcagagcaccggtactccttacagacctggttaacgactagctgggagtcgcctaataccaagaggcggcggatccccagtccagccgccactctgagtccggcaaggagtccctcgtactctgccatattgttagtcgctcggaagttgagacggaccaaatatctgaggacgtctccgttcggagaggtcaacgtgacccctgcaccggcgccctgaagagacagagaaccgtcaaactgcatcacccagtgggcggtttgaggcagctgtgaggggttcgtgctggcctcgggtattgagacggtctctggagccggggtccactctgccacaaaatcggcgagggcctggctcttgatagcgtggcgtggttcaaagtgcagatcgaactcggaaagctcgattgcccattttaccactcgtcctgtaccctctcgattatgcaagatttgaccgagggggtaagacgtaaccacagcgacccgatgcgcctggaaataatggcgcagtttcctcgaggccatcagaatagcgtaaagcatcttctgggcctgtgggtatcgggtcttggcgtcccggagggcctcactaacaaagtagacaggccgctgcacctttcggcgaggccgatcttcttcgctaggggccgcacccccggggcgttcttcgtccgagtggcccctcggggcgcacccgtcttctgtgccgatgacctcggggtcggaagacgacaggagcggccttcccacagtggcctcgggaccgtcctgggggttgggggctcctggtgtcatcggacaagcgggcaaagggccaactccggtcgtcaggggccttaggccaccgttcggctcgggggcctcttctccctgctctctcccgggtcgaatcggtacagggttagcctcggggtcagagggtgataggtgcggcctccccgcagtggcctcggggccttcctgagggtcgggggcacccgacaccgtctgacaagcgggcggagggccgactccggtcgtcgggggccttaggccaccgttcgactcgggggcctctcctccctgcctgctcccgggccaagtcggcacagagtgggggtgcgcagaatgaggattgtcctcatcgcgctccacaaccaacgctgcactaactacttggggggtcgctgctaaataaagtagcaggggctcatttggctccggggcgactagaaccggaggagagctgagatatgcctttaactgagtaagggcatgttcagcttcctccgtccaagtgaacggccccgagcgcttgaggagcttaaacaagggtagcgccttctctcccagccttgatatgaaacgacttagggcggccatgcaaccggtgacgcattgcacgtccctaagtttgctgggggggcgcatccgctcgatagctcgaatcttctcggggttggcctcaatgcctcgggcagagaccaagaacccgagaagcttgcccgcaggtacaccaaacacacacttatcggggttcagttttatgcgggcggagcggagattctcaaaagtttccgctagatctgaaagtaaagtttcttggttgcacgtttttacaaccaagtcatcgacatacgcctcaacattacgtcctatttggctacccaaagaaattcgagtagtacgctgaaaagtaggacctgcattctttaacccgaagggcattgatgtataacaataggttcctacgggggtaatgaacgcagttttttcctcatcctccctagccatgcgaatctgatggtaaccagagtatgcatctagaaaacacaaaaggtcgcaccccgcagtggagtcgacgatctgatctatgcgaggcagggggtaaggatccttaggacatgccttgttaaggtcggtgtagtcgatgcacatccgaagcttgccgttcgccttgggaacgaccaccgggttcgccagccactccggatggatgacctcacggatgaacccggcctccaaaagtctagccacctcctcgcggatgaaggcttgacgttccggggcttgccgccgcactttctgccggaccggccttgcgcccggccgcacggcgagacggtgctcaatcacctccctggggaccccgggcatgtccgctggtctccatgcgaagacgtcagcgtttgcccgcaggaaggagacgagcgcgtcttcctatttgccatccagaagaccaccgatccgtgtggtcttggatgggccgtcgcccaaggcaacctccttgaccggaacctcatcgcatgtggccatccgctgcctcggggcggtgggggcagaggggccaagcctctcgtcaccaccctcgggcttggacgcagcagcgaggcggtccgcgcgctgctccatgcaagcaagcgcgactttaaggtcgccacggacagagatggggccaccggggcccggcatcttcatccggaggtaggcgtagtggaccgccgccatgaacttcaccaacgcgggtctccccaggaccgcgttgtagggcagactgaggtccgccacatcaaagctcacccgctccgtgcggaagttggcgggtccaccgaaggtgaccggtaggtcgatgtgacctaatggccacgtgtgccccggcgtcacaccgatgatcggttgagacggctggagcaccatccccggggccttgatagcatcaaaggccgcgggggaaaggatgttgagagccgctcctccatctatgaggacacgtcccaacttcacgttgcagatggtgggggagaccaccatcgcaacctgccctccccgggcaatgcacggtgggtggtcggtctggtcaaaagtgagagcaacctccgaccaccgcgcccgacgcatcacctcatgggtaggggccatggccagaagctctcgcttcatagccttgaagctccggcgagagacgtgagcacacgcccctccatcgacggtggcaatggtggccccaggttcttggaaacctaggtcatcatcaccatcatcaatgtcaacagcgggggccttctgcttggcctcacttcgccgtttgccggatgggaccgccggggacttgccctcgcggcgttcctgcctcctgtcctcctcccacttcctcgttcgctcagccaaatttttgactgcgcgacagtccgcgagatcgtggagggaggtgttgtggacggagcaccacctgccggcggggcgctccctgctgggtgtaccagccccgttctttttgtcgctcgcaggcctcccctttcgagtggcccgcggagcgccctcgacggcgaggacatgaccctcgtcgccggaacggtccggcctcttcttcctcctcctgtcacgccgccctgtctgagcggcggatccgggggcggccgaagctgccactccggaaccggaggagttccaggtccacgcttcctccttacgagccactcggtccgcgagctgaaaaagctccgcggtagtctggggctctttggaagcgatcttttcgagcatgcggttgtgccgcacgccccccctgaacgcgtagatcaccgcgtgtgcagggatgcatggtatagtgttgcggacttggcaaaaccgctgaatgtacgagcgaagcgactcatcatcgcctcgctgtactgcatgcaagtccgcttcttcgcctgggcgcggatatgtgccttggaagttcatggtgaactgttggcacaaatcttcccaggagtggaccgacgcgggtggcagattcattagccaaccccgcgcctgtccttttagggccatgggaaagaagttcgccatgactctgtcgtcacccccagcggcctcaatcccggtcgtatagacctggagaaactcggtggggttgacactcccatcatacttctcggtgatggtgggccggaaccttgggggccaacggacattccgaagactcgccacaaaggctctacagccaacaccaccggccgggggcacggagggctgatcttcacgtccatgtcgaggtgacactctggacgaggaggctccctccgttgcacggggagtacgccggctattacgccggcgcccgatgttgaggcgggcatccggctccccatgctgatcctcccgagtcgacggtgtagacgagggagtggcagccgaatgacgtgcagccgccgccgctcgccgcgccctccgccttgatgacacggagccggtggtagcggcgccggaggtcttggtggtggtggcggaccgtccaccagcacccaggcgctgctgtgccgtcatgaccaagttggccacgtcttccagccatcgttgggctggagactccgggtcatggacgacaggcgggtgtcgtaggagcgcgccagcagcctgaagcgcaccctgaggtgtgctgccgtcgccgtagacgaggaggcgacgctccccatctcgccgttctcctgcatcacctgcggctggtgacgccgcggatttgtcgaccctctcaagcgcctccccctgcttagggctttggcgcggaggaggtggaggagtacgagctcgacggcgcggattcggctccccgtcgtcgccgctcacactcggcgagaggtcgtgtgtttttccttgctcggccattaggctgaacaagaaaaacttggggcacacggaagagtctgagagctcagaaagcacacgctgagccccctacctggcgcgccagatgacggagctggtggctcctcaccgggagaccgcgcaggcccccctttgccagttcggccgggggcttagggtgaaatctcaagctctcgctctctctctgtatgtggaaatatcgtccgccagccagaaacacgagacaccggcgatctatacaggttcgggccgctgagaagcgtaataccctactcctgtgttttggtggatctgtgtatgaatgggctacaagtgtgagctgacttctcccccgttctaagctcacaatctggaaaagaatcaagaaaaaaccccttctctatgggcaaggtcctcctt

SEQ ID NO: 47720 - DNA, 1903 bp, Oryza sativa
ggaagacaattctttttagggataattctttttatctcttttgtgtccattgttggatgaaatgctaaatttgtgttaatgttttcttccatctacgtcatggccgttagtcaaattaatgctagtcaaactatgttaaggccacgaaaatatctattgatagcttgatttatctcgaatttatgttaggatgcccatcgatccgctagaggaggtggaagcggttttgctcgatttttcttaggttttggttgaagattgaagcctacaaggtaaaatgcactactcatttgtatggatctatcagccattcgtagatctgttctctagtgttatgctaaatttgaattaaggtgacgtgggtgtgtacaaaatcctcaattttatcgtagggtaaaatggtccttcctcgttgtttttattctaatgtgcttgtaaattatgaaatcttcattgttttttccttcacggtttgtaataaacgataataatcgcaggtacccattggatataatagatttagaatggataactacagcgagatcgtgactctgtggagtatttcaggggagtaacggctctcgttgctgcggccaccagcacaaactcagtcgatgcaccggaatatatttggtgtccatgccatgattgcaagaaagacaaacaacttccggctcaacgggtccattcacatctccttacaaggggttttatggaaaacttccttagcgaggaggagcaaggtgagagaagtgatggcaactgtcatgggcatgatgcggatgtcggctgcgaggaggaggaccaaacatgtgtcgattagatgctgcgtgacggggagagatttgacactgatgatagggaatatcacaagttcacaaccagggtgaaggactccaaaactccagtttacaatggatgtaaggcggagcacagcaagctccaagtggtcctatcgctgcttcacctgaaggcgagcaacggatgttccaataagagcctcactgagcttttgcaaaaaagtccttcaatttttatgtaactagaaaaaatgctcgtgcgttgcaacgggtgaagtctattttaatcttattatttttatatggtttagttaagataaaattcactgtgggagttcgcttggatatatttatttttagaaaatcatgagatgcagttagaagtccgatcgtcttaagttagcatgcgagtttttttagcagatttcttgtatgattccttctgtattactaaaagtgaatgatctttaaaacctcaaatacagatatgtatttccaaaagcaaacaaacttaaaaatcgactcatacacagatgatgtaccaaaataccggcaaaaaacatctttaatttttataatagtagagattcgatctcagtcccaaagaacagtacctcagagacgctattttatgtagagacccttctaaaagccggatattccaaacaatggatagaaaaatagctactccctccgtccctaaatatttgacgtcattgaattttttaaacatgtttgaccgttcgtcttattcaaaaacttttgtgaaatatgtaaaactatatgtatacataaaagtatatttaacaatgaatcaaatgataggaaaataattaataattacttaaattttttaaataagacgaatgatcaaacatgtttaaaaaagtcaacggcatcgagtatttagggacggagggagtaattaggactgcgcttgaaaaagtgcaagtataggggctttttcgcaaatgacctccactaaccctagccagcgccgcccccttgtacctcttcctctcccgccgccgagagccgcgcgcgccgacgcctccgcgtgcagagccgtgcacgccggcgcgcgccgccacccccatagcccg

SEQ ID NO: 47721 - DNA, 2829 bp, Oryza sativa
ggtcgccggcccccgccacgaccccttagttagcagccggatccggcgccgtccgtctccaccgccgtcgtagaaagcccgtaggccacctgtgtcctcttgccgcccgatgtgacgaggagctcggcggcgccacacggaggtcaaccgatccgcatcatccacgccacttaaagtgattatgatttgtgaatcaacggatttgagatttggtaagtgacctctccctctctcaggttttcctcagctcttgatgattttttttggatcttttatgtactttcttcatccgctaacacatgatgagtcgagtagctagcatctccatggcaatagaactaagaagttcaaaaaaattgtatgatcaataatagccttaacaaagtgacctctaagcaacaaatctactgtcccaggggaaaaattgtgatattttgaaggaaatgctatagtggttaaatacttaaatgttcgcatgttgaactgttaaaaacactcataacttgatgatctcttgacagaacctagacaaggaagggctcttggagcaactgctacagtcagctgctctactggttagttggtcacttggccgtcacttgtcaggtagtatgcacaaccttgtggtatatcatctgctttatgtaaattagtttggctcatttttactaatgttataactgtgtgtttagcctgacggtgcagcatttaaaagctaacttatacagtgtgctttatctctgttatagctgacctcggttgtaagttctgaattttgagtggtgttggtcagaacaatttatctgttgcaatattagcttttaaatgttattactgatcatacaatttttttaaaatgtattacgattcatgtaagtggctcctaacatatgacctgacatatgttagaataaatccatctctgtgtatacattttctggtgtgtccctgaaaatcttgcgaggcgttcggggaggtgctagttacatgtatgttacaaaattaagttttgtgatagctaattgatattgattttgtgggcggatgcagctgtggcctcggtgccggtgaagtgacctgcgcggtggacaagtgcaaggaggagctgagcaggtgccacgactagcaccggtggcacaaggtgtgtgaggcgctctccaagctgcccgtcgttgtcgccgattgtgagatgctcttttgccaacagtgcatcaggtaaccaatagtttgtcagatagaaaactaaatcttggtaattgatcttcaggctaagtatgatggggatgaggaggagcagaggtggcctaaatctgatggacaagattttggcagtttgggaagcatttgggatatggcaggtaatttacacaagcatgaaccataaaaagcaggatttctcctacatgattgcattagctcaagtatcagaagtaatggtgtaactggaatctaagtcttactgaggcatatatgtgtgttgcacttatcaattaacgtgtgactgggagagatcaactttactgcttgttgttgcatttacatatctttctgtctatctatttattatttgactttgtgattcttcacatgtattggatgaaattcatcggcaacctgcatcactttcactttccatggtctctgcccaggctccagaatccgtggttaattcattaccatgtaagagctacaaaaagcagacagcccaatgcagtgataacatggaacagtgagattcttaccattcaaattttatcatttacttgttgtcacctagggccaaaaatagttctgagtgtcattgaagaatgtcaagttcgccgctacaaatgcatcacattatcttacgcgtttgaaataactatgctgttcatgtccattatccatcaaaaaataaattgagaccctgtacaaaatccttattattttatttgccttacatcagccttctaatatggttgttgtagtcattttagagatcttatcaaataagcattttgtcatgggcattgggccaaaggccaaggtgtttagcgttttggatcatgacacatttgggggctaattctgccttaacaatattgtatctgtcataacgagctagaaccatgaaatatttgggggctaattccgccttcatgatattatatctatcacagtgggctatcctaaagttgaaaatcacagtgagattctattatataacaagttattcttactgaaacttgacacgattttttggactgcatatcatgatggcacctggatatgtggataacaagttaacaacatgatgataaactattagaagttgaggatgccctgtggtgctcagcaggagctttgaggctctgtgagttacttagtaggtcgctaacccttaatgatatgaatgtgaattatatgcaaatgtctagaatttaaatttccaattttctggacttatgaattttagacttgtgaatttatgatctaagtatatatgtgcaaattaatgttcataatttagacaggaatttttggacttaaaaattttagaccacaatcttttgacttaggaattttaaactaggcatattttgagttaggatatatatgcaaatgtttaggatttaaagataggaatttttggatttacgaattttgacttagacttgtaggtttttatatgttgtgatgaatggcttgtaggtttttattcgttgtggtgaatgtgaatgtgaatgaatgtgctgtatggatgtggggctgtagggatgaatttgggtttatatggaattggggttgaatggatgaatttactgcaattattttttttttggcccaaca

SEQ ID NO: 47722 - DNA, 1144 bp, Oryza sativa
tccctgatctccgcagcccacttgcccaacggtcgccgcctcaccccgcggtacttgcgcgctgtcgcgggcgcagccaccaccaccgccgccgccgcctcggccacgtttgccccgccggcgtgatctcccgctgtaaattaaacatcgcagtacacaacacaacataaacacacatcatcatcatccgttccgcgggtcgagcagcacaggatggagcaacaaacagaggtaccggagacgacgccgaccatctcctcctcccgcgcaacgtcgacgcgccgcccgccgcctgttcccgcccgcggcggcacgaccaacgacggcgcgggcggcggcacgcagacgccgccgccgcctccacgcccgccgtcggcaatgacgcgcgtcagcgcagccacgatggccgccgtctccgcggcctcgaagagcgccgccattgccggcggccgcatcgatcaagattatattcaagaacgctgtccgtccagtgggatttcgcgtggcgacgtcgagatcgaacgtgcacttgatcttgctgagggcatgatcgatacgtgggggagggaggcctatttataatggagtttgtgagtgaggcgtgtgtatgatatggccaacgcgataaggaaaagaagcgtatgggcagcgtttccagttccatgcaatggaagaagaagaacttccagaagttgctcgacttttcccagcttggaatgtatggcttcgtgacctcactgcaattggccgggagtgttttcgtgtgctttttcttattatttcactacacctacgacatatttttaagagtaaagttcatcaccgctccctaaacttatattgctgtgtcatcccggtccctaaactcgcaaatcgaccgttcagatccttaaacttgttcgactgtgtcatcccggtccccaaacttgcagatcactcgtttaggtcctccaacttgttcagttgtatcaccccggtccctaaacaggacggtttaaaaactttatattaaaaagtaattcataactttttcatgtgaactctaatgaagacaaattttatatcaaaatggtagccctcgacacgacctacaactttgtagttgataagtttttgaattaaaactgtttagggtcctaaaata

SEQ ID NO: 47723 - DNA, 3756 bp, Oryza sativa
attcctgcagccctatagatagcatggaccttgctaaataacttcacttcaatattctcattgcacgaagccaaagataaatatctgcatttttgggaattaccaatagttgcattctgagaatgagacaccatttcaccctgtaaaatttgccgagtaaggtcaagaaccaggtcatgcatcttgcatatttccatttcatcatactcatctacctctagatcttggagaaagtgcactttcagaagagaatcaaagcagtcatttgcaacatcctctacttgttcaatctcattcattggattgatgaagccatttgctatccactctccgatcaactggtgtttgtagatcttgtagcctttaggaaatatagagcaatatacaaaacattgcttcagatgatcaggcagatgaaaatagctcagccttaatgacgcaaacactctatcttctatatcatcaacattccacatgttactatcacgtaaggcacaccatgcatctactgttttcttgttacggaggacacctgcaagaattttaattgccagtggcaccccaccacattttttaataatctctcttccaatttctacaaattcagagggcagaccttttgcagctaaccttaaactttgttgaaataaattccagctgtcctcatctgacaagaaagccaacttatatgtacatgtagattccactgcctccgcaactccctgatcacgagttgtgagcaaaatccggcttccaggtgatccactcttaagatatagcatgaatcgttcccagtcatattgattcttgtgccaagcatcatccaagacaagtagaaacttattcccattcaactcgtttgaaattgcttcaaccatctgttggtcggtacgaagatatgatgttttctttaaaatggcttcatacagcttgccgacgagtttgttattatcaaattcttgtgacacgtgaacccaaaatattgagccttcaaaatgctcttttattttgttgtcatgacagatgtgtgtggccatagtagttttaccggttccaccaagtccaacaattgaaactattgagattttctgttggtcatctattaacttacatatgatcttgtgcttctcctcatctcacatgtatttttgagtcatcaacattgcccaataaggatggctcactgataatcttgtttttatgaacattatgatcgattggtatagcattcaatatagtattgacatcgcctctttgctcgacaattgcagcaaatctgtttttgattgtctttatcttgttggccattttgagttgaaacatggctagttttggttttgtgcgcatgtatttgagcacagcatacttgtcacgatcattatctgtgtcatgtttctcagactgaagatgaaattcatgtaccaaatcttcaagatcgtaagcaaaatctttcaatttttttagccaattagatggtggtttattaccaattgcattatcacctgctacctgtagcccgcttttgatctcctcaactaaatcttgaagctcctggagatctttcgtaacacccataagagaactatactctcttattacaagtggtgctaacttgtctcccacaatcttaaataatccatacagcagcttccatgcccatatgtttgaaacttggaagcttctctttggcccaaatcctacatattaaatttcagaatgagatgctacatactgaatttcaaatgattcaggtgcaatattcgtaattattttttatgcaatgaaaactaacgctagtatatgtttgtatgcctgattgttattttctttctaagttcaaccatgttttacacgtgcagagcaagatagacatataaaagcgtaacagatgacgcccggttaatggtacctgatatggaaaaataggtgttaagcctttgccttctcttcgttgaagttgtgcttcttcgatctctttgaagatgcacttgttttgttcaattgttcataacatcatgatgaaccaagaggtacatgtatgtgatatattgaggacaggttctgatgtatatacaagaaagcaaactagtaaataacggaagatagatgcccatgaaagcttctagcacacaagaaccatcagtaagttgtgtttctattgaattgtaaatatccgtacttagtagtactgtagtagagtactagctccctgagaagaggcagaacaatcccctgagaaaagctgaacaaaagacaaaccatttgcaaaagagattagtggtggagtagattttggagaacacattatcttaacataaaaacgcgagaaatttagttttgaaggatacaaaagctgaggtaattaaacacctgatctcaggtcgtctgacttgatcctgcagtatcccctcactgtcccaagcaacacaaataacacctgtttcttgggatttagttgcagagtggtggtggttctggcagctccattcattagagctcccttgtcaccttaaaatgtgattagtatccaccaatttgggttggtgtagtgctgggtgagttggaaacacatgcccacaacatataatataaatcgaatatccaccaattgcagtttaaatacagaaagctggtgtggaaatgtcactttcgaaaccactctatggcaagccagtcaaagaaggacgatcctcacaaaaatcatagtaataatctagttttgcttagctgttggtagtcagatgggggctgtatgaggacagcgatttctagtttggggctgtagttgcaagttgcagatcgaagtatcgaacaagttgagctcccccctaatagatctagtctgggcgggccagggagagagagagagaaaggtaggcgtgggggatcagggatgcgatacctaacctcgtcgtggagatggaagacgacgaccgcgcggctgcatcgttgggccatgcgtccgcggcagtatgcggatgggataggagccggaggcgaagggaggggagcaagccgtgagtcctggcggcggcaaccggcagcaacggtcgcgcaagcggtggccgaacgattaacattggaatctgggttattttacattctactagcatagttttagagaacttactttgtaaattaaccctatataaaattatttcagaattagaccattatctcgatgttagtgaccctcgccaacgtacaatgtctcaacaccaacgatattagtattgacacccttatcccccccaccccccaacagtcaagatgtagaggatcagtgccactaaagagattatcatcgaggacctatttataaaataaattttttaaaagaggttaaaatgtaaatattctttcttcaaatcggtttttaacataaataggcttgcaccaatagactatttatcaatggagcgggcttgccatgtttggtgattgtagtgcaactttcctgacctctttttattgctatagtgcagccttcatgcgcagaccatagggtcaatcaaactcatgcaaggcccaaaatgacgcaacttgtatacaatggatacagatcatctgcagtatagtattacacactgacatgtgggccttacagaccctcaagcccatatgtcaatgagtggtactgcgggaaatctcaattggtatacaattaagtgtttttattgtagtacaaattttaagtcacatatgcgcttatatttttctaacagaggaagtaactaacttcaaaatcaggtgagt

SEQ ID NO: 47724 - DNA, 2880 bp, Oryza sativa
caatgtaataaaataacatacatgtatggacaccttaatacgaccacgatcagcggaatgttgtgacctcattgtcttatctctaatatatatcctaatttccaattacctaatatctacatctgacaaatgtgggagaggatgtgctagtccttcccctgaccttgtaacacctactcaaagcaaggatgtaactaatcagcaaatcatataaagaagtaaggcattgtatggagttgggagaggagtcaaggactaaaggccaaggtatctttggctagaaagcggttgtgtagagagtttgcccaagtgattctagtagcatgatgagcacacgggtaggaaacaaaagttggaggtgttggagcgaggtgagcccatgatggagcacgatgtattttagagagcatctcgagggcacggctttcttgtatccacgggttttggagggggggcttttaactatttgccactcttatgagtggtgcttaacgatttgccactaggttcacatgtcatagacacatgagggcccacatgttatagacatggtgtggcaaatcgttaattgccatgtcacaagagtgacaaatagttaaatttccctttggagggaggtgaggtgttcaatgccttcaactccctccctcatattactacaacgagaaatgcacaatttaaccaggaaatggagatgtaccgtcatctcacgtgccactccacatactttcggtagattcctcatatgcaattcaactaggttaggaaatggagatgtaccgtcatccaacgtgccactcctttgtctcatcatccacgtgatgggcaggaacctccataactaacaatttctaacacatgaaatcgatcaacgtgatgggtacgaacctcaataactaacaatttctaacgcatgaaatcgatcgtgttttttatggtcatgaactataattagcaacttgtttttttttgaaacaaaagataagcacactagcctctcaaatgaaataatagaaaaaacttgtgctgagtgttggtagaaaattattattagcccttcttagaaagagttgtaagcagacaagaactaatctaatgtatagagcagtggcatttgccctcatcaatttttctctttagtcataccttaggttctatgtcatgtggggcctcaaggcctcggtatagagtggtaggtcgccggctcccactattttcagaaatggttatagaacggaaatctagatgacacaagaaaaacctattttcaaaaatgattagaatggaaatcagatgacacatgaaaacaaaaaagcatatagcaagtgcaagaaacaaaatgaatatgcgttaggattacattaatactggctagaatagcttagctttcttttgctctagatgaggcttgcacctacacaacagtgcaaattagagtacaagagcatgttaggttggtgcctgaagagcatgcctgacagaaatgcatcattgctgctcatcgatggaccattggatagttttgctagtggcctcgtatcactgatatccaaactagcttgtgctcataaccgtttctttggtaaacagctcgtatttctggaaaggcaagctagccgtccaaactacgctcgtaatcgtttcttagaagccgcacgacaaacacaacacacccaccaaacctcaattcgaagtactattagcacttcacaacgattttcctgacttaacagtaatagcaacgatttttcttttcatgctaaggccccctttgatttgtaggataagtgtaggaaatttgaaggatttcaatcctatgaaaaaatttcctacgaaaccctttaaaacgaaggattgaatcctatactatcctttaaaattcctatgagatgggtaatcctatagagattttggaggaaagttagcaagaggtccttggaaaaattctttttgagtctatctctctcatccgattcctgtggtccaatcaaacggtcattcctgtgtttttcttgtattttccaatcctctgttttacattcctgtcagaatcctgcgttttttcgtattcctctatttttccattcctgcgattcaaaggggcccttaaatgaatgaagacaaacaatggaccatagatttctcaatatacaggaagtgagaccatgaatagctgctgcaaaaccatattagatatacaaacgtcatatatgacagaaaagaacaatatttgaacaccatgaaaattgctgcagtgctcaaaaacttgccagaacaaaattgtggtggcattactagatgagatcaagcaacacaggaggaaaaaaatagtccatgcaagcctaacaattgtgccatatgtatatcaatataaatttctgcatcaataccatattaccatgatagaacaccaactagcattttcatagaacaaggacaagttagcaaacaactacaaccagcggaacaaaccttacagtaggctatagccctatagcctacctaaacagaggttttttttcccaatccttaagagacacacaactcccactacttgagtggtaaaaaagtttattattacaaaacaagtttatgattatgaatggcacggccattctggtagttgcgaggtatattgttagtccagagttatccacggtgcaagtatatgcctctaattgagacaaatatacatacctctaagaatgcaataaatgccacagaaatttataatgaaaatttccaattctatttcaacctataaggttagttttggtacttccttttatggggaggtatacaaggatggttgaaaacctcaaacagtaaatgtgatcgaaaaaagcattttaaaagagagctgacataggctacaatgaa

SEQ ID NO: 47725 - DNA, 4280 bp, Oryza sativa
aaatttgaaaaccctaactacctgaaatgagcatgtcacaatcacaacataacagtagcggtaccaaagcagacagcaacactactcgcagaatcatcttaacatagcataacacttgcagtatggatcatcttaacaacataaatataactcaacataggtaacaggcaaaaccatattccagagactagagtagagtcttaaacatttcaatcacatccatttcacaatgtcaaaaaggcaaggttcagggctaagttttaaaagactaaacttgaaagtaatgcagtagctagatagatgtagaacaagccaagtagctccattgatagggtggaaaagagaacaccgctccgaatcggtccggcgagcgctcagcggtacgacttctggaaccttgcgcgggcgccgcgaccaccgaacttcttgggctcgcagcgcctggggtcggcgacgaggagggtgcggtcgtagcgggcaaagatgtccttgacctccttcttggacgcctcgtcgacgtacttctggtagtaggcgacgagggccttggcgatggcctggcggatcgcgtagatctgcgacgtcttcccaccgccgcggacgcggatcctcatgtcgatgtccttgaagcgcgagcgccccgcgagcaggatgggctcgaacgccttgaggcggagcatctccggcctgatcagctcgatcgggacgccgttcaccttgatcagcccgcgccccggcttgcagtaggagacggccaccgccgtcttcttgcgcccgaagcactggaccgtgcctggaggcgggcgggtgagcgcggcggccatggttgcggtggtggcgcgcggcggcggcggcggcggctagggctcaggcagcttggtgcgggagagaggcggcggcgaaggggagagatcgcttcgagagagcgattttatagcgaggggattagggtttagctctagtgggccatgggggatagttagtgggccattatgggctgggctagaattagttgggccttcgcgagcccatttggtgggcgcgtttttcgcttgtaaaaaggccgtgggggaggaggcggcgagctagggtttcgaccctcacgaacactacttgatcttatctgagcttgccgtccggcggcgccgcggctgccggagtcgcctctccggcattcgcgccgccaccgctgtcctcgtacggttggcgggaaggtggcgcgctttgttcggggaaagaggcgggtttggtatccgtggcgctcgccggcggtgagcgatgacgactgcccgcggtcggagcgcgtgcgatgatggccgcgcgggttcaccaaaacaacaaacagatcacaatgttttgcgttttttctgccattgttttattgatgatttttttattcggagttctattcatttagttgttctcgtattagtcaatgtgcgttgggttgttagtggtttcgtagatcctgtttggcaatagtggatgtaaaagcgctttttgtttgtgtagaatgtgttaggatagtatacaaatgttttgtaattgaacatgtgcatagatatgttagcattgtacttgttgagcttactttgtaagtttgggcatatcgaattttgcttaattatcattgaaaccttgttttcatcctagttttgtagtttagtttttaaatatgtccatattacagtatcactccacttcagttcaatgtcatgtatattagcatgccatgttttcgatgatgttgtaggtttatatcaatcaattattagcttaaagaggatgatatacagaattctattctgtggaccaaacggaaccttgatggtttgaggacagtcccttcaatgatatacaaatcaaatattttcttgtgtccttgagaaatttggaagacgcactgttaaaatccatgtcttttttgctatgcatggctgatgtggactctaatttctcctcggttttgaacttttgatgcggactctaattgcaagatccttttgaaaatcgtggtttttcttccacaatgtggttttgactaaataaacgttcaaagtttaaaaaaaaagccctcatgacttgacttgtgcatttttgtatcaacctgaatcagctcagcatcttttcttggtttgcaacattgcataagtttgtagggttttagaagccgtgcagagcactacaacagtgcctacaatccgtctgttggatgcacggcctttatgtgatcattctaatggagtaatggccttccattgctatatctggaacatatagataacaagtcttgttttgagtgcaaaaactgtcactttgatgtgatcttttgaatttgtacaaattttaatagtgggcaggtttaagcaaggatgaagctgctgctgtgtaagcaaaggagggtaacttctgaatatgactctgaacgttggtgtgaagttgcaacaacgggaagatggcgagtatgttgaagaaaactgatgcagtcatgaagatcatatttaatcttttctactaccagttgttgtcgatggcttcttcattctttgttgctgatctatcgctgtttgtcaccgactcgatacttcccttttagttttaggttgactaaggctaggtttgtcaccgactcgatacttcccttttagttttaggttgactaaggctagcttaagcttgggtattttgtctgtatgatcacctgctttgctttccctgttcccaaatgtactctgaaaataagaactatgttatttctcttcatatcaaatgtataaatggttaccctgttaaaagagattaatgaactgtcatgtggttcttattttcctgatgattgccagcggcaaactgcagattcaggtagcttaaatgcttaatgcatgcagaattgcagatagctcattagaatagagctgtaatacagatttcgctgctatcagaatataggaggaaagtaatgccgttcaagagtttgcccgtgaattctgagcttttcttggaccttatttctgttcaacaatagcgtccccgaacggtgtgctctattgtaagcctagggtacgataactgatgcccaagagctgatcaaaccaactaaccaaggaacagcaaatgcaaaaattactcatcaatacataagacggcttaacctcgcatatgaccaagtctaatgctgttcacaacatcatgttcagaaaaagaactttgccaccctcttttaatttacttttaagagtatatgttacaaaatcaacaatcttttgcctgccagtatacacttcggttggacagcctaacctaagctatgagccaacaattaacctgatatctttacatctcactgttccttgctaatctgtccgattatgttcatgaaaccatgagacgtgtgcaacggatgtgtcagtgaaatgctagttagattagccaaggccctagataacatgcatacaccgccttcctgtttattttcttcctgtgccagatcttgaaaatcttctagactaatggatcttctccatgtttattttcctctatcatatctagaaaatcttctagacctatgtgacttcaggcggattgctggcacctttctagccaatgcttgccagatcatttggaccgcatcatccttctgtgatgggtattgatactcaaaatgtttatccacttctttcagcctattccacatccttgtccattgatgcttgcttactcctctaatcagcctcatcaagtaacccttttttacagcatcagatgagcgaacaaagatagaaaacttcgaatagtccaatgcatcttcataaggaagctcgatgtcgtcactgatgataacagggacgcaatgacttactatagcgtcaaacaggcgattggaagaaggggtgtcccctgcaatgtttaggcaaaattttgatgcgtgcattcccttactggctttactggccccatggtcctggacacttccaaaggcaaaataaacatccttttcatctttgagcatataatatagctcctgcctaatgttccctccctgaacaaaaatgatgcaatttattagtccatgaatcgctagttttgtagcatatagataatatagataaactaataacctaaagtctacatgtatcaacattaacttttaaagaaggatacacatccagctgacaaaaaaaaagttttgacacagtaaatttatttgatgccagatggctgaaacagggaacatctgctgatatgtcggcattcaaacttttgatgattcatatgttgta

SEQ ID NO: 47726 - DNA, 5183 bp, Oryza sativa
attcctgcagccctgcaagggagactgtcgatcgtaacatatgcacttcatgtcggcctttgggagcactgataagctagttcttcttgagctgtcttgatgcatcaagcagcacatggaggtcgctaattaattggtctgttgggctgcagctgatacttgagccgtctcagctgcttcctgctcagctccactggcgtcactgggcacatccacgaccatcttggaaacacggaacatggccaggtggatgtcgcctgcaataaaatgcaaaagaggaacaagcacagactgatcacaacgaagaagagcaggcaagagatgctgcgagttgtatgcagtctgaagagagtgaggtgagctaatttgtagcagtaataactaataagtagtagtaccaaaaatgaggaggctaccggggtcgatgggagtggggaaacccgggctgaggcgcctctcgttgatgtaggtgccattcgtgctctccaggtctgttaccaacaggctcccctctttcttctccagccgtgcgtgcgtcccagaaactgctttttttcatgccattccattccatttcatttcatttgcagcaacttagtaagctacatatgtctgatggattatggagagagcaatgcaagtgaatgaatgtgctgcatatatatatgctactacctgttgcgacagacaggacgatgtcagcctgttcaggaacacgacccaccgtcaccgccgcctcctgcacacacaagacaacacattcattcatccaagagaacacccggctgcagctgagctagcacggttacagcatggatatccagagaatttctgggaaggtagaaacaaagagagacatacggatgctatctggaagccgccgggtcgtgcgacgcggtacccgatatgacgccaatcgccgtctcctgcaattcaacaacagcaggttctgtttgttcaggtggacagcaataaactcacgaatattgctgctgtgttctgttttgcaattttttcttcagaccagctagttaaagttggtaagatgacgatactatgattaagccggtaggcaggcacaagcatgagccagttcacaagggatatcgacattgcattacaagtatcattttcacaagtattgaaagcagactaacctgcaggctcaagaacccatctttctgaagtggcggaagaagacgcgctgtcagtgccactggaagagcacctcagcgacaaaatggaaatgcttcttctgccactcccgttgctgtttctgctggttagctgactgacgaactgcagccgcggctgctgcagcttcgccccattggaggcgtagctgctgctgcaaggaggcggcagtgacaagcaggaggaaggcctcctgggtgttgggctagagaagagcaaggaaggagtagccactgctgcttccatttgtgtctgtgatttgtgctcactgctcagcagtggcagggaaatgcagtgccttgctttttttgttcgcttcttgatttctttgtggatcagtggagatagaattgaggttgtttgtcctgtgttcaatgctatctctggactcatggccaatcagttgctcttcaccttcatctgttggtggtcgaggttcactgcttggtcattgtcggattctcccgttgccctacggtcccactctgcttgtctgcttctgctgtactgtacacaaataaattttttttctcaaacacatttttaagagtaattttagatgaaacaataacactcctccaaatttcacagaaaaaaaaaagagtactccaggattaacattgcagtaatcttttagcagtgcataaataggaaaaatgcataatgaataatttagcttgtttgagtctcaagagaagaaaaaaaaaacacacgatgaatattgtatctggttgagtctctagagaaatttagctcccttagttattctccgaagagggtttgtttggatgactcacctgcatagagaaaaacttgagaataaaggttagttaatcagtgagagaaagcgaaggtgtattcgaactcttcaagcaaaatttacacccattggctttggtgtgatgtaatgtaagcttcatccatagtatcagtatattcttttagcggttttacacatttttcttacaatatttgtttgtttctctagacgtgcaatgcaacacagtatacaacatagaagcgttagtatatttccatattattactccagcaggaaaatattcaatacaagcgacatctgattaagcagttcagcaacctacaaatttcaaaaacaaaattaaacatcctcgattctttcaataaataaataaatttcaaaaagaaaaattaaacaccctacatcaggccaggtcagctaaaagcccaacacgcttggggcctaatgctgtctgtgcttgggccggcccactcaggtccacttccggacccacacgccagactctctcgaggaaaaaaaaaaagaagtaatcgtggttagcaacctgccccttgttccacaacgacgaacaacatctcgccacgaggaggagggcgagagcttacacgagtccgaaatccccaatccgggatcccctgcttctcttcgcgccaaggtaagatctctcacggatctctgtgcttggcagcgcggatcgaatttttgtcattacttgtcctaatttttgttccggggtgtctaatttgggtccgatccgatcagatggcggctgcctgggcggcggcggtggccgtgatgctcctccttgcgcaggtgtcagcggcggctccggtgatggggcctgccttcctctgggcgcccaataactacgggtaacttgttgccacagcgtttctctttttcatcgtttcaagcctgagatcccttttgctagatatgtatgaatgtattaataatgttaacgatttttagtgaactctgctgcttcacttagaaaaggttgcaatttggtatagcgagtattgacataacacataactcttcatgaggtgcatgcgatttactgctcttcttttcttgaacgaatagtgcatatgcagttcgttcctcatgaaacaggaggcttcatgatcggataattagtttcctttgtatctaaggccacacccttgactctagccctgtgtgccatagatgatagaatcttcttgggcattcccaggagtgatcctcgcgttgtctcatggggtccagatcaaccacattcctttgaaactgcatcctcaagaaacgcccaggggtcttccagctagctccacaaggtggtgggctagatgacctgggttcgaagcctcaccccttctaattatttgatattaggtccttccctaatattcgcgtctttttttttcgaaactgcatcctcatccatcattcagtacagacaatcaatatggaggttttaaatctagaacaaccatagattccatagttggaggatttcggagttctcaacttatactgatcaagcagttaccttgcacagttgcccatttcctgctactacttcacatcagcgctccattttgctgcggagagtaaatgtataatttctttcgtcaaattccaatttatatggtggagggtggagtagggtggttgagagaaatctcagttggaagtgggatactggaaggttgatgagaggaaaggatgaaacccatacccatttagcaccctttcatttttggtcatatgatctggtatatacatatcaaaaccttctagttagaacgaagaacagagattgtcttgctgcttaggttttgtgttacagatttgttcagcttttctaacatgctcactcctatttgtgttgatattaggaaagtaaagtagggtatcagttaagacaggcctccattttgtatttgattttgcacagtgcacactggaatatcatggcttgcttcaaaaaacattaccttcttagatttttttagctcagctagggagcatttttatgtttttttttccatggggtttgtagtaatgctgcacacttatgtcttaagcatgctttccttagtagacaggtgcatccgtgcatgtggccgttagatatgctgtctttcttgcatggaaacttgcaatccaattgaaatcctgctaaaaattagtaatagctccatggggctggctctaaaaaaatgattttgtgtttgcttcagctcttattttatatggacaatctttggcctctaattgaaaaagatcttgaaactatgagttccattaaataggctatggcgagttcctgagcaatatgttatccttatctgagataataagaacattaaagcaatggagtaatgcaacttcatcactgattcttgcctagagcatatgttgcacctggtctgtactgtagatggcaatgtcatgcatatgagggtcacccatttttgttggtgcctcacattttcagttacttgctggctagattgaaattaccagttcatatagaaaatatttgctgaccttcttgtggttattttaatcaaagtttagttgtataaattacattttatttaccttgctcgccagattctcttctgatgagactaaagaaatggtctactatcagacagtatccccaaagagcttagtgaaatctgttcttgaggaaggtggttggtcaaacttggtggtgagttgagttccccccacgtcaattcacaaacaactgaccaatttcaattgcagtatctgctcttattgtgcacaaactcaaacaattcataacattgtgattttattttagtgttcaagggaggatcatgcaaagagtgttgatgttgcagttctttttcttggctcgaaggtacttattgactcccattcatttggtactgtgaactagtgtttaggtcttcactggttgcaatgtttacataattattgattcagtccacattgatcaaaaaattggaatacattttcttcatagtgtttctgatagacgataataatcaatactaagaggccataacatttccaaattctcttgtttgaatctgtatgtcaaaattattgctagatcaagtaatttatattatgatgctgtttcaatttttcaatgcttcagttgaaactgactgataacttattgttcctgtagctacaatcatcagacatttctaaagaa

SEQ ID NO: 47727 - DNA, 18799 bp, Oryza sativa
  unsure (1)..(18799): unsure at all n locations
gtttcacctagttacaaaaatgagcatgcaacaaccacatatataggcaagacgctcaatgaagcacggtgcatcattgatccagttgatcaacaaactattggcccgctgaaaacgttagcgcaacgaaccgcgtccaattggttaattagatgcatcattacgcgagcacatgtttaagcatggtttgattgtgttgttttcgttttacaacttattgtagcatatgtatttcttacattattttctaaaacagaaaacattatttcttaatgtaaacgaaaacattatttcttaatgtaatccgagtattgctattggctgaaagagaaaaggagaattaatactatcaggctgctcgcactttaaaaaccacaaaacaccccgcaaaaaaaccgcaaaacaaatagctcatgaacttttgttagaaccggatattgacagtggtcacgtgggtaggttggttagaattagaattccaaacaatacgtgctgtaattactgggctgcgcgcatgtgtcagcgagacacggaccggtttgcaggaggacccaggccgagtccgagtccgatccattcgtggtgggctggaccgagtcggaggccgggatgcgaaaggcattaaaggcggaggcggtgtcgaactcgaacccaaggcccaagatacaaagaagaagaagagagcgagaggagaagtaaacccaatatgtagctccaaggatggcgtgtaggatcgaatcacaagaattaaaccaactagatgggggtgaatggttggtatacccaaaaaccaaaaacttttagcggaaataaaagttaccctcgaaatcgacggaagtcggtctgaccgcccgtatgtcgccggtctgaccgccgcttgccgccggtctaaccgctgaaacccggtaaacacaaatcgaagaacttttaaagtggatgacgactttattgattctctctatgtttacaacgtgcaccaacagcactccttacaaaaatttcgactaaacttgaaaccctaactcaaaactcaactcaattgctctcaaaagcgataccgggaagcctcacgctccccctctatttatacatgaggtaggcagcctaaagccacgaaccaaactcatactaagaggcctaaacaacttaggaaaccctctagtacaagaaagaaactttacataaccaatcgtaccaaatttgaactccttccaaattcgactccgtatcccatacgcacataataactccatcgtatgccatatgaaatctccatcaaccacgtgcatcaactctagcctaagtatcccgcatgatctctgatcaccacggacgtcgtcttatctccaagccgactccctatcaatcaccgcaaatactctcccgaggcatcgagtcacctacacatgaaataaataaaaaaaccatattctgagaccaagttatctccaacttgactcattagtagcagacaacagtattacatacgtatagtattcatcgagaagtcataatcatgaaataatcacggatatccaaacaaacaacccgaaaccgaaaccgacacagtgtcggccggtcagaccgtgggctggccggtccgaccgctcgatcaccgccggtctgaccggcatacacagcccggtctgaccggtcacatgaaataataaaatcctgcgattacctgtgaatccaatcatctccaaaaccacttcgtgaataaattccaaataacaaaaccaataatctccaatgtctaattgttcatcacagaataataatcaaaaatacctttgattttatatggcgatgatgagggggtgcgccgatggggagaagcggcggccccatttcgagctggtgtcggcggcgaagaagaagaagacgacgacgacagaggatgatcatgaggaggtgttgctggcgtatcggccgcgcgagaaggaggacgggaagaagaggaagaaggtggtgaggaggctggggaaggaggaggtggagaggctgctgtcgttgaagctggccgtgccgaccctcagcgaggaggtggtgatgcctatgcctgacgacgacgaggatgatgtgtggcagaaggaggtgctgctccgagccaaccggttgctgagggagagcgccatcaggatgcgcaagaaccaggagcttatccgctccctcttcgaggccaagggctatgtcgacgtagaggatgaggtctccgacaacgagatggacatggacatgcagcttgtctaacataacttcacttcacctgtaataatctgaaatatatatatactgcaatctggaatacatacgggaaagttctcttaattgttgtgttgggccctctagtgcaataagaatcatgatgtggtcgacttttgtacccatgaaggctcttgaagatgcaagtttctgctttcgaaaccccgaaagatgacgatcaaacactatatgtaccgtgcatgtctgcccgggaccgggaggctaaagtgtgtaaactactcctagctagctagctagacgcgtttaactggagttccttgaaatatcatctctgatttaatttgttcgtacagagaattgccaaattcttaaccaagtgatctgctcatttctcactgccaattgatctgctttgcaagtttgagttttcttaggtgtgatgtgtgaagaggatctgcttgctgtatacagttttttttctctttttcacggagagttaataggtcccttaaaggcggaagaggatcctctcatttacttccctatgacttttaagtggcacaagttagtggaaagtaagttagagaatcttaatcccttaacagccatgacctcgaaagagaccattaattaattgagttccactacgatactctctactagtattacggtactctctactggtattacgaagcaatctaaaccgtttgtcccatttgattaaagggttcagatttatttataatatcaccttaggtaatggtaaaccggtagtagaaacgtgaaggagcattattataaaaaaaaacggagagatgcaatcgtcattttagcagtgactaaatcttttttttcttctttagctttttttatgaatatgggcaatgccaatgtaatggatggccatatatcaatctagacgggaaaaaacatatgacaaagctatccctaattattatattaataaattattgatttacccttaataataaggcaaaattggttatatgcctaataatattgatagtattataccactaggagagagtataggagcgctctaattaattatcatgttccatgtagtacgtcaatacaattagctagactggtagagaattactacagttgtttcaattcagtaacacgtacttgaggacagcacaaattaattaatttcgatcgctgcagttcactgttgaaaagttaagaatgtactgaccatggccatgagcagaacaaataatagtctctttggcctaacaattactaccaatctctaatctctcttttagtactactagtagcacagtctacacagaggaagtgagattcagaagagcaggagtaaatgtactaagtatttactccatccatccatccgtcccaaaatataagacttataattaattttcttacatagtcttatataatatactttaaccattaatacatttcatgttaggtttctgacaaatatgaaattagcctcgtatgaaaaatcttcaaaatataaatatagtgatataacgtacatatataatacttaacataaataaatatagcctaattttattttttttaagaaaagggagcgctctgtaatttgggaggagtatttatttagacaaaggaggaagtagtacatcacatcaattaagcaatagagcagggagataaaatagttagtatgtttgattaacaatggggaataaattcatttgaggtctcttaattttacacttaatccgattttcatccttgaacttcaaaaccagatataaccagtccttgaactttcaaaaccggtgcaaacgagatccctcggtggttttggcttacgtggctggtttaactaggtcttcgtcccacgtggtattgatgtagtgcttacgtgccaattccatcctagaaaagtaataaaaaccgtggtcccacatatcaattaaacacaaaaattaataaaaaaaaatggtggaacccacgtggatcctacatgttattctctctccctcttcttcctcatcctcactcctcttttcttcccagccatggaactagctcaccttcctccccattctcgcgtgcccgcggcgggcggcccgacaacatgaaggttgtggccgtcctcgggtgcttctcctcgcgctgtggcaccgcctcacggtcgtcgccgctgccgttgtcgtcgtccccccagtccccgccgccactgaggacgacgacgacgccgccgctgataacgacgcggggtcatctgggatgacgcagccacatggaccagcacgaagttaacgaggtctccatctcctccctttggacgcatggcaacaagaggagaggggagaggggagaaggaggcgtcgtcgtccttgggctggcctccgattgctcagcgtcgtccgcgccgccaacgttgttgtcgttgtcctcagccgccttgcctctcgcctgtgctccgcctgccgcccgccctagcctttgcctgctctggccctcttcttgcaggagagagaaaggggatagggagagaacaccgcggcgcgggcctgggcgctggaggtgcacgcgctgtggaaaggacctgacgtgacgctgtgggtggcgccggccgttgcggccgccccgcctcctccctcccttccctaaccccacacactgtcctcctcgcctcatccctctccggccgccgctcgccctaccctgcccgatccgccccgcccatagcccgctccagccaccgctcgcccatgctctgccagccggccacaagcagggggagaaagaggatagagagatactaagagagagagacgaggggagagggaagaagggaggtgtaacaccctgaaaattcgaccgacaaaattaaaactctaaaaatgcgggctttcaaaaactttttaaaccaattgcatcatgccgactttattcgcctgtttcattggattttgatgtcggagtctattaatcgcgaataatgaataactagctaggaacaaaccataaaagaaaatctagttgactaaataaataattaaaatataaattaaaataaaggttaggtgggtttggaaataaataaaatattatcgcaaccagattagcaataattaaattttagtacgatggaataaccctaattaaaataaactatataaacagaatatgagtgatattaaattaaggaggattttagttaggataacacaaatgtgggatgtacttcatttatacaagatttagaaattatgaaatcaaatttactttgaaaataacctaaaatcgggaataataggaaagtgcactattcattgcccgcaaggtgttcgatgtggtccctagcctttccccttctctcccacctctcccctagcccagccccctcctctgccccgcgcgccgcgcgcccggccgccccgagccccgtgccgtcgcatcgccgtcgcgtcgcccgttgccaccgcgtcgccgtcccatcgcgccgcgcaccgactcgtcgccactgccgagccgtcgccgtcgtcgcctcgcaccccgtgccacgccgctcccccgagccccgtgccgccgctgttaccgcgccgcgccgcccgttccatcgccgcgcgccgtcaccatccggtcgtcgcgtcgcctcgcgcctcgcgcccgcgcgccgctcgcccgttccatcaccgcgacgcgagcctgccgcctcgcgccccgcgccgctgctgtgagccgtcaccgcgcgtcgacgtcgctgcgcgaccgtcccatcgctgcgcgcgtcccatcgtcgctccgagccgcgcgccgccgctgccgagccgttcccatcgccgtcccctcgcctctgccgcgccgcaccaatgtcgccgtcgccaccgccgcaggtcgccgtcgtctcgcgcctcgtgccgcccgccgtcgcgtcgccgcaaccgtcgcgtcgcctcgcgccgcgtgcccccacctcgcgccccgtatcgccgtcgcgtctctcttctcccttcccccccccccccttagctcttcccctcccctatataagcctcactatttccccctcttcccctccatctccacccctctcctctacccacactaccgcgccgccgcctccacgccgccgcgccaccgcaccgccgttatcgcaccgccgccatcgtgccgccgcgccgccgccctcgtgctgtcgtgccgccgcgttcatgcccccgtgccgccgccccagtgtgccgcaccgtgcgccgtcgtcgccgccgccgccgtcgccgtcgccgccgtcggtgagccgctgccccccccccctctttcttttgtcgccgagccgagagagaaagagagaggccgagggaggaaaaggagaggaaggaaggaggaagccgggagggaggaaagaaaggaaaaagagaaaaagagaaaagagaaaagaaaagaaaaaggaggaggaaagaaaagaaaaggaaaagagagaaaagagaaaaaggaaaagaaaatttaagagatttagaatatttaacatattagaaattaattataggattaataagaatatcgttagatgaactcctactatttaaaataccaaaagtactaagatttgattatagaattaattatttacgaattaaaacaattagatgaatcttaatagattattatagattatttttagtaatgtctataggagatcaattcgcggtaataatttagatcaattcgcggtaattattatagattattttgggtaatccctataagtaatcgattcatggtagaaattcggatgtaatcgctaggaattttagacgtatattatattaatcgtttagtcatagactaaattaaattgtataatatttctaggatttcgtccaatatttaactcgtaatagaaatttctaacctattatatacaatgctcggggaaagtaaattattgacaacgaaataattatacccgcaaagtagtttaaatcgaaattgggtttgccgtagtttgcagatagtaaagttaataaaaaggaatcgactttcgcattcgactttcatttggatttatttggatttttatttgaattctaaccgaattcaaatcaatttttgcacgtaactatagagcccgagggagttgcggatccaagcgaaggccaagacccgcaagactttgagcaaggcaagtcatcactattccttgaacatgttgatcccaattgcgaaattgttttgtttacaaatagaattgcatgcaatgatgaacatcccacttgtgattatgccatgccttgattattgtttacccttaaatctttgtaaccatgtttacgtatgagtccctagtcaactatgacaattgcttagaaatgctattctagaattatgcatactcatatttatcaaatgctatatgcttgggcaattacctttgggaaggtaattgagatgcggcatgtggagacatgagcgccacattgccatgatgttgatgacatgatttgtgaaaggaaaaaataaaattaaacaactgttttcgactggggcggacggaggatttgggtggtatctggaaaaggctagtaccgtccccggtcaattaaggaccgagccatgaagttaagcatgaaacgacccccgtacaaccgtacttctcgaatgggtatagacctagcggattagatagccgagcggagacagtatccctgcatagatggttcacccctgagtgaggcaggtgcgctacgatgggacagccgttgaggtagggccaagaggcgtgccctacatcggtgtcgccattggtaggactgccatgagtgtgtgagagagagaacttaacttgaaccataatttaatatgtgtgtgagacttccctttcccgggagcgccagaactcctctcactgctagaaacatggacgcctagagtgcatgaggatttaagttcatggagcgggtactgccaatgcgaggttatcgaaaagctttgccgtgacgcgtctcatgtgttgggacgaggctcatgtgttgggcagtcgcggagtacgggtaaagtgtacatccactgcagtgtgagtaaaccaaatctattcgaatagccgtgctcgcggttattgagcaccgggacatgtattacacttggctagactctaaattcttaacttgtgtgggatgggatattgcatggtgatttttatgctgatggagccacttcctgagaggagggaaggtggacgtcctcagaaaaccatgacgactcaatggcgggaagctatccttgggatcacaatggatggtggacagaaccgtcgttgtttaatgtgaacactggaactaaaatttgatcagtctatgataggtcttaggcttgtgaaaatatttgcaaaacgcagctttatgcaaaagaacctaaaaccattccttgaataccctctatcatatgcattgttgttgtggtggcttgctgagtacggttggtactcacccttgctatttatatatcttttaggagagtgttgaagagaagcccttgtcggtacgcttgcgtatcccacaagatgatcggagtgcggtcttgttctaggtctcgttccccagtcgactgcctgtggcatgttaaccgggcccttatattattttgtcttccgctgttgttctctgatagttgttggcctacctggccctaatgtaagtgtttaactcttttagcctaaattcattcgtgatatgttgtgatccaactatgtatgtgtgtaccaactactgatccagggattggtacggataaacacagaagatttccgattttcaaaatcgggggtctacaggaggatagaggctgacatgtgggtccacggtttttattatttttccaggatcgaatgccatgtaagtgccacgtcaatgtcacgtgggacaaagacctagttaaaggagccacatatgcgccacgtcagcccaaactgcctggggatctcgtttgcaccggttttgacagttcagggacctggttgtatctgatttttgggttgaagaacgaaaaatcggattcggtgtaaagttaagggacctcaaatgaacttatttccaacaaatggtgagggtgtgggattgcagaagtagaagtaggaagatccatccgggtatggtctagtgggctggacttgtccgagtcagattacatccgagttagaggattccaaaaattaagcccagcccagaggtggtgatagagtcgagtcgaaccaaccaaaagaaagaagaagaagcaaagccccaaaatcgctagcaatggagatggagttagatggggagagtacatgcgctgctccatgcgagaagaagcggctgattaattccaagctatttcgagtggggtacggtctcagcgacgaagaagatgaagacggatgaggtgttgctgccttgctggcctatacattgctcggcgaagggaagaagaagaagaagaagaagaagaagaagaagaaggtggtgaagaggctggggaaggaggaggtggagaggctgctttcgtacacggtggtcgtgccgaccgtgagcaataaggtgctgggcagcgagacggtgcctgcacgacacaaggagatcctgctccaagctgtcgactccatcaagaactctgctgtcaccatactagggatggacaaaaagctcggctcgtgagctcggctcgggcttggctcgagctcgttaagctcggctcggctcgaagactaaacgagccgagcccgagcttcctccacagctcgtttgcaaatcgagccaagcctgagctagctcgcaagccgctcggtaggctcgtcaagtctgtggaaaacatgagtacatgacctgacctggcccattaacaagttgtatcagtctggctcatgagaaacagagaaccctaccctaccctaaccgctcgccgaccctccccattctccatcccacgcaggcgcaggcacgccgccgctcgcgcgcacgactggcatctggtggcgactggcgagaggagttgccggacaccgcctccgtctccctcccctgcgccaccgacccgctgtctccctccccagtccctagtcgtccctcggtgccgccggcccgccgcctccctcccctgcgccaccggcccgccgcatccctcccctgtgcggctgcgccggctccggcctccctccccagcgacgcttgatgatcgacggctcgacgctctgtgccgccgcagcgccgcctccctcccctgcgctgcctccggcctccctccccggtgccgctcgagctcgacgccccctgcgccgccgaccctacttgctgcttacatcacaagccggctcgagcttttatacgagccaagccgagctacactttttgctcgttccatttatcaagccgagccgagccaaagcctgtttttgaccaagctttctcgcttggctcgtttccacccctacacctaggggtgggcaaaaaaagaccgaaccgaaaaaccgaaccgaactaactgagaccgaaaaattcggtcacaaattcggtcatcagttgtaactaaccgaattttacacggtcttttcggtcatctcgttcagttaaccgaaataaccgaattgaccgaatcactatgaaagcccaatacagcccaatagcccattagctacagaaaaccttaacattccatcccgtccccacctccttcccactctgcccggtcctcccacaaccccacttgcgcgttgtgctgcctcttcctcgcgtttctcctcctcctctccgcctcttcgatctctgctttctcctcctcgcaccacgccgctccgcgttccccacccaccgcgccgccttcaccgcgcctccgccatctcctcgcgccacgcctctccgccttctcttcgcgccgcgcagcaccgccgccttctccccacgcgtctgcgcgcccgctccttccgctcttccgccacttccttcgaggctgatgggagacgcgagatggatgggatctggactttctggtggagtggttgagatcgacgggatccatggctggattgatttgcttgatttgattttttttccatgaatcatgctctacttgctacttgttggtggcatcatcatattttactcattcatcccagttgctttctcatcgatcttgtacagaggactcaaaaaattttttgcaattaatttttgtgctaagtttggtctataactgagaccgaaccgaactagccgaagaccgaaatgctcggtcttgagttttcttgaagaccgatcggtcttgtgattctaaagaccaaatttttcaaacaccaaataaccgaaccgaatttttcggttagactgaatgaccacccataccaccatacgccagaggcatgatgtcatccgcgcccaattcgaggccaagggctacgtcgacgtcctggcgaggcctccgacgactctgacactgaccaggagatgcatccgctgtaattactatagacgctgacaaactccactttacttgagcaagtttaatagtatagccaactattagctctaaatcatatatagccaatttatacaatagttgcttactatattattaatacctgaccctgtctatcatacacacattatgttttagagttcgtgctgtagctggctatagatctgtagcccgttgcttttttctctttttctttatctttttaaaatatgtttatagctggcttatagtctgttattgtacctgttcaaattcactagtatattactatagacgctcttgacgatgctggttacataatgtctcgttgatctgcatgtacatttgactggattactgaattcaacttgttaagtggaattaaaaaagttacgaggcctggtttaggtagcaattgaaaggtgacgagataaagcagcggcatactattatatgtgctttcatgatgctcttctcttcttttcttcctttctttcttttttccccatccatgacaaagtgcggccatctcaaatcctggaataaaacatatcctggaaatcatggaaacaaggcttttaagttgttgtgttgggccctgcagggcaacaagaaccatatggatatgttggtcgactagttgattttgtacccaggaaggctcttgaagctgcaaatttctgcttttgaaaccctgcagaaagatgatgatcagacactgtttgcaaagccgcaatataggaaccttaatttaacaccttttgcactgtggccgctcgggaggctaaagagtgaggtcctagctgcctaaactaggaacattccatatctgcataattgaagcttggtgattttccttcctagccaaaagtgattccctttcagcctgtcgagttcgtgggcatcgcatcgcatcgatctccctctggatctgggacgtgtttgtttcgactgcctccagatcacatctcttgtttgttcgtacagagaatatattttgcctgattcttacaccaactaggcactagtttccctttggtagtttaagctgaatgtttttgcaaatttgacgctgctcaagtgtgaaagaggcccctggttgctgtaagcaggtcaatttttaactgctatatatcgccatgaaagaggcgaggtagtgcagcaataggtagctatcaaattacgactaaatcaataaagtagattagcacatgattaattaaaaatcagctgcttgtttgcttcagactgaaaaatagattttttttaaatatatatatatatagttttcattaaaaaaccacagtctaatgatttggaaagcttgtaaatgaaaaatgagaaagtaactttttctataagctgaaaaaacggtgccctgagccgatattggtttcagtcctgtaatatgcagtgcaaaacagattaattaagaatttaagatctatcactgcagtgcatttttttaaatgcaaggaatatgtcatggccatgatcaaaacaaagtctagtctctttgatctctctattggtaccaaagcgcaatgagatccagaagagcaggagtaaaggagaggttagctggtctggtctggtccaaatgagactgtcctagtagagacatgatcgcgcatttctttctttatgtgattcctgtgcgtcccaagggccaacattaattctgatcgttcattttgcacccgacaataatctagtactaccagcatagagtacttaattagttgtagcagcaaaaaaagttcactatattactacctctaatcccaaaataagttaacttagtatgaaatgtgagttaacctaatacgagattctagattcttagtaattttaagatggaaggagtacatcattcacaagttcatggaggtgctccctccggttccatattaattgacgttttagataaggttgagatcaaacttttataactttgactatcaataactttaaaaatatttagtttaaaggaactagaacaatatatatatatttgtctttcaaagcactataataaaaaaagtaaacatgtatttatttattatatatattataatagaaaaataaggtcaaaaatatattttgtagaccgtgtcgttgtccaaaatgtcaattaaaatgaaactagagggagtagtctttagtgaagagcagagagagcacatatagggccatgtttagttcacccccaactaccccaaacttccaactttccatcacatcacatcacatcaaaaactttcctacacacataaactttcaacttttttttttcaaactcccaacttttcccaaacttccaacttttttttcaaactcccaactctccccaaacttctaacttttttcaggaactaaacacaccctagattgtttttgaggttggagttgtattttgtttgaattaacatgctgattatatacatttgcgatcgtgtgagtaatccaacacagtccaagccaacccagccagagggagtattgaagtattttatacatgtgaacacgtgtgtgtagcgcagatctacggacagtatatttgttggattatctatgtactgtagcatgcaatagaaaagcgcctttgttatttaaatggtgatgaaatcatggcacgaatcacgcaaagtggtttgattgacaattggagtagtaggttaagaggaagttcagtagtatagccaactactggcttcaattcatctatagtcaatctaatagctcatttatataatagttacatactacactattaatatctcggattccacctatcattcacacactgtatcttggaatcagtgctacagctagctacaaatttgtagcctgctgccattctctctccttatttatcttcttaaaatatgtttgcagctgacttatagcctgctattatatctgctctaatgccaacaggtagctgctaccgaccgactgactgagagctgactcaaattaaccttgaaccaagcaaagtaaatcaaccaggggttaatttagtttagtttattactatagattgctgacgaatctatctggaatagtacaaagtttttggatgtgcgtgcgcaagcccatatttgtttggtcgatgatgagaagaagaaagcatgtgcacatgaggatcagcatgttgatgctgtgggcgtgcaacgcatggcagcgagtaaaatgaccgagattgaaattgcagtgaaatatactaggatttattggtttcaccaggagtagtagtagtagtaggaaaaccgataaatccttccttgggttgatggatgggcgacgagctggcacatggagggaggagggcctacgttcgtacggtggggactagtcctttgggcgcctgcagtttcacgagacgagtcccggggctcccgactccattttcccagctgatggtcgaactgttaaagcaagtttaatactcccactggtacagaatataatcatttttagtgctagacacggttattaaaaaaatagatagaattaaataggggaggattattattggatgagaagtgaaggtaggtgaaaaatttgaatggtgaagggttatgattagttaaaaaaaaagaatattggtgtaaaagttattatattttgggacggagggagtagtagtttaatattataacccactactagctccaatacatctatagctaatttaatagccaattcatataatagttgcttactatattattaatatattgtcccacctgtcatacacacaattgcgtcttggaatccgcgctgcaactggctacattatctgtagcccgctgctcttttctctcatcttttatctcattaaaatatgtttatagctggctaatagtctactattgtacctactcttaatccctctatctgttagtagatactccatccatcccataaaagaccaacctaatatcacatccggtactagattggtcttttatggggacggagggagtagagttaaataacttttactccttataaccgatccaggtataatgttggttttggagtatttaagatgtgctgctgcaaatggtgaatggtgtgtattactaagggcacccacaatagttatctataggctctatacaagagattcatgtcagcatatttttctacttggaataaattaaatgaagagagagagagcaaagctatctactaacctggagatagtctatagagaaaaacgaggcaatggattagagagctatagatacccatgtagatatactattgagttggtttactattaatctagtttattgctgagatatacatattttatatggagagcaccttattttattattgcgagtgctctaatagcttgattagcttagcttaagtagacaagccactttagaggaacaatgaagatcagtgagacaacgaaggagaggggagtcaggggacacgagaattcgatttcattggagagaaagagacatacaacgtccaaagcaaagcaaaaaggagaaacaaacaaaagcaaaccnnnagaaactagaatatagagagagagagagagagagttgtggaatccaaccaaccaatatgcgccgctcctcttcactctccaagcagagcacaagaacgcgctttgctcaataacacactcccctagctccccgaggatgcctgcccctgcctagcttaatgtggaactaactaggagtattaattaattccttccactaatcacccatcagcgccaaccggcggccacggccaccgtccgctccgacgacgacgacaagttgccactgctcactgctcactgctctggaaggtggtgaagcaggtgtcgctcggcttcactatgaagggccaccaccaccaccattccttgccgccgtcgccgccgcccaagcgccggtgtaccgccctggccgcggccgtccctgcgctcgtcgtctgctccatcctcctgcccctcgtcttcctcctgggtctccaccgccccggtacgcgcgcctgcctcctcgcctcggatctgttctgtaccttacctacatgctgctcacctcacctcctgcttgtcttttttttcttaactgtcagcagggcatggatcggaggagcgcgccgcggttgtcatcagcactgtacgatttcatcaacacattttttccccctccttctgaatttcatacatgctacatttcgaaattacttatttttttctcattcttctgacgcgcgtgtgtccttttaattaggaaatggggtttagcaagcacaagcatctggatgggaggatgaagcacaagctactcaaggtaatgctgcttgctgattctgcccattggctgactcataactcttagtcgcccagctttactgaaagcataagagtgcatacgaagtttgaaaagaaacaaaaaaaaaacttgctggggattccagcgaactgggaagaattttcccatttgatattctgtcctgccaattggaagatttgtgtgactctggagtaagaactgaccttctgaacataaattcccaaattttcaggcgggttttatgggtaggtttctgtagtataaggaaaaaaaaaaacaagacggcatcggttcatgcactctgcatgtgtgtgcagtgtgcttgctgactctttactgccttctgccttgctttgcaggggtattcactctacactgtaagccagggctttgttgctattctggtattaccaccccaaaattgttctttgccaatgacactgacaaatggacttggactgttgctgctgtgagcaacatttctgatgaactgcacatctttccattttaactggtcttatttcttttatgtttttcttttgggccttacattgttgccttgctttcctcctaactgctgttgtcacacctaattttcaattaacatgctgttgtgaaaaatatatctactaatttaccctgcggtacttgcatgtaaatgtatatgtcctgtgactcatgtaactgaaaactgctctacagcactgcagcagactcccaagtggggcttcggtcgaatactatcgcagtatgccactacggctatagtatatttgctattcgtgcctggtatcgtcatgttgggggtgtaacatatggattagcagttttgtactaaatgtattgtattacaaattaataccaagtagatgaatcagctcgtatgcgatatggtttacactgctgcctaaacttattttgaatgtgcactgctattgaaatgaatcacccatgccattttgatatttgcttggttacaataatctttaagagcttgctccactgacctctcaaatgattcctattattttggctaatctcctttttgtggaaccaggatgtttctagaaagaaaattcctggatctgatgggattttgggtgagaaatctggtagtagatcaaagtccaagaatgtttctaccaaatcaaaagaaaagctcaagggtgttttctctttagttcagctaaaaaatgagaccagaaaaaacaaaggtaagaaatgtcagatcagattttgcagtgtgttactgcatttactttgtaaaacaagaactgcaagataccaccagcatccattttatagtatccaatgttatttcagaacttcatacacaaagaagataccagttaaaggacttatcctggagatcaaaggtaagaaatagtttctatatttatttgcaatcttgaggattttaatatatgtgcatttcatcggtttggagtaaccaacggattattcttgtctgtgagcacagttagttataatgtttgttcttcttgctatgataagttgattagtaatggtattttacagtcaacaggatcttcaggaagacagatagtgaatgtgaaatatttgagtaggaacatttttttgatttccagtgtggcatcagtaataatgtacacatttgtgttgattaaaagtacaataattttgtactatacagttgacttgtccttttggccatatttcacaccttaaaaattgcttcttagatatctcactgttgccagtactttcaatcagttaagaatgcacatacttgacatagtttgcag

SEQ ID NO: 47728 - DNA, 7037 bp, Oryza sativa
  unsure (1)..(7037): unsure at all n locations
cggatattggtctagcaatctgaagcacagttcttcctcagtactgaattgtggacaagacgaccattaatttgtcattttggttggagtcgtagagattagttgatgaagcagctggtttgtcctgaagtatttgacaaattgagcaagaatttagtcagtattgttgtttgaaagtacaattgatcagcgtactatatgtacaagtggtgttatgcaagctactcctagctgcagggcactcgtttggcgccgatgatcagagccatctcaatctactcgaaaggaatcttgagcaggcaaaggtatattccgacctcaactgtaaagtttatctaatcctttcaaaatggataaggattgaaactttgaagatgcaaatgctagctagcccaccaactagtcctttgcatagtacaagaccaattatatatcagcacattcagacaagaacaaattgtttaatttgtaaggtccaatgaatcaacgacaaagtagcatgtttctttcgtgtgcttgataccagaataattaagaaacatgcataaagattatcatataaattggcttgagtactagcttgcacgatattaccatttataatttacattcttgtacatgaaaatgaaaacaaaaaaaaactcacaaattaatgccataggaagaaatctgaatctttccttgcatgggttacatcaagaattccgtctgtttgtctatctgtcatgcaactcctcaaaataaatccaaatggaacaatcagtatcttcctctctgaatctgtagtttcattcgttgaaattaattcacctctcttcagatcgatcggtaaacggatctagacgcctactagctactgcatctgcagatgattgttcagcagtagctgctggttcagaggaaatggatggctcaacatattgccgttctgaaactgaaaaccagtcgcagtctctgaaagctgctggttgcagtaacctcctccaaaaccactgccccttgaatcacttggcagcagcagcggtttcttggcaacatgcaaaaagtcactgctgctgctgctgctgccatcatcaaaagaagttgcactacacgccatcattctcttcctccttaggccattaacattataattgttaacgtaaccatcgtgatgatctaggcgtgactcgaaggcgtgtggcatgttgttgttgatgttatagtttagtgtttggtttggatatattagagggctgggaggagcaggaagctcagcgatggcgtcggatgagccgtcgaggagaaactgcgagagcgcggcgcagtcgaggttgttgaggagatcggtgagggagcatgacttgctcatgctcatcgccgtcatgggctggaaatctgactgttggttgttcatgtcaggtggagcaggaggttgttgagaggaagagttgttgtcatggatgtcttcaagctgttcatcgacggttgatccctcgggttcttggtcgtgttggtcagaggaattgaagtcgttgctcttcttgtggattctgcacagcacccagtcgtccagctgatgaacaatatcacaaatgcagtaaacaataattagaagtgtgcaaacttgctttatttatttttaaaataaagaataaaacacaagctcaatcaacatcaacaaatttgactttgtagagtgagttaactaagagcaacatgcacgtttgcttccttcaatatgccaattcaaacaacgacgtagctttcaaagaagacgtacgacgaagagaaaaacaaattaataatgaactaaaattaagtaattaaatgaatctcaccctcatggtcatggatgatgctctacgctgctttgtggtggtggtgttgttagctgatgtgcctgtgaggcgatactcgtgcatgatccagtcggtcttgacgcccttggggggcttgcccttgtagaagactagggcccttctgacgccgatgttgtcgctcgtcggagttgacaagatggacttgtcggggccggtggccttcaataaccccaacccgccggcgcggttggggcgtgccccgttggggtacttgcggtccctcgggctgaagaagtaccattcgttctcgccgaacagcgccttacctgcaacattccatatccattttcaaagcccaaaattaaatttggtcagtttgaaggcattaatttgatcgagtttaattgatacatggatagtttatatatgtatggtgattagttagttagttaccaggaaggtcccatgggttgcacttgtagatgttgacctcggcgatgattggcacggggcacttgatggaggcggcctggttcatgaggtagtgaacgatgagctcctcgtcggtggggtggaagcggaagcctggtggaagggcaggcatggcgccgccgctgctcggcatgctcagctccttcaatcggctcgcctagctagattttttttctttttttaaaaaaaaacaaacaaacagaataacagatggtgtttggtcagcgtgagctgaaggaagaagatgacgacctggctagcttagattacgtaggaggaaaactggcactagtgaaggaaggaagctaataagctaaggaagaggaaggattgaaatttttgagatggagggggtagggctctcttttatagacgccatgggcttggctcatcttcttgctgttcgggagaaagagaggtgggtgcatggatggattactacaaagcaattgattaatgagagctaattaactaggggcacaatagacaattaactagttattagtaggtggcgtggatgtgagtaccaaagactggaccacatttgacacttaaccatgcatgtcagattaaataacttgaaatttcagcgtccaagcgatttagtcgtaagttcagtttgacatagggttgtactacttgctacctcctttgatcgttgcattttttgtcaccggattactatttatttgcaaagtttcactatttatcttttttcaaaaaagaatgacattgttcttagtactctctatggcttcatatgttattgaagttagtagcaaataattcaaaaagtcaaatctaactcttgtaaaattaatcagtggcaaatgaaggtaatacaatgaaagagccatacaaatatatatttcaatcgtcttctatcttcattccaaaataaatttattttataatatgaatatagatacattcaaaataaatttattataaggcgaagataagataccatgagaagagaatatcgtcaaaccattaaccatggcatgatatactaaaacaaatattactccgcgtacgtagtagtaccacccaaggacaattggtaatgcaagaagctaatgacctgtccttggcgcatgcatatatacacagtaattataattgtacgtacgtggctccacgtcagctagctaccagtgggcaggggggaccacaacgtacgtgtggtgtggataaactcatgcatatggaagcaaaacaaatggatcgatcggctttaatttgttcttcacatactgtactaaagacgatgacgacacatgcatccagtagtacatggatttatgttgagccgtccaggtgtcaactacgcattgccgccaatgatatgtgcaccgatatgatggttccgtcttggcagcttgtgcgcgtggcacgctttcgactctttcttcttttgttaggccgaccggtgggccccacctacctcgtggaaaccacctgcatcgtcactccatgggctctaccctcgcttacactagacgacaatttggttgacgattaattaaagggttaattggatccatactactttaattttgcccattcattagatctatgctattatcatcatgtttgatattatcatatagactaaaatatctctagacgtgagatccacatgttagtcatatcttctttctccatcctcccattttttctcttatctgccggacgacacaacgcctctatctgcatctcgtcctcctctcgatctccccacgccccgtccgctagagaccaaggcctcgccctctctctccatctcatgtcctcctcctcccgatctcatcgtgctccgctcacttgctagagaccaaggcctcggcctcggcctcaaccttcaggacctcggatctagaggatgaaaggcggaagcatgctggccgtcgaagctctggtgccccttgcaacaagcatcaggatgacgacgttgatcagggagccgcgagcaaggagaagggcggagctctggtgcctcttcagacgagtagcaggatggccggctagggagcgatgagcaaggagaagtgcaccggggaggggggatagtagtggtggtggattgtcatggccaaagctcctccatgcggtttgcggcacctggcgcaccaaagaatttactatttgccatcttttcaaaatgtacatgcccaactctcccaaatgttcacttgatttgccatccggtcccatatgtcagcctccttccacgtttggacaaatgagatgtgggatcaggtgatgaaggaggctgacatgtgagaccgggtagaaaatgtgaatgaaaattatggagagtggcatttgggcttgtgcattttgggaggatggcaaatagtaaattctccccctgacgcgccgatgccaagcaacaggacggcggtgttgcccagggagcacacacgcctaatccgagtgctaggagcacgaatatttccatgcgacacatcatcttggcctaaaaggaacatcgtcttggcgacaagtgtgatgacggcttccgtaacgaatgttaccgccggctgcatccatgccggcatgctcgtgtcctctactcactgttgcgctctcttgccggttgaggaatggggatgagacagtgtggtagagaagatgagagaaatcatggagtgacatggttcaaattttataaatttccagtgacacttaaccaatatctcgaattgtaatagcacttttttgaattagcaaaattgtaatggcatggatcaaattaaccattaattaaagcgcatgcatgtatcatatcatgatgtgtagtactccatccggcccaaaataacttaatctaggatagaatgtgatatatcctgnaataacaaatttggacaagtgttatcgagattcgttatcctaaaatatgtcgtattttatccaagattgagttattttttttagatgtaggtgtactctcttcataaggtaccctgcactaaagccaaaacaaacagatgaagcacgccttgactttggtgtgttcagttcacgttaaaattggaagttggttgaaattggaacgatgtgacggaaaacttgaaagtttgtatgtgtagaaaagttttgatgtaatggaaaagttgaaagtttaaagaaaaattttggagctaaactcggcctaagacgacgacgaatgctccaaattgacaagatcatgatcgatcgaccgatatggatgatcctgctgtgcacatgcatgcagcaaattaatgcggcatgtgccatggatatatagagtatagaccagccgcctgaaaaatgcacgtgagtaacgttgataaagtatctcccacgcggccggagctaactagctagatgaggtacacgtacgcgcgatggacaacttcaataccaatactggtactttgcaattttttatatatatgaaaataaatttatttttcattcatctaatacatactccctccttcccagtatagtggacgtttttaactttgtactttcaacgtttgactattcgttttatttgaaaaattagtgcaaatataaaaaagataagtcatatgtaaagtacttttgataataaagcaattgacaaacaaaataaataataattccaaaattttttgaataagacgaatgatcaaaaattataaaaaaaactcaaaaagacaagtaatatgggacggaggtagtaccaatatatttttgaaaaaactcaagtttaaaacatatcgatcaattaggaggagacagaaagtacagcgtgtggctgctcaaatggaccggtcataaatctaaatctaacagctagaaaggagtcaaagaattcggcccacgtgtgagtgtgtgcattgctggctgacggcccaagtgacgaaatgtgtgaaagggacgtagtcctacatacgtacgtcgtagtaccaaattaattaataacgcatctaataattttaccgagtgaatactactcctacgtaccagtataattcttccttatttcatattcaccactgatggctatgttctaccagtacaattgacattctaccactggtggctgccgatatatataaaaacaggctagcgagttgggatgaaaaaggttcgaaaatttttctactctagatgttcacatttgtacttagtattgaggtggttagttaaatgaacgttttttttttcagtcaggtgttttagatcatttttcttttgcctaatcgctattttttgttttggtactacttatagttaccaattaaataattgttgattattgtagttctatcggagagtgaagtatacaattatttgtattattaccaattgatgacaatcgatgaaaaggttctatatgcagattggaatatttggaagcatcgaaatggttatattaatttttgataatgttgcaccctcagttttctcttgaatgacattctttaagaatgacttatcccatcttgtttttttgtttaagtttagattaaatatcagcgtctatctcctggataagtcagttgtagtaccttttattttaacctcctttttataatatatttactatgggggcttcctcatagtgctttcataaaaaaaagatgatagatttattatttttaaaaacaataagctacatctctttgttgatttgagaaggccagttagaattgtttttatattccgataaacattgttaccgtattcgctccgatctatattcactctattttagtattc

SEQ ID NO: 47729 - DNA, 3309 bp, Oryza sativa
ttcttccttggccgtgcggatggaacggattatctactaccggagtacttgactaaaacaaacatcagatccatatagctttatagttggccttattacacgtcacgatcttgacacccagttcaacaatcctctactcatttctaccaagaaattctagcttgtgataagtacctataccaatccagtttgcatgcgtccatattagactctcctgtcaaaagatgttcgttcatatagatcgatagctatgtcaactgtgtattatatactagtatatcattagcaaaagtcgtacacaaagcaagtaaagtcatactgtagggcttttttgtcaggcgctatacaaattaattgaaattaatgttgaagggtcttaaaatgcaactgtactgcattcagatatgcacgcatatccgttcatgcaaatatatctatgttgacgtcttaaaatcgcacgtataataagttatttatgatatccatccatgtacggcccgccgtgacgccgccgccgcacgccgcagcaacgcacgccgccgcccgcgcaaccggctgtctccaaacaaatttagggttagtgtcttagggaattggggatttttggaggaggggatttttgtttggaaatgggctcagttgcggcccaagtggaatgcgggccgagtggaaagggggaggggagtggaaaatttaggcccaatacaacagaaatggtaaaacaaggcccaaataagtagcttctttatctttttgcatacatatatgaactatagagtatatatacctattttttgtccaaaaatctttggtatacatctgaatacccttgaattatagctgggcctgcccctgcacgtacctattaatcatgtgactcatttttgcacaaaattactacgattcaaaagtactacatgggtgcaaagcggtcggtttaacaagaaacctctttctcgttaaaaaagaaaaacctctttctcaacctactagaccaacttaaatttctaggcctactaagcctacttagattcattgtgctatcaacttattgggccattcttttcaggatacctatttagttattgggccttaacgttgagccaatatctgctgtaatcgaccctgctcatgctgttatgcagataaattaattagctgcttaattaatcacttacatccgaggccatgtagtagaaactggtcgcaacgtagagctcgtcctgcccagcgccaccgccgccgttccacactccgttgaagctgcagttgttggtttcgcagggcgcgtccaggttgagtgccttcaccacctcatctctgcacttgtggtagtctgctccttgtggcgcgccgttgcatcatactgctccccgttataaatgtacttacctttaatattccaaggattggcacaattaaaccacttgattaattataattagaaatgtagtaaacaatggattaattacatactccctctatttattataagtcactttgatttttttagtcaaattttttaaaagttcgaccaaatttatatacaaatacaataatatttatagcaccaaatcaattttattaaatctaaaattgaatatattttgatagtttacttattttatgttaaaaatattattatatttttttataaatttagtaaaaactaaagaaatttgacttagaaaaaaataaaacgacttataatataaaagagatgtatttcgtaaaacggaggtattatatatgatgcatcttgaagaaaaaagatgtgtaaacaaatctcaaggaacaagctagtaccgcaaaatccgcgcagcatgcagttgctaaatgtcccattcttcctttttaggatctccacgcgagaagcccgagcaccatagtgcaggtaactgcagattgatgattattgatcttagctagtaactacagtgataaaaagtatgcataattccttcccatagcttcagttatatattcactagagaactgttcaacaacgtagcagactgaggattgatcttagttaactgaacgttacactcttgaaaaccttattattcagctgctggtagtagagattgagatgtaaaatgagatcgatctgataaaaaaaataaaaacgaattaagttactgacctgtgcacataaacattgtaatctcttcctttaagatactcctttataatgtaaggatcctgcccatcgggcatttctggagcattagcagctgtgcctgatgagatggcataggccatttgcacggatccgcctccgagatcaatcacacccacagttttggagtagtcacctcctaatctatccaacaaatagttaagtgcaacccacatgtaagatcattcttgagatccactaagaacattaatccagtttggattgtattggaacttggtcttggtgtggacaacatctctaacctgtattatgaatcaaattgctgctagtgatatgaaggtgtttaatttgtatggtacgattattctgaaagtatacttaccgcttcaagaatctagtttgtcttgtcatctccaataagtctgagtccagcagttgcctacatgttcgattggcaagttaaaaggtttttttgtgagtaatatttgtttcaatttttctattttaatttgttcaaggaggaaacatatttttacaacgttacggtaggaaaatggtttcaactcgagtgatactccctccgttcgctcttacaaggcatattctaactctacaaatgactttaagactaaatttgaccattaatttctgataatatatattcatgataagcatgaaactaatattatagtagtatatgaaaagctctttgaaatccagatctagtcttataaaactgaacggtggaagtattctaacttatgggtaaaggatataagcaggttcataatcctaataaatcaaatctgctcacgagcgacatcatcggatttcatgtaatccgtaaaaaaactgatagaaaccaatgaaatctggataaattttatcaacaaaataaaattcactttaaactttttaaaaaattgatcgaaaaatcaagtggtttgtgtttacgacctggtcaaaaagttcggatttcgcgagatctaaatcagatttaattgaaattgggaaccctggatacaagagactacttcgtcacatggtccaatatttttttcttgtctgtattgatgttgttctcaagtagttgcaccaatctcaaaaccaggggccaacttaaatatttgattaaagtcataaacgtctactatatctatcgtttt

SEQ ID NO: 47730 - DNA, 14956 bp, Oryza sativa
atactggattcatcgaccctcggaaagtaaacgtcgcaatgctcgaccagtatccgcaagccacagaggacaatctcgtccatctcctgaaggcgcagcattacaagacgttcatactgttgccgtacaacacagagttagtttaattttactgtcttcctataccaaatttcattcccgtacgaacatgctaagtgtttcatatgtaatgcatcccacgcacattgcagattccactgggtgcttttactcttcgacctggagacctgcaccgtcaacgtatatgactcaatggataaaaaagagtctacgtttgacaaggttttcgaacttatagacaggtactgtcataagttcctatgttaattaagaatcttgttatagttaattgctactacgaatcatagctttaaactccatgtagggcttggtatcggttccgtcatttggtccgcagcaaatggagaaaaagacttaggcggaagttcaattttcttgtgagtacacatgctctacatttatatttctccgattcaaatacatacaagtgtatattaattagatctctcgtcgtttgtcatttatttatagtgcgcaaagcaaaagcagggaactaacttgtgcggctactacgtgtgcgagtattgccactgccttgcagaccaaatcatcaccacaagagagctcaatgtacgtacaaataaattcaaaatttcattacgtatcgatttgttgtttaattactaattaatttcatatattcatatagtttattcgcatgagggataacctgatcacacacaaggaatttatcgcggcggttcaagaacaactcatgggattcatcaacgaacaaatccttgatcccaagggtgaattctactacgacggaaatacaattcataggtccttagcttctaagatatcaactactactacgtcgaaatcgtagctagctaggacatataaaggattgtaattaatacatgtctatgtttctatatgcatgtgtacacatttctataatgtaaatatatattttggtcatatatatatatacatatgcatttgcataacatatatatgtataaatacatatatattatgcatgtacatatgtattgaaacatatataaatataatatatatatatatatatatatatatatatatatatatatatatatatatatatatataagaaatttgtttggggctccatggggcccgggcaccattgttgaaattgagtacatacccaattcagatgagtatgaaactttttcaattcaaatgagggtatatatatatatatatatatatatatatatatatatatatatatatagagatagagagagataaagaggtatgtgtgtgtatatgcacatacacatatatgtgtgtgtgtgtgtgtatatagagagaaaaatacatatatatatatatacacacacacacacacacacacacacacacacacacgcatatgagtgtgtgtagaaaacaaaaacatagagagagagagcgcgctctctatgtgtgtgtgtgtgtgagagtgagagagagagagagagagacacagtctatagatatagagagcggggtgggtgtgtgtgtgtgagagtgagtgggaatctctatatatatatatatatctatatatagagagagagagagagagagagagagagggcgagtatgaacataaacacacacacacacacacgtgtgtctctctgtgtctgtgtgtaagggcgcgcgcgagcgggcgcgcacacaccccctgtctctgacagagacagacacaaacacaatatatatatatatatatatatatatatatatatatatatatatatatatatatatataggaaatttgtttggtgctccatggtgcccgggcaccattgttgaaattgagtacatacccaattcaaatgagtatgaaactttttcaattcaaatgagtatatatatatatatatatatatatatatatcggcatataaatacttctttttgacgaaaaaagataaagccagtctacgaaaaatacatggattggttgggccaaaattttcaaaagccataaaagatatacaatgaaagagagaaaagtgagtttgtgtatcttgtggatcatagttaaccttgaaaactctatggagcaatcaaataacatattggtaaagaatcattcgaagaacttacgaagcactctacaatatgcatcgacacaccgtgcagtatagctaaatccaatgtataaattgaactctaagaagctagcattcatagagaattatctgtaaggagtttatacaaactatgatgatgttctctaaatccactgagatgagaaaccgaatgtatggacatgaatgaatttgtgtcaagaaaaagagaagtccactatgctcaccagattcatcaatgcatacacaatcataattaggaaactatgtacaaacataccttatttccttttgctagctctaaatcctcaaatttatagcagcataaactgatctgtaaacccgtgcaccctagaaacttgataaattctcagtcaagcacctgtagcaagcctcatttgccctgataaccactcaatttatattagcccactgctcactgaagcactgaatgtacgtacattgtttcatctttctaccagaaattagtgccgatcaaaataattagttactctctccgtttctaaatatttgacaccgttaactttttagcacatgtttgaccgttcgtcttattgaaaaacttttgtgaaatatgtaaaactatatgtatacatataagtatatttaacaatgaatcaaatgataggaaaagaattaataattacttaaattttttgaataagacgaacggtcaaacatatttaaaaaagtcaacggcatcaaatatttagaaacagagggagtatattgttaacgaccaaatttcataaattctatcattattggcatcggagatgaagatcagatcgaagtggaatccaagatgaagatcgttgcggaaacagagtaagaatcggctgcagtccaaatcggctaaggtcaggtcgacagagttcgagtcggacggggctagccgatacagccgattagccgatatagccgattccgataatatgactcggtgtacgtcatcgggttcaagttgatgtgtttcaagataattgccacgcatggatagagtcctgggaaggcaattgtatctattaattagggtattctatgtaatttctttagagatatgtttgggcaaaagtctgccgtaaagacttatggtatcttagagtttgttagagataatagtcgtgtctattatggacgtatcttgtaattctcgggtataaatagacccgagccctatgtaaaaaagaacaacacatccaatacaatctcggcgcatcgccaccctttatgctttacttttatttcgacgagttcgtgctctcgggttgagctgcatcggtttctgtcggtgacatgggatcaggagtatcatgactagaggtttgaggcagacacaatcgcccacgtcgcgcctgcttccggcggaagtggaggtaggtatgggccgtcctatcagaaggtcattcggacggcaaccatacaagtctccatctgtttatgaaaaggtggggtaagtccccacaaaaaaagagagaaatggtgcatgtggtatccccttaagatataaaaggaggaccttgcccactgagaggggggactagacttttccagattagaaacccagaacaagggagaggctggctgatactttgtagctccttcatacacagatctcccaaaacataggagtagggtattacgcttctcagtggcccgaacctgtatacatcgcctgtgtcttgtgtgtttcctgtctcgcgagccttccacatacagagagcttagaatctctccctgagtccccggccgaaccggcaaaggggggcctgcgcggtctcccggtgtggagccccacgcttcgtcatctggcgcgccaggtagggggctctgcgagggattttctgagctctcgcactctttcgtgtgcgccaagcttttcctgttcagcccaatggccgagccagcaaaggcgcacgacctctccccgagtatgagcggtgacgacagggagccaaacccacgccgtcgagctcgtactccaccgccccctccacgccaaagtcctaggcgggagaaggcgctcgagagggccgaaggatccgcgacttcgacacccacaggaggtggagaagggcggcgagatggggagcgtcgcctcctcgtctacggcgacggcagcacgccccagggcgcgctccaagctgcgggcgcgctcctacatcacccgcccgtcgcccatgacccggagtctccagcccaacgttagctggacgatgtggccaaattggtcatgactgcacggcagcgcctagatgctggtgggcggtcctccgccaccaaggcctctggtgctgctaccaccggctccgcatcgtcaagacggagggcgcggcgagcggcagccgctgttcgccattcggccgccactccttcgtcaacgcctccgacccgggaagatctgcgtggggaaccggatgctcgcatcagtatcgagcgccggcgtaatggccgacgtgctccccacgcaacgtagggcgcctcctcgtccggagtgtcacctcaccacggacgcggggatcagccctccgtgcccccggttggtggtgtcggtagtagagcctttgtggcgagccttcggaatgtccgttggcccccaaggttccggcccaccatcgccgaaaaatatgacgggagcgtcaaccccgccgagtttctccaggtctacacgaccgggatcgaggccgccgggggtgacgacagggtcatggcgaatttctttcccatggccctgaaaggacaagcgcggggttggctaatgaacttgccacccgcgtctgtccactcttgggaggatttgtgctaacagttcaccatgaacttccaaggcacatatccgcgcccaggtgaggaagcggacttgcacgcagtacagcgaagggatgatgagtcacttcgctcgtacattcagcggttctgtcaagtccgcaacaccataccatgcatccctgcgcacgcggtgatttacgcgttcagggggggtgtgcggcacaaccgcatgcttgaaaagatcgcctccaaggagccccagactaccgcggagctttttcagctcgcggaccgagtggctagtaaggaggaggcatggacctggaacccctccggttccggtgtggcagcttcggccgcccccggatccgccgctcagatagggcggcgtgacaggaggaggaagaagaggtcagcccataccgacgacgagggtcatgtcctcgccgtcgagggcgcttcgcgggccacccgaaaggggaggcctgcgggaggcaaaaagaacgaggccggcgctcccaacagggagcgcccaaccggcaagtggtgcaccgtccacaacacttcccttcacgacctcgcggaccgccgtgcagtcaaaagtttggctgagcggacgaggaagtgggaggaggagaggaggcaggagcgccgagagggcaaatccccggcggttccttccggtaatcggcgaagtgaggccaagcagaaggcccccgccgaggacatcgatgacggcgatgatgacctaggtttccaagagcttggggccaccattgccaccgtcgatgggggagcgtgtgctcacgtttctcgccggagcttcaaggccatgaagcgagagcttctagccgcgacccctactcatgaggcgacgtgtcgggcgcggtggtcggaggttgccctcaccttcgaccagaccgaccacccaccgtgcgttgcccggggagggcagattgcgatggtggtttctcccaccgtttgcaacgtaaagttggggcgtgtcctcattgatgggggagcggccctcaacatcctttcccctgcggcctttgacgccatcaaggccccggggatggtgctccggccgtcccagccaattatcggtgtgacgccggggcacacgtggccgttaggtcacatcgacctaccggtcaccttcggtggatccgccaacttccgcacggagcgggtgaacttcgatgtggcggacctcagtctgccctacaacgcggtcctggggaggcccgcgttggtgaagttcatggcggcggtccactacgcctacctacagatgaagatgcctggccccggtggccccatctctgtccatggcgacctcaaagtcgcgctcgcttgtctggagcagcgcgcggaccacctcgccgctgcatccaagcccgagggtggcgacgagaggcttggcgcttccgcccccgccaccccgaggcaacggatgatcacaggcgacgaggtcccggtcaaggaggttgccctgggcgacggcccgtccaagaccacacggatcggtggtcttctggacggcaaataggaagacgcgctcgtctccttcctgcgggcaaacgctgacgtcttcgcatggagaccggcggatatgcccggggtccccagggaggtgattgagcaccgtctcgccgtgcggccgggcgtaaggccggtccggcagaaagtgcggcggcaggccccggaacgtcaagccttcatccgcgaggaggtggcgcgacttctggaagccggattcatccgtgaggtcatccatccggagtggctggcgaacccggtggttgttcccaaggcgaacggcaagcttcggatgtgcatcgactacaccgaccttaacaaggcatgtcctaaggatccttaccccctgcctcgcatagatcagattgtcgactccactgcggggtgcgaccttttgtgttttctagatgcatactctggttaccatcagattcgcatggctagggaggatgaggaaaaaactgcgttcattacccccataggaacctattgttatacgacaatgcccttcgggttaaagaatgcaggtcctacttttcaacgtactactcgaatttctttgggtaaccaattaggacgtaatgttgaggcttatgtcgatgacttggttgtaaagacgcgcaaccaggaaatgttactctcagatctagcggaaacttttgagagtctccactccgcccgcataaaactaaaccccgataagtgtgtgttcggtgtacctgcgggcaagcttctagggttcttggtctctgcccgaggcattgaggccaaccctgagaagatacgggctatagagcggatgcgcccccccagcaaacttagggatgtgcaatgcgtcaccggttgcatggccgccctaagtcggttcatatcgaggctgggagagtaggcgttactcttatttaagcttctcaaacgctccggaccgtttacctggacggaggaagccgaaaatgccctcacccagttgaaggcatatctaagctctcccccagttctggtcgccccggagctagacgagcccttgttactctacttagcggcgaccccgcaagtagttagtgtggcattggttgtggagcgcgatgagaacaattctcatttcacgcttctccaccctgtgccgacttggcccgggagagagcagggaggagaggctcccgagccgaacggtggcccaaggcccccgacgaccggagttggccctctgcccgcttgtcagacggtgctaggagcccccgacccccaggaaggccctgaggccactgtgggaaggccgcacctatcgcccttcgaccccgaggctaaccctgtgctgacccgacccaggaaagagtagggagaagaggcccccgagccgaacggaggcctaaagcccctgacgatcggagttggccctttgcccgcttttctgatgacgccaggagcccccgacccccaggacggccccgaagccactgtgggaaggccgcccctgttatcctccgaccccgaggtcatcagcacagaagataagtgcgccccgcgaggctgcttggacgaagagtgccccagggatgcggcccctagcgaagaggatcggccccaccgaaaggtgcagcggcccgtctactttgttagtgaggccctccgggacgccaaaacccgataccctcaggcccagaagatgctttacgctattctgatggcctcgaggaaactgcgccattatttccaggcgcatcgggtcacagtagttacgtcttaccccctcggtcaaatcttgcataatcgagagggtacaggacgggtggtgaaatgggcaatcgaactttctgagttcgatttgcactttgaaccacgccacgctatcaagagccaggccctcgccgattttgtggcagagtggaccccggctcccgagcccgtctcgatccccgaggccagcacggacccctcgcagctgcctcacaccgcccactgggtgatgcagttcgacggctccctgtctcttcagggcgccggtgcgggggtcacgttgacctctccgagcggagacgtcctcagatacttggtccgcctcgactttcgagcgaccaataatatggcagaatacgagggactccttgccggactaagagtggcagctggactggggatccgctgcctcctggtgttaggcgactcccagctggtcgttaaccaagtctgtaaggagtaccggtgctctgacccgcagatggacgcctacgtgcgccaagtacggcgtatggagcgccattttgacgggattgagcttcggcatgtgcccagacgggataacatgattgccgacgaactctcacggctcgcgtcctcgcgagcccagaccccaccgggcgcctttgaagaaaggcttgcccagccgtcggcgcgacccgaccccttaggggagacggatgcgcctgaccggcccccgaggcctgtcggagtccaggcctcgggacccgaggggagtgctcccaactcccttagattgattgcttggatcgccgagatccaagcatacctcacagataagactctacccgaggaccgcgaagggagtgaacgcgtccatcgcatctccaaacgctacgtgctggtagaagggaccctctatcggcgcgcagctaatggaatcctcctgaagtgcattcctcgggaacaaggcgttgtgcttcttgccgatatccatgaaggcgaatgcggagcccactccgcctcgcgcaccttggttggtaaagcttttcgccagggtttctattggccgacagctcttaatgatgcggtcgacctggtccggcgatgtagagcgtgtcgattccacgccaagcaaatccatcagccggcccaggccctgcagaccataccactttcgtggccatttgctgtctggggactcgatatcctgggaccgtttaggcgggccccgggcgggtttgagtatctgtatgtcgcgatcgacaggttcactaagtggcccgaggcttatccggtcgtcaagatcgataagcactccgcacttaaattcattaagggcatcaaggcccggtttggagtgcctaaccgtattattacggataatggcacccaattcactagtgaactcttcggcgactactgcgaagacatgggcatcaagctctgcttcgcctcacctgcccaccccagaagcaatggccaagtggagcgcgccaatgcggaaatcctcaaaggccttaaaaccaagaccttcaacatactcaagaaacacggcgattcatggatcgaggagttgccagcggtgctctgggcaaaccgaactacaccaagccgagcaaccggggaaacgcctttcttcctcgtctacggcgcggaagcggttctcccatccgagctcaccctgaggtctcctcgggctaccatgtattgcgaggctgatcaaaatcagcttcgcagagatgacctcgactacttggaagagcgaaggcggcgcgcggccctccgagccgcgcgctaccagcagagcctgcggcgctaccatcagcgccacgtccgggcccgatcactctgcgtcgacgacctcgtcctacgccgcgtccaaacgcgttctggattgagcaagctttcaccaatgtgggagggtccgtatcgagtggtcggcgtcccccagccgggctccatacggctggccacgggcgacggcactgagctgcctaacccgtggaacatcgaacaccttcgtcgcttctacccctgaggggggggggggtcgggtgtcaggtttcgggctcgggccaacccccctcgggcgtgcagggttggccgggggctacaacatatgcatattcttatttctcttatatctgaatttctataaaagcagtttcaatttcctaaaggctgtatctgtgctgttttttccttttgaagaatcttgacttgaaataggtcactcgtgctcaatcctgccctcgggggctcgggtcggctaaaatcgccaaacggggcccagaaccgagccgtgccccgaggcgtggtgaactccggggggggggggggggaatcggcaaaaacccacaatcgggtcacccataaccctcggtcaccacgttcccggcctggccagtctcgacatgtggatctccccaggcactagcccgacccgcgccttttgaggaccaaaacctgggcacaagcccttattcaagctaagacacaaaaggaccacggcacagatcatcctcatctcatactcacagcaagatgaaattaacacaaaaatttcttcatttttgattacagattaagttgatctatacaaaaaagaggcccgaaggccttagaagaaagaaaagaagaaaaaactgaagaatggcgggggtctgggggctcaatccgatgcgcccggatcgccggcctcgacgtcactgtcgtctgcaccaccggcattgccctcctcgtcggagttgggggcgaacgcaagccgaggggccgagccctcgaagctgtcgacgatatggtcggcggcatcccggacctgcgcgcgcgcgcggtcctcggtcccaggagggaactcatccagcgccatccatggagagaaattggggtccctggcctggtaactcgccaggacgagctccaccgctccttgggcgaggtccctcgaggatgacttaattgtcttctcgagctcctcggggagccgttggagagccccggccatcttcgagaggcgctgggcgaggcctccctggttggcggcgtactttacggtccgccctctccagaggcccacttgccgaccggcgcaatctaggcgggagacggcgtcccaaagcatgccgggccctacctcgcctgccaagcggagggcttcgacctccccgacggacgagtccagcgcgccctgcagatcggcgatggtgcgttcggcagctgcgaggcgggcggctaagtcgctttcgcccgtggccgtcccgccgctgcgcgccctcgcgtccagctccttcgcccgcgcctcgagctcagcggcccgttggttcagtacggccctctcggcgcgggcaccttccagattgcggcgcgcctgctcctcctgcgctgcctcgcggagggacaggttgaccgccagctgttgcgccgcggcctcggccccctcgagagctcgctcccgttcggtgagcgcgtcctcgcggaggcggagcgtgaactcttcttcggcgcaggcagcctcgtgcgccgccagcgttgcttcccggatggtgacggcggcctcgcggtccgccagatccctctccacgacgctggcgcgctcttccagcgccatggcgcgagcctcaagggcctcttcgcgccgctgggacgccgcttcggtctccgccgcccgctgttctcgggcagcggtagcgtcaagcaccccctgggcggcgtcgagcttcttccctagctccgcctcccagctcccgtattgaaggcggagggtgttctgcgcctcgttcatcacggtggtggcaatgagggcagccccccgttcctcctccacttccttggcgatctccgccagcaccttcttacgagtttcaagctccgagacgtgccggcggtgagccttacggcccacctccaccatggcctccaccgagcgtcgcccctcttcgacacgcgcccacgcggcgtcgagctccgcccgctctgcctgcaggacctccacctgggcacttaacccatccaacaccgtggtgtttgcggcggccaaggcctgcagaaggggctctgcgttcagtagggcgatagaaggcgtggggaagagtcgccttggagaggatgccacgcggctcgggccgccgatggaagtgccggactcggggatgtcccccggacccggttggtcctgagcgtcgcccgagggagtgtgcccaagcgacgcgcccgcagcctcgtcgccagctgccccagaagttgtcgcctgagcgtcgcccgagggagtgggcccaagcgacgcgcccgcggcctcgtcgcgagctgcctcggaagtcgccatcgcctcgtcctggcgaaatccgacttcctcccgagcggcttccccggcctggcgggcccgggcggcctcctcccgagcggtttcctcggcctggcgagcccgggcggcctcctgggcggcctcctcggcttcccgtaggcgatccgcggcctctcgccggtcagattcccgcctgagggcctctgcggccgccggatcctcggcctcagactggccggacttgggatggcgggagggacgcgacgggatctcgctgaaacaaaagaaaaaaccagaagacgaacaagatgggtgagtgaaaactcgcgttgagaaaatgaatacagccacgatgggtgagagacaaacctgcgagggggtcggttaaacgaccactttggaggggaaatgaggtttccccgagatggttctgtctccccaatcttacggggccgcttcttcttgcgctccccctcgggctgcgatgttggcgcggccccctccgggcgcctgttactggcacgcgccgccccgccccctcggggacgagatgggggaggtgttcctccctgcttcctcttcccccgggcgtcggcagggcggctgctccccgggcccctgtcgcgggacccagaagcacgaccccctctcggggtagattgttcccccctgcggctcccgcctgcgccgtcgtggccctttggagctcgctcctctgaggccccgaccgccatcataatggtcaggatggaggcgcggtctggatcgctgcagagggggaggattccttggggaatgagggccgcctctacggagttgagattcagcacccgttggaccaatatcttgaagtcctcaggagcccagtcccatctcactccctggtgggtcctcgtgaagtcttcgaacccggtgtactcccaggcgccccgagcgcgtcgctggagcggcgcaatccgacgacggaggtagtcgccgtacaccatggcccctgtgagcccctgggatcgcaggcccgccaggcggtcgaggacggcgtcatagccatcccccagatctaccggcgcccgccagctggaggcctgcaccgggggctggctcggaagtcggaggcgcgcttcgtcggcgaggggagtgtagaaccagtcgctcttccagtcgtcccacttcttgcggagggcgcaggggatgtagcggttcagcaccggcccccgtggctggaagtagcagccaccgactaccgatggcggcgacaccgactgcacggtgaagaaccaccggaacagccgaagagatgggcgcaccccaatgaacatctcgcacagatgcgcgaagatggccaatgtcatcaccgcgttgggggtgaggtgcgccatctggagatcgtagaactccagaacatccatgaagaaagaagaaaatggtggaaccagccctgccattgcaaaggggagaaagaagatggaccgccccgggtagtctggcgccgggcgtccctcgcccagcgtgactatctcccggccggtggcagattccggcatgaagcggcgcgacagcccagcctgcctctcgctcacgatccgggaaggcggcagcacgctaccatcgagcagagcggaaccccgtgccatggcgccggaggaagagaagattaagagcgagcgcgtgtggcgaaggtagggcacaggaaagaaggagttagggcgcaagcagcgaaggcaaggggaataatggcgaaaggaaggaaacagatcccttcctcagtgcctttatactcttgccaacgctgtgcccggctcctcgcttctcgcgcccactatttcgccccctcgtttctcgcgcccacgcttccactaatcccattcgcccgcttgcggcgcatgaggtggatatgcggttgtggcagtcgagatagatcatatcgtgcgcgcgttaattacgctcgccgaccgaagcgacgttaccatatctccagacgaaacgaatcgccatgtccagattcgtgtgctactcaagtaatgtggcagtcttgaagagaccgctcattgttgacagccgagttaccattgccgatgtgcgtggtttgtgaccgttgggtttctgcccaattgtggagaccggtcccacctgtcaccaggtcttaggagtggcgtcacgcccgaccgtttcccttaaagagggcgatcgccctggcataacgccgggggctactgtcggtgacatgggatcaggagtatcatgactagaggtttgaggcagacacaatcgcacacgtggcctggtacccccgagggacgtcgggcccgagggtgatgcgttcgccctcctcttagtccccccgagggggtcgggccgcacccccctcggccccgagggccgagcgccccgacccctcgtgggtttttgctccgcgtgtatgggtt

SEQ ID NO: 47731 - DNA, 7101 bp, Oryza sativa
ccacctaaccacatttattgcggtttggctgagcatgtcacgccgcatgtaacgcagtgcagtgcactcgtttatccggtctgtgaccagtcacagaccggtcagatcgcgggttaggtggcgacaggcgatctgacacacgcctcgccccttcccgtcaggacgagggcttctaggcgctcgtccccagctggagctagcgtgttacctcccagagatggcacgttagtcctggtcagatatatgccaggcttcatcctaaccattacaggcaagatattgtatgaagaagggcgaacatgcagattgataaactgacgcgtggtggacaagaatgaccgatttgtgaccggtctgacactggtcatgtcgtcagcagacagccatgttcccacgtcgcgcctgcttccggcggaagtggaggtaggtatgggccgtcccatcagaaggtcattcggacggcaaccatacaagtctccgtctgtttatgaaaaggtggggtaagtccccacaaaaaaagagagaaatggtgcatgtggtatccccttaagatataaaaggaggaccttgcccactgagaggggggactggacttttctagattagaaacccagaacaagggagaggctggctgatactttgtagctccttcatacacagatctcccaaaacacaggagtagggtattacgcttctcagcggcccgaacctgtatacatcgcccgtgtcttgtgtgtttcctgtctcgcgagccttccacatacagagagcttagaatctctccctgagtccccggccgaaccggcaaaggggggcctgcgcggtctcccggtgaggagccccacgctccgtcagtttcgatcttcaacaagaggtaaaacttgtcatgacgacttatgttctcaagattagtgcttccatctttatgacactctaatcttgtctatataattcgtcgagttatcatatatttcacataatctttgataatatcttcatctaacctataatcggctaacatctgttaatggaaggcagccgattaggttagataatgatgttaacttagactatgtgatatatctaccactctatgaaacttccagcggcttgattgtctagatattgtttttcttttcatacttaatgctgcatcagttgagtttgatctattaagtcgtgcttagaattgcaatctctagcctgctttctgattgctgattagggtagtatcggagtttcaaccgatcttatctgatttaactacttttattctatatgcttgattgacatgttaaatctgccctttatgttaagatattgtcgcatctaagtatattaagcttatgtttagtatattctacttgctttaaaatcttagtatagagtagtatcggagtattagccgatacatgctagatctacctgatcggctatgctatgaatgtatataatcctactattaatatatatttcgatctaagtgatttatactgtctcagcaaggcgaccgatctatcacaatcatttgatttaagtatatattgatataaggattatatatcattaacatctacagccgatcgagtagatttagttctggtttgcttattgatatttgtcggtcgatgtacacatgacaacggcttgaaataaatgatatgtcatcggcacctagccgatcggctatcatttataggattaattgtggtttctttgttctatttcttgttgattgcaggatcaaatcaactggcacgctcatacatccgaagacgagctttggacctgcactggagttaagcagatctcccaggcctcgtgttttctgtcaacatatatttactgagcatagtgattgcagaagcattatattgaagtagctaaattttgcacatacttaacagtcttatgccacacatatatatcatttggttactgctagcttgctgcctgtcatatgggcaacactgtgttttatttttaagggaaaattgcaaaaaccaccctcacatatcactctgggtttgagatgttccctcataagaagatttgttgcaaatccccacctcctaattcaccttgatttgatttaggcaccttttctctatacatgcatgtttcctagagaatctcatggtgaaatcaatcgagtcccactcggcaggaacaagaggttatgttatttgttctgtataagacgatctttgtgcagtaccaagaaattaacaacaccctaaaacaaaatttccattgattacattgccaaaaccaaaaaaataaccacttgctaccatgaatttctaccctaacgaggatgtaatctgatagtgctacatatgaaaaaccaactctctgtaaattgtaatgccaacgaaatctcaaattttaccaacacccaagaacttactgtatgtccgttccgcgatcgtcgaagtgaaaccctttctagtcgcttggacaagagaaagcatcacaatcggcggcgatcttcgcagctgttccgcccgctaccgccgcctcaatctccactcccgactcaaactgactcggagggaacggtgtgattaactaggtctcggcgtctctcgctcccgtcaagcgggacttggctaatttcgccacgagatgctccaggaaaaacgcatgtgtagagagaaggtgtccaaatcaaaccaaggtgaattaggaggtggggatttgcaacaaatctttttataggggggcatctcaaacttagagtgatatttggagtggtttttgcaattttccctatttttaaggaagtcagctgcagtgcccaatttttcattaatatcgcatacggccatcgctcccataagctaacaagacctaatttttcagaccaatcagttcaatgaatcagagaatgatgaactacccaacatggtcatatctctgaatgcagtgcaccctcttttcagcatgctcatatgtgaaacatgctcatatgtgaaaccacctaactgtattattaatggccctgttatatcatacactagcaatatgtatgacaccttcaaagagcaagctataaaaatgagtgcaaaaaattttatggctggaggtacgtagacagactacataatcatgaaattaaattgcatctagcaattgttaattgcatcctcaccagtaagagtgaacaatcgaaatcgtaatatggtgatttatgattttttttagatgaaatactgcctgacatttgccgagcagtgttgtatggtgatttatgactgaagcagtctaattccacagttagtaaatttaaatgtactgataatgcaatagaaatgtaaaaccaaataaccataaacaacatccagtcattcagtgttcatcagcactgctgtgcttaacattacgttaaattgtctatgcagaaactgtatacatttctttgtgtcaatatgctttttatcgcctccaatttgatgcatagtacactttagttttgactgtgctaatccaggtcattgagtaattagtccctaatctatccatctcctacttgttcttcctgtgatcattgccaccccaaactctgaggtcctcatcgatgaaaatgaggaatgagcacaggaaggataaggggagccgggaacgagatagatttagagttgataaaatgtacaaggaccatcaataaattagggaacatagatagattcagagtttggggtgattcatgcagatgcagagatgacaaaaggtacaacatacaagatgcagagatgacaaaatgtacaaggaccatcaataatttcactactgacatcccgtcaagccaaaaggtacaacatagatagatgcagaggtgacaaaatgtacaacgaccatcaataatttcactactgacatcccgtcgagttgcttaacagaagatagagtagaggggataatatggtcacctggtggagttcatggttggtgactttaacgaggatgtggcagcgaagcaggaatccaagcccagttttagtaggccaacatgcagctggagcaagactgcaagaggcggcatcccggtcgggtggcctgagatggatcagatggcgtccatatgcactgtactgccgatgatggcgccggcgggctagggcgcatggtggtggcaacgaattgcattcggcggagcgatggttgctaggagaagtcagggagaggagaagcgctatttcggggagggggggcgcagcgtgggaggttggtaacgatcgctatttttgtttttaatcggtggttacgtgttgcagagcaggagattgctaattgtagggacagatttaactcgccacataagccattggatgaaaatatctaatggttaaaagagaattatgtacaatttgtggataaaactgttacattttatatcagtatatctctactatattataagaattgaagatgtttccgctgaaattttgatacgtcattcgtgttagtttttcagtttgttgtacatcgtctatacacaattctatgtaagtatagaatagctattatacactctcctcctatctcaaccactcctcctcccagcccatcccaactggcccacaccatcctatcagcccatcctgcgtgcctccactcggagccgcaggtgcaactccccatatcagtgtcttttttctcttgatcatcctgatcctctccctatccttccaatctcctctcttttctctccatgttctcttctttcctcttagttttctctttcaaatttctgttatcataaatatttttgttttgatattatgaatatttaaggtatatgtggcaagtttgttactttagaaatgtttttcatctatattaaaaaaaacttccactgattgaataatcaaaatttcaaactttggtcaatgaggtatagagaaatacgcatgcgtcaacttatggaatagccacccaacgatttgtaaggctatggaaatgtgtacaaaagagattctttgtgtgatgcatgaaacgagcgcaactaggttcaatgctatatatgattcctaattttgttttgtttgtcttatttcggtttgtcgtttaaattagtggagtttttatcaatcatgaaaattatcttcacctgttgcagtattttttgctagtatacatatagatataaaactgattctttggtgcaaggttttgtgccaagcgtgaaacgctatgattcgctttgtctcttaactctgaacgcgcaatacatttagcttgtagtaatatatgcttcttttattctactttctacactatctgaactcttagaaaaaaatgattatgctacgattgtgtcaggtcaaatactcaaatgtgcaccagatgttcagtcttttacatacaagacatgcgtgctcatgacacacaaacacaaccgatgatttctgtgatagtacgtaattatatatagaaagctgctatatattcaaacatacacaacttggagtctaggacaaagagcatggccgcctcgatctattgatagctcgacccattattaacatactacttatatatcatgatactcagttatactgtaataaccagcacacagacatcgatcatacaacaatcgatatcctaacttccaaagtagctagtacatcgatctcaagatcatttgtatatttctcgaagccgttttttgggtgacacagcttcaatagctgtacccaatggccaagccgcgtcaatgtagtactccccatgcttcaccttgtctaccagcgttatctccttacttggatgtagacctgacatccaattatatatatattaattagtaaactgcatgttagataaattgttcaacaatttacacacctatatatgagttctttttctttagagttaatttcttatccatggatatatattgtatctccattattagaagctagtgtacgtaccgaagccgtcaacgagcaaggagtattcgtagataagatccatgcataagtaggcatgatcacgaacgttggggtattctacttttgcttctttgacactcagtttacaaaccttttctgcaacagccttaaacgttgcaggggttgacttcgcactgggtgcatcgctgttgatgaacccaacctttatcccggtccgatcaaaatgtatgcattggagataaaattatcaggtaaaagtattaatttgtatatgtaacataattacacaaacaattaaatgcacatatttaggggtatatatttacataactagttagctagtagccagtctgaagcatgcctgagaagttaaataatttagttggctaattaattaagtaatcacgacgtacatgggaggctatgtagtagaaggcggacgcaacgtagaggtcatcctgccctgctccgccaccaccgttccagacgccattgaagctgcagttcttggtttcgcagggcgcattcaccttcagtaacttcactacttcttctctgcacttgtggtagtctgcaccttgtggtgcggccgttgcgtcgtactgcttgccgttgtaggtgaagttaccttgtttttgccaaatcaacaaaacaaattaaatctcacttggttcattaagcactaaacgttaattgattatatgaatcttaaaggattaaagggtcgatgcgtatagtaaacagaacaagtaataagctagtatctaggtaccactgaatccgcgcagcatgcagttgctaaatggtccatcctttctctctaggatgtgcgcgcgagaagcaaaaccgccatagtgcaaatagctgcaaattgttgattgatcttagtaaactacggttcaaaagactatatatgcattatttttcatattttctacagtaagttcagatattaacaggctaaagcctacaggcttcaatagttcagtttattcagtattcactagtacagtgtgtgcaacaaatgaattaatgttgcactttctaagtagtatattattcaccagcttgcagtggatccagatataaaattaaacaaagatcaaattatacttaacaagagcgtgaacttattaattgacctgtgcacataaatgttataatcttttcccttgagatactc

SEQ ID NO: 47732 - DNA, 2635 bp, Oryza sativa
ccattatgtttcagaggaaacatatcatcgttaacattttgtcagtagttttaagaaactatttcgtcagataaaccatcatacggaaacatccgtacgtattagtaattttaaattaagttcccgatgcaggtttcgtttaataattagataaagagcaaatcaatttagttgtgtacgtaccccaagtttaaggggagttttgttcataagtctggcaggaacaacggtgttggccttgtcaagcagaggcaatatggagtttgcggcatcctgaggacgtccagcgtaggagctcagcccaggatccacctacaacaacacacaaattaattagtcagtcagtagtaggattaaaatagctcaattaagtaggtactaacgaatcatcatatattaataagtacttcctccgtttcatattataaaactttctagcattgcccgcattcatatatatgttaatgaatctagacttatatgtgtgtctagattcattagcatatatatgaatatggacaatgctaaaaagtcttataacctgaaacggaggtagtagattagattaatgtggttaccttagcgaagagctcgatgttgtcgccgaccttgaggaggtccagcttgttgtcgaacctgaagacgtgcacccgtgtgccggtgctgccggcgtccaatatcacggcgtacctccccggccccgccgcctgcccttccacgacgccgcctttccggccgagcaccgccgtgtcgtcagcaacggccggcggcgacaaagccagcaggagaagcatggccacgacaaggtgatcagccgccattgctaactagacaaggtgaggcgcaggtgctcatcaacagaatgcaaggggcaggttttaaagggagaggggaattaatggattactaacgtagagtttactctgcataattcagtccctaatcacagtgtccacccattagcacagtacaatactcaatccgtattaattgtatttactgtaataaacagcttttagacggggccgtgttgcaaaggtttcactgtggattcacgtgtgtaatcctagtgcgctagctttattgattttgattgatcagaagaactgattcttggtgcccagcgtgaaacacgatgattctatctgtctccaactctccttacataacaagtttaaatcataaatattttcttggaaagaaaatcagttgattgtaaaagaaagaaaatcagttgattgtaaaagaaagaaaatcagttaattgtaaaatataggattccatttccgtcaccgtcagattagacccctaacatcttagcttcctctcacacggttgggtccgtccgtccatgacatcaagggggccctttcgatgcaggcgctgcacttgtgggatcggcttgaggcaattcagctacagccggattccagggacagctttgtgtggaagctttcggccgaggaaactactactcctcctcagcttactccatgtttttcatggggaaaacaaaggtggtatgggtggagttagtctggggggctaaggtcactcctcgctgtaaaatgttcatgtacctgacggctcggggcagctgcttgacctccgacaatttggacaaacgcaggtggccttcctgccctctctgttcgtctgggccagaaaccgggaaccacctgtttgtcaattgccctttctccaaacaggtttgggcgcaactgcgactccgcctccgccttcagccgcaaacaccaaatatcccccggtatggtttcctggtggctgcatgaacacgagcttcataacaaacaagggaagaaggtgtttgacgctagactcttcctcttctattggctgatttggaaagaaagaaatgggagggtcttcgaaggcgtttccaacttccaagacagcaaccgaggtggcagaagccatgacagaggagtggtggacttggagagatgctggtttaggtgctaggatcgagtctgtatagtcctcctgtggtattagacttggcagtggcatgtgtatagctatgttgtgggtcttcttccctgtggtacttagctcagtctccgctctgggcttggcgatggcccgactctctgctccctaggggagcgttagccttctccgtcaagaaccgttattgttgtaactgataatcttttctctcattttaatacaatttcgtcggcttccgctggcccagcgaaaaatcttgcttcctctccagaagttcactttatcttagtaatggttgccccttgttctctaattgatcagacaaaccaacaaaaagttaactatcctaactctcttcctttcaaatatattccattatacttgaacgcatgtattggcgctcaaatcttttacatgttcgctggatcaaatatcaatcataaagggttagaaataactagttgttgttagtgctatctatattcaaattttaattgtttgtcaaatatgttgattattttccaaattatagcaacatagattaaaagaagagtctatccacattagtatttcttgaattgttacgacttgtacctaacaaaacagtccatatcagttacaatgtgctactccctccatttcacaatgtaagtcattctagcat

SEQ ID NO: 47733 - DNA, 3967 bp, Oryza sativa
  unsure (1)..(3967): unsure at all n locations
atatatatatatatatatatatatatatatatatatatatatatatatatatatgtataaattcattaacatntatatgaatgtgggaaatgctagaatgacttacattgtggaacggagggagtaattattaattttcaagtttggaactaaatgaatacgatataaaattgagggtccagaacacattcaacttcgtattattaattttaaatttccaatttctgtgaaaactataactaaaaacatccatggtattttcaatggcatgttttatttaatataaattcttattaagatcttcaatcatgataatatgacccatctaattattaatggcaaaatctttctagcatacaggatcatatatatgaggagacaaacataaatgcatgttatatcagcatgagtttgtctatgatgcatgttcatccattttagcttttatgagtgctccaagaatattaggtcttttgaccactccaactaaaaggaagccataggcaggacaccggcactccaatgcaatagacgtagacatatagtgatgactatattattctgcaaaggttttcactctttcatcaaattggatggatatgaagaattaagaaaaggaaaaagtacgaattaccccccctgaactatcgtggtcgaacgaattaccgccataaactcaaataccagatattttacaccctcaattattcataccggacgaatttaccccctaacactgttttaagttgttttgaccaggagtttgcacatgtggcatcaacgtgtcaatccagtccgcaaaaataataacaaaaaaaattgtagggcccacctgtcatctatttcttctctccctcaatctctcctctccccgtctgtttcccactctattcagctcggatgggcggcggccggacggaggaagcgggagaggtggggctcaggatgggggcggtggccagtggcggaggcaaagaggcggcactcgggatcggggcggcggtcggtggcggaggcagagctcgggatgagggtggcggctagtggcagaggcgggcggaggcagctagaggtgggactcgggatgggggtggaggcggtaggaggtgggatgggggcgggcggtggggctcgtgtccctctctttcctctcggttcaaccccctctcttcggcggttggaaaaggggcgacgaccggtggtggaggcgggtatcgggatgagagcggcggctggggtgaggctaggaacagggtggcttcgagctcgctatggaggcggcgaggtcaacggcgagctccatgacctaagctccgccgcccctactgtccccgccttgccgagccgagcaacgcgaggcgcgagtaagaagaggagcgagagggagattgaagaagaagaggtgtgaggacctccgccgccggctacccaagcgagctccgtccgcctccgtctgagcttctcgcgaaaggccaaaggggagaagaaggcatcagcgaccggatttgagggaagcggctcgctccgcctccgcctctaccgccagccacccaagctcctctcccctgctctctcatccttctctcctcgaggtatgaagacgccctcccatcatcgacaacagtggagcagcgccctcccagcgactccaccgcctccagcatcattctcggtgtactcctccgccaaccgcagacgccgccgccagtcggccgcccgagctctttcctcctccgcttccaccgccggccgcccgagttctctcccatctccaccgccagctgcccaagcaagctctacctttgctgtcggccgctcaagcgagagagagagagagagagagagcagggggattggggagggatttggttgagggagagggatggcaggtgggtctagagagtttttttattttctttgctgaccggattgccacgttggtgccacgtgtgcaagctcaagttaaaaaccgcttaaaacagtgctcaggggggttatttgttcggtttgcataattgggggtgaaggatgtctggttttatagttcaggggggtaattcgatcgaccacgatagttcggggggggggaggggtaattcgtaccttttccttaatgtgttcatgtgttttttccttgatgacaagatctattcatttagaagccaacaactacatcgactctagattgttactttgaatttcattgtttgtttactttctacgttgtctaaacctaacaaggatcagttcattataacatatgcttgcataacattagataagtcagatggaccattggatcttttcatcttaaccttgttgttcgcttgcaatgatcagtcaggtttcctacaatgttaaaacaaaatagttcaacacttgttcttgctatgttcaaaattatgaggtagaggctactgatcacagatataaacattactttgcgtcaatttcagtctattactcaagatgcacaagcatgtctaaacaaactctctttgtaccataattttcaaaatcaactggaacaaaaagcgagaggtgagagcatgcatagcttaggagagagggtggtaatggttgaagatctcatccatgcacgtccatccattttacctttggtggccgctccaagaaacttcgggcagcatgcaacacaccatgcttaccatctctatgcaataggtgtaggtagtagtcaacacaacttaatttggcagatactatatctacgatacggttcatctaccttgttctcacctgaatatgattgatgacatattttgtttttttttttgccaagcttttgaaagtctagtgacacactacacgcgtgacttggtcgatactaataataactgaggtacgcaatcatgcatatatatatatttcttggtttggaactaaaaacaagtggagtactagagacaagcctttagtggcctcatcatctatcgtttagtgattgaagtggtctctttatcactgtacataatggcagcaagcttaagcatatatatactctcgtaaccatggtgcccatgaaagaaaatggcttaaagaaagaatggaagaaaaatggctcctagatggctagccatttcaagcgaacaattgaacatacacaaagccagcacaacaaactttttaaatttcaagttttgtatgcatgacttccatattgtgttggacttatgagtgatcagtgcaacctgctcgtgtggaagcatctttattgaatgttgatccttaatgaagtttaggttcaatttagaacgaaaaacacttacgagttgtgtattcttaggttcattatgggactctatgcagataagtatttagggagtagacacatactcacatcacaaaatagtaagcacgttactagatgcatacacaccatcatactctagttatgtgaagcaagcaatcaaacgttcataaaccaaagtaatcaaggctcgaatttagatgtcatatgtgccattgggttgtattcttttcttaagggttcaaatttggaaacacgtacgttcaatgcatatgcgttgtttcgattttagttcaaattgcagggaaacaaaatgtgtgccaactgtcttcttggttgattatgttatgccactcttttcttggttgtgcatggacaactaagcaattacttaaatcaaactatatgtgtcatacttttgttgttatgtaattaatgagcaaatatattattttaattattcaattccaagcatcacacctataaatgtccattcttaattcaaaatccagactcataaataatgatggaagacactattactttaacgagtagaatgcactgctctatgtggaaaccttaggtgtaatcaataaatcactaaacaatactaacgcattgtttttttacacacaactaaactcccaattcatgttgaatagtccactaactttgtgtagaaaagtctaaaaatat

SEQ ID NO: 47734 - DNA, 728 bp, Oryza sativa
ataggcatataggatattataaaaagtgatggagagatatattgaaatattatgtgaattatgtgggatgataatttaattaacatgcttgcattttaaagctctaaaacttaataaattagcatgcttgcatgagatttgagatgtagtaaatgttagcggatgacgtagcatctttgcatgttgagctttaggatgtagagggccttaactttatagaaagataggattactaggttgtatgcatgtgcttacataaaaaaaatcagcgctgtttgcgttaggaaaaacttaactttcattttcatccctcaaccacagaagagtatccatcgactattaaaactagtgtaaatcgaatcccttagcagtttacatgatggctccatcgtcctacgtgacactgatatgacggtctagtaaatcaatatcatattaactacttaaaaattaaatccgtaatcaaaagaaatagctggtatgtgttttattccggtatatttcagattacaggtgaagttatgttacaacggctccatctccatgtcgtcgtcgtcgtcggagacctcgtccaggacgtcgacgtagcccttggcctcgaacagggagcggatgaggtcctggtccttgcgcatgctcatgacggcctccctcagcgtccggtcggctcggagcagcatctccctctcccgcacatcctcctcgtcgtcctcatcgtcctcctccat

SEQ ID NO: 47735 - DNA, 1786 bp, Oryza sativa
ctgtactaccgtacatactctattttttttttccgggggatacatacttgcattgtgaaactcaagggcaagagactggcagatattcagatgtttccaacctgcactgtgaagctctaagcttatgccatcctggaagctcgatgctgtagattttagaggtgcaggcatcactacatgtctagccggttttcgtgttcttctcagcctttttgaactgccgccctttctttctatcattacttgatggcttgtcaaacaattccttgtatttctcaagcaattcctttttctcctctactagaccaagcatttcatatgtgtcttcaactttccgtacaatatctttgcttggaggtttacgaccacatgcttcaagattcttgaagagctgaaatcataagcaaaaacagggaaatgaaatacacataagtgggttttatcataatatagaatctgtaagagactaagcggcatcattgatcactcaagacccatcaacttctactgaggatcattagcttaaaatataagaaaaacagtacttgatggacaaagacttaagatccataccttgacaagcgtatctagcctattatttctgtagtaaatacccaacataagacggcaaaaccgccatggaactgattgtagatcatgggctatcttcaactcccagattctgcaagcttcatctgctctgttgtccttctcaagcgcacacactaattgctcatatgttctgatagtcttcccttgtcctttactcagcatccattttatcacctaaccatgtagttagccaattatttaattttgggtttacaaacgataaaacacaattaaaatcaagtaaattataatatccaaaacctggacgattctatgccactgttcctccttttcaagagctacaagtgctgctttaacgaggccacaggaaactcctgttcaaaggcaacccaagcatccagagtgctgtaaacaccttcttttgaatcttccaggtcaagcagctacaagttataaaaattattgattggtctctaccaggaagcaattataaacaaaacctaattatcatagagacttcatgctgtcaaatagtaaactagacaatacgaaaactagctgtgcatacagtgttgacaagatatttccttttctctgccgattataaacaaaacctaattatcatagagacttcatgctgtcaaatagtaaactagacaatacgaaaactagctgtgcatacagtgttgacaagaaatttccttttctctgccgatgatagatttttcccaactggcccttgtttcaattcctttgtactgttttgtatgtgtttgatgattgcaacatcatcctgcaatgcaaagccaatttctttaataatcaatcaccaatcttctataactctaggactgtgaaggtaaacatccagcagtctcaaaagataagagtcacaacacaggcaaaaacaaaaccatcctacaacagaaaatttagtgaaactggttggattagaaaaatgaaatgggttgaatcttaagccttcggggagtaaccggaaacataaacaagggacagtgccatggtaacagggatatagattaactgtgaagaaatagataatcctcctataagtatgactggaataggtaactacactaatttggcacactagtctaagatactaagggaacaactttaaggttcataccttgtggcttgaaaaatgaaacacacacaaagataagtatacagtttaagctttgtgtacgta

SEQ ID NO: 47736 - DNA, 2222 bp, Oryza sativa
tggtcgggattgattggcccaagatatccatcggcatcgggcgccggcgcctggtggtggttgcggagacggcggcgggcgcacgactgggggaagggaggcgacgctgcgctcaaccgaaggagtccagggagctaggccgccagcgtgggcaagcacgcgcccgcgcgacgacgacatcttccacctcgagctcgctcgaggtaattagtagaaaaccaaaccaatcgattagcttgcataaattaatttcgcagctgtgcctgtgcttacttgcagctaatctgcctcgcatcagcgcacacgagtagtaacctcttgttcggtgtagtgtgtaattttattaggcattattactgtgcacatgggaatttagcatttcgctggagcattcatgtatatgactttttatgtaatgttcttggtccataaatcccatttgttgagatgtactagtaattgagtggagctttgatcgattgaaaggttggaaatcttaactagatggttggattgaccacatcatattcatgtggggaaaagcacgaactgaactgaacatccactttgcaggtgcactatatcactgctccctgtaaagaactgaagtttattcattctagatttctaaataaatatctgaaggttgtgatggaatttacacctattgtcttattcaggttttgatggaatggaactaaacaggatgcagacagagtaagtcaagccaccaaagttgactgattgctacactctgaaactaatcagatctcctccacaagaaaaccactagtaccaaactaccagtgaaggtatctagtaccaaattgttcaaactgaaaccctcactcacaacattgctctgcagtcccaaccatggatcaccaagaactagaagatggagctgagaaggtgaagctgttaggcatatggtcaagcccttaaggtgtcaaagtgatgtgggcactaaggatcaaaggcgtggagtatgactacatcgaggaggatctgaggaacaagagcaacttgcttctggagtgcaaccccgtgcataagaaggtccccgtgctgatctatcaaggcaagccgattgctgaatcagacgtcatactggagttcatcgatgatgtctggaaggatttgagataccgtatcttgcctgaagatccctatgaatgtgccatggcacgtttctggtccaaatttgggctggacaaggtcagcaattttttttgtttattttctcaagtctaaacttttaagtaatcatttatccacaattgcagctgtcacctccaatttggaagtggttcaccacacaaggcaaggagcaggaggatgcatacgaagctgccatggagcagctgctggttctggaaaaggtgctcgatgagaagaaattctttggtggagagaggatcgggttcgtcgacttgtctctgggctccctgtcgtatgtgattccgatatatgaggacatcaccggtgtcaggctgatcaccagcgacaagttcccttgtctgtctgcatggatggagggttttttgggcttgccactcgtgaaggaacatctgctgcctctgtacaagatacggcccaggtatcaagcaattcgcgaagcatttttatctaaatagaagcagttggttagtagcagatgatgatatactgctctcttcaatgtttgtatatgtagcagttccacttcacactgctagactgctagtatttgttactactacatgagctacgatatatttttattatattgactcatactttaaaagagcatacaagttgatactttgtcttgacactgagctaaaagactggtactatagtaataccatatacccaagaactagagctaaaacaagctaaatttatttcctttctttgtcggcattcctctcgttatgtatgatctgttaatgctttccctgtacacaacacaaagaaaccaataacacgatcatcaagacttgacaggaggcagattatatatagtacataatattgactagttgattcctgtttcactccaaaaaggttggaattactgatacttactcagcaaagatgaagccccctctcctttactatgtgtagtctcatagaccaactactcctcagcaaggggagaatctgaagacatacaacaaaatagtctatcttatataactgcagtaattgcaaatgcaacatggaattacatgctaaca

SEQ ID NO: 47737 - DNA, 964 bp, Oryza sativa
tattcgctctcatgcaaaacgatctatgcataaaatttcgttcttactcgcttctcttatttgagtcctttattgctttatttaaatttggatttgagcatgcattgatcctactcctttgtcttctctagatggccgaccacccacccaaccaccgcggagaaggcatgattgactttgtggcagagttggcacgtatgacgctggtggtgggctaccccaacgcgccagagtacacgactgttccacctctcagtggtgagcttcctcaccgtgtccgcctggaggtccatggctacgtgggtacctgcctagctaatatggtggttgaggcgtccggaggcatagcagatcacgcctgtcaggaggcagcatacctgatgatgcccagactacgggagcgccacaactacatcttccacgacacggcgtaccaatttcaccctcgtcgagccagcggtgatgatgtcagtaccttccgtccaacagccggtgagaacgacaccaccttcggccacatgtgcgccgtgatgaggggaatggataggatgcactcgaatctacacaaggcgtccaaggccttgaacgatgggaagctcgtgaggatcatagctctgaaggatgagatagcacgcctaaagagggagaatgctcaattgaagggtctcccagcgccaggaggagtccggatccgcaccacgccccgcaagtcgacgactgcacctgtgcgcattcagcttgcgcccaggaacccacctctgcccgcaattcccgcagctccagctccagccccagctccagttctagttccagtgccagctcccgcgtccgctctctccttcgctccagcatcggccgccaggggtccagctagtggcaacgggggttggttgcctgctactcccagtggcagtcgcgaccacagcagcagcagttccagtggtacatagccgggtagtggcga

SEQ ID NO: 47738 - DNA, 2021 bp, Oryza sativa
tgagcatctgtttttcttcttttgccccgtctgctcttcctccagatggtctacaccaggaatggtagccgtacaacaggcgagggcagcaacggcgaagagcgcactgatggtgtgcatcccaacagcgatttcggcaatggtccgccaccactccccgagaatccgacccttgcccaagtaatggctcatcagacacagatgatgacagctatgacgcagcaggtgcagcagcagcaccagcagatgtaccagaggatgcagcagcaagccgagcagcagtagcagcagtttggtccccctccccctccgtccaaactgccggagtttcgacgcattagaccacccaccttctccagcaccaccaaccctatggaggcgaatgactggctccatgccatagagaagaagctaaatctcctacagtgcaatgatcaggagaaggtcgccttcgccacacaccagctccaaggtcccgcatcagcttggtgggacaatcacatggccacacgcccaccaggcactgaagtcacttgggcagagttctgtcgcagcttcaggcaagtgccagatgggttgtggcacaaaagaagagggaattccgggcactccaccagggcaacaggacagtgacggagtatttccatgagttcaatcgcctcgcgcgatatgcaccggaggatgtccgtaccgacgccgagaagcaggagaaattcctagcaggtctggatgatgagctaaccaatcagttgatatctggagattacgccgactttgagaggctggttgacaaggcaatccgccaggaggatcaacgcaacaaaatggacaggaagagcaaggcggcgcagttccggtcaaaccaagggagccaccagcgaccgcgcttcactcccggacagcagagtggacctaccaccctgatcgtccaccagcaccgccctttcaatgccagcaacttccatcagggtgccagtggcagccagaaccaccatggtggtcagcccaaccgcagtgcagctccgcgcccacaaatggcactagcacagtcagctacgtccgcgcaagccaagaaggagactgggacaaagccagggtcctgcttcaactgtggcgagcttggccacttcgctaagaaatgcccgaagcctaggcgtgccgagccaaggtttgtccaggcccgtgtcaaccacgcatctacagaggaggcacaagcagcaccagaggtggtactaggtaggtttcctgttaactcaatcccagcaacaatactttttgattctggtgcaacgcattcgttcatttcaaagaagtttgttgggatgcatgggttaataagagaggaacttagcacaccaatgcgggttcataccccagggaatagctccacttcggttcaattcagcccttctataacaatagaaattcaaagatcaccatttctggccaacctcatccttctcggatccaaagacctagatgtcattcttgggatggattggctgaccaagttcaagggagtcattgattgtgcgaatcgcacagtcaccttgaccaacgagaagggagaaacagtagtgtacaaatcaccagtctcaccaaagcaaggggtctctttgaatcagattgaggtggaaatcccagtggtcaccgaggagaagaattcgaggaaattggaagagattcccatagtctgcgagtacccaaaagtgtttcccgaagacctcactaccatgccacccaagagagagattgaattccggattgatttggcaccgggaaccgctccaatttacaagagaccgtacaggatggcagccaacgagctagcagaggtcaagaagtaggttgatgagcagctgcagaaagggtacattcgaccaagtacctcaccttggggtgctccggtcatttttgtggagaagaaggacaagcaaagagcatgtgcgtcgattatcgcgcactcaatgaggtcacaatcaagaacaaatatcctttgccgcggattgggctgcaggaat

SEQ ID NO: 47739 - DNA, 6903 bp, Oryza sativa
gccgcggattgatgatttgtttgatcagctgaaaggagctaaagtgttttctaagatagacctgcgatcaggctaccaccagttgagaattcgggaagaggatattccaaagacggccttcaccactcggtacgggctatatgagtgcacggttatgtctttcggacttaccaacgcacccgcattcttcatgaatctgatgaacaaagtgttcatggaatttctggacaagtttgttgtggtattcatcgatgacatacttatctattcaaagtccgaagaagaacatgagcaacatctccgtctggtactcgagaagttaaaggagcaccagttatacgctaagtccagcaagtgtgacttctggttgtctgaagtcaaatttctacgtcacgttattacagctcagggcgtggcagttgatccatcgaatgtggagtcaattaccaaatggaccccacctaaggccgtgtcgcagattcggagttttcttggacttgcgggttattaccgccgattcattgaaaacttctccaggatcgcccgacccatgactcagttgcttaagaaagatgagaagtttaaatggacagctgagtgcgacaaaagttttgaggagctcaaaaagaaattagtatccgcaccagttttgattctgcccgccagatgaaagacttccaagtctattgcgatgcatcccgccacgggcttggatgtgttctaatgcaggaaggtagagtggtctcatatgcctcgcggcagttgcgtccacatgaagggaattatccaactcatgatctagaattggcagcagtggttcatgctttgaagatctggaggcactatctgattggcaaccgctgcgaagtatatacggaccataagagtctgaaatacatcttcacccaaccggacctaaatctccgacaacgaagatggttagaactaatcaaagactatgacatgagcattcactaccacccgggtaaagccaatgtggtggcagatgcgctaagcaggaaaagctactgcaatgccctatgcatcgagggcatgtgtggagaattgcagcaggatcttgagcgtctcaacgtgggaattgttgaacacgggttcgtagccgctctggaagcacagcctacgctcgtggatcaagtcagagcagctcaagtaaatgaccccaaaatagctgaactgaaaaagaatatgagggtgggaaaagcccgggacttccttgaggatgaacatggcacaatctggatgggagaaagattgtgtgtacctgacgacaaggaactgaaggatctgatacttatcgaggctcatcagactcagtactcaattcatccaggcagcaccaaaatgtataaagacctcaaagaaaagttttggtgggtcagcatgagaagggaaatagcggaattcgtcgcactctgcgacgtttgccaacgagtgaaggcagagcaccaaaggccagcaggtttactccaacctcttcaaatcccggaatggaaatgggaggagattggaatggactttataataggactgccccggacatcatcgggtcacgattcaatctgggtagtcgtggatcgactcactaaggttgctcacttcataccagtacataccacgtatacgtgcaaaaggttggcagagctctacctctcgagaatcatgtgtctacatggagtacccaagaagattgtatctgatcgagggagccaattcacttcaaagttctagcagaaattgcaagaggaattgggaacccggttaaatttcagcacagcctaccatccgcagaccgatggtcagacagaagagtcaatcaaatattggaggacatgttaagggcttgcgcacttgattttggtggagcttgggacaaaagcttgccgtatgcggagttctcttacaacaacagttaccaggctagccttcaaatggcactgttcaaagcattatacggtcggaagtgccgcacacctctcttctgggatcagacaggcgaacgtcaactgttcggaacagaagtgttagcggaagcagaagagaaagtcaggactgtcagagagaggctgaggattgcccagtctcgacagaaaagctacgcggacaaccgccgacgagagctcacttttgaagcaggggattacgtgtatcttcgtgttactccactccggggagtgcaccgttttcaaacgaaaggcaagttggcaccacgcttcgtgggaccatacaaaatcttggaacaaagaggagaagttgcgtatcagctagaacttccatccaatatgatcggtatccatgacgtgttccacgcatcccaattaaagaagtgcttgagggtacccaaagaacaagccaattcggagcacatcgatatccaagaagatatgacgtatgtggagaggccagttcgtatccttgagaccagcgaaaggaggactagaaacaaggtcaccaggttttgccgggttcagtggagccaccattctgaggaagaagcaacctgggaaagggaagatgagttgaaggccacccatccgcacctcttcgccagctcctccaaatctcggggtcgagatttcatttaaggggggtaggtttgtcacatcccgaagttctttcccaagcctaaattggagttttaaatggtctcaagaaaatacctatgtcaagcaagagtaaaccttaataaattaatgcaaataataatcggaattggcatgtggaatttttcttgagttttacataccgaaatacgctaacaagatttttagtggaattttcagagttcttgaaataattttaaccaattaaaattgagcacatgcaattttaatcccatgaaaaatcctttttccttctttttcctttttctttcttttcttttctttttttttcctttgaatgggccgccggcccattcctcctttttctccccctcctcccgctggatccggccgaaggccgaggcccagctaagctgcgcgggcctgccgcccgcctcccctctctccccgggacgccgacaggtgggccccacctgtcggggtcgtccccttcctccagccgcccgtccccacgtcgccaccaccgccgaaaccgccgccgcgcccacatcccgccccctccgggccacgtcggccgccccggtcatgcgccgcgtctcccgcgcccacttccccctcactctcccgctcgcccgcgctcccgagacgaccgggattcgattttcgaatcccgcctctctctcctctcccactcacccacgtcggccggcgattcccgcctctcccggccacgtccggccccctctctccctatttaagctccgccgccaccctctctctctttttccccatttcgccgaactctcccgagctctccatcgctcccgcaccgtgcatccacccgccgccgcctttcccgctactccgggcgccgctagtgtattaatccccgtcccaggaaaagccggggtacaccatacaaacatgatataaaagacacatctttattatatcgataatatttacattattacaaaggcacttaaggcctgacaatcaaaaataaatagcagcggactagcgggcctacggctccatcttcacaggcgctcaactggggtataagccaggactccacctaagacttcttctccaaagcttctcttactgaagggggaaaagattgagcaagaatgagtacaaccacagtactcagcgagccacaccggcagatgcacgattaatgcaagggggtacaaggggtaatgatataggggttaagttttgcagaaaacatcatttaaaagtcacttagttgcccaaagccatttataaagacgatcctagagctacacaatattattaatcaaggccgtgaaccctcacgaacctgccttaacccaaggcctacgatgattcagaccgaactggcaacccgaccctgggtcccagctcgtcccaagccaacccaggccaaccattccacattttagttgttaagcaaattttaagaattaaaacactaacttgggtacattgctcggcttgcccataaccgagggcgcggctattcgaatagattatactctgatcagaggtgtacatctttacccacaagacacatcttcctcacgtgtaaccatgtgccacataccaccatggtatacggacggaagacgtgacatagtttccaacccatcctagccataaacaagagtaccgacccaaccccacctacggccggaacctccgggacaggtatgcaggattgagcccctagcagcaggacaccagccctgtgccatgacatctcgactaccgggccgcagctcgtgtagccttcatttgtcctagagatgtccatcgacccccgacttcgtccatctccatccgtgtacttttgtttataaccagactgagccacaaactaagccttacccactagacatgtggaagtacggtagtgctttgcaacagaggcccgagcttaatccttatagtggccggggtgctacttcccacaactggcatgcacccaaaccccaccggaaaacaggttttaggggttttgaaagaggaagagaggtgtatgtccaattccaccataagccaaccattccatagtgtccaaatgatatgagaatttccaaagtctaaagttataaaaaccacctaatgttgtcctatttaatcagcgaagcatctacctaatttcatactagtggaaccatgaatagagtacccactagttggggttttgttttcctagggtgaacaaggtaataataacaatagcaataataaggtcttaacaaaggtaaataggcatggctaaataaaacagtgataacacgggaatttaaataaagcgataatgcattaatttaaatcaaaataattttataaactgggattcaatatgttcaaagatgatgtgacttgccttgctcagagagaacggccttccgaaccttcggcgacgaccacgaaccacgcttcgggaacctccggaacgacgaaagctacgcgaagcacacaagcaaagctacaagcctataaagaagcaataacaatacataaaaagaaagcacagggttctttaggttataacaaacattaggagacttgaacgggtcgattcagagttcgtatgaccaagatatgatcatccgaagtttaatgctgttatatggagatttgcggattattataattaggctttgcaaccataaaacatgtggaagcgctagcctgggaaaagacaggaaggctgcgctgttgacatgcggaccccacatgtcaacctaaaggaccgcggtagaccgagtacacagagacggtccacgggtcgacggaagcggaccccgtgtgtcaactgaggcgagtggccgacaaacggactccactagacaccacacgggttgcacacgtggagtccacgcggctactgagtgggtacactaacacggtcaccacacgcgcaagcgaacgactactgacaccggtacacgggtaccggggtcgacaaccgcacaacgggcacgggcgacaccgaaaggacgaggacggggcagcgagggagagggatccttaccaccacgcgacgaggcgtgggaacgacaacgacgaacgggcgcggcggagacagctcagggacgatggaggcgaacggcgagggaacgacttcggcggcgatccttggacgaaggcgagacgcggccggcacaaggcttgacgacgcggagccgaggacgaagacgacgacggggctgctgcacacttgacgaaacgcgggcggcggacgagaatggcttgacggagggacgaacgccacaacgagcgaaaccgggaacgacgagaggacgacgacgacgacgaccggagccggcgaggaggcgacgagggcagccggcagcggctgcacggagacgaggacggcgtgttccacgccgcagcaatgccgacgacggaggcggcgccgcgagatgacgagccggcgaggaggaacgatgacgacgacgacgaacaccggcggggttcggtcgaaggggaggcgaggccgagggcggcgtcgcggctgcgatgccgaaggtggtggaggtgcggccgaccggtgcacgggtgaggagggacgggcggccgaacaactccggcgaggcggatggagaggttcgcggcgatgtgcggcggcttccgggcgaaaccgaggggtggacgaggtggagggctacgtcaccgtgccgagggaggggacggcagcgccggctgacgcacgggcatggcgaaaggggttgccggaggagacgtcgacgaggaggaaggtgaggccggcgcgggcgacggtgttccggtgaaattcgggcgaggaggaggtgatgccggggatgagagcagcgtcgcggagccgagggaggtggtggcaacgtcgaccggcgctcaggcagggagacagaggcggctggaggcggccggcgcggaggaaagggaagggcgacggcgggaacgcagctccgggggtcaccgcgcgaaacggagggtaggccgtgggagaggaggcggctgcgacaccggggaaggcgacggcacggccggccggcgtggtgacgcggcggcaggggcggctggaggaaggccggcgccggagggagagaaggagaaggcggggagaggtggtgaggccacgggggggctcgggaggaggctaaaacggtagaacgcaaagagggggttccattttataggatgggggagggagccgggcatgggagagggcggaacggcgacgagaaacacggccggcggccatggttggtggccgggaaaggcgcggccgttcccgatgattgaaggcacgaatcaagggggaatttggggggaatga

SEQ ID NO: 47740 - DNA, 1088 bp, Oryza sativa
accctcggaaagtaaacgtcgcaatgctcgaccaatatccacaagaaacagaggacaatctcgtccatctcctgaaggcgcagcattacaagacgttcatattgttgccatacaacacagagttagtttaattttactgtcttcctacataccaaatttcattcccgtacgaacttgctaagtgtttcatatgtaatgcatcccacgcacattgcagattccactgggtgcttttactcttcgacctggaggcctgcaccgtcaacgtatatgactcaatggataaaaaagagtctacgtttgacaaggttttcgaacttatagacaggtaccgtcataagttcctttgttaattaagaaaatcttgttatgttaattgctactacgaatcatagctttaaactctatgtagggcttggtatcggttccgtcatttggtccgcggcaaatggagagaaagacttaggcggaagttcaaatttcctgtgaatacacatgctctacatttatatttctccgattcaaatacatacaagtgtatattaattagatctctcgttgtttgtcatttatttgtagtgcgcaaagcaaaagcagggaactaacttgtgcggctattacgtgtgcgagtattgccactgccttgcagaccaaatcatcaccacaagagagctcgatgtacgtacaaataaattcaaaatttcattacgtagcgatttcttgtttaattactaatcaatttcatacattcatatagtttattcgcatgagggataacctgaccacacacaaggaatttatcggggcggttcaagaacaactcatgggattcatcaacgaagaaatccttgatcccaagggtgaattctactacgacggaaacacaattcaccggtccttagcttctgagctagcagcgagtactactacgtcgaaatcgtagctagctaggacatataatggattgtaattaatacatgactacatatgtttctatatgcatgtgtacacattttctataatgtaaatatattttggtcatatatatatctatatacatatgcatttgcataacatatatatgtata

SEQ ID NO: 47741 - DNA, 825 bp, Oryza sativa
ccgacgaacttggtgatgttggggtggtcgatcttgtgccaggcttcggccacgcccctgagcgacgcgcgcaggtgggcgatctgctcgggcgtcgagaacccctccttcccccagtcgaggagcttcacggcgacgtcgcggccatcgtagtccgcgcggaacagcgagccgcggaagccgtgcttgacgggagcgccctggcggatacgcagcctcgagaggtcgatctcccacgccgccttgggctcgtcgccgccgccttcgcagccattgttgctgctgctgatgcccttgcccaatgccctagcagccatcttctcctcgagctccatatccaacagtgcgaggtcgaccggcacgcacgaacactgtaaaagtgcgtaagcgttctcacctcgtctcgaggccgcgtatgaatatttatatgttgttgagaagaaccctcaacgtggcttacaagattgaatcagtttggatccgattacaagagataaaacattgtttcatgtgagaaacaaactctagacttatctctaagcctatgcaaatctaaaccatactttatctctaacagcccccctcaatcataacttatctaagttaagattgtatacaaaattcttgaattgttgagctgaaagagacttagtaaatccatctgcaatctgatctccagaagcaataaacttaataaccaattgcttttgagccactctttctctaacaaaatgataatcaacttcaatgtgctttgtccttgcatgaaaaaccggattaactgaaagatacatggcttccaaattatcacaccacaaacatgct

SEQ ID NO: 47742 - DNA, 5670 bp, Oryza sativa
ttctctaagtcaaacttctttaattttgatcaaatttatataacaatatagcaatattttcaacataaaaaactatcaaaatatattcaatgttaaatttaatgaaactaatttagtgctataaatgttgctatgtttttttataaatttggtcaaactttttagaaaattgattttgcaaaagtcaaagcgtaaaatatgaaacggagggagtattatcttctgaacatatgtttgaccattggattaattaaaaaattatataattatcgttatttcattatagcttggttaattttcaaaatatatgttttgtatgacttatatttttatatatttatataaaattttgaataagtcaaatagttaaacatacgtcgaaaagtcgacggcgccatttattaaaaatccaggagtattcatcaactgacaattctcttaattttttttgtcgtaaaataaaattttatttcgtatacacatgtggctataatttataatgtttggttgcacgttctgtacatggacatctatttaacaagcagcgcaatgcttgttttggcagcaatagtgtgagagagagagatgtggcgttgctgcagcagcaacagagcctctgggcttctcgtgtggctggtgcttgtgtgctcatggcagattgcagctgctcagcctcaacaagcagcaaaaactgatccaaccgaaggtaagaacgtaaccatgttccccgcaaaaaaaaagaacgtaaccatgttcttgggttttcttggcttaatttgtccgtggacactacatgattaatttagaggaatttgtgttgattcatcgcctaattctgcttacacatagtattaattaatgttgactttgttgagttaaccgtgcagtggcagccctgaacacgattttgggaagatggagcaagaaggcatcgtcggagtggaacatcagtggcgagccctgcagcggtgtggcctcggatccgagcaactgggataacttccccaacatcaaccccctcatcaagtgcgcttgcacttactacaacaacaccgtttgccacattaccaaactgtatgcacagtagcaattttgtgtctgacattttgctattgaagttaattagaacctgtacaaatcaattacaaattaaacaccaaaattacaaaatatttggctaaatttgaataaacttatgctaaattagaaaggaatgaaaattttgtcctgaagaacatcctagcagggaccgagtgacaaactgacaatcccaaaattctgaaactcttcccaaatatggaactgttagacacctcttctctcaacaaataacagcatatctaatacaagctcgacaagtacaaccagctgtttgaggtgaaactgaggaagaaaagggatagaggatacaagctctaaaaggtctagaagctaggaagagcaagtggagctaggaggagaggtagtggaaagatcgccgaggttccagcccggaaccaggacactgccatcgccgagccaccatggccaagtcaccgttttctgctctgttccatcgttgaagtcctcctgtttcggccttttctattcctctacattgcttgtttgagcctcggcatggattagcaattgagtaggccctacagcccaacgggttcctaataggaggcaactattttttgcacctgaagatccttaatagaaaaccccttatattttcagggcttcaggctggaaggcagaggcatttggtgtttcttccaatcagtaacttgggattcacatcgactaaccattacttctctcaaatgtttttagttggccatagaggaaatgttggtatgtcctttacaaaaaccgatggtgtattcagtcctccaggtcaagtggcatggttttgcatgcccttgcaggaaaatcaaacggtttataagttaggggtgaaaatttaactgtccctatagaagttgagagcagatgtcacgtcctgataaattcatcccgaaataaaaatcatcttctaaaaggaataatagaattaattaaaattcgaaaagaaattggcaaaccctaaaatacgtacaagaaaaattcaaatgtggcccggagaatttttgttaaattctccttggtctaaaaggagccctcaaattttagtggaattttcagagcacaaataataattattaagaaataaacaaagttgaaaaggttttataaaaagaaaaatccctaaaagtcttcttttccccccccttcctctcttgggccggctcggcccaactctccctccctctctctcctctccccccccccgcggcccatcggtctcccccgcgcacgcgccgctgacaggcgggcccgcccgccgccctcgctgacgggtggggcccacctgtcatcgccttcctcctgccgctcccgccgctcgcccgtgccctagcgccgccgccaccgccgaatccgccgcatcccgccgtccccgcacgccataatgaggggggaatcattccccgcgattccctctcccgattcccccgctttttccctctctctctccctcggtttcgttcggagttaatcccgcaagtttcgccggcgtcttcaagggcggccgagatctccgcgcccgtttcctccctctccggccgcgctctccccctccagacgctatataagagttccccgtgctctcctcctccgtttccgccactcgccgcctctcctccccgtcggaatcgagcccgcaccgtcgcaccttctctccgccgtcgccgccgagctccggttcgccgccgtcgtcgctccggacctcctccccactcggcgtcacctccatcggcttcgccgcgtccccgtcgacctcggccacccctccgcttcgctcgccgaccgccggagcaccgtcgccctcgccgtcccgaaccgcgccgccgccttcctccgcttcggccgccgttcccgtcgtcgccgtcgactcggggtgagccgaagaccgccctttcgcttccctctcctctccgctctctcgggcgccgctccgccgcgccggtggtcgccggcggtgaccatcggggcgcggtcgtgccgcctcccgtcggccgtgccggcgaggccgccttcgggcgcgccctcgcggctgccaagtgggcccggccgtcagccgcccgcgcccgcgggtgcggctgacgcgtgggacccacggcgccggccgccgccagccgcgtgctcccggtccaccgtggaccgagaggctgacgcgtgggccccactcccgtggacccggtccgcgcgccctctctcccggctgacgcaataaatgggtttttaattaaaatttaaatgaagaaattcgcaaatatccatttaaagagcatataaacttcaaatggccatatcttggccatttgaactcggaattggaccgttcaagtctctaatttttccttaagaagtcaagaacccatttttgtgctttgtttctgctgttatgtggagtttagtagagtaaaagccttttcttttccgtcggtcgtgtagacgctgcagcttcggaagatccgctcttcgtggaagttgaagccggtgtttgggaaagcgagcaaggcaagtcacatcatccttgaacatattgaatcccagtttgtaaaattatgttgatttaaattattgcattatcgctttatttaaattcccgcgttatcactgttttatctagccatacctatttacctttgttatgaccttattattattgttattgttattatttccttgttcaccctagagtaaacaaaaccccaactagtggacactctactcatggcaccactagtttaattttaggtagatgcttcgcaatttaattaggtaacattaggtggttttacaactctagactttgggaattctcatatcatttggacactatggaattgttggtttatggtggaattggacatacacctctcttcctctttcaaaacccctaaaacctgttttcggtggggtttgggtgcatgccagttgtgggaagtagcaccccggccactataaggattaagctcgggcctctgttgcaaagcactaccgtacttccacatgtctagtgggtaaggcttagtttgtggctcagtctggttataaacaaaagtacacggattggagatggatgaagtcgggggtcgatggacattctccagggcaaatgaaggctacacgagctgcggcccggtagtcgagatgtcatggcagagggttggtgccctgctgctaggggctcagtcctgcctgcctgtcccgggggtcccggccgtaggtgggattgggtcggtactcttgtctatggctaggatgggttggaaactatgtcacgtcttccgtctgtataccgtggtggtatgtggcacgtggttacacgtgaggaagatgtgtcttgtgggtaaagatgtacacctctgatcagagtataatctattcgaatagccgcgccctcggttatgggcaagccgagcaatgtacccaagtcagtgttttaattcttaaaatttgctcaacaactaaaatgtggaatggttggcctgggttggcttgggacgagctgggacccagggtcgggttgccagttcggtctgaatcatcgtaggccttgggttaaggcaggttcgtgagggttcacggccttgattaataatattgtatagctctaggatcgtgtttacaaaatagctttgggcaactaagtgacttttaaatgctgtttactgcaaaacttaacccctatattattatccccttgtacccccttgcattaatcatgcatccgccggtgtggcttgctgagtactgtggttgtactcattcttgctcaatctttccccccttcagtaagagaagctttggagaagatgtcttaggtggagtcctggcttataccccagttgagcgcctgtgaagatggagccgtaggccgctagtccgctgctgtttatttttgtttgtcaggcctgaagtgcctttgtaataatgtaaatattatcgatataataaagatgtgtcttttatatcatgtttgtgtggtgtaccccggcttttcctgggacggggattaatacactagcgttcgggaaaaggcgattttcccggtcgcgacagcagaaatgggggattttactgttaattcaatgatttggcctgaatggcatataaaagtctacaataatcacatatgaatattacttgtagttcttaaaataaaaagaatattactggtttgtttgggcaggaaggtatataagttggacgtggttggtcaaataccagcggagctgcagaatctcacctacctagaggacctgtacagtatctaagacttatcatcttatttcttgacaatgaaatgttaaaccgcccatctatgttgtgccaaaaaaaaatgctatctctggtttttaacagatgccaacatttactttttaatacatgtttgatcaatcatcttattaaaaaaattacataattataatttattttgttgcaacatggtttatcattaaaggtctattaagctgacttacatatttgcataaaactttttaatacgacatgatcaaacgtgtgtcaaaagtcaaaggcattgttcattttttaaaccagatgagggctgcagga

SEQ ID NO: 47743 - DNA, 5973 bp, Oryza sativa
cagaacatccatatagctagctatctaactgatttggcagacttaacttattattactcacttcaatagtcttttcatgtactctcttctttccgagcatatgacattaggacccatacaccagcctctagtactaccccttcttcctactcctctttctcccctcttcctcctctcccggccttttaacggcggcgatgacaacgtcagccgcaacccagaactcagcttggggagacggaggcggtgaaggccacgaagctgcaaatccaacccgctagtcgaatttgcgctagagcgggtgtcgtgtagccctcgaatccacaccgtgttgcccgaatccgacacaagccctcgcgaatccgcgccacgccagtcgaatccagtaggggcacaggtggcggaggcttccagactatggcgaatacaacagcgacaacggatagtaacctcgaggtggatggcaacggctagtgatggcacaaacgacagtggcggtggctggcgatagtcatggttggaaatttcggactgaaatttccgaaatttcgatcatttcggtcccctccgatacgatattacttcggccgaaatttttcattttttcatgaattttggtaatatttgttcaaattcaactaaattttgttcaaaatttcggaccgaaatttcggcattttggtgaggcccgatcaaatcagcataaccgataggattaaccctggcgacagtgacctcggtagcaacaacggatgatgatggcgaccttgatgacgatggtggccggcagcgctcctctgcatgggtgcgggaaaagagagagaaggggagaagggtatctgacgactggatcccctggttggcaacatggcttggcccgctaggtaggatgcccatgtttagctagctagagagttaattttgtgagccagatggcttggagggtttgttggcaggtctattggaggatattttttcatcgaacttacctaattttagtttggagaatgcattggaaaggctgttttttataggttcgttgcaatgatatacctcaaatttaaatatttaaagtaaaacacatgttcagctgtgaaaaagggagtactatgttagttttctctagagtttttattctttcgtggagtttgggatgcaaataaaaatcccacatagtacataaaaaacaatagaaattagaattttccaaattcaaacattgctaaggcatccacgttaaattgaaataaccaactacggaatcatttttaatcaaatttaataccaggctaattataaggattgaacacaagtttttactttttttctataaagtgtgtgaaattcaacaacgccttcaaaatgaaaacacgatcatgaaatttgtgtacatggataacaaatgtaaaatttttgagacctactatatttcaagtaaattgagggtaaatcagctggttatatttttttttaaccaacacaaattcaactcaaaaacttgacatggcagcactcgtacgtacgattaattattattccagtgataagcgaggtacctgtctatagcatagcacctttgatgattttatcaatcttgatataccgtctcactctctcgaagtttttgttggggaagggtatgctgtgtttataggatgagtgtacttgcgtgtatgaaccactgtgtttcttttttttttaaaaaaaaaaggtcctcgatacttgtttacaggaccaagaaagtctctttcaaagcttgttttatgtcacaaataatatggtcaatccaatcaattatgatcaaaatgtgaaaatcttacaccaggcaccaaaggctacctatccatgagcccactctaaaaatgataggtcaatccaaatagtctactccctacatcttagaatatagcaacctaaaaccaccggatgtgatatatcctagtactacgaatctagacagaggtatgtccagattcatagtacatccaatccggttttaggttaatatattctggaacgaagggagtagctatcttgtcttggaaattcggaaacatttactgatcaaagaacgattttgctatatctcactcgaaagattttttcttatctcttactcgattttctcactcaaatttacagtgtgttttcttgtaagttacaatataatttatgaaatttgcactgtaacttttgtaagttacagtgtaatttttgaatcttcgcatataagttttgaaatttatattggatttggtcttttttttctgaagatatggtaatatagtatccattatggtgtttcttagttgttttttgtattttactgtgtctattggattttaatccaagaattaaaaatctgtgtgatatgattataaaaatctttcgaaagatgcatagatatccaaatcggccctgaccacatcatggacccacacacaccgcgcagcctaggagggccgaagcacaggcctcattttccatttggaataagttaacttttggtctcttaaattttcgacgaatccgaattccgtcgttgaaccggaaaaccagatacggctgtcaaaaccggtacaatatagatcccatggtaagacaacagttttagctgacgtggcacctacatggctgatttaactcggtctttatcccacgtggaattgacgtgacgcttacgtggcaattttatctagaaaaaaataaaaaccatgggcccacacatcagttacagtaaaataataaaaattaaaaatggtggggcccacatgggcccccacatgtcattctcactcctggacatttttcttcctccagcggtttcttctgcggcgacttcggcgcccactactaggaaaagcatttttgtaagtggccaaaacctattttcgcaggcggaggggaggaccgcctgcagacgaacgacggtgaaaatcatccattttcgcaagcgggcaaatggcccgcgtgcgaaaatccaataaaaaacaaaaaaaaaatcgcctccacgccgccgctgccgcagcaccgggagccgccgccgccgccctcccccggcctccctccggccgaatctaggaggggaggccggggtagccgccgccgctgccgcagcaacaggagccgctgccgctgccctcccccggcctctctccggccgaatctgggaggggaggccggggtagccgcagccgccgcgtccgcgcaccgccgccgccaccgtgtccgcgcgcgccgccgctgccctcccccggcctccctccggccggatcttggaggggaggccggggaaccacgtcgccgccgtcctcccccggcctccctccgaccggatctgggaggggaggccggggagccgccgtcgccgcaccgggtcgccgcagcgtccgtgcgccgccgcctccgcgtccgcgcgcgccgccgctgccctcccccggcctccctccggtcggatctgggaggggaggccggggaaccacgtcgccgccgccgccgcaacgggtcgctgccgtgtccgtgcgctgccgctgccaccgcgtccgcgcgccgccgccgccacggtgtccgcgcgcaccgccgctgccctcccccggcatccctctggccggatctgggaggggaggtcggggagccgccgccgccgccgcagcgcgctccgccgccggtggaccacataagatgcgcctcgcaggggaggggaggggatggtagaggaggggatgggggagctaagaagccggtggtggagggagagagagagttgagaagatagaaatgagtggtagggaggggttggagtactggataaggattgaagttttttttttggtagatacgatttttgcaggtggaccacataagatgcgcctcgcaggcgtggcttaggtggtccgcctgcgaaaatgattttcacaggcgccgcttaagtagtccgcctgcggaaatcttttcgcaggcggacaacgaacttcacctcgatttatatttttgtaggcggtcatttgactcccaagcttatgtccgcctgcgaaaataagacacctacattgggaaaaatgatttttctagtacctgcacgtcgaccggtggcgaatgccggtgcgtcaaagggttcaagctgtcggacacgtacgaaggagtggggcggctcggctactttgtcaccggctgctcgaggtctctcccactgagctgcgagcctgcgacgccaacggccagaacgagcacggcgactccttcgctattcttgacaatctcgaagggctcccttacaacgctcaggacgaaccaggtgacaccgatgaagattgcagagaagcttgcctgaacaaatgctactgcattgcatactcaagtgaatatggatgcaagctctggtattacgacctgtacaatctgagctcacctaataaacctccatacagcaagatctatgtccgagcaccgccgcgtcctccagcgtgtcaccgtcgccccttctccggatactagcacggaagtcgtgcaggcgctgaatcgatgagcttgatgggatgcttcaatttttgcttgagatttcatatgtactgttgatcacattcaactctgatcagttttgggtgcagcgactaatagccggacttgtagccgggggaagaagatcgcccgagagagaggaagcagaagaggagggactgagaatgacatgtgggccctaatatttttaattatttttattttaactgacatgtaggcccacgatttttattcatttttccagatcaaattgcaacataatcgccacgtcaatgccacgtgagataaagaccgagtcaaactagccaccacatcaactaaaaccgccgtccaaaccgtcatgggatctatattgtattggttttgagtccaaaccatcatgggatctatattgcattaattttgatagttgagggttcaaggatgaaatcggattcgttgataagttaagggaccttaagtgaactttttcctttccattttcaccccgtgcttgcgcctctggacctctgcttcgcaacgcggcctagcaggtccgagacaacgacgagccagctgggtcgctcactcgttctgccctgctctagattctagaaccgtagactacccgctggattcttaaaagatatcaatcttttcatatttttcgtggctgaaagttgatggattacctagggaaaaatattgatgtattgttaactttattcggtatttatgtataattttaaacattttttattaaatataataatgatatccaacaaaattataatattgtaaaagtacataaaaaaatctattcaaaagtacataaaaaaatctattcaaaatattttcatgttttgaaattaaatcattgatggtcaattttaaaatttttgactgaataaagtcgacaatattatttatttaaatagagtgtgtatatatgatagtaaaacactagattacaaatactttgtataagtggtctgcaatgtggtagacctttttttcataaattgtatatttagatataaatacgagcaattctcaacaaaaatctaatgaataagctgaaaaagggacaactagcaacaatttaacttccatatatataagtggcgaccttaatagtaaaccataacgcaatgccacttttgcacttgcggaagtggtgagctacacataaactgatccgaactactacaagctaagataaccatgtgtataagttgggggcacgagttatccctaaaatctatcactggtggagaaaccatctttcgtcggtcggccgatttccacaatagtcccggatacaataaaaaccggggctaaagatgatctttagtcccggttcaaaagggtaacgggcatatttgatctttagtcccggtttgtgtaccaaccgggactaaagatcatctttagtcccggttcgaatgctgtcagggcctgtcaggcccccccggg

SEQ ID NO: 47744 - DNA, 6575 bp, Oryza sativa
cacccgtcggatagactcgaagcaaaagtgcaaaacagaccaaaccagacgatcagctactttattacatatccaggataacccgatagcatatcatctgaaaaattatactagtaccaatttaccattcctggcatcgacaacgaatgcacgcacgtaataaaggtacatgggctccctaaaaacagacacaatttatgaaagtatagaagaagtatggaaattaaaataaaggaaaattcacggcatgaactttgctatagtttggatattctcaaagatagatacaacaagaattcaaaaaaaaaagaattcacaattcatgacaataaacaacagtgtcaagttattacataaagagtaaattaggatttattatgtaaaagtactaatattaatagatttatcatgaaaaatgctttcatatatagttatatgttagtaactttttatacaacataaagttagaaaaagtaataagggaacatgtgtttttggagactgtgtttgtgtctaaaatgtaagtaaaagagaatggagataataacattcagttccatctactttgtaaatttcggcggtgccagccagcattaattaatgaacccatagcattgaattggcacaacaagaaaaaggagaagtctttcaatggtcaagatgcttttgggcggagataccacacatctaataatgattaaagattgaagggctaacctcatgtagcactggtacatgcttaatttaccgctaaatatacccacgtgtgcatgttctacactactatagatcctgctattgttggtggcctatttattattggtggcctatttgttatggatcaatacaacacatcacagaaacctttatctctaacatgtagaacattagcccgcttaagattatattgtccggaacaacctgccacaaatcgaggttatatgtgatatagtaattgtagcccgtcacggatcatttatgataggtcataacgacaacccgttatggatgatcccacacctttaacagtctattaacccatcactgataagagtgacgggtacccgatagaaataacaaatcatccctaacgagtttgttttttaacccatcaccaatgtggaaaaaccgattgagcggtcaattgcatgtcatccacacataaaagatcttcaagatatctctcttgctagctagtcagcctctcccttcttgttgctatctcccaccttcaccgtcagcaccaactccaactccaccagccatgccggcaccagctcgatctcgaccggccactgcagcctctagatctgagagttcaggccgctagcctcctcctagggtcaaatatgaagaacaccgtttaagcgtaatagcagatcaaccaacaaaactaatgttggactataataatggattaaatgttattgtggttactaagaacgctatgtggtaaaaaaaaaggggggacacatttaagtatttgccacttcacaaatacgacgtttaacaattgatcactcatgttgtgtctatgaatatggacctaagctagagccctcgtatcttaaacacgtaatgtgaaaaattattaaataccacgttaaaattgataaatacttaaatatcccctgtttggcacccgtcggatagactcgaagcaaaagtgcaaaacagaccaaaccagacgatcagctactttattacatatccaggataacccgatagcatatcatctgaaaaattatactagtaccaatttaccattcctggcatcgacaacgaatgcacgcatgaaataaaggtacatgggctccctaaaaacagacacaatttatggcgattttgacgatacgaagtatctagatttattcggtcggatcacacactgtacgcccctaatcaacgccgaattttcgccatgtcctatattatttcgatgtcgggcaagctgccaatcccaaaccaagattatgctctctccatacaattaactcgatctacaactactctgccgctgcacatgcctgcaaattcgccagtgcgtgtttgatctcgcatcagcaacttgtcctcttccagagcacagatctatctgtcaaatcgcatgtcacccctgcattgctgctgccacttgaccctacacaacaaattatacaattattcatcaaatgatgattcatccatctcatgagtttttttcccttaaacaattgttagcataatcccttgcagaatatatgcgagataatgacgtatcttgttggagcaataaaaaaaattatggccattgttgggtgaagcaaaggttatagcagaacgtgcagccacactagccatgatccatccatgaaccatgatccacaatatatatacgtgtgtgtgatggtggctttgccattgtcatcgtggacactgcaatttgcagctacctctcctaatctctctttgatcaaatcactatcgtgtaattaacgcatagttagctatgaggaaggtgtgccctaaccttgaccgggaggacggcctcgacaccgtgctggaggtgccggtgccggagctccaccgccaggcaccgcggcggcgagggcggcgcggcggcggcggcacggtgaagtcgtgggtgcgggcgaggatggagcacgggcggaggcgcgacggcgcggcgccgtcgcgcgccgaggtgcagctgatgctcggcgtggtcggcgcgccgctggtgccgcaggccgtggaggcgaggaaggccatggtggccgggcggggcgtcgggggggagggggaggagcccctggacctggaggcgtccaaggcgaggtacatcgtcgagcagtacgtcgcggcggccggcggcgaggccgcgctgggcgccgcgacgagcatgtacgcgatggggaaggtgcggatgaggacgacgacgacgagcaaggcgaacaagggcaaggtgatgggcgtggccgccggcggcgaggtggccggcgggttcgtggtgtggcagaagaagccggatctgtggtgcgtggagatggtcgtcgccggtggcgtcaagatgagcgccggcagcgacggcaaggtcgcatggcgccagacgccatggcaggaagcccacgcctcccgtggcccgccacggccgctccgccgatgtattcaggtactgaactgttctttcgtctctgcgtttttacccaaaagaaaatcaaatttgactaaaacttgtaataattgagcaaatcacaattgcatgcaagaacatggtgtaccgtacccggacaatccggccggacgaacgtgctcccatgtgcttgtaaatgtatgattatttaattttgatttaattactgtattaatcaattttgattatgtgtgatgcagggcttggacccgaagtcgacggccgacctgttctcgagcgcggcgtgggtgggcgagaggtgcgtcgacggcgacgactgcttcgtgctccgcgtcgacgccgaccacgccgcgctgcgcgcccggagcagcggcgacgtcgaggtggtccggcacgccgtgctcggctacttcagccagaggacggggctgctcgtccgcctcgaggacagccacctgctgcgcatcggcctcgcccacgccgccgccgagagcgcctactgggagaccaccatggagtcctccatcggcgactaccgcgccgtcgacggcatcaacatcgcgcacgccggccgcaccgccgtgtcgctgtcccggttcgagagcgccgacgacgccgccgccgccgcgcgcggtagtaataagcggtcgtggggcaccaccaccatggaggagacgtggagcatcgaggaggtggacttcaacgtcgtggggctctccatggattgcttcctgcctccccgggacctagtgctcaacgactgcagcaagcagcagcagaaagaggacgccgccgccgccgtcgtcgtcaaggacgccgccgccgccgtcgacgtcaaggacgccgccggtgccgccgcgaacgccaagggcggtagtgacgacggcaagaccaacggcggtgacgtcggccgcggcgtggtggtgaagaaggcgcttgttccggcggtgaccggactgggttggttcggtccggccaaggtggttgccgtcgacgacacggtggacgacggcgtcgccgccgcagccgacgacgacaagtaaatgtagatatctctcggctactcgctagatcaggtggtgctcgcttctgcgcccctcaagagtaaatattaattcgtatagtttaagttaatttctactacttaggaacatgcaagcttgatcatgttatatgttagatctagcaactgcattccattgtagatgttgggggaggagactaagtttatgttcttctccattcgagtttgaggacattttgcgtagtgtccggccggtgcttcattcatgatgtaatttaatactttggaaacaaacatccaaaggaaactttgtgtatccattttgttaagaacgacatgggggcttcagttccaggtccattcatcagaaactaaagttattaccgccaacgacgaaaagcatccaaaattttgacaaattgacttgtttataaaaaattattttaaaaataaaacgtaaaaaaataatttcagaaatagatcatgacctcaacgacaattttgtgctgagctaaatgtctcaactccaccactattgatgttgagatctcatgatcttgtccgacgtgacataaatctgcaaggacacgggagctcagcataagtgtgctggcggcatcgatcgatgtatggttcagcatcctccactatcctccgaatgcatatttacattttttgagttgatattaagatgcaagaaataatttgaaccacgtcaaaatgtgatcaccatcatggatctcaaaaggtacaatctggaacacatacacatacgcacacatccccctccaaacaaaaatatttacgtaccagattaaatcttagcctctacatctaaattagatgaatacaacaccaacccaaaaaatataaactatttcttagcttccaatgttccaatacaaacaacaagatatattacttcgctcaaccatgcgcaatcataagagtggagtgcattttccgtacaataaaataaattgagtgcctaaacttcaggcaccatttttcttgttctagctaggtgacaatccaataattctcaacacttctctattgctaatttaaaaaagtctattcgatttaaataaaaggtcaaaacaataaattattatgacataaaatgcaaagttatatgaaatgaacttacaattaataaaaataaaaaatacattaaaataggcttagataaagaaaaaattaaaccatatatttcaaaaaatgctaaaaaattatacattttaggtgcattaagtgtgaatcttttttggatgggtcaactagggtgtgtttggttgcctgtatgaggcctggcccacatctgtagatgcaattttcggtttttggttacctgcgtggccttcccagcctcgccccgctcatgcaaaaaggcctccgtagccaggctgagtggaaacagtcaattcgagcttcacaactcagcttggcccgatggatgtaactggctgtatccgcgcgtgcaactggtaaagatggggtcagtttgcccctcctcatttctccccccaaatccaaaagctagggtttggtgccagcgtgccaccctcctccttgacactactcgtggacacatggcctagaaaagagagacgtacatgggctgatacaagtgcatatagatgtattttgtcgttctccatcatccgcacgatatataaaagttagagtaaaatgcttggagagggtcatctaacttatttagacgtgtcacataggtcactcttctaattttaaattgcacatctgaatcacgttagtgagtcaactgagtcatttagtcaactaactatccacatgaggacgccttgtatatatgacatgtcacctagaattgacaaaaatacatcatccgcagccgctgcctcttaggaattcgactccatttctgtttacatccatagtttatcattgccgtcgggtttgatggcaagtgagagaggactgagaactagcagaaaaactcatcaaaacagacacaagtgaaatgatttggttcctttcatttcttgttagtgttgtgacaaaaggggaaaagaacacacatgtggtttcctgcatgtccaaaagcaatttttccaataagggcacccacaatggttatctataggctctctacaagagatccatgtcagcatattttcctacttggaaggtattaaatgaagagagagagcaaagctatctactaacttagagataatctatagagaaaaacgaggcaatgcatgagagagttatagataccaatgtagacatactattaaggtggtttactattaatcgagtctattgctgagatatacaagttttatagatagcaccttacttaccattgcgggtgctctaataggtggcatgccatgcgtataagatatcgtgtggatacattaattagat

SEQ ID NO: 47745 - DNA, 5926 bp, Oryza sativa
aattcaatgagaagggaggatgaatctggagaaacgattgatctaccaaaaatggatcagccatcacgagccccaattgagctaaagcccttaccttcaggcctacgctatgcctttctgaatggtgatgcggagtctccagtcattataagtgacgaactctctgagagggagacgacccgacttatcgccgttttagaaaaacattgtgctgcttttggctattccctccaagatttaaaaggcatcagtccgaccctttgcacccatcgcattcccttagatccatcttgcacaccatctagggaacctcagaggaggctaaacaatgcgatgaggaggtcgtcaaaaaggaagtcttgaaactcctacatgccgggattatttatcccgtgccatatagtgagcgggttagccatgtccaagtagtgcctaagaagggaggcatgacggtcgttgaaaactcaaaaaacgagttgatcccacaacgaaccattacgggatggaggatgtgcattgactataggaaactcaacaaggctacgaagaaggatcactttccgctgcctttcattgatgaaatgcttgagcggctagcgaaccattccttcttttgtttccttaatgggtattctggttatcaccaaatccccattcatcccgatgatcaaattaagactacattcacgtgcccataccgaaaaatgtcgtttgggttgtgtaatgcaccagcgtcatttcaaagatgcatgacgtctatttcatttttcaagcaaacgaagagctttttccagtaaatgccgtgtgtacttttttagaaaatggattaaaatccggcctctacatccataatggatgtacacagcccaaaatgccgtgtgtacttgtgtacgtagatactgtgtacattctgtacagtaaatagaaaaatcagaacaagatttcaaggaacagtgtggatgccttgacaagacaggacgagcatgctgagaacaagaaaggcagccgccgccgttcgaaagaaccccatggccatcgtgtatctctcgatcgatcggctcaatgtgcgtcgacgtttagtaacctgtacgtatgaaccttctgaagatcggcctttgtttgtcgacccgcacggcgattcaatcgcaccctctggtatatatattgcacaatcggggtacaagataaggtaatttcagaagtatatttatagaatttctcgataaacagatgaatccaaaattgatatctattgagccatcattaaaaataaaaaatagtattctttgtatgcatcgtatttgaatcttaaccttccataagccatgtgcactaagtgtagttgccattgatataaaacttaactagcaaatatgcccgtgacttgcaacgggatatgtatattatatatatattattcctatttattgcatgatttgttttttttctatacttatacgatagtggtgagacagatgattcacatgggatttggagagatttgtttttaaaatgtttggcgtgggtctagtacacgtgatagatgaaacatatgatagagatctaaaggtcaatttacgtattgttgctagatctaatgattcgtattcaccacaaggaattggctgaaatcactccatggacctgataagcctgggatggtgaatcaagcccacgcttgttggttttaataaaaagatgtgtaagtattttattatctaaattttaataaaatttattacatacacaaccagtgaatcagtgaaaaacaatcaattaatagctaaaagtgcttcaggaaaagaaagcacaacacaaaatttatataaaaaatgcacgattcgataaattttataaaatctacttatacatcatgtagaatatctcattaaatttatttttaccatgataaatcagtaaaaccagagtatagaaaagaaagaaaagtaaaaacaaacaatgtagcatcgcctcggctagcttctcataccacttcgctgagccactcaccttgccttgttactcgcctcgtggcttaccggcgctaggtggttggatccgatggcctggtgactaagaatttagagtcaaccttgatgatagggagaatcagcaccactggtggacaaacccgttttaatcccggttcacaactcccctatagtcccggttatgcaaccgggactacgaatccaggactaaaaatacctatttttagtcccggttcaaataaccgggactaaaaaaggatctttagtcccggttggagttccgaaccgggactaatgctcttttttcttttttttttgtttcctgctacttgcatgatttcgagccccacgaatctccacaaatcattcgaacaccacgtatcattcaaaaaatccccaaatatttctatccccaaatacatcacaaatcattcacaaaatcataaaatcatctccacaaattcattcacacatcacatatcacacagatcagaaaaagaaatccacatcgcacagatcggccgcacagattagaaaaagaaaccacatcgcacagatcgaccacacacatcacatagatcaggaaaaaaccacatcgcagagatcgggcgccggccgtccgccgcctcgccggcatcccgcccgggcctcaggctccgccgccgcctggggagcgtcgccgcccgccgccagccgcctatgcggccggtgcgtgcctgctgccacctcgagctccgccgcctcgccggcctcgctgacctcgctggccgcctggtgggccgcccgccgccggcctcgcaagccgcctgcccggccgccggcctcgcctacctcgcaagccgctgcctcggccgcccgctgctccgcgccctccctgccaccgcgcgccgcccggcctcacgtggtaggaggaggaggaggaagagaatagaagggagaggaatgggagaggagaagggatgaggatggaggaggatggatgaggctgaggatggagaagggataagggctgtttaattaatgagaggggaggagagaggaaaggggagagaccgaggcggccgggcgaggcagtggcgccagctcggttgattttttagtcccggttggtataaacaaccgggactaaaaaagaattggggtctaactcggtccgataaccttttgaaccgggactaaaaatgatctttagtcctggttggtgttaccaaccggggctaaagatcaaaaggtttttaaccgggactaaaaataatctttagtcccggttcctattcgaatcgggactattgtggattttgggcgaccgagcaaagatggtttctccaccagtgcactatgctcagaaaagagccaattttcatatggtccgagatgttgggtgaaaatatttatattaaattatgaaaaaaataaaaatagaaagagtatagaataattttatttttgaaatcatcaaatgaatatcatttcaccgtgttcacgcatgtgcatgcactgataatcgcgtcatgcacaagctttgtgatggcaagggcagtttggctcggggccgctaatgggcgggtgatcgccccccatccccctatacactactctcttatacactactctcttgcttcctcatctccttcttctcttcctactacaccataaaattttaaaaaataaaaaacacaaagttgaaaaaacttatgtatagaaatactatatataaaaaatttgaattcaaatataaatttaaaacgggtatgtaaacttttgacttacaaactttgggtctataaattaatatttgaattcaaattcaaatttgaatcggatatgtaaacttttgacttataaattttggatctgtaaactttaggtgtataaactttagatgtataaaaatactatatataaaaaatatttgaatcaaattcaaatttgaatcggatataatttaaattcaaatttgaatcgagtatgtaaacttttgacttataaactttgggtctataaactttaggtgtacaaactttagatgtatagaaatactatatataaaaaatatttgaattcaaattcaaatttgaatcggatatacaaacttttgatttataaactttggttctttaaactttagatttgtaaacttaaggtgcacaaaatttaggtgcataaatttactaaaattaaaaagtaatacagtgccaaaaaagaaaaccacgtgaaggagaggggggcgccctagggtcgatcgatcgctccttagcaatggctcaggttggtgccggttgaggacgtgtgttagacttgcagttggggcctgtgggcaaatggcccagctggtccagataaaagatcagcagcgacgctgggtgcagaggaaacgcgtaacgcgggcccaactccgagcgagcgcgtgcgtgcgtgaacggatgattttttttttttggaattaaatgcgttttggaattaaatgcgtgcgtgcgtgcgtgcccatctgtgttgaaatataatgatttttggaggtgtgtatgggtattaatgaagtggaattaaatagggacgtttgtgattgttttagataagaaagtactcgctcggtcctaaaataaacaaaccaaccaatcaatcgatgcgaggtgcctatgatgacttcgacaatctaatgatatatatgctaccctagtctcttgaggtagaatgtgcgtttgtatatccatagggataagtgtgtgcacatgtatgtgtatttattgttttttgtttgtgaaaagaaaatgacgatgaaaagagttaaaccctgcattttaaatcagcaggtagggtttgtgtgcgtgccttcataggggtaagtgtgtatgtgttatgagtgcttgcgttgtactgtataattctcaaaaaaaaatcagtagtgttttatctttgtgaaacattttattaacttggttgaaacaattttctataagtggtgaaacaacctatgaggccatgactagttatgacatatataattaatataattgtatgatatcatattataaatatttaattgtaatgaatataactgtataattggattatagattgaataaacaatataggagggaaaatgattaaaagttaataaaaagattatgcaagcacgtacatatgctggcatgctgctaattataagagggagagagagggatgccatcctgatgttcagaggcacagaaagagggggcagggagtacgtacacaagcattaccgtgagatctgatttttcattcccgtcggacgtctaatgtgtagctctctccaagttgtaccgatatattagagatagctactaatgtgtctgtactaacgttacggcgaaatttagtaatacaaacaaaacaacatgaagatgacaatttaattttaaaattcatgtaaagaaagaaggatgaatagctaatctagtccttcaactcatatagatcctcatatgagttgcatcttatcatatatatagatcctctaagtattcatttttggctcaaaatttttcatggactcacttgatgtgccacatggttaatccaattcaacatttatattacaaaatgtccattatacgctcacaacaattagaatacaacaatcagatcagcatcataaaatgcaatattttcatagaaacggtatacaatagtcaataaagataacatgcttgtagttatggaggatacttgacgttgattcttacaaggacacctttattggcaaaattggttatatagcattgaatgttcacgtttttggttttatagcaccgaaaaataccggttcactttaatagcacccaaagtttaccatgttcccatttttagcacttccgtcaacttttccgtccgtcttgatcgttattgacccagctacgcatacgatatgacgtttctacccctcattgacatgc

SEQ ID NO: 47746 - DNA, 1781 bp, Oryza sativa
acttgaagatattgaataattcaaggaaagttaattggattggaagagagaagaaagcacatgtttatgtaaatagtgaaaatgaaaagctgagttctcagtactggtttctgaccagctcaagtttgcaagcttggggggaaattgagacagcctttgccctttcccatttaatctgattttgccaatcttccttttacctgcattttcttgaaattcatcagacaacttacatatgattgcaaacatcacattttaggcctcgtttggctgtttgtgtttcgatgtggaacaggccccaaacccgcccttcgtggaatgcagcccacgcctggatcaattcccacatctggcccaaatgtgcattggctgttcgtgtattgctgtgattgcggctcgatccatgccgacccacggatgagagaataatcctcacccgaggcctggaactttctcgcgtgcacgccgcagctcgcggctcctcctgcaccgccaccgctttctccaagccatccaccgcctcctcgccatcctgctgcgccgccggcgccgccgccttctccgagctatccaccacgtcctcaccatcctcctatgccgccgacgccgctgccttctccgagccgtccaccgcctcctcgtcggcctccgtcgtctgtcgcctcatcgccagcgtcgccccggcagcctactcgcttgatcaaggttcaaagtcctctcctccttctcctccttcatctcatctcattttctttgcccatcttctttcatccacttgttttgctgctaggaccttcaagatccggaaagtacagccatcctgctagggtttgacgatctgcaagagaaatattggagacgaggtatgtcaatgcttggagatatgcaaagtacagccatcctgaagggaataaaacacagtagggaatcactagcttcgatcttgtgtcagtgcaaagagattttgagcagaaataaactacaactagtagttctcctctacacactgctgagactgtaccaccaccactacatgatatacaaatgtatagcaagcagcacacattacagtattttacactaacaccattgaatgcacaaaagagcatactagcatagtagtatagcacttctattaaacaaagtgagtgttcagttcatacacatgcataattagctttaattatttatgaacatatatagtgttgaaactaaaaactagagtgctgaaaccttttttttcttttgctaactgcggtcatcttaaatattcagtattccttctagttagaaggtatgaattcgctaattaggaagagaagagatgaggaggatgaggagattattatgttctggttgcctgccctatatcttttaactagtaatggagggatagagaaaagagtaaggcatacttcaagtcagtacggtgaagaacaactcagaaatattttagagggacatgaaaagaattgccttgttgcattccgcatggagcctaacatatttagagcaatagcgacatatcttcgaacagaacatctcctacgtgacacagaggtattacggtagaggagaaacttggatttttttctttacatgatatctcacaatgcgagctatgaagatctacaacatgaattccatcatagtggagaaacgattcaccggcatattatggcggtttaaaatgtaatcccactttgacctatagatttatcgagcaacctactggagttgaaactcactggaagattagcacagatcaacagttctttcct

SEQ ID NO: 47747 - DNA, 1834 bp, Oryza sativa
cggggtacctgaatcacgccatgaagggagactacggggaaagggaactctcggaaggaaagcaataatgacggtagacaacaatttattccgtaaagcccatttcactgttctgcaacactcttcattggtagctccttacatcgaggagcacttggctctagttcgcgccaggaacatcggtaagtccgatgcatggattacacggcatcacattgatactttccccgcgtggctacgacaacatctcatgggtaacgagtcgatcaaccaacaacttgccttcctggcgaggggaccgtctgggtcgatcacgacattccagggatatgagatcaatgggtacacattctacacgagagcccaagacatgaagagcacgaaccaaaacagcgctattcgtgtcgatgccatgggacacgatggaacaactgccacgtattacgatgccatcgaggacatatgggaacttgactatggtcctctcaaggttcctctgttccggtgccaatgggttaggttgactggtggaggcgtaatgattgatgatagtgggatgacaactgttgaccttaacaaggttggatactcggacgaaccttttgtccttgccaatgatgtaacgcaagtctttttcgtgaaggacatgtctagcaaaggaaagaagggcagagggcctgatgagcctaagcgtcaagtggttctcccaggcaaaagaaaaatcgtcggagttgaggacaagactgacgaggattacgatcagttggatgggcaaccccctttcacggtgacgattgaccctagcatcctcctatcaaatgaagacaccccttactcacgcagcgatcacaaggagggaacaatagtgaggagaaagtacgtgcggtcaaccgtcaccgccgatgtaatgccgtaattattgtgtacacgatgtaaactattttggatgtattgattatccatataaatcaattgatgtatggcatatgttaattacgcatgattattagaggtttcaacaagtttaaatcatgtatatgctagttatatgtgatacttacaatttttaaaagttttaaatcacacaggtggcaatttcatatgtatgttaattagagtttttaacatttaatttactagcattcatatgctaattataattgactagaggatttttaaaagttttaaatcacgcaagtggcaatttcatatgttaattagagtttttaacatttaatttactatcattcatatgctaattataattgactggagaatttttaaaagtattaaatttaatatatttttaaaactatcattcatatattagagtttttcacaatttaatttactatctttcatatgctacttatatatgactattcgaatttttaaaaggtttaaatcatgcatgtggcatttacatatgttaattagagtttttagcatttaatttaatataattcctacgctaagtatatatgatgattacaatttttattaattttaaatcatgcagtatgtacatacatatcttaattagagtttttaccaatataataatatcattcatatatatgctaagtatatatatatattggaatttttattaattataagtcatatatttgcttattacgatttatccacttaatttattacagacaaaaataatttttcgaagtaattgtcattaatttttgtactttaaataatattaatgcattaacttctattttataaacacatatgtaagcgaaaatcatatgcagtgctataatctttagtcccggttcttaaccctaaccgggtttaaaaagaatttcgaaatagc

SEQ ID NO: 47748 - DNA, 10026 bp, Oryza sativa
actaaagatttagtcccggttgttctcaacaaccgggagtaaacatctgggggtatatatattcccggtgcgccctcgtcttcttcaccaacacttagacgttttcggccgatcgatctctctcggcctctctccttcgccgccactgcctagggcaaatccccgcgccgacgccgccgtatctcgccgtcgtctcgagctcgtcgtcctcgccgccgcctccacctcctccgctgccgccgcatctctggggtgagagccgccgccgccagatctcccttcatgcatctcgatctctccgatctcgatctctctccgtcgcgccgcccgccacgagacgccgcgccacgacgacgacgcgccacgacgacgacgcgccacgccgccgccttcgccgccgccgcatgccaacgccacgccgccgccgccgtcgccacgccgccgccgccttcgccgccgcgcgcgcaatgccgccgccgccacgccacgccgccgccgccacgccacgccacgccgccgccgccacggccccgcaacgccacgccgccgccgccgtcgccacgctgccgccgccgccgccacgccgccgcgccaaccgccgccccgatgccgccacaccgccgttaacgaacgagaacgatcgaacgaacgagagcgagaacgaacacgtcaacgtacattgccgcgagaacgtgaacgagaacgagaacgatcgaacgaacgagagcgagaacgagaacgatcgatcgaagacaagcgagaacgagggaacgaacgtgaatgagaacaagcgaacgaacgtgaatgagaacgagcgaacgaacgaggacgaacgttaacgtgaaatgcaatatatatatatatatatatatatatatatatatatatatatatatatatatatatatatatatatatatatatatgttacttcgcatttatcctaatacatctttttgtatcttgcagaaaagacgtgttgtcggagtcgtccgtcaagcctgagtggaagagctagccctagaaggaattggagcatgcaagtgacgtaataatataaatgattgttatatttgtaatgcaattaattaagattattagacctgtaattagacttatcatataagattgtgtagtgttctaatattatttgagttttaatataagattactttatttgtaattagacttagtatgtaattattgactacggaattggtgcgacaagtagcaattgactattgtagtcttaattagacttagcatatacatgactattttagtcttagcatgtaatattatttgagttttaatataagattactttatttgtaattagacttagtatgtaattattgactacggaattggtgcgacaagtagcaattgactattgtagtcttaattagacttagcatatacgcacgaaacacttagcatatacatgactattgtagtcttagcatgtaatattatttgagttttaatataagattattttatttgtaattagacttagtatataattatttactagctagggttgtataatatacgtcacctagacttagcttatatcacgatttgtaattagacttagcacgtaaggttgtgtagggttctaatgtacgacatttacacttagcatacatgacttagattgttaaaacataaatgtctcgtgacttagcagatgtttcttgtatcaacagatggctgaccgcgatgaggaacagatattgtacgatacaatcgcggagggaagcagccagtactggaatgaagaagaggggaacgaggatccaaaccagtacttgaacgaggaagggaacgtggagagggatgctgtcgcgtcccaaaacgactctaaaatacatcctcaaaattatgcatagaataattaaaatccatgtgaaagcctccaacaattaaaatgtgcaaatttaaaagtcaaataaggcttggaggatttttgtatatttcctaaaagcctaaaatgcgtaaataaattttagtggaattttcagagcacaaataataattaagaagaaataaacaaagttaaaaaggtttcaaaaaagtcctttccccccctttccctcttgggccggctcggcccacctccctccctctctctcctctcccccgcggcccatcggcctcctccccgcgcgcgcgccgctgacgggcgggcccgcccgccaccctcgctgacgggtggggcccacccgtcatcccctacctcgcgccgcacccgccgcctcgcccgtgccctagcgccgccgccgccgcggattccgccgcatcccgccgcccccgcacgcaataaagagggggaaatcactccccgtgattccctctccctttccccccacttttctctctctctctgtcacatcctgattttcgtttcaggatttataaattatttaataaatcattaatagaatttatattaaatgatctttaatttacaagtgaagttaaatgtgggaaataaaatttcctaaatataaagcatggatggatttaattttttattaaattctccatgattaagtcaactctctgaaattttctcggatttttcagagctcaattcctaaatgatacaaagaacagtttagcaattatttaaaaaataaattaatcattaaatgatctggatattattatattaaatactttgagtgtccaagtatgttcaagatttttcttggaattatttgagcattggaagtatttttaacaattgaaagatcatctcattggttaatttatttggaaaagtaataaaaatcctccttcctagtcttgggccgaatccagcccattccctcctctcctctctcccttcctgtcagcccagccaaagtctgtttaacctccctggtgctacagtactccatcttcctcctccagtcagagccgagccagccgtgctcgtgcacagtgccgccgattcccttccaaaatccgacctccccgttgctcctctttccaaattggttgcgggaatggaatcctctcaatctcctcttccttttccccaagaaatccccaaaagtttctatggaaatcctttccaatttcgcggatcaaatcctttcctttttccggcgaagataaactttcccgagtttttcccgtcgatgtgggctcgatcccggcctcccatggctatatatagagcccccagcctctcctctttcggccgccacctcctccttcttctgccgccgcccgaaaccctctccccacgctctccctttctctccacctccggccgccgctccagcagccccgcgccgtcgctgtggtcgtcgccttcggtcgccgctgccgccgttgggttcgcgaggaggagaagaagaccggcctccacttccccgtcgtcgaagaccccgggaagcccgtcgtcaccgtgaagccgatccgttccatcttcagccgcgccgttcgtcgccgtccatcgccgccttcattcaccgtcaccaccctcgggatcgcaggagcgaggtgaagaccgtccgcccctcggttgttgcctctcgtcgccggaaagccgtcgccatcgtcaacccaaggtcgccgcctttggagctcgtcgcctgccatctccctcgccgtctgtcgtcgcataagtggtggtaagggtcactttgatcccctctcgctcccggtgccctccgtttgcgtttgtgccgtggttcgccggcaaccgccgctcctttgccgttcacctgtgaggttttccctagggccttaatccgatctaatctaatcttgtttggccctagcgtcatcatcgtctccgtgtgtgtcgtcgtcgttgtgtcgtagctgcttgccgtgccgctgctgcgcgtgtgccggctgagccgcttagctgcagctgcttgccgctttgccacagccgcagccgtgccggttgcgtttttgctcgcagccctgctgctctagccgtgcatggtcgctactggctgtgccgtcaccctaaccctagctgcgtgtttccgcctagccgccacctagccgagtcaagttgtcttagtgccgccgtgtcgcagctgtgtgccgtttaaacctagccgccgctttagccgttgctcggtagccaagttgtctagccgtaggtgcatccctaggttcctaccggcctatcgtttgtcgtaccagggctttaccgtgaatcgtgtctagccgaccggtttaaccacaaccgttgttgagtcgttcgctcgttcgttcgaacgaggtgttccccgtgcttcgttcattcgtccgtgttgagtcgtcctttagtttagagccgtacagagccgccggttctgttcgccggtttcggttgatcatttaggtgatctcatgtcacgtggagttgactcgttgagtcggtatctcgtgaggcttgcttgccagatcaatccaagccatccgatcttagtcgactcggtcaaggttaatctcagccgtccaaaatcaatataaattcgttctatcttttcaatggcatattagtcctttttctttttatcatatgtcatctaccaatataatctaatcttttccggaggttgctttaatcttttctctccgttataaatcatttgtaaatgatttaattaattgggaatagtcttcgtttaataggtttaattggaattaaatcttgtaaaattcataataaattcatatgaaatcagaatgaggccgttcaagtctcataattcatctaaaattatgatctacatgtttgtttactttttatgtattgtttatttggtttttattagtctttttcctcgttttgcgtgttagcttgtcgtttccgtcgttgcgaaggttcgcgagtgcgccggaagtattcagaagattaattgaagaccgattattgcaaggcaagtcacacagatcctaaacacaatcctttgagcatgttgatcctatatttaaattctctatttatttcaactgtgcatttattttcgaatgtcaccgggtggtgtgaacctattcctttgttatggcctgtttgcattgattactctattccttgataccttgggatattataatttgactagttgagctttatatatattggttcaactagatattagatattattgcttagctatgcttagaaacattagcacacaattgggataactaatgtttcactatcacttaaggttatatttaatggtagctcacgatggtcaatcgtgattggttaattaattacttgccaactaaaacttgataatggtgggttgtgagcacatggttttgagagtcgtgctcatgacaattaaggaccggttcgcgagctactgttgtgaaacattaaccgtgccaaccacaagccagcgtgggcaacggctttatcttttgtatagcatggttcattgcggggcaccagactgagaagtggcggagataagcccacgggggtcgctggggagtccatgccttgttttataagggggtgattatgatccaggaatggtgcactgtggtgagttgtattatgcagagggtattgtcacagcctctattcgggtactttccagtatcgcgacgcatggtagacatgatgttgaggctgtgtcttgtgggtacagtggtacacctctggccagagtaaaactattcgaatagccgtgcccgcggttatgggcgagttgagcaatgtttttcgtgattagtcccacacctctcacaataattatggatgttataactggtaataatttgcttagctcctggtttggaatggataattcctggtttggagattagatctgtacagccgggtatggttgttcaggatggtcgggcctgtgcagcatgggtgtgctgttcagtgttgattaaaattcctgattaattactccactgttttacttctcttaaatgttttgctaaatgctgcttttgcaaatgagcctatattatgccatcctttggtatccttgtgcacttgcatatttgctgtgtggcttgctgagtatgtcatatgctcaccttgcaataatcaatcaacctcagttgaagaaaaatgatccagaaggagaagacgtttggcttataccccagttgagctgcctgtgggagtggagctggagcttcgctagattttattttccgctgcagttttcttcttgatgaggactaagtgcctcataagtaagtatttatcgttttagttaatttgatgaatctgtatattaaattgtcagtttgtgtacctcggctgattcctggacgaggattttatgcacaaataagttcggaaattacttgtgaattttcgggcgtgacactctccctcggattcgtttggaaacactcccgcaaacttcgccggcgcatcaatggcggccggatcttccgcggccgattccccctcatccggccgctctctccccctcccaacgctatttaaacactccccgtgcctccctcctccttttccgccactcgccgctctctctccccgtcggaatcgagctcgcgccgtcgtcctccctctccgccgtcgccgccgagctccggttcgccgccgtcgtcgccccggaccttctcccgcttcggcatcgccttcttcgggttcgccgcgacctcgccgacctcgtccacccctccgtttcgctcaccgaccgccggaacgccgccgtcctcgtctacccgagccgcgccgccgccttcctccactccggtcgccgtttccgtcgtcgccgtcgacccggggtgagccgtggaccgccgtttcacttcccccttccctcccctctctcgggcgccgctccgccgcgctggtggtcgccgccggcgaccatcggggcgcgggcgcgccgcctccccgtcggccgtgccggcgaggccgccttcgggcgcgccccgcggctgccatgtggggcccggccgtcagccggccgcgccctcgggtacggctgacgcgtgggacccacggcgccggccggcgtaagccgcgtgcacccggtccaccgtggaccgagaggctgccgagtgggccccactcccgtggacccggtccgcgcgctcctctctcccggctgacacaataaatccgattttaaattaaaatttaaatgaagaaattcgcaaatatccatttaaagagcatataaacttcaaatggccataacttggccatttgaactcggaattggaccgttcaagtctctaatttttccttaagaagtcaagaacccatttttgtgctttgtttctgcttgttatatggagtttattagagtaaaagccttttcttttccgttggtcgtgtagacgctgcagcttcggaagatccgctcttcgtggaagttgaagccggcgtttgggaaagcgagcaaggcaagtcacatcatctttgaacatattgaatcccagtttataaaattatgttgattcaaattattgcattatcgctttatttaaattcccgcgttatcactgttttatttagccatgcccatttacctttgttatgaccttattattgttattgttattatttccttgttcaccctagcataaacaaaaccccaactagtggacactctactcatggtcccactagtatgattttaggtagatgcttcgcttttaattaggtaacattaggcggttttacaactctagactttgggaatattcatatcacctggacaccatggaatggtttggttattgtggaattggattcacaccgccccctctattcaaaatccccaaaaatggttttaggctgggctcggggtgcatggttttgatagtagcacctcggccatataaggaccggtcttcgggcctctgttgcaaagcactaccgtacttccacatgtctagtgggtaaggcttagtttgtggctcagtctggttataaacaaaagtacacggatggaggtggatgaagtcgggggtcgatggacattctccagggcaaatgaaggctacacgagctgcggcccggtagtcgagatgtcatggcacagggccggtgtcctgctgctaggggctcagtcctgcctgcctgtcccgggtgttccggccgtaggtgggattgggttggtactcttgtctatggctaggatgggttggaaactatgtcacgtcttccgtctgtataccgtggtggtatgtggcacgtggttacacgtgaggaagatgtgtcttgtgggtaaagatgtacacctctgatcagagtataatctattcgaatagccgcgccctcggttatgggcaagccgagcaatgtacccaagttagtgttttaattcttaaaacctgcttaacaactaaaatgtggaatggttggcctgggttggcttgggacgagctgggacccagggtcgggttgccagttcggtctgaatcatcgtaggccttgggttaaggcaggttcgtgtgggttcacggccttgataaataatattgtttagttctagaatcgcgtttacaaaatagctttgagcaactaatgtctttaaatgctgtttactgcaaccctaaccctttatagtgtaactcctttgtactcccttgcatttatcctgcacttgtgggtgtgtcttgttgagtacggtggttgtactcagtcttgctcaatttttcccaaacccagaagaggagttcctggaggatgaaggctttggtgtctagctcgtgcctgccgtcaagtgcctgtggtcgtcgccctagtcttccgctgtttctcgtttgtctctgtgtgtgctcggccttcgctgcccatgtaataaattaactatttacgcttccgcttgttaaactctgaattgtatcaacttttggtgtaccttgcctcctgggacaaggattaatgcacgcacgtaaggaacgcccgttgggtgatttccggtcgtgacagatgcggaggggaaccagcaggggcacgtggaaagggatgtggaggggaaccaggaggaggaggctagtggtagtcaaccctccgttggacagaagagggcacgcgggcaacgaggtgcagcgaagaagcttgagggtcggcacatcataacggaagtgcaagaagatggacgtcctagtgccccggccgaagccgccaagaactatgtacgtcacagcggttgggttgtgcgggataacgtgcctgtcagtagggtgtactggcgaagaacaagggcacgcggagatcatgagagctttgtcccagattcggagaaagagatgctgtggaccacaatgctcgagacattcacccttcctgcgggtacagaggacaaagtgaaaaggtggactctgaagaaaatggcagaacagttttagagcttcaagggagatctgtaccagaagtatatactgaaggggcagacaccgaacttcgacacattcccaaagctaagggatcactgggacgagttcgttgcatataagacaggtgaacaagggcaggcgatgatgaaaagaaacaaagaaaatgccgccaagaagaagtaccatcaccacttggggtcaggaggctatagcgtcgcgatgccgaagtgggagcagatggaggctagcttgattgagaggggtatcgaaccggcaacagccaattggccggaacgatcgaagttctggtactatgctcacggtggaacgctcaacccagctgatggctcactggtcttcggcgatcagatacgagaggctgcgcgacgactaacagatgcagtggaagcctcctctcagggcacgttccgaccagacagagatagggacgagctgacactcgccctgcagactccagagcatccaggacgaacacgagggaaaggggtgattccttggaagattggtttcaaggaggacatccacacgtacaggagtcggatgaggagcaagagagataccgaggcgaagattgcagacctagagttccgggtatcgagctacgaactcaacatgcaagaggaggtggcaaggaaggttgatgaacgcatggccgcacatcggtcccatgatccccagccg

SEQ ID NO: 47749 - DNA, 1735 bp, Oryza sativa
acgtagctgaatcatgtgcctcgggagcatctggagtcgtggccgacgctgaatggctggcagtaggagacaccggagccttaggaatcacaggcaacgatgacggcgacgtgacagcagctcccgatcccgagggcgacgacagagcgggagaatctccgcccgtatcatcatgatcttctgtgaactccggatcttgtgtggctgtgttgaaatccagctctatatgatctgtattctctgcattttcttcagcaaaagtattagtatgttcaggattatcaagcatatggtcatctcctattgttgtacccctaccagtactatcatccgggttcagaagtgtaggtggcagcaataaaatctcagaccgtagtcttgcaccggcattagagtggagggatgcaaaaggaaaaacattctcatcaaagacaacatcccttgaaatatacactctaccagctgctacatctagacacttgaaccccttgtgtaaattactataacccaagaacacacactgtttggaacggaattgaagctttcttgcattatatggacgaagattgggccaacatgcacaaccgaagacccgaagggatgtatagctgggtttttgatgaaataaatgctctagaggcgtttcatattgaatgactttacttggtgtgcgatttataagataggtggcagcaatgaaagcttcatcccaaaatttcaaaggcatggatgcatgagcaaggagagataacccaacctctacaatgtgtctatgcttgcgttctgcagaaccattttgttgatgtgtatgaggacatgaaacatgatgactaatgccaatcttagtaaagaaatcatgtaacttttcatattctcctccccagtctgtttgcatggcaatgattttgcgataaaaaattctctcaacaagctgttgaaactcatggaatttatggaatacttcagatttttgcttaagaagatatatccaagtaaatttgctaaaatcatcgatgaaactgacatagtattttctgcccccaacagagtcaggagcaggaccccatacatcagaaaacacaagctctaaaggaaaatttgacgcacttgtagatttgagaaagggaagttgatgactttttcccttttgacatgcatcacacacacctaactcttttgactctcctagacatgggagattattatgactcacgaccttttgaacaatttgccatgagggatgccctagacgactatgccatattgagacagtgggcttgatagctcctaagacttgcttggatgaagacgtggaggctggtagaggatagagtccattacaacagggtcctctaagaagagtgttcttcgtgatttgatccttgatagcaaaaaaccgagggtgaacttcaacaaaggcatgattatcaacggcaagacgatgtgcagatataagattctttttggttctaggaacatgaagaatatttctcaaatatagattgcgtgtaggggtacgaatagtagattgacctatatgcttaatatccatacctgaaccactcgccgtgtggatttgttccttgccgttgtatctgtcacgggttgtaagcttctcaagctcattagtgatatgatctgtggcaccggtatccacgtaccagttcgaatctacaccatacgaggcagccgctgcaacccttgcgtccggcacaaaggagtcatcgtagcaatg

SEQ ID NO: 47750 - DNA, 2922 bp, Oryza sativa
acagaaggccgacgatcatcttccatgcatgagccgctgtgtcgacgtttgcgacttggatgagaatctccttggagatgcttgatagaaggaaaccgaggacctgttggtccgcagcaatccatgcctcatatgccggattggaaactttcttggttatttcacccttttctccttccttgacttctatttccgccgatggaacttgtgttgcaccggtcagataaccttccatacgtgcgccgcaaatcactgggagaatatgcgtcttccatagcgagaaattgttcttcgtcagcttttctgaaatagcttggccgaagagaggattcacggcagcgccggaggaggatgccatcgctagtttgatctagtcgtggcgagaaggctctgataccatgtaaaagtgcgtaaccattctcacctcgtctcgaagcagcgtatgtatatttatatgttgttgagaagaaccctcaacgtggcttacaagattgaatcagtttggatccgattacaagagataaaacattgtttcatgtgagaaacaaactctagacttatctctaagcctatgcaaatctaaaccatattatatctctaataaacacctcgtccgagaactcgtcaggtggctcaatcttctcctccgcctccgacgacatgcccgccatcatcgccccccgagacgcttgatctctctgctaacttgaatgcaaaaaatcgtgcgctggatcaagaactgaagatctggcagatcgatgagaaaccccaactccttgcctgtcacgcccagaaattcccgaatagaattccaagcagaatgtgcattaaaatccccgtccaggaccggccggggtacacaaacgacaatgttaacattcagatccatgtcttacaaacatcataaaagtcttacataaatacagcggaaaaatgaaagataattggagctaagccttgacttgatctgcagcgggaacacaactccacaggcatcctcgacggcacggacgaagcctactcctcggagaaaccaccatctgacacatactcgtactctggggttggggaaaatagagcaagactgagtactacccactgtactcagcaagtcataccggaataggggtatgatgcagggaattatcaaaggagagctagagtggttcatttgcataaaggttcatttgcattaaagcgagcatttataaacagaagttaaaagaattaaacagtcctgataattaatcaatattattcatccactatccaacgctataccacgttgcgacaggcccaaccatccacctatactatccaatttcattagactaaactagggtgagactaatcacggtgaatctggttgaccgcccataaccgcgggcacggctattcgaatagttttactctgatcagaggtgtacaactgtacccacaagacacagccccacgacacgtttccgtgcgccaacatgccaccacgacataccggaaagaggccgtgacaggacccttcgcataaccccctctaaccaagcacaccacacctcaagtttcacccccactccttgcaaggcagtgggcagtcccctctcatgcttaggtgaatccggaagagacagaggccgtcgtagggcccgccccgctccatcacgcccacccttgcctggatgcgtcagctagaggaaagctacactataagcccagccgttgcccacgctagtttgtggtaagtacgataagttcttccagggcatcccgcgaaccggtccttaactgccatgggtgcgaccagcaaaaccatgcacccacagcccaccatgtgattcattttaattaaccaacaccaaagcagtggcactaatccaacaataccattagaactaacagtctaaacattaataggatttttcccattgtgtactagttgaactaagcatggctaagcaacccctagtccaatctctagtcatgttataacccaagctaacaaaggaacatggtacaacaatagcatggctataacaataggtaaacaccccatagtaacattataaaacgatgcagtatttgaagaaaaataatagagcatttgcaatataggatcaacatgttcaagtgacaagtatgacttgccttgctctgttgttggaggaacctcggcgactatttcgaagtacaccggagcgtcagaagaaccggaatctaagcgacatacaaagcaaacaatacaaacaggctataagactactgaaacagagaacaaaaccatttttaatggatgctacacatttttcttgatttactgagacttgaatgggcttaaacggagcacggatgaattagttatgaattttggaagattcactgtatttattactataacaaaagtccttaaatcatttattgcgcaataaatcccagggctgacgtcatcaggggggcggcgccgacaggcggggcccgcatgtcagtggcgcacgggggccggtctaccgtggaccgggaccacgcgggtggtccaccgccggtccacgggatcgacggcccggatcggcccggggccgatcggacggtgcggcggcggcctggcttggctcggctcggcacaaagccggccggccggccatggcaagggcggcggcgcgcgcgcgtgttgctggcgacggcaaccggcggcgggaggcggcggcgcaaaggcggcggtgcacgaccggggcggctaggagggagagggaggggaatagaggaggagggatgcctcactgagagtggccggcgcggaggagaacgacggcgaacggcgacggcgagccacgggaggacaacggcggcgggcggacgagctccgggaggccctaagagaggaaaagagagagattagggggagggagatggaccacggcgatcagaaaccat

SEQ ID NO: 47751 - DNA, 2180 bp, Oryza sativa
ggaaaaagaaggaaaaaggatttttcctgggattaaaattgcatgtgcttaattttaattggttaaaattatttcaagagctctaaaaattccactaaaaatcttgttagcgtatttcggcatgtaaaactcaagaaaaattccacatgccaattccgattattatttgcattaatttattaaggtttactcttgcttgacacaggtattttcttgagaccatttaaaactccaatttaggcttgggaaagaacttcggggtgtgacattgcctctccaatataaatggcaaaacttcttgttctattcggtcaaaaatctaataacagaaacagagtcagcaactgaagaataaccctcgttctaaccggattctaaacctttgcacacaattctttttcgtaatcggtgtgatctctatcaagattacaagataaactaatctactcctagcttggtgcatggcttgaagatgatcgatcgtgtgacgcaccgcggctcaccgtggtaaactgcaacggcttccaagttccaactaacctcgaaccggaaactgtattttcatattaagagttcttaaaagttatcaactcaaagcccaaccgtcaaagaccgaaaaccaaaaggggagttggttaagcgcgtgccgatttcgagtcgggtccatggggcccacgcaccttcgcgtcgccgactccgtcggcggcggacgcagagcttaattcattttttctcttcaaattcctgggtatgcacttgaacgaatttttcaacaaattttaaatcacatttggaaaacccaacattctactaaaacattaaaaccttggactaaaagtttaaaaagaaacaattctaatatcgaaactttcaactcaaactagaagtttcagcttaaattaaaaaatatatacttaaaaactaaactcaaaatttgaaatttaaatttttcaactgatttttaaaaatctttcatatgttaatttgaaattttcaactcaacttatttatttataattttctagtagaaagttatcaaatgctagaaaggagaaccacacggtgcaggaggggttgcgcgaggaatgaaaaccgttcacggttagcctagggcgttcacgttgcaggatacatagagttatgtggcagcataccatgtagttacatgatgaggttatactataagaacactagctgtaacatcataaaaattaatttaaagcacacaaaaaaaaagaataatttaaacctttttttcccccaaattgcatcatgtatggggatgtttactgtgaagagtgcatatatagcttggaatctatctcggaaaggtcttgtccaggcatcttcgggcaccgcaacatctcgtaaaagggaggtatggaatagtgtgtggaatgccaaagtgaagggcactgtaaagattttcatttggaagctggtctaggacaaattgccaacgtgagagaataaagagagaagaaaaatcgaaaggcaagggatgtacccactctgtggagcaaaagaaaagaatagctaccatgcaacagttgaatgtacaaaagctaaggtgctaagggaggcttttagagcagtctggcaccttcgtgaagaggacaaatttgcatagacaggaccggattggttactgatattgttggatgctgtaaataaagaggaaagagtgcacattatgtatatgctatgacgggcttggtacctacgaaacgagttgattcatggtgatggatgaaggccaatagcagtatcagtgagcttccttgctagctatgaggaggtgctgcttcgcatctgacagcagctggacgacacataaggaaaaaagccaatgtatagcgaagcccagaccgaatctcataaggtggaaaagcaaacaaacaaatgcacggctccacctgaaggctcggctaagatcaatgttgatgctagattcagggcagaaacaagggacgcaagtgtaggagtaataatcagtgattgcagaggtctgatcctacttgatgcatgcaagacgctacaccgatgcagttcagtagcataggcagaagcgctggcgtgcttggaaggcatccgactggcgattgaatgggtgcatatgcctgctattctagaatctgacaacgtggaagttgtggctagcttgacaatgaaaagctcat

SEQ ID NO: 47752 - DNA, 732 bp, Oryza sativa
attcctgcagcccaggaatttattaatttatcttgtcattactcatgcatagataattgtattattgatgagaacaaagtcccaatacatttaaaaggagaaaaaagaaaatttcttggttgcattttaatttgcacattttttggaaattcaagttttgttagacaaacatcattcagaacagtttcatggaatattttaggaccaaaattttgttttgttgtccttagaccagagaagttttgattatccgatattttgaactctgtttttttaatctttctggcttttgcaacaagattttcatgttgggatggctgcttgagaacctggcagaagataaataatttcgatgaaccatgtaactcttgacaccctgaagaactactatggctaacactaatacttttaagctagattttcaaaactgcaactcaactagcagaatttaaagtagttaatacttaatagtcctgattgaactgccagaaaataaaatagtttctgttcttgtttcacatatcacaaagccacaactggttgaaggataactgtaaagaaacctactgttttgtcacctccccagtttagttgactgataacttgtaagatgaggtgatttgtatgaggtcgcatgctcaggtgctagttttatgtgccctttcagctgtacgctgtaagggagagagccacctgaggctggtgattgagtcagtctatctagtttttttt

SEQ ID NO: 47753 - DNA, 3062 bp, Oryza sativa
tgccggcactatcccggccgtcatctggatcctcatgccgacgaagcagatgacgacgctgagcaccaccgccacggccatggcccgtggcgtcaccagctccctgaattccggcgatggctgcttctcgaacaccgcctccaccgatgtcgctgacatgggatcgccgatcatcgcatccatggcgattaaagctccaggtcaatggaggcaacctcctggagggtttttgggttgtgttgtgatggcacaagtgggtggtctcctgggttggctctcctaggaacaatgcatgggttggtctgaattgggaggtggtgagggaatgtagtgtcgctgtggagcaaaaatagcgtctgtttgttgaaccgatttctctgattctgttccttatttctatattgatgaaacagatgctgctgagggcaacatacctaatgtttacagggtggaaacggttacaatgagtgtccagaaagtagttttaaccatttgctttaagatttgtacgaggtctatcaaaactatgctaggggttaaaatagaatagaaatttgaattagaattagaattgatggatgtgacatgtagaataccaataatttcgcactcttttgcacacacttcaaccattgatcaactcatatatgcttaagaacacatttgttaacgaggtttatagccaaagcataaatcttgacactctaattatggatgctactcctcaatcaatagtacacctaactgctataggcctatgacaatgctgccatcctcctcgtgagtgcctacattgcattttcgtcaccatgcatagttacattgtggtgtcctctatatttaaagagttgatacgttacaagagtcaaaagctaaccctaccctatcacctgtattaatacaacactttgcatagaaaaatatgctgagaaactcctgttgagtaccacaagcttttaagattttgtactgcattatgttagaaaacagtgaacatttgtggaatagtagtataattcatatttcaactacaactttattctgtggcacttaactataacaagcatctcttacatgttgcaaccaaagctggctcacatgtctacttatgtcaattacatgacatatctatatgtaaaatacgatacgtgcatcattatttacaatgatcaataatgattcatagaccacttaatttccaccgagatgtggtaaccaattaaggagtactaacagtcaatcttaatttgatgagtgcatatattaacttgatctcaacatcgatcggtcatgtcttgggtactgttcctcccgagctgttcaggaatgagtccaccacctcaacctcttgtccactgggcaagaacttcatgcacatcggcggtagcaccttgaacatgttgagcaacgccgatggcagcgtgaagagcccctcgccgcagatcaagcccgctgcgacggcggccgacaggatctcggcgctcatggtgtcgatcttcttccagaggagcagcagcaggccgcccaggcacatgtcgagggtgaagtacgacccggcgaagaacggcagcgcgatcaccgtcatgctcgggatgtagaggtggagcctccaccccttgagctgcgagaccagcaccagggcgtcgatggcgatggtcaccaggacggcgatgacgcagagctcgacgcagtactttgggaggcccttcacccctcccatgccgatgatgcagatggcgcggtacagcccggcgtaggggcacgggtagacggagtccttggaccccagcggcgccccgggcttcgccgccttctcgaacgcgcggaagatgcaggggctgaccacggagctgagcgccacgccgaacacctgcccggcgatcatggcgcgcggcgacgtcagcgtcatgtgcgccgacttgaggtcctgcatcgcctgcgacgagacgtgcagcgacgccatggtgatcccgctgacgaggaggctggcgacgatggcgcccggcctggcgatccacgccgcgaagatgaagggggagaacttggcgtaggtgttcgacaccgaccagtcggtgagccccgtcgcgtaggtgttgcagaagccgaccacgggtatggcgaggtagagcacgccgacgtggtagtacttgatctggtcgaacatggccggcatcgcgaccatgctgatggccgtccatgcgacgtaggccgccaccggcacgaacattgggatcttgctggacaagaacatctcgatccttttgcgttcgtcgtagttcatgctagggttcttgctgatgtagctggccagccctgacgtttgctgttgctgttgccttatatggtagaagttaattgcagctgaagtcacgagtatcagaaagtttatcaggccgtcagtgacgatcagtgtcacgctgatgaacacctgccatgtaagtttatatccattggagaaaaaaaaacaagaagtttagaatagttcgtgtcactagtgaaaaactaccaaaattaatatggctttcatccaccgcatgcatatatctggaaattatatcagaaggtttgttcaagttataaattggatacatggatcatgacaaaaattctaatatactaggtattactatacttgataccttcatatgcatttcaattagtactactcccccgtttcataatgtaagtttttctagcattgcgcatattcatatagatatgagcaatgctagaaagacttacattatgaaacggaggaagtagctattaatttgggggacaaaattctttccgtgcattggttagtacgtaccacaaaatgagtgagataaaatcttattagatgatccaacaattgatatgatcttattatttacgtatatatatctttattgtttctctgagttcctcagttttgaggcttggagtttaagaactctcgtaactttcggctatctgtggataaagaggtaggtcggatttttatccattatattaagaaaagaaatgtaccttgtatccattgagtccgtctaagtttgaagggctagggctgcaggaat

SEQ ID NO: 47754 - DNA, 999 bp, Oryza sativa
tagctagctattctgaaaactccttgccacttttctctagttatcagcataataactatattggcattaaatattgtgaaattactaattgtttcttacatatttaatcatttctgttttggaaatggatacacaacttatatacaaattgttaagagaatttcgtgatacgctatatgtatagatatataattttctgtgtgaccgttctagatcatctgttgatgatactatgttgatactcaatcattgactaataccattattttaaaaaaggaatatagctatcacctgcgtttatatagttccagtccaaacgttggaaagcttgaaaatccacaaccactgcctgaagaatagaaccattggaatatagaccaagaaaaactaccaaaaaatactttgaaaatagtcataacctgcattctgttgacataaaaatattagtgcaaaaaatatgaatatgtagttaaatgaaattcagtgttttaattttcactaaaaagacaagacttcattactttgctatataagcaccttcaggagtgtgaaagctattaataaggtgtcctatgaccgatcctgttgggaatagtaattggtagtcgataatcatgatctacagtagaacgaaacaactcataaattatatttaagaatgagaataatgcaaaactattaagaatgataatatataaatacaaaactatactattagaaatggatatccctctcattgcattaagaatttagacatgcttgtaacatcactttacaggcctacatattaattaagtactaaatgagtaaaaatatagcaattaatagggaatgctaacttcatgtaacgtattgatgggtgtactgaccaaacaggactaaatgcatgttgaattttatagaaataactaagttaagttgattcagggggtgtttagatatatgggtgtaaagttttggcgtgtcacatcggatatacgaacacacatttgaagtatt

SEQ ID NO: 47755 - DNA, 848 bp, Oryza sativa
ccccaaagtccggaatattgtcgtcttccacttcatcttcttccatttcaacaccttgctctccgtgggatgtccaacaattatagcttggcatgaaccccgactcaaacaagtggaaatgaatagtcctggatgcagaatactccttctgattcttacacttattgcatggacaacaaataaaacccctttgcctgttagcttcggccattctcaaaaaatagtgcacgccgtcaataaactctttggaccgccggtcagcgtacatccattgccgatccatctacatgagtcaaaaaaaccgcacacaaataattattcttacaataatgacagtcatacaataattataagatatctttattcatacaaaaatcataaaatattacaccaaataattcttaaaaactatttgtaaagttttaaactaattttaatgtgttttacttcttttaatttttattttagtttgttttctattatttaatattaactttcactagagttttccttctcaactattttataaaaccttgtttagcaaatgaactaaatttctatatattctttcttccccacacacattttctctctcatcaacttacaactaaattttggagacaaaaaaagtgtgcaaaacataggtgcaaatgtagtatgacaaaaaaaacattggaggatgaagttgcaaaccttttaggcacctccgatttgtatgtaatcaccaaaataaattcaatagaaattttggcatgacctcccctcttttttgaagaaattttgaagcttgctcgggcagctggaggaggaagaagacatatatataggggtgggactttagtcccggc

SEQ ID NO: 47756 - DNA, 5635 bp, Oryza sativa
gttggataccactctggagttgttgcaatggaaggcaaggaatggggttagtgacaaggcatttggcgatttattgaaactcgtcaagaacattcttccggggggaaacaaattgcccgagacaacgtacgaggctaagaagatagtctgcccgttaggactggaagttcataagattcacgcatgtccgaacgattgtatcctatatcgcggtgaggagtatgagaacctagaagcatgccctgtttgcaaagcactacgatacaagattagacgggacgatccaggagaagttgacgggcagctaacaaagaagagaattcctgctaaggtgatgtggtatttccctataataccacggctaaggcgtttgttcaggaacaaggggaatgctagaatgttgcgatggcacgctgaagagcgtcaacaggacgggatgctgagacaccccgccgatggttcgcagtggcgaaacatcgacagaaaatttaaagaattggaaaggacgcacgaaacatacggtttggtttgagtacggatggcatgaatccttttggagagatgagcaacggccatagcacttggcccgttacgatgtgtatctacaacctcccctcctggctatgcatgaagaggaagtacataatgatgccgattattattcaaggccccaagcaacctggtaacgacatcgacgtgtacctaagaccactggtcgaagatcttaaacagttgtggaagaaggaaggtgtccccgtgtgggacgaggacaaacaggaggagtttaacctacgagcgctgctgttcgtaaccatcaatgattggcctgcacttagcaacctatccggatagtccaacaaggggtacaaggcttgcactcactgtatggatgaaacagaaagtacgtatcttaagcactgtaggaaggttgtatacatgggtcatcgtcgattccttgcagcaaaccacccggtacggaagaaaggcaagcacttcgaacataaggccgaccaccgtacgaagcctaaacatcgcagcgggaaaacagtgtttgctatggttaaagatcttaaagtagtgttcggaaaggggcctggaagccagcatatagagagcgaagatggtcacgcggcgatgtggaaaaagaactctatattttgggagttaccatattgggaattcttggacgtacgccacgcaatcgacgtgatgcacctcactaagaacctttgcgtaaaccttcttggcttcctaggtgtatacggaaagtcgaaagatacactggaagcacgtaatgatctgaagcatatggaacaacgcggcgaccttcacccggaaccaaaggagaaaggaagccattacttgagtccagccagctacactcttagcaaggcagagaaggaaagtatgtttgaatgcttggagagcataaaggtaccgtctggatactccacgaatatcaagcgaataataaacacgaaggagaagaagttcacaaacctaaagtctcatgactgtcacgtgttgatgacacaactgctaccagttgtaataaggggtatccttccagacaatgtccgggcaacaataacaaagctatgtgcattcatgaacgcaatttcgcagaaggtcatcgatccggatagattagaagcccttcagaatgaagtggtgcaatgtctcgtcagttttgagttgatatttccaccttcatttttcaatataatgacgcatctgctttgtcaccttgtgaaagagatccgtattctcgggcctatgtacctacacaacatgtttcctttcgagaggtacatgggcgttctgaagaagtatgttcgtaaccgtgcttgtccagaggcaagcatcgccaagggttatggaacagaggaggtcatcgaattttgcgtagaatttctcgaagaccttcgcccaatcggggtacctgaatcacgccatgaagggagactacggggaaagggaactctcggaaggaaagcaataatgacggtagacaacaatttattccgtaaagcccatttcactgttctgcaacactcttcattggtagctccttacatcgaggagcacttggctctagttcgcgccaggaacatcggtaagtccgatgcatggattacacggcatcacattgatactttccccgcgtggctacgacaacatctcatgggtaacgagtcgatcaaccaacaacttgccttcctggcgaggggaccgtctgggtcgatcgcgacattccagggatatgagatcaatgggtacacattctacacgagagcccaagacatgaagagcacgaaccaaaacagcgctgttcgtgtcgatgccatgggacacgatggaacaactgccacgtattacggtgccatcgaggacatatgggaacttgactatggtcctctcaaggttcctctgttccggtgccaatgggttaggttgactggtggaggcgtaatgattgatgacagtgggatgacaactgttgaccttaacaaggttggatactcggacgaaccttttgtccttgccaatgatgtaacgcaagtctttttcatgaaggacatgtctagcaaaggaaagaagggcagagggcctgatgagcctaagcgtcaagtggttctcccaggcaaaagaaaaatcgtcggagttgaggacaagactgacgaggattacgatcagttggatgggcaaccccctttcacggtgacgattgaccctagcatcctcctatcaaatgaagacaccccttactcacgcagcgatcacaaggagggaacaatagtgaggagaaagtacgtgcggtcaaccgtcaccgccgatgtaatgccgtaattattgtgtacacgatgtaaactattttggatgtattgattatccatataaatcaattgatgtatggcatatgttaattacgcacgattattagaggtttcaacaagtttaaatcatgtatatgttagttatatgtgatacttacaatttttaaaagttttaaatcacacaggtggcaatttcatatgtatgttaattagagtttttaacatttaatttactagcattcatatgctaattataattgactagaggatttttaaaagttttaaatcacgcaagtggcaatttcatatgttaattagagtttttaacatttaatttactatcattcatatgctaattataattgactagaggatttttaaaagttttaaatcacgcaagtggcaatttcatatgttaattagagtttttaacatttaatttactatcattcatatgctaattataattgactggagaatttttaaaagtattaaatttaatatatttttaaaactatcattcatatattagagtttttcacaatttaatttactatctttcatatgctacttatatatgactattcgaatttttaaaaggtttaaatcatgcatgtggcatttacatatgttaattagagtttttagcatttaatttaatataattcctacgctaagtacatatgaggattacaatttttattaattttaaatcatgcagtatgtacattaatatcttaattagagtttttaccaatataataatatcattcatatatatgctaagaatatatatatattggaatttttattaattataagtcatatatttgcttttacggtttatccacttaatttattacagacaaaaataatttttcgaagtaattgtcatcaatctttgtactttaaataatgttaatgcattaacttctattttataaacacatatgtaagcgaaaatcatatgcagtgctataatctttagtcccggttcttaaccctaaccgggtttaaaaagaatttcgaaatagcgggaaaagatatttactcccggttgttgagaacaaccgggagtaaagatccaggggtatatatattcccggtgcgccctcgtcttcttcaccaacacttaaacgttttcggccgatcgatctctctcggcctctctccttcgccgccactgcctagggcaaatccccgcgccgacgccgccgtatctcgccgtcgtctcgagctcgtcgtcctcgccgccgcctccgcctcctccgctgccgccgcatctctggggtgagagccgccgccgccagatctcccttcatgcatctcgatctctccgatctcgatctctctccgtcgcgccacccgccacgagacgccgcgccacgacgacgacgcgccacgccgccgccttcgacgccgcgcaacgccgccgccgcatgccaacgccacgccgccgccgccgtcgccacgccgccgccgccttcgccgccgcgcgcgcaatgccgccgccgccacgccacgccgccgccgccacgccacgccacgccaccgccgccacgccacgccgccgccgccacggccccacaacgccacgccgccgccgccgtcgccacgccgccgcgccaaccgccgccccgatgccgccacaccgccgttaacgaacgagaacgagaacgatcgaacgaacgagagcgagaacgaacacgtcaacgtacgttgccgcgacaacgtgaacgagaacgagaacgatcgaacgaacgagagcgagaacgagaacgatcgaacgaagacaagcgagaacgagggaacgaacgtgaatgagaacaagcgaacgaacgtgaatgagaacgagcgaacgaacgtgaacgagctagggaacgtgaaagagcgaacgaacgaggacgatcgttaacgtgaaatgcaatatatatatatacatatatatatgtatatatgtatatatatatatgtatatatgtatatatgtatatatgtatatatatatatgttacttcgtatttatcctaatacatttttttgtatcttgcagaaaagacgtgttgtcggagtcgtccgtcaagcctgaatggaacagctagccctagaaggaattggagcaggcaagtgacgtaataatataaatgattgttatatttgtaatgcaattaattaagattattagacctgtaattagacttatcatataagattgtgtagtgttctaatattatttgagttttaatataagattattttattgcaaattagacttagtatgacattattgactacggaattggtgcgactcctagcaattgactattgtagtcttaattagacttagcatatacgcacgaaacacttagcatacattactattttagtcttagcatgtaatattatttgagttttaatataatattactttatttgtaattagacttggtatgtaattattgactacagaattggtgcgacaagtagcaattgactattgtagtcttaattagacttagcatatacgcacgaaacacttagcatatacatgactattttagtcttagcatgtaatattatttgatttttaatataagattattttatttgtaattagacttagtatataattatttactagctagggttgtataatatacctcacctagacttagcttatatcacgatttgtaattagacttagcacgtaaggttgtgtagggttctaatgtacgacatttacacttagcatacatgacttagattgttaaaacataaatgtctcgtgacttagcaga

SEQ ID NO: 47757 - DNA, 2275 bp, Oryza sativa
gacgtcctagtgccccggccgaagccgccaagaactatgtacgtcacagcggttgggttgtgcgggataacgtgcctgtcagtacggtgtactggcgaagaacaagggcacgcggagatcatgagagctttgtcccagattcgcagaaagagatgctgtggaccacaatgctcgagacattcacccttcctgcgggtacagaggacaaagtgaaaaggtggactctgaagaaaatggcagtacagtttcagagcttcaagggagatctgtaccagaagtatatactgaaggggcagacaccgaacttcgacacattcccaaagctaagggatcactgggacgagttcgttgcatataagataggtgaacaagggcaggcgatgatggaaagaaacaaagaaaatgccgccaagaagaagtaccatcaccacttggggtcaggaggctatagcgtcgcgatgccgaagtgggagcagatggaggctagcttgattgagaggggtatcgaaccggcaacagccaattggccggaacgatcgaagttctggtactatgctcacggtggaacgctcaacccagctgatggctcactggtcttcggctatcagatacaagaggctgcgcgacgactaacagatgcagtggaagcctcctctcagggcacgttccgaccagacagagatagggacgagctgacactcgccctgcagactccagagcatccaggacgaacttgagggaaaggggtgattccttggaagattggtttcaaggaggacatccacacgtacaggagtcggatgaggagcaagagagataccgaggcgaagattgcagacctagagttccgggtatcgagctacgaactcaacatgcaagaggaggtggcaaggaaggttgatgaacgcatggccgcacatcggtcccatgatccccagccgaccattcctcctgcaatggtgagcccgtcaggaaaccgtagcagctgcgcctcaacggggcaggtaggatcacagagcatggacgccatgcaaacacaggacgaatcgacctgtcccgttgatgacatcactcagcggacaccatgtgagctgcatattcctttgaagaacttatcaataaaggtaagatttagccattccgctagttgctgcttatatatgttgattactaataaataatctctcacaacatgaaggtggcgtcgggcatggccatcccaacggacccttcaggtacttaccactgcaggccgattccagcaggatactccaaggtcgaagttgagttggtcgaaggcgcgtacgaggacctcgagctggattaccctggaggagacggtgagacgcatctacgagacacatgccatgccattattctatggcgcaggcggtacatcatcctccctgggcgacaagcggcgtctcgtgcaccatctcctccggctccgccatctcctcctcaggatcctgcaccgtctcctcctcatgctccgccagcaccgtctccacctcaggctccagcatcgactcctcaggatcctgcaccgactcctcctcgtgctcctacacctactcccccgcaagctcctcttccggcaccttcaaagtcaagggcccccccagctccaccgcttgcccacataagggcaacaaagaaggcgaaagttgacgccgccaagaacaaggacccggggtacgattgcacgcaagaggagcttgacgcttacgttgcatcagaagtcaagagacaattcaagcctcgaagtccagaaaagaagattcctatagaccccagtgtcaggaacttcttcaggggtatgtctgcatctgtcaaggaggccatcaagctatcggactatgagcgaacgctgaagaaagcatcttctggaaagtccaaaccagtccctcagcttggagagcaaccaaaccaggagatcgagccgttggtgacccgataagaaatgacgatagaacaatttattactgacaccggtctaactacggatcaattgctaggagtcgcaccaatcgaaaaggcggaagtgaaatacatgtacgaactcggtaaaccgcttgtcaagcctgagctgctgcagtccctacccacacaaatgtacaagttccatcagctgtgtcggtgatatgggaccgggagtattgcgcccggaggcttgaggcagattgaatcgcccacgtggcctggcaccctcggggacgtcgggcccgagggtgaggtgtccgccctcctcctgatttccccgagggggggtcgg

SEQ ID NO: 47758 - DNA, 2924 bp, Oryza sativa
acgttgcgcctgtctccgccgggagtggaggtaggtgtgggctgtcccatcgaagtgtcattcggacggcaaccataccaatctccgtccataaagagaagaaaagtccagtttggaaaggaaagggtacatgtggtatccccttaagatataaaaggaggaccatgcccacaaagagaggggactggattttcccgggagaggagagggctggttgatattttgtaacttgctcttacacagatccaccaaaaacacaggagtagggtattacgcttcccagcggcccgaacctgtatacatcgtccgtgtctcgcgtttcttcctggcacgcgatctttccacatacagagagagcttgagatctcaccctaagcccccggccgaactggcaaaggggggcctgcgcggtctcccggtgaggagccacgagctccgtcatctggcgcgccaggtagggggctcagcgtgtgttttctgagctctcatactcttccgtgtgcgccaagtttcccttgttcagcctaatggccgagcaagcaaaggcgcacgacctctctccgagtgtgagcggcgacgacggggagccaaacccacgccgtcgagctcgtacgcccccacctcctccacaacaaaatcctaagcagggggaggcgctcgagagggtcgaaaaatccgcagcatcgccagtcgcgggtggtgcagaagaacggcgagatgggaagcgtcgcctcctcgtctacggcgacggcagcacgcctcaaggcgcgcttcaggctgttggcgcgctcctacgtcacccgcccatcgtccctgacccggagtctccggcccagcgatggctggacgacgtggccaacttggtcatgacggcacagcagcgcctgagtgctggtggacggtccgccaccaccaggacctccggcgccgccaccaccggctctgtgtcatcaaggcggagggcgcggcgagcggcggctgctgcacgccattcggctaccactccctcgtcggcgcctccgactcgggaggatcagcatgaagagccggatgcccgcctcgacatcgagcgccgacgtagtgatcggcgtgctccccgcgcaacggagggtgcctcttcgtccagggtgtcacctcgacatggacgtgaggaccagccctccgtgcccccggttggtggtgttggctgtagagcctttgtggcgagtcttcggaatgtccgttggcccccaaggttccggcccaccatcaccgagaagtatgatgggagcgtcaaccccaccgagtttctccaggtctatacgaccgggatcgaggccgctgggggagacgacagggtcatggcgaatttctttcccatggccctgaagggacaggcgcggggttggctaatgaacctgccacccgcgtcggtccactcctgggaggatctgtgccagcagttcaccatgaactttcaaggcacctatccacgcccaggtgaagaagcggacttgcacgcagtacagcgaggggatgatgaatcccttcgctcgtacattcagcgtttctgccaagtccgcaatactataccttgcatccctgcacacgcggtgatctacgcgttcagggggggtgtgcggcacaaccgcatgctcgaaaagattgcctccaaagagccccagactaccgcagaactttttcagctcgcggaccgagtggctcgtaaggaggaggcctggacctggaacccctccggttccggtgtggcagcttcggccgcccccggatccgccgctcagacagggcggcgtgacaggaggaggaagaaaaggtcggtccattccggcgacgagggtcacgtcctcgccgtcgagggcgctccgcgggccacccgaaaggggaggcctgcgagcgacaaaaagaaagaggctggtactcccagcagggagcgcccagccagcaagtggtgctccgtccacaacacctccctccacgatctcgcggactgtcgcgcagtcaaaaacttggctgagcgaacgaggaagtgggaggaggacaggaggcaggaacgccgtgagggcaagtccgcggcagttccctccggtaaacggcgaagtgaggccaaacagaaggcccccgccgttgacatcgatgacggtgatgatgacctaggtttccaagaacctggggccaccattgccactgtcgacgggggagcgtgtgctcacgtttctcgccggagtttcaaggccatgaggcgagagcttctcgccgcggcccctactcatgaggcgacgcgtcgggcgcggtggtcggaggtggccctcacctttgaccagaccgaccacccaccgtgcgttgcccggggagggcagattgcgatggtggtttcccccaccatctgcaatgtgaagttggggcgtgtcctcatagatggaggagcggctctcaacatcctttcccccgcggcctttgatgctatcaaggccccggggatggtgctccagccgtctcaaccgatcatcggtgtgacgccggggcacacatggccgttaggtcacatcgacctaccggtcacctttggtggatcagccaacttctgcacggagcgggtgaacttcgatgtggcggacctcagtctgccctacaacgcggtcctggggaggcccgcgttggtgaagtttatggcggcggtccactacgcctacctccagatgaagatgccgggccccggtggccccatctctgtccgtggcgaccttaaagtcgcgctcgcttgcatggagcagcgcgcggaccacctcgctgctgcgaccaagcccgagggtggtgacgagaggcttggcacctccgcccccaccgccccgaggcagcggattgccacatgcgacgaggtcccggtcaaggaggttgccttgggcgacggcccatccaagaccaca

SEQ ID NO: 47759 - DNA, 14591 bp, Oryza sativa
taccatcagattcgcatggctagggaggatgaggagaaaactgcgttcattacccccgtaggaacctattgttatacatcaatgcccttcgggttaaagaatgcaggtcctacttttcaacgtactactcgaatttctttgggtagccaaataggacgtaatgttgaggcttatgtcgatgacttggttgtaaaaacgcgcaaccaagaaactttactttcagatctagcggaaacttttgagaacctccgctccgcccgcataaagctgaaccccgataagtgtgtgtttggtgtacctgcgggcaagcttctcgggttcttggtctctgcccgaggcattgaggccaaccccgagaagattcgagctatcgagcggatgcgcccccccagcaaacttagggatgtgcaatgcgtcaccggttgcatggccgccctaagtcgtttcatatcaaggctgggagagaaggcgctacccttgtttaagctcctcaagcgctcggggccgtttacttggacggaggaagctgaacatgccctcactcagttaaaggcatatctcagctctcccccggttctagtcgccccggagccaaatgagcccctgctactttacttagcggcgaccccccaagtagttagtgcagcgttggttgtggagcgcgatgaagacaatcctcatttcgtgcacccccattctgtgctaacttggcccgggagcgagcggggaggagaggcccccgagtcggacggtggcctacggcccctgacgaccggagccggccctctgcccgcttgtcagacggtgctaggtgcccccgaccctcaggagggccccaaggccactgcgggaaggccgcacttaacgccctttgaccccgaggctaaccctgtgctgactcgatccgggaaagagcagggagaagaggcccccgagccgaacggaggccagaggcccctgacgaccggagttggccctttgcccgcttgtccgacgatgccaggagcccccgacccccaggacggccccgaggccactgagggaaggccgcccctttcatcctccgaccccgaggtcatcggcacagaagacaagtgcgccccgaaaggccacttgaacgaagaacgccccggggatacggcccctagcagagaggatcggccccaccgaagggtgcagcggcctgtctactttgttagtgaggccctccgggacgctaagacccgataccctcaggcccagaagatgctttacgctattctgatggcctcgaggaaactgcgccattattttcaggcacgtagggtcactgtggttacgtcttaccccctcggtcaaatcttgcataatcgagagggtacaggacgggtggtaaaatgggcaatcgagctttctgaattcgatctgcactttgaaccacgccacgctatcaagagccaggccctcgccgattttgtggcagagtggaccccggctccagagaccgtctcaatccccgaggccagcacgaacccctcacagctgcctcacaccacccactgggtaatgcagttcgatggttctctgtccctccagggtgccggtgcgggggtcacgttgacctccccgaccggagacgtccttagatatctggtccgcctcgactttcgagcgaccaataatatggcagagtacgagggactccttgccggactcagggtggcagccggactggggatccgccgtctcctggtgttaggcgattcccagctggtcgttaaccaggtctgtaaggagtaccggtgctctgacccgcaaatggacgcctatgtacgccaagtgcggcgtatggagcgccattttgacgggatagagcttcggcatgtgcccagacgggataacatgatagccgacgaactctcacggctcgcgtcctcgcgagcccagaccccaccgggcgcctttgaagaaaggcttacccagccgtcggcgcgacccgaccccttaggggagacggatgcgcctgaccggcccccgaggcccgtcggagtccaggcctcgggacccgaagggagcgctccaagctcccttagattgattgcttggatctctgagatccaaacatacctcacagataagactctacctgaggaccgcgaagggagtgaacgcgtacaacgcatttccaaacgctatgtgctggtagaagggaccctctatcggcgcgcggctaacggaatcctcctgaagtgcattcatcaggaacaaggcgttgagcttcttgctgacatccatgagggagagtgaggagcccattccgcctcgcgcaccgtggttggcaaggcctttcgtcaaggattttattggccgacagctctcaatgatgcagtcgatctggtccggcgatgcagagcgtgtcagttccacgccaagcaaatccatcagccggcccaggccctgcagatcataccactgtcatggccatttgctgtctgggggcttgatatcctgggaccgttcaaacgggccccgggcgggtttgagtatctgtatgttgcgatcgacaagttcactaagtggcccgaggcttatccggttgtcaagatcgataagcactctgctcttaaattcattaagggcatcacggcccgttttggagtgcctaaccgtattattacggataatggcacccaattcactagtgaactcttcggcgactactgcgaagacatgggcatcaagctctgcttcgcctcacctgcccaccccagaagcaatggccaagtggagcgcgccaatgcagaaatcctcaaaggccttaaaaccaagaccttcaatattctcaagaagcacggcgattcatggatcgaggagttgccagcggtgctctgggcaaaccgaaccacaccaagccgagcgaccggggaaacgcctttcttcctcgtctacggcgcagaagcggttctcccatctgagctcaccctgaggtctcctcgggccaccatgtactgcgaggctgatcaagatcagcttcgtagagatgacctcgactacttggaagagcgaaggcggcgcgcggccctccgagccgcgcgctaccagcagagcctgcggcgctaccatcagcgccacgtccgggcccgatcactctgcgtcgacgacctcgtcctacgccgcgtccaaacgcgtgctggactgagcaagctctcaccaatgtgggagggtccgtatcgagtgatcggcgtcccccggccgggctccgtacggctggccacgggcgacggcactgagctgccaaacccgtggaacatcgaacaccttcgtcgcttctacccctgaggggggggtcgggtgtcaggtttcgggctcgggctaaccccgcacccccctcgggtgtgcagggttagccgggggctaccacacatgcacagccttacttttcttatttcagcatttcaataaaagcagtttcaatttcctaaaggttgtgtctgtgccgtttttccttctgaagaatcttaacttgaaataaggtcactcgtgctcaaccttgccctcgggggctcggttcggtcagctaaaatcgccaagcggggcccagaaccgagccgtgccccggggcgtggtgaactccgggggggaatcggcaaaaacccacaatcgggtcacccataaccctcggtcaccatgttcccggcctggccagtctcgacatgtggatctccccaggcactagccccgacccgagccatttgaggatcgggacttgagcacgagcccttaaatcaagctaaaatgcaaaaggaccacggcacaaatcatcctcaactcatatgcatagcaaaataaagttaacatagaaatttttcatcatttttgattgcagattaagttgatctatacaaaaagaagaaagaaaaagaaaaaattggagattggcgggggcctgggggctcattccaatgcgcccgggtcgccggcctcgtcgccaccgtcgtcctcaccgctggcgtcgccctcctcgtcggagctgggggcgaacgcgagccgaggggccgacccctcgaagctttggacgatgtggttggcggcatcccggacccgcgcgcgcgcatcgtcctcggtcccgggagggaactcctccagcgccatccatggggagaagccggggtccctggcctggtaactcgctaacacgagttccaccgctccttgggcgaggtccctcgaggatgacttgatggtcttctcgagctcctcggggagttgttggacagcccaggccatcctcctaaggtgcggggcgaggccttccagattgatggagcgcgaaattgtctggcctttccagaggcccgcttcccgaccggcgcgatccagccgggagactgcatcccaaagcatgccgggccctatctcacccgacaagcggagggcctcggcttccccggtggatgagtccagggcgcgctgcatgtccgcgacggtgtgttcggcagctgcgaggcgggcgactaagtcgctttcgcccgtagccgccccgccgctgcgctccctcgcgtccagctccttttctcgcgcctcgaggttagcagcccgctgctccagcgcggctctctcggcgcggacgcattccagattgcggcgcgcctgctcctcctgcgttgcctcgcggagggacaggctgtccgccagccgttgtgtcgcggcctcggactcctcaagagctcgctcccgctcagcaagcgcgtcctcgcggagccggagcgcggactcctcttcggcgcaggcggcctcgtgcgccgccagcgtcgcctcccggatagcggcggcggcctcgcggtccgccaagctggtctccacggcgccggcatgatcttccagcgccatggcacgggcttcaagggcctcttcgcgccgccgggacgccgcttcagcctccgttgctcgctgctctcgggcagcggcggcgtcaaggaccccctgggcggcgtcgagctttttctttagctccgcctcccagctcccgtgttgaaggcggagggagtcctgcgcctcaatcatcgcggtggtggcgatgagggcggcctctcgctcctcctccacctctcgggcgatctccgccagcgccgccttgcgggcttcaagctccgagatgtggcggcggtgagccttacggcccacctccaccatggcgtccaccgagcgccgcccctcctcgacgcgcgcccatgcggcctcgagctccgctcgttccgctcgcaaggcctccacctgggcgctgaatccatctagcaccgcggtgtttgcggcggccaaggcttgcagaaggggctcggcactcagcggggcggcagaagacgaggagaagagccgccttggagaaaatgcgacgcggctcggcccgccagaagacgcactgagctcggggatgtcccccggacccgtttggtcctgggcgtcgcccgagggagcgggcccaggcgatccgcccgcggcctcgtcgcgagccgccccggaggctgtcgcctgagcgtcgcccgagggagtaggcccaagcgacgcaccagcagctttgtcgtgggctgcctcgaaagacgccatcgcctcagtttggcgggcccgggcggcctcctcccgagcggcttcctcggcttggcgggcccgggcggcctcctcccgagcggcttcctcggcttggcgggcccgggcggcctcctcccgagcggtatcctcagcctggcgagcccgggcggtttcccgggcggcctcttcagcttcccgaaggcgatctgcggcctctcgccggtcagattctcgcctccgttcctctgcggccgccggatcttcggcctcggattggccggacttgggatggcgggaggaacgtgacgggacatcactgaagcagaaagaaaaaccagaaggcaaacaggatgggtaagaaaaaacttgcttttggaatagaagaaaagacggtcgcaatgagcgtgggacgaacctgcgagggggtcggttaaatgaccaccttggaggggaaattaggtttccccgggatggttctgtctcccccatcttgcgcagccgcttcttcttgcgctccccctcgggctgcgaggttggcgcggccccctccgggcgcctgctgctggcacgcaccgccccgccccctcggggaggagatgggggaggtgttcctcccagtttcctcttcccccgggcgtcggtagggcggttgctccccgagcccccgacgcggggcccagaagcacgaccccctccgggggtagattgatccccccggcggctcccacctgcgctgtcatggcccttaggagcctgctcctctgaggccccgaccgccgtcataatggttaagatggaggcgcgatctgggtcgctgcagagggggaggataccgtgggggatgagagacacctccacggagttgagatttagcacccgttggaccagtatcttgaagtcctcgggggcccaatcccatctgactccctggtgggtccgcatgtagtcttcgggcccggtgtactcccaggcggcccgagcgcgccgctggagcggcgcaatccgacgacggaggtagtcgccgtacaccatggcccctgtgagcccctgagatcgcaggcccgccaggcggtcgaggacggcgtcatagtcatcccccagatctactggcgcccgccagctggagaccggcgccgggggctggcttgggagtcggaggcgcgcttcgttggcaaggggggtgtagaaccagtcgctcttccaatcgtcccacttcttgcggagggcgcaggggatgtagcggttcaacaccggcccccgcggctggaagtagcaaccaccgaccaccgacggcggcgacaccgactgcacggtgaagaaccaccggaacagccgaagagatgggcgcaccccaatgaacatctcgcacaggtgcgcgaagatggccaaagtcatcactgcgttgggggtgaggtgcgccatctggagatcgtagaactccagaacatccataaagaaagaagaaaaaggaggaaccaacccggccattgcgaaggggaggaagaagatggaccgccccgggtaatctggtgctgggcgcgcctcgcccagcatcactatctcccggccggtggcagattccggcatgaagcggcgcggcagcccagcctgcctctcgctcacaatgcgggaaggcggtagtacgctaccgtcgagcagagcggagccccgtgccatgtcgtcggagaaagagagggttgagaacgagcgtgtgtggcgaaggtgaggcgcagcaaagagagagtttagggcgcaaacggcgaaggaaaggggaatagtggcgaaaggaagggagcaagtcctttcctcgatggctttatacccttgccatcgctgagtccggctcctcgtttctcgtgcccactatctcgctccctcgttactcgctatctcgctccctcgtttctcgcgcccacgcttccactaattccattcgcccgcttgcggcgcatgaggtggatatgcggttgtggcagtcgagatagatcgtatcgtgtgcgcgttaattacgctcgccgaccgaagcgacgttaccatgtctccagacgaaacgaatctgcacgcccagattcgagtgctgctcaagtgatgtggcagtcttgaagagaccgcccatgactgacggccaagacaccgttaccgatatgcgtggtttgagaccgttgggtttctgcccaatcacggagaccggtcccacctgtcaccaggctttatgagtggcgtcatgcccgaccgcttcccttgagaaggatgatcgccctgacataacgccgggggctactgtcggtgatatgggaccgggagtattgcgcccggaggcttgaggcagattgaatcgcccacgtggcctggcaccctcggggacgtcgggcccgagggtgaggtgtccgccctcctcctgatttccccgagggggggtcgggttgcccctgccccggccccgagggccgaggtgccccgaccccttgtggggtttgcactatgtacataggttgggtgaacacggtagggctcacctaaccgcatttattgcggtctggtcaagcgtgtcacgctgcatgcagcgcaatgcagcgcgctcttttatccggtctgtgaccagtcacagaccggtcagatcaacggttaggtggcgactggcggtctgacgcacgcctcgccccgttccgtcaagacgagagcctctaggcacacgtctccagccggagctagcgtgttacctcttagagatggcacgttagccctggttagatgaataccaggcttcatcccaaccattacaggcaagatgctacaaaaagaagggtgatcatgcagatcgctgaactgacgcatagaggacaagaatgaccgatctgtgaccggtctgacactggtcgcgtcagcaacagacagccacgatcccacgttgcgcctgtctccgccgggagtggaggtaggtgtgggctgtcccatcgaagtgtcattcggacggcaaccataccaatctccgtccataaagagaagaaaagtccagtttggaaaggaaagggtacatgtggtatccccttaagatataaaaggaggaccatgcccacaaagagaggggactggattttcccgggagaggagagggctggttgatattttgtaacttgctcttacacagatccaccaaaaacacaggagtagggtattacgcttcccagcggcccgaacctgtatacatcgtccgtgtctcgcgtttcttcctggcacgcgatctttccacatacagagagagcttgagatctcaccctaagcccccggccgaactggcaaaggggggcctgcgcggtctcccggtgaggagccacgagctccgtcaagctgtacatggagatgagcgccaccggtagagagatgatcggagcgaggatcagggacacggacttcttgcaaggagatgacattctctggatcaatttcaggggaatctacgaactataccagctggacgccctcgacgtctctattatgagttgctggattttgtaagtatatcgttcagttagatttcttactatacgtctcctttaattaattaggtccttgtatataagtagaccatagaaaataatatactcccttttatcgttgtagaatggagattcaaagggcccgacggcggagggttttcgatactggattcatcgaccctcggaaagtaaacgtcgcaatgctcgaccaatatccacaagaaacagaggacaatctcgtccatctcctgaaggcgcagcattacaagacgttcatactgttgccatacaacacagagttagtttaattttactgtcttcctacataccaaatttcattcccgtacgaacttgctaagtgtttcatatgtaatgcatcccacgcacattgcagattccactgggtgcttttactcatcgacctggaggcctgcaccgtcaacgtatatgactcaatggataaaaaagagtctacgtttgacaaggttttcgaacttatagacaggtaccgtcataagttcctttgttaattaagaaaatcttgttatgttaattgctactacgaatcatagctttaaactccatgtagggcttggtatcggttccgtcatttggtccgcggcaaatggagagaaagacttaggcggaagttcaaatttcctgtgagtacacatgctctacatttatatttctccgattcaaatacatacaagtgtatattaattagatctctcgttgtttgtcatttatttgtagtgcgcaaagcaaaagcagggaactaacttgtgcggctattacgtgtgcgagtattgccactgccttgcagaccaaatcatcaccacaagagagctcgatgtacgtacaaataaattcaaaatttcattacgtagcgatttcttgtttaattactaatcaatttcatacattcatatagtttattcgcatgagggataacctgaccacacacaaggaatttatcgcggcggttcaagaacaactcatgggattcatcaacgaagaaatccttgatcccaagggtgaattctactacgacggaaacacaattcaccggtccttagcttctgagctagcagcgagtactactacgtcgaaatcgtagctagctaggacatataatggattgtaattaatacatgactacatatgtttctatatgcatgtgtacacattttctataatgtaaatatattttgttcatatatatatctatatacatatgcatttgcataacatatatatgtataaatacatatatatatatgtatgcatatatatgtattgaaacatatatatgcatggtttatatatatatatatatatatatatatatatatatatatatatatatatataaaccatgcagcaacaggggcatgcaaaaaaaaaaggtcagctctatctttagtcccggttggtgttaccaactgggactaaagatagatctttactcccggttatttcacccgggactagagatagcgatctttagtcccggattggtactcccggtttggaaaccgggactaaaggggggttacgaactgggactgcaaagggtttctccaccagtgacacatgattggaatccaggacatgcctcaactaactcaaaaatgaccatcacatggaaccaaattagaaagtgtgatcagcacttttcaaatatatgcattgtatatttttgtcatacacactctctccaagcagtttcaatatttagatactttcaattgctagcaaggcttgttttctttagtttgagagaaacatctgccatcatatttttcattattattttttatatttttggtaatacgtgatgagcagagcatcctaatatacataataaaagatgtttttagttttaaagcgcgcgcatagagtgagtgtgcatctaaatatacactatcaaaacctgatgattttgaagtgtaggcagatagcgagtatttatatgtttatgtgcaactaaatatacacgtcaaaaaatgaccgcacagaccatgcaagaaatggttggcgctaatccaaatatttactaaaaatatatatctagacttgttttttcaaagttatcattctggatcactgattaaaatataggtgttcaattcatgatcatgagcacgtgttgtttgaactaaaggcaaacaaatttgcccttatcatgacaacgaaatggataatgatgacctaaggaaaaaagaagggagtatctgatgagcaatttaggcattttaaggtttgctgccggagaagctgctggccgtcatgattccaagcatgcctctttgcccggtcaaaagacggcaccggtcttcaggtaaaaaaccaagaagggcaagcataatcaacaaatggatagaataaaccatccaagtaccatcatttggttggccatttggcatgctaatcactgcctgacattctggagatgctgaaaggaaatgttcctgacattctacaacgaatcagccgctacaaaacttaaaattttaaaattaattttagagctcattttaagttgtttttaatgaagttttttttcagcattgcttttaagtcactaagaacgtgtataagttttatgccgttacagcttaatgtaacttataatcagtgttacaagaaagataggatgtacagatcagatcatttctaccgtcagcagagattatcatgcatggtaaaatcatacaaggaaaaataatttactgaccacataaatcacaaaaagaaaaggttcatcagtttggcaaaaaagatggccaacctgcccctacttgaatagttccattatcttataacattccagttcataccatgttttgtgttacatttcaagtgcaactgctacagtgcttacctaaaccaaaccccaagtgcttcccagcaacactagtacagcacagttcacatagcattagcatgtcctctcatctcacactgcatcatccattgtggtttcagattttcagtgacctgtcttgcagttgcatgcaacaaaatcaggcaggcagggacagtgaaaagagcaaggaaaaaaaacaacaacgcatcaatgtttcccagatttcttgtgttcatgttcagaaatcagaacaagatggagtgctactactgtttccctcatcacattgtactacagtggtcaactgctctgaaaagtgcaggtactactgttttgccaatctttattttttgacaatttttattctgaaataattacttcctccgtctcataatataagggattttgagtttttgcttgcaacgtttgaccactcgtcttattcaattttttttaaaattattatttattttatttgtaactaactttattatctactgtactttaaacataactttagagactttggagggagtaaaagttactaggagtaatattctgcagtgcacagattctttcccagtgatcattgatcacttttaccaactctcctcgtgtcttttgctgaaacattactccaaaaagtttgttcttgcagtgagaggctcccagtgcagctgaagatctgacaacacaagccttgcagcaatccagccccagatacagatacaagcagccttcaccagacaaggctcgaggagtagatggagtaaatactctgaatattttaaacatgcagatttaaagacaaggatttgattctccatttaaatattttaaagcatgcccatgttgctatacatttctcagatgagagcaaataacagttatatgtgagtggtttaaaaacattgcattgcagcacactggatagtattttactcccaggttgtatgataattatgtctaaagaagttactaagcacaagaagcaaacaggataagaaaagaactgtcatgtcagctgttcctgtccacctaattaaaccccaatgggggagcagtaaacattaaacaacaacattattagtaccaggcttgcaaccgcaagtgttttaattactgtttcttgtttcttgcagcattcagattgagccagtttcttaagagagcctcaccaaccagtgtgtgctgccatttatcttcagttattgcaaagctagctaacatgaacaatatagaaaggcaaagctttattgcaaagcagcaagcatggaccaatagaaaggcagcaaagctcaagacagaggattgctactggccatgtctgaaggaaacaggattacaagagtatcttacacaagattcttgttggttcattaatattaatcactgctcttagccattatcttagttcttaaatctaaatctagagatatcctttaggtatttgcaactatatccccatatcattgttcataactacttcctccgtttcataatataagtcattctattcttcgtttcataatataagtcattctagtattacccatattcatataaatgttaatgaatctaaacatatatgtgtgtctagattcgttaacatatatatgaatatagatagtgctagaaagtcttacattatgaaacggagggagtatatcctttaggtatttgcaactttacctttatcagaaatatttatgttggcaattttctccagaccaggaaagtgtactcctttgttcttctgcaattgtcatccagcagtagcatgctgaaactaaagagtagcttctacttgggctaaactgggatgaagtttccccaagtttaataacaaatttgaaccaaataagatagaaaatctagacaaccaaactactttaatccttgcttcccatgaaaagcacaatactttcagttcttggattctttccactataatatttggtagtgtcaccaactcaccaacacaaacagtaatcccaagaacaccaagcagaataaaaaaaacaataataataaaccatttctttggcattcaacacttgcatcaccataaattactacaaaagagagatcaaacagcccattaatccccttttttctatacaaaaacgaaagtcaaacattttatcattccatgccttcttggcttcttgcaactaccatacatacttactacttctaattactcattactaataaacacttaaataagccaaagccatgaacagtagaattccaagaaacagcagcaagagcaagaaatccatggcggtggcagcggcggcggtcagggcgtcatgacctggacttgccggcggcggcggcggcggcggcggcggcgccggagaggcgggaggtgaggccgaggcagccgaagagaagcccctgctggtacggcaggaacgtgcgccgccgcatctcctccacctcggctcgcctcgccgcgtacatccgctcgtgcgccgacctcctcctgccgcccctcgccgcggcgggcgccggcgaccgcggcggcgcgatgggcggaggcggccgctggtccttgcccccgtccgagccgctccggtggaggagatccttcaagaatctccatctgcgggagcttctcgacgaggaggaggaggaggaggaggcggagg

SEQ ID NO: 47760 - DNA, 9391 bp, Oryza sativa
gtcggcggaggacatcgccgcgggagcaggagacgggaaccttgacgagaaatcgaactcgaactcatactcctccccgtcgccgccgccctcgccgccgtggtggtggtggtggtgggcggggctcgccggcgcgctgaagaagccgccggggaagggggcgtcgcgggcggcggggctggacggcgcgctgacgaacggggtggagcacgcgctgtcgcccccggtggcgaggtggtggtcgtcgcggagacggtgtccgccgccgcggccgacattgcggcggcgagtgggggggagtgatggggttggggaggtaaaaaggaagcagcttttaaagcgcttgtccgacgcggtcggttactggttgttttgcggtttagtccctgcagaaactggaaatttgtaaacattcataataatggtgtttttctaaggagctactacctgttttttattttattttgttattttttttgcggggttattttattatttttagaaacatagtacaaaagcagacgcttataatgtatgcatactcatccctataaatatacacatgcacacactatctctatgagcatctctaaaagactaggccggtgtatcttggaacgtgaatatctttgtttagattcgtaagatcatgatacattatatttaataataggttgcttttattttatggcgagggaagtattcttcatccaacatagtaaaaatatattttctgattacatggaagataacgaatgaaacatataagtggtggagccgtggcggagaaaaacagagtcaatcataggctacaaagaatgtttttactaaatatcaataattattattttcctgtgttgccctaagaaaagatgataggaatattatcgacagagcttcgaccagcttgaaagttggttccaccaccgaagcatatggacgtactccatccgtctcataaaaaattaatctagaattgaatcaatctagaattgaatataattgaatgagacattatatagtttgtccagatttattatactatatgatttcttatccaatcttatattaacttttttggaacggaaggagtacatagtcacccttacaaatcatgtattaattttttccatttttcttctttatggatagagggaaggataagtgggatgttaccggggtttataaaaccgccggtaaccacacgattaccgtggttattgggcttaccgcggggtacggtaaaaggaaaaccacggtaacctccttaaattcaaataaatttagaactttttgaaattttgataaattttacacgatttcatacggtttgccacggttaccgcggttgctgcgtggtaactgtgtttaccgccggagcacggtaaccccgaccccagtggtttgggaaaccctggatgttactcatgaatggtgcgttctctatatgatccttaatttcatgcttgtcatgaaatggaacaatactcgtttgcaaatattaagaaagtatacttgtgacttcttcatagattttcttgtcatactgtaatttcaaaaagaacaacaactattatatggatttggtagataatttcatgaatggaaattcaaggagatgagcaaagagtctcgaaagattaggcatgtcgacgccgtatgtatgtacgtatgcaagaattttgtcaagctagctagtacgtacagctacatgatatttctgccaagtttttcccatatgtatatatatttatatatatatatatatatatatatatatatatatatatatatatattgaggaagtggccccatgtttcgcttattcaagggcatatttgcaaacgaaaaataatttatgaataaaacttttatatacaggttattagcgatccaaaagtaaaagctgaaaaataaacttcgatgaaaaaaacccctgaaaaataaactttgataaaagaacctcaaaatcaaaagtaaaagttgaaaattcaaaatttggctgataagcataagagcgaatactatagtaggctacaagtcgattgtaaaaaaaaaagatagaaggatagcgggctatacatttgtagccaactgcgttgtgtgtgtatgagaggtggcaccatatattaatggtttattgataactatcgtatgaatgagctattaaatcggctatagataatttaaagctagtagttagatatactattaaacatgctctaagaccattcccaacccaataattaggatggtgtccatagtattaaataagctgctatctaaaataaaaaatgatatggcaagtgaataaatgaggaaagagaaggaaaccatgtcttgcatgagatatggtttctacacaacatccaagacatcatgtgatataagtaccattaaattttaatatgaaatagtagaggctgtttggatgctatactaagtttgccaccattcactatactttttatgccacacttgtctaagttgtggcttaaaaaaaaatgagccacaccttaactagcaaaattggattgtgctacactttagtgagttgatgacatgtggggccctaatagatgacaaggaatcttgccataagtgtggctatgaaccaaacaatatgctaacttagtcaaacttgcctaacatgaggtgtggcaacctttggcaaacattgggagcaaaccaaacaatcccgtagtgtttgcattggaagagtagtgtatagtaccagttttttttgatgacgtgaaatttatggaaactatgtcaatgttttgagttaggaatgacataagcataagtggaaagatgaggccgcgtatgtgagcactcagctcgatggggaagcgtgtgcattcatcgatctataactccatgaaaaagatcagcttttaattttctccgtgcagcacgggcgtttttcttgtatcactggcttttattaagcttgctgtttgactggctgataagtatattgtatatataccacatatcactagaattacttaattacgtactctcccggcttaattccatatcatagttttccgtatcagtatttattaacgagtactcatattctttccttcataattaactgaggtcatgtccttcactaaaacacttatactagtattttgataaatctcaagaaagctaaaacaaatctcaagtgtgttattttttttacaaacctcaaaagagagcatggagaattcgctttatattaaaaagaaaagagttgaccctttagagaaaaaacagatccaaaaacttcacaactccattgttagtttagagaaaccgaaaaaaatccatatggagaggcaagacaaaaaaacttgcaatagcacaactgctgcgatccaatacaagtcatttttcccgggcttatcacaagacaagcagctccgatatgctattgcgattgacggactcaaccactactcaactccgaagcaagaccttcgaagtgaagccttcaagaaaaaaataacatcaaagacgctgacaacgcctgtttacaacattcgactaggtttttacccaaaggaaaagaaaataaaccatcagcacaacgccaccaagaaggaaaacggctcctacatacgtcaacatcactatcaccagtcaaagaccgggcagggcttacgccataggctcctttaagtgttgatcacaatcgcctctataattacccagctcgctacacctagcgcggcagcttcgactccattgcaagacaaaccgctggtgcaagcagaggctagcacaccaaaccttcccctcgcggaacgatcataagcttgtgtgttatcgttgtccagctcgtcactcccagcgcagcagcttcaactccggcataacaaacgcagctgcatcgcaaggctaccaatcgcacgttcaacttttcttagctgtcacaagatcttctagcgtcgtgccaaaaaagttataactttttcgcgagataactttttcagctacttttagcaatcacaaaaaagttatccggaaaacgaaagtgaaaataaattgttgaaagtattttgtaatcaaactaaacacaaaatcaccttcgaatgctaatcctgatcgagcaaagtattattagttttccactagtcgcgcatgagcaaacagttaagctctagcgtgatgatcaatagaaaactaactcttcctcttcttcctattatctccatcgcaaaatataacaaattattggacacggttattaaaaaaataggtagaattaaatagaatgaggtttttttattgagaaataaaaatgggtgagaaaagtaaatagtgaagggttataattagttagaagaaaatgttgcttaagaagttgttataatgtgggataataacttctattaagttttaaaagttgttacattttaggacaaggaaatatatcttttcttctttggaagaattacaaatataccactactttcaccctctaattcaaaatagccattataaaaccatcaattacaaatttgccattaaaatcggtgcatgtacacggcgtatgccattgccgtttagtttggtgcaattaagagggaaaaaattataaaattaaagtaaaaaaaaggcaacacgataagactattttgtccttcccagattcaatcccctatctgctctctctctctctctagaagccagaaaggatcccctctccctcgatgaaccctagaacccaaatcccttcatcccttctaaatcaagagctgatcaatcgaaaatcagttgcaatgaagtaagagatggcaatggaaaaactcatgaagaagggcgtcggcgacggcatgcggcgtcgtcgggtgttgtggcagcaggcgacggcggcaaaagcaggcagcaacagcgaccgtagcagcaccagacggcgtcggcggcggcagcaacagctgcaccaggcaatggcggcagcagcaccaccacgacagcggcagcaccaccaccaccattatcgagagccgacgccggcaacaccatcggcagcatgcggcggcggtagtatgtagcagcaacactacatcaacagcagcagcaacaaacatcaaggaagactatggaactaagagattgtattttacaaccctcatgtcaagatgatgccagtaagttcgactattttcttgctgccttaggtgctctaatgtctatgccaaaatgatgtaaattttgcaattttgtggcacgggcatccttgtcctaatttttagaaaaaccaaccttctaacaccgttagtttaaactgtcagtccaatggcaagtatattgggctcaaggtggcaaatttgtaaatacagtttttttaatgacaaattcacaataccggttcaatccagtagcaaatatacaattgaccctttctcttttcagatagcagatggagtaaaccactgttaccgaaaagtccttggagtacttcgagttaacatccagctctatcggtaatcagcagtgccgtatggctcaccgacagtcgtccgtgcgagatcgtacggctgatcttatcttacacacgctcacagctcagcacagcgcgggcccatctgtcagacttttgagaaggaaaacaactggcaagtccgttgtctccattaaaaacaatgaaaattttgatattgtcctggaaattttggtttctggcactcctttgtttcttcttgggattagttggtggcagtatgtatctggcgcgttggcatgattattattttgcccatcaattaagatgggaaattaaatagagtaggagagttccatgggaggaatccgatccaaactagctgacatgctgaagccgaaattcaaattgtgaagcctaattttaaagttgattttggtgtctttttattaaagtttattcttcgacatttgcttctaatatcctaaggctttgttcggtagatgaaaaactctccattccgcattccgcatgtacgctttctaaattacttaacggtgtattttttttgaaagaaatttatacgatagttgtttaaaaaattatattaatctatttttaaaattaaaaataaataataaccaattaattatgtgctaatggcttacctcattttacatattttctcaatcttatatttttccctcctctcaaacacacgtaagattagaaatataagttttaactaaagttattttctgttatttgtctatttccctaaggcttaccaccattactcaaacgaccaaaggctcaaaagttccacacaacacaagcgtaatagcttactttttgcaaaccaaaactggcccattaaacaaggagcccaaatgcataatcctttctttgcacataattggtatccactactgttataaaattatcttttttaactcattatgtcatcaacattatattagtcattcgatcaatatgcacaccattagatctttatttataaaaagaagacccaaattgatggacaggcccagctagacacatcttcactcccgcacatctctccaattgacgcacgccacacaaggattaccaaattaccacggtgatctccatctcaatgcatgtattttgtatctacccaacaaaagatgagttgcattattctttcttagtcctctcacaccggtcatacatagggcctgtttgggagatgtttgggagagtttctacttgttgcagcttctcccagaatcagaagctcccctaaacaatccagtttttgatttagattcttagaaactgtagttgtagaagtcaggaaataaactagaagctaaaaactggaaaacccagcttttccagatttttaaaaactggctaccaattagctgcttctcaaaatcttaatcccacaaacatgcccaaagtctttggccactactctctccgtcccataatataaggttcatccctctaaaatccattatattatgggacagagggagtacctagaagtacatttgcagaaagaatatatctctctttacttctgatccaactggttaatttagttaaaagaaatatttgatagaaaattacttttgagataaaattgtatttttgcatttctggttaaccaccttatttccattggaagtaattcagttatatctcaaggatatttatatctcttcgaatgtcttgctctgatgccccaaaaatgtctttcggcttgaagcgaatttcctacatatttcggcttcatacatatttttccaaccatttccttgatgtttgaagtaccatggaaaggaaatgacaagctgaatggaacactgcaatttgcactatgtacgaagcctaaatcaataaaactctacataccacagcacagtaccacacaacataatcaatttaatattttaaaattagattcgatgtggatctaaaataaaatttcatcgaaaaaaagacgagagaaaaaaaatctgaccacaacaatagaagattctctcttttttctccttgcctatctctaaaataaatcttcatcaaaaattcaggtagttagaaagtttgttactaaggccccgtttggcacaactttagctcccaactccaacttacctggagcgggagctgtgccaaacgattcagattcacctttttttggagtggagttggcagagctactcctagaaaatgaactacgggggtggagctgggtttttgctgctccacagctccactccaccccaaaagacccactaccctctaatattttagtgtatttacacgaaaatgccactcaactaccctttcaccccttctttcctcccgttctctctcctcccccaatcttcctcccaatcccgagctagtgcggcggcatcggcgggctgcggcagcgttgacggcgacgggcagcgacagcggcgggcggcggcggctgcgggatgacgacgggcggcacgcacgcgcggccggaggctggcggcggggggctgcggcagcggcggggagcggctgttgggggacgaggacgggcggcgcggcggcgaggccagcaggtggcggcggcccatcttcttccccatcctccgacgacggccacaaccggttgtggcggcgtctgcgttggcagcatacgggggcagcaggctgcggcgcatcggcggcggcaggcggtggcggcggctgcgggcggtgttgcggtggccgcgacaggcggtggcggcggctgcgggcggtgttgcggtggccgcgacgggcggcacgcggcggcggcgtcggcaggcgactcgcgtgcgggggcgtcggcaggaggcagcctgggcgacggcggcggcctgtgcggcggcgcttgcgcagcggcttgggaggcggcggagatgcgtgggcttctcggcggcggtggctcgtgggctgactggctacggcggcaacgtcaaggcgacgcctagaaggtgttcgatgaaatggcgacaaaggatgtagaaatatggagctgagtaatctagccaaacacttttttacctacctcagctcctagaggagctagctctcactggagttggagtttggagttgggagttggagtcaggagctctaccaaacggggcctaatattttgagattcgcaaaaagataaagaagaaaaaaacctttatatatactgcctcctgtatctctcgcgagtacaaaaatactgtagcttcggaagaagaagaagaagaaaggggtttcccttccgtacaccagcagcagcatcagcagctgctcctccccgcccaaaaaaatccaatctttccccatggcggagcccggggaggatgcggcagcggcagcggcggcggcgtcgaccaagtacgtgctcatcaccggcggcgtcgtcagcgggctcgggaagggggtcacggccagcagcgtcggcgtcgtcctcaaggcctgcggcctccgcgtcacctgcatcaagatcggtccgtgtgtttcttcccccattctttcaactctttgctcatctgaatgcgatggctaaaaccctaggaaatcgagtgtggtttgggggagtgcggagatggcgattgtatgtgattgctggttgaattcgaatttatggcatttgttgtgcttattcttgatgaaggggtaaaatattgccgccttgtgatgaatttggtaggggttagggcttttttcatatctttcttgatttgggggtgtgtcaaaagcgtcggcttgttggtttatgtttggagggaggtgaaaggtggccgctttcttgtttatggtaatggagtattgaaaaggttgcctattattgattcagccttcatggggggccatgattgtgggtgcattcttgtcttggttatgttttggtggtgaaaatgctatcatttttctgtagaaaaataatctatcaatgaa

SEQ ID NO: 47761 - DNA, 3166 bp, Oryza sativa
agagtttaacttgcttggaggtttctcagtttattgatgtatcattagtcttacactcttactattgtccatcacctggtgttgcagatccatatttaaacacagatgctggtacaatgtctccttttgagcatggtgaggtctttgtgcttgacgatggtggagaggtatggcttctttgatgcttccatgtgatgttactctttatgacctgtgcacatgagcttgtaatgtttgaaatttgtaggttgacttggatttagggaattatgagcgtttcttggatgttactctgacaagggataacaacattacaactggaaagatatatcaggtgatcatcccttcctagaaaatgcttgctggttgtcacatgagtttgtaatcaatggcttttgttgttttcagtctgtcattgagaaggagaggaagggtgactatcttggaaagacggtccaggtaattcccttgtggcatttttttttggcaatggtcacatgcttatggaatacccatatgacaaactaaaatcttatggctgtaacatgttcaggttgttcctcatgtaactgatgaaattaaacagtggatacagtcagtatcttctgttcctgtggatgggcagactcgtccagctgatgtttgtgtcattgaattgggaggcactgtaggtagggtttcgaggcatcttatggtatagttattactattataatggatgaactaaattttttcttgtttcaggtgatattgaatcaatgccattcattgaagctctgcgccagttgtcattttctcttggtacagttggattttcttcttgtgatttcaaatttaataggtcatggttgctgagaaatatgttgagttcaatgggctacgctgactctctatcatttcacaccatttttctctgtttatttctttggaaatgattgggctgtagattaggtatccactttattcggtccgcaccgccttcctcttttgtgctaaagtggcaagctgatagtcacatgctattgttgatatgttgagaagacatgcagcgttgttttaaaaacaattctgatttgttagtgctcattgttggatattgtacccatcattcttatatattttgcaggtaaggacaatttctgcctcatacatgtgagccttgttccggtattgggtgtagttggtgagcaggtaaataattctcttcaatcatgatttctgctgatgacatcttgacctctgacatgagacaaaattgcattgcaatattcaagtcttatgtcaggacatataattgctaagattgaaccctgaatctgtcatttccatttttgtagaaaactaagccaacacaacacagtgtacgagaactaagggccttgggtctgactcctgatcttctagcatgccgatccgcacaggtaatgcaaacaacatagaataacagaacactcttaagatatgatatctccattgattctagcatttgatgttgatgttccctattttattatcatatggaatacttctctggcagtcactctaatatgtcttttcctgtcttactctggacatgactgtccatatctttttggtgcttagtctatattttttcttgtctgtaatggattgacataattttttgcgatctgaacattcagccactaataggatctgtcaaggagaaactttcacaattttgtcatgtaccggtatgtttttgcttctaagtttgaaaagagccattttattctcatgttttcctacttacattctatcttatctcttacaggttgagaatatacttaacatccatgatgttccaaacttgtggcatgttccacttattcttagagtgagttatctttggctcaaagcttaagtgttgactctgtagagaaagataatgagtatgatttatataatcattgcactaatactttattttgacatgtgttattttccagaaccaaaaggttcacgaggctataatcaaacaacttaaccttggaaggtgagccagacaattactgaatatcagtttcttgtcaatgtttggaaataatgtgcccaagtgtgtgcctataggaagttttatatttgggatttactacctttgaaaatcatgaatagttcattattatgttacacttgctatttctggtctatatttgaccccttttcagttaacgtgaatggacttgcttgatcgttgtgagatttatgagttcgggcagtaataacaaatctgttgtactttcctggcattacttattttatataaggtgttttggttagtatgttgaatcaattccataccttattctgtaggtctgctggaccccctgagttacgagattggacacagatggctgagtcatatgatgacctcaaaaactctgttagtattgttaagttgctctaatatcttgactttgcattgattattttcaagtgcataattaattttgatggacttcaatgccatgcaggttaaaatcgctttggttgggaaatatactaatctgaccgattcctacttatcagtggtgaaggtgagttaaatcaactttttaatatagaattgttatttattcaattatgcatccaattggtgaaaatgggtcctttttatttatgttttgcctgttgtgccattatttccctccattagtgcctactgcaaatgcaatcaattcctaagagttgtgtttatgcaaggagatttttgaactacccactactcttgcagtgctactgatttaattcttattgaaatattatagtattatacatgcaaatgttgtttcaaattcatgtgtatacaaatatgtttcaggctcttctacatgcgagtgttgcatgttcattgaaaccttctatccagtggattgcagcttcagatcttgaagatgcaactgcaacaagtgtaagcccgaaactctttgttcataatatgatagggagtagttctactggattacgctacatctcttaacacagttgtaatgtttaaaccaatgctctgttttatgtttgttgccaataattatctcagggctaaagatcatttttattcatactagtctactaacttaatatattctctattgaaagcaatgtaacactcctattatagttgtccttcctgctttgtgttatctta

SEQ ID NO: 47762 - DNA, 1382 bp, Oryza sativa
aataaatgctagttggtgatgatgtgaatatttacatatttggatatacacaaacataaatacttgctgtgtacacgcacatcataattgtcaggtcttgatagtgcatatttggatgcacacaacgacacaaacattcgcactcactctacgcacgcttaaaactcaaaacattttttgatcgtctatatttggatgctatgctcatcgtacattgattaccaaaaatattagaaaataataaaaaaatataatagtacatgtttctctcaaacaaaacaaaacataccttgctagtaactgaaaggtgtctaaatattgaaactgtaaggagaaaaggtgtgtaagacaaatatcacaatgctgtcaatgcacatacttgaaaagtgtggatcacactttctataatttgcttccatgtgaatgtaagatggccatttttgagttagttgaggtatgtttcatggattccaatcatgtgtaagtttctctttgctggttgatttgtttaattttgatgaatcatcaaacaataaaaggctagctagtgctaaataaaaagtcaccatatgcatcaagaatatcaatataacgttgtgcaaggcaaatgatcacttgcaacaccggagccccatacccgaaatgccaagtgagcatatacggaaaataagttataagcaaatgccaactgcttgttcaaagttctacaccctgataaattaagtcttggtttcactgatcaccagcataactttcaaaaaaagttctagacatctctttattttttttctcgaattcacatgatagatgtttattattgtattaataaaataaaaggaggacacaaaatcactatttttatttaatctttggattagcgccaaccgtttcttgcatggtctatgcggtcattttttgaccgtgtatatatattgggatgtacacaaacataaacattctctttctacacacgcttaaaaattgtcagtttttatagtatatatttggatgcacacaagcaaagacgctctctacgcatgcctaaaacttaaaagcatttttattgtgtatatttggatgctctgctcatcgtgcattaccaaaaatatcagaaaataatgacaaatatgatggcaaatgctccaaaatcatgcgaaaatgcgaaatttgccccatctgttgttgtactgctagctatttccccttttgcttaggtctgtattcggtattcctagacacattattgttgatggaatttgcgtcttgagccgtaaactgccctaaatttgtaactgaccttaccaactcctttccaccttcattgcttctagggcaagtagatgatgaaatttgcccatgacatattgtcgacatttgatgtc

SEQ ID NO: 47763 - DNA, 27895 bp, Oryza sativa
tcttgtttgggcgactggatttatgttcttaatttcctggcgtggatattggcaggaattaattgagactttaggtcttgtatttatacccataggtgtccccttgtccgagtagaactagggagaccaatatggatacaatccgagtagtactggttgtttccatttagaactctggttgtctttccttatccggaactcctcctatatccgcaggttgtttccgtataggacatggtatgtggtgggtcctgccgagatgtagtcgactactattaggtatgtggtatccataaccctgacagtagcccccgacttcaatgcaaatgaacgaattcatattctcaactgcgtgcagacattggagtaactgttatcgagctgatgtgaccgttctcggtgagtttagagataacgttagacttcctttatcagactcgtgcgggcaccgaaagggtttgtctaagtcaatctctgatgtcaaccaaggaagtacagagcagacgactaagtctcccgtcttgctgtaatcgagaatttggattgaagtcaagaaattttatctcggcgggtacaccatttcttcattctgtattccttgtcgagatccagcaatcgttctcgagcgatcgagaaggcgtagagtctgcgacgaagccttgtcaacattggtcgtactcgccttagtcgatcttggtgtagaaccatagagacatggagtcttccataatgtcgaatagaattttcctgaaatcaatactcagaaaagaatatcaaatagaaatagcccccgagcgaacgctcaaagggtgacatgttataatatgtatggaaaactaaaaatgaattaactttaccgaccaatgttttgtgtatgagcgtcttctctcttaccgacttcgatcagtcagtttgtagagtcatacactctccctagtccccagccttgtcgtcggagaatcgttctcagaggataaggctcttggacccttgacctgccttagttgaacaagcactgatcctagcccccagccgtgaagttggaaaactcaatttccgatcacacggcttggttaatacgcacgacgagaactcttacacgaccaggtcttacatggtcttttgtctctacaggatccgacaaggccttatcggctctgggcatccccagccaaagttcccttaggttcctcggaggccttgtcaagatgacgtaaagggacagtaggataggtttcaacgctaggtgtcgtcgtggtaagggatctctgggtaaaacacttggcgatattgtatacctgctatcaactttgttgaagtagaggtagtaggagaaatcgctacaccgctggtcgaggaccaggtagtagtcgtaactcgaccacttgaagtggaaatagtgggagaatcgctacaccgctggtcgaggaccagggagtagtcgtaactcgaccacttgaagtggaagtagtgggagagacgctacatcgctggtcgaggaccaggcagtagtcgtaactcgaccacttgaagtggaaatagtgggagagacgctacatcgctggtcgaggaccaggcagtagtcgtaactcgaccacttaaagtggaagtagtgggagagacgctacatcgctagtcgagaaccaggcagtagtcgtaactcgaccacttaaaattaggcgagagagatcactacgctttactggttcgagaactaggagtaggagtctcttaatcacctataggggcgctaaagttggtttattacatgtgcatatcatgtggccagcatgactcacatacccaacttatagcatatccggatgtctgctcgcaatcatgttgggtgatcaagccaacggcgtttgcgaggaattatccgttgacaaccttttctcgagtagtccagccatggccggtgctatgagataggtcgtcggtcttcgttggtaagttgggtgcgataactccgcatttgtcgagaatgttctcgataatggagtgtactcgaccataacctactcgagtgctcaattgttcctgaaaaatattttctagaaggcaagatatatagcagataatatcgagtatgtactcaaaaaactgcatggatcttctagtattatcaggatataacgagcagatgtaattatcaggcattatgtaaaccgtaaacaagcatgatttatacagaagaaaacagagcgagcccccagcgttagaccgtagttggcctaacatcggaagtactcgcgcaatatatattgtataaaaaacatgctctaagtaaacgtaataaattatagatctgacaatactgtatgatctgaataggtacgataaattgtagataaaatattgcgtatctttgtagatacatgccggatgtatctacgaaattagtagattaattttaaaaaaataatcttactaattaccttaattagccttagtagccaacctaaattgttctctggtcacacagtgactagcacacgtatgggtggctcgtatgggctccacaatgtgcatgctaatacacgtgtgcatgacaatgcaatcggtcggcttctcgtccgctcggttgtcctgctgctgcacgtgaaatctcaaccaatcgggttctgattccagattgtattgattaagcttgaataatggatgttgatcctgattaagcttgggtcttgggaaccgcgcgctgcatgcaaccgtgcgtagtagatgccgatcccgatttgatctgtcagaattccggcgatgtcgatttggagatggtcggtcggggacgaaacctcctgatcgataaaattaaatcgatgtcttccgcggtggcgaaaatcttgaagccgatctcgccggatcgaatagttaatgacgatgattccaatctcgtcgggagacgtactccgatcagattagatcttttcatggtcaaagttgtcgagtagcttgttgacagaggatccatctcttaaacccatctcgtcgaaatcctaaagcaccaaaatccccctacctggcgcgccactgtcgacgtttgatatcgcggttctagtatttggacagtatggggatcgttggtactaggatatacgcgagactgaggtaaaagagatggagacagggatttttatacaggtttgggcccctgagttgtcaggtaataaccctacatcctgttggccgaagccggagttgctttttattcaccataatcacaccagtacaatatgtggggtagcttatctaactgttgtcgacatggcggtctgaaaggctgactcgtagtcgacaacagggtagccttcctcctcgaatccatgtccggcgagatcagagatagcgctttcgtctctcctgacggtatccgaagacaccgtaggggaatagccatgcctatccctgaagtcgatatctggcgtcttgtcttggcgtatgtaggcttgtattggcttctgttgttccgtatattgtggtggttgttgattgtagtgggtctcgatcgtggtgaccatgttgatcgtgtcccctctcctcgtagggggtcttgtatttatacccataggtatccccttgtccgagtagaactagggagaccaatatggatacaatccgagtagttctggttgttttcatgtagaactctggttgtctttccttatccggaactctcctatataggacatggtatgtggtgggtcctgccaagatgtagtcgtcgactactattaggtatgtggtatccataaccctgacacatatcctttttaatttcattatttgtgtgaattgggaaagacaatgatttcatatgtgcgtcaggcttcgatatccagaggactttgttcttaaggtgccttcaatagttcttgatcccaatgttgcttcttccaggaagatattaagctgtaacagtccatctgcagtaaaaagaatcatccagtaaaaaaaaaagatatgaagtacgctatttttttataactagttttgcagccttgctctatgtttttttaaccaaggatatgtcgtcatatcatgttagattcaagcccactagttgccactttatgaagttattgataacacaaagacaaagtaagatagaaggagttgcatggttgttaatgttaaacacacaaccaaacggatataacaactaatgcacaacacactttatagttaagttagcccaaagaaaataatggttaacgtcatatgaaaaacatttttttcttggataaaatcaaatgaacaataccaaataaacaaaaagcattagtataatggttcttgcacaaaatgtgatccagccaataacactagttttaaggagcatgattggcatttattttttccttgaaagaattgtcgtatgctttacttatttagatggttcatccataataatagttcatgccaaacatgcttttttttctttgcaaaccagaagatgtttacaacaacatttagcctgagtttttgttttgagctttaccaactcaacttcctcgttgttcgcacacatgcttcccaaactggtaaatggtgcgtgttttgccaaaaaaaaagaattatacaaaagtttctttaaaatatcacattaatcaatttttcaaaaaaaaaccctaatacctaattaatacacacgctaatggactgttccgttttgcatgtttgaagggagagttcccaactccaactaaaacccatccttaagtcttgtgcttttcttccttttcaactaaatttgtttgtcagttatgcaatacgacacattcaagaaaagaagttatgaaatatgacaaaaataccattctttacataacaatgcactgccttacaaaaaacagacaaacaaagagacttgtctatggtgatagttaaagtgtgtgcgcacaacatgaacatctgtacttgtaaagtgatttacctgtttcctaagtgaaatttcctctatcagtcttatcccggtggtagtcattccaccttgagttgtagctcatggcaaaccttagtagcccttccaacacaaacacaaacttaaaaagaacactttgattcaaaagagaaaagataacacaattagatgaatcaacagggcaaatgttacctgcttgttcagggagagatgcccatttccaggttccttcttcattctcctggatgaagcatgtgaacttccctctaaggcccatttcaatgttttaataccactttccatctccttgattttttgtgggaggtcaaactaagtttgtactttgcttaggaaatgtgggttgtgtgtgtgtttgtgtgtttactcacgcatacacacagggacaaattaagagatcgagagaaagatagagtcagagtcagagtcagagagagagagatatgttttcctcccatatatcttcattcatgtctagatttaaggtttgtgttattagaatatcatcaacaataggtatggaatgttaagagagtcttgcatttgaggtaaaagggacgaatatcgaccttctccatatatatcgacctttcatccagactaatgcatggctccttaaatcattagggaaacattctggtagtagccaagttttgcaagcataactaatttatgcatgtggtgtctgcatatcaatgctttgcacaataaaatttaagaaagaaaatccaataagcttaggacaacctctaaatggaccatgattctacacagccaggtgagtacactacttcaggcttttagtaacatgtcattctgtcaattagctgaaaacaaatgtgttattgagttcttggaaatgctgtagaagtaatgcatgtacaagggaaaggagtaatacatgtaataatgtaaagaatcacaactcatcgacttatgaggtagtgtggatcatttatcatagcacacaagagcatctgttcagtttcctaagacgtcgcttatatttccgaaatcaaatatgcctcataaagttgaacggagggagtatattcaatacttgcttaagagaatgcgtgcgatagagaatgcgtgtgacataaagagtcgagaatttatagtgtgttagtaggatatacattgtcacgtaaccgtagtcgcggagtgtgtgtatattgtcacacaaccagtcgatcatggtggttggtcaaatttataatttgttagtggggtatgttattgtcacatggactttcttctagtttttagaaaagaggaattgtgagaagccgactatcctttagtactaattttgagatttgaacccaggtgagttgggcgaacaccctcacaccacaccaactgagctatgctcagttctcctttttcatagtttctaccagttaatagaacataaaaaaaacatgtcaccagtattaatccttacaaacaagaatgcacaatcttatataaaataaaacaaacaagcatgttcatctatagcgataagattcttgtattgcataaagaatactaccgaacaatgtacctgtttgaaaacctccttggtgaagtttcatctcttaatgccatccctcggttagtcattctacatagaattgcagctctttgcaaacctcaatatcccctgcattccgaattaacacagaacaaggaatggagaatagaataagcgaaattcacaagcaaaaaagaattccaaatgaaccaacaattcccctatccttcttttctatatagttggtacccacttagagttatttactgctataaagctgagatttggtgaagccacgtcatcctatgaaatagacggtcggattgattcaggccagcctttgtgtcaccgttcgattcctctccggtagtgaaactgtcgcaataaaatggcaaccgatggccgtgtttaatgcattttaattccttcacctaacgcatgtttttattcatcaatcccggtatatcttcatcgttgataatgacgcactcaccatgggtcaccagttcagtgcgacctgtgcggctgccccaacgcccaagaacaggtacttgcccttctgatactcatgtctcatgtagctgatcatctttgctgctactttgtttcaggctacttatgagattcgttttttttttgttgtataattaatcctttcgtacaacctgctcacatatattactgtcctatctgattgattaaataagatgcagtgtttgggcaccaagaaatatttgttccatgctttacaaagtgatttttacatttttgcgatgtttttaccgttgattatctcctacattgccctaccacagctcacttatgaagtgcacttccagtagttgcagtggtaattaagcagcgatcgattccgctcatgaaaatggttgcttgcataagccatggtgagtttccttgacgatccatgtttcctacagtttacacgttaattgatccctaccctaaaaccttgactcttttgcaacctttagtctattattctgtactctgtacatgcatcattaatttactttagagttcagccaagtttttcaggtgaaggatatctatggatccaaaatatatgtgttccttggccaagttttagttaggtggctatgtttctctccgacatttatgctctctgaaaaaaaacacactccatatttaattagcaattctatttgagaacttttattaacctccatgaaacttgaaacttggtagtttcttctgcaatgaaattatgtgatgagttttcagctatatgatcctgatcattgagattaggtaacttctctgtaggatatgagctgaaaaccttctaaaacagggtactgaaatttgtctaattacatctgtaaagacaaggtccaaacatatttttagttttttactatgatgcttgatccaatttaattataacagcctttgtttcattaaatttggtttgcaatttttacaagtttatgatttttagtaaatgatgcctttattttgttaatatctatgtagaaatttgtttcttttatttgaaacattgacggttttgtccttccaattggaggttttggccatcagctgaatatttcatatatacaatcatatatttttgtgaccataattattttaagatatattctaagcagattataagcaactttaattatattgtttgcacaaatattacgtaccgagaactactcttttatgcccgcaacaatgcgcggggcatcaactagttaaccatgataaaccatgataagaacaattacctgaccatttcaggtaatctttgagggattgatgcattaatgaagcagatcaacttctcatcttcctccactgaccttttcagtcgttctagacatattcttaatttttattagtgaattaagtttaaaccttactttcgggggtgcgtggagtgtgtgccagagtcagatagagccttgtaatgttttagatgaatgaagagacaaagggagcaatggcaagcacttccccacattccttagctttatttatatccaaacttgaaggatactacctccttgaaggattctacctccgtttcaaaaagacttaacttttcaacatgaatatcgatggacaagagatccatgtaaaaagataaagtctttttggatgaggatagtatgttatctgccagtaatgtcacaggaaaaaaatgacaagcatataactcctaaaattaccacgcactactttatgaaaaatacaaacttgtccaaatgtaaggtttatgttatttcgacgagtttcttttgtcatttatagaacatgtcaaatgaaaaggttaacatgtcaagaatcacactcaagcagataaattgcgctgcctctctaatttgtggcattgtgtcagcttcctaaatagcagagatcaaaatttcacataccccttaatccttccttataatctagatattttgttaacctgtcatcagcatctgtatatttgctaaattaataggatataatccacattgtaaatagaaacaggaaagcaagaatatccacacagaaaacaaaatatcaaacagagacaagagaatagggttgaatagttttggttcatgaacttataataaactggcgagaaatgcgtggattctgtacattattttaagtacaactaatctcgagtcgaatcattgtacacgtaaatatatttgcaagctctccaaatgaggctttgccacattaatattgtgatgcaatcagatctgattcaactgaatgttggtcaagggtgtttgttcacttcacatctcaagcttgctagcaaggtaccaggaatgcatggctaggctgccgaatgacatgatgttggccaaagacgagagcccgtggatcatcccaaacttcttgttgattgcggcaagggtagggttgttttttgccacctgaacattcttcgaccacccaacctcctcaccaatgctcaggtccctctcaatcttgtgcctcttcttcatcatctgcgaggatcaaacaaccaaatattatcgtcgcactaggagatgaagagaaaggaaggggatcttctaatttgtttaggcatggttaccataggtcttggttcatacaaaaaggcaaatgattgacatatcatatacaactaaatattctattaaagaaaagcattagtgttgctgcactttataagagaatcataaacatgttttgctagagtatgggtagttaaatatcattgaatataaaacaaataggggatatggcaacgtatcactgtcaactactcaactgcacatcactttacacaaaaaaatgactggatagaggcacttcaaaggattaggagtttcagtacttgaaaggaagcagaaaatagcacaaattatgaactaaattaagaatatcagcagtgagatagcttactagtaatcaaccaaaataaggatgcttgtgaatttaacatatagattataagtacaagtgactatatatagttgcatcaacaagttaatatgcaaagtataatttatgttgcttaggaacaacaaagataacctactactatctgatacaatcttctacatccatgatgaccatcatgtaatcaccaacactatggcatcacatatgtgcttattctgaccaataacctaaagtaacacatgagatctaacagggatgaaggagtctaacgtcgatcaacattcatacatccataacaaagtactaaaattgcacacttcatatgccatttaatgaagaaaaatcttcaagaagatattaaacattttaatggaagagttatgtcatggtaaacaacaccacactgaagcatagttgcctttaaaaacttggcattataggttatagcaatgagcactataatgcagctataggaggtctcaatttggtaaagcaattacataagcaatcaaaataattaaaggtaatgctgatgctgttctctaattagcaacatccctacccacataatcaagagcatccaaaattagattcaagttagagtagcacaaatatcaacctctcaactctggaatccactataggaaaagaagcctgcaacccaaaactatcactatcccgcaactaaaagttactagtattagccaatcaacaatcaagcaatgcaagaaacgcttgttaactaccagtagagttgattatgtattgttgcgtcatgtctcgccattttctaacaaacttccataacaggtgaagtattatttatgctgattaggatgatatatatgaagaataaatcatctactattgctaatttgccatcaccaaccctaaactgacagcttgtagtaatcttgtacaaattaagtaatagctgacctcgatggtcatgggggtgaacacgagcaggttggagaggtcgaagccaagggcggcgaggaggaagccgagctggtagcgctcgacggtggacgccgtcttccacgggtggaggtaggcgaaggcggcgacggagacggcggcgcaggcggagatgagcatgaagtaggccgggaacaacttcccctgcaggttcccgaactggtgcctcggcagattcctttccaacacaaacaaacaaccattcatccaatcgaatccaactctcggatcagatttgaagtaatctcagatttgaagcaatctgggttcttggaattgggggaaaaaaatcaagaactccccaaggtttttgggagtggtgggattacttgaacatgatgatgccgccgatgaaggtggcccagagggcggcgccccatgaggtggcgaagcagaggaggtgggccaccttggcggccgcggcggcgccgccgccggagccggagccggagcgggcgccgaggaggacgtcgggggcgaagacgacgcccgccgcgaagaagcagaccgccgccaggaaccgcgtcgcccaccccatcactctctctctatctcgatctcgacggtctcgaggaggcgccggcggcgagggggaagcggcggccggagacgaggaggaggtgtcgagatggaggagggaaggaggtagttggagagaagggatggaaaaggtgggttttttaggggaaatttggcccttctagaagtaacaagggtatattcgtaaatttaaaccgaatttggaaataaattccaggcaatatactacatgactttgttattgaggccccattcagtttaaaaaaagaaacttgcatcgagtgttatggtacatgtatggagtattaaatgtggaaaaaaaaccaattacatagttttcgtgtaaattgtgagacgaatcttttaagcctaattgcgctatgatttaacaatatggtgctatagtaaatatttgctaatgataaattaatttgtcttaataaattcgtctcgcagttttttggtggaatctataatttgttttgttattatacaatgtttaatactttaaatatatgttcatatatccgatgtggtaacaaaacctaaaaattttccccaactaaagatgaactaaattccaggcaatataccgcatgacttgtttactgagtagagaagtcaaaaaatcgtggtttgatttcttgagactgccaaattagactgttgttggttctttatggcaatatcaaatggttactttccccgtcctcgatgagcatgttttttaaccactaaacgggttattttgtaaaaaacttttttttattaaagtctctttattttttaatttatataataagtaataatcggttaattatacactaatggttttttctcgtttcgtttgctccaaaaatttcagtccaaacacaattccgaacgaggccttattcctactcttcaaatcgctgtgaatgtgaaactacagaggctaattgatggacgtgcctggtttaggtgggaaaaatttttaggtttgattgtcgtattggatatacggacacacatttgaaacatttaaagtttaataacaaaataaattacagattccaccagaaaactgcgagacgaatttattaagcctaattaatccgtcattagcaaatgtttacttagcaccacattatcaaatcatgacgcaattaagcttaaaagatttgtttcgcaatttacacacaaactgtataattggtttttttccacatttaatagtacatgcatgtgttcaaacattcgatgtgatggatgaatagtttttattttgggcactaaacataaacaaggcctgcgaaagggcctgtagcctagtggttacaagagcatcagtagcacatgaggtcctgggttcgactcctcataggagtgaatttttcaggatttaacggcgttgtgcttttagttgtaggcaacgtacccgtcgacagcgatgcacttgtagcttcgtcaatctctccagaatttgccggcccagtcttcctgtagtgacttcgtcaatctctccaggatttgccggcgttgtgcttttaattgtaggcgacgtacccgttgacagcgatgcacctgtagctttgtcaatctctccaggagtagtgacttcgtcaatctctccaggatttgccggcgttgtgcttttagttgtaggcgacgtacccgtcgacagcgatgcacctgtagcttcgtcaatctctccaggatttgccggcccagtcttcctgtagtgacttcgtcaatctctccataatttgtcggcccagtcttcaaagatgctcataggggtgagtgtgcgtgagttgcgtcaatctctccaggatttaccggcccagtctttaaagatgttcataggggtgagtgcgcgtgagttgtgagtgtctgcagtacgtagcgtttagtttatatcaggacaaattcttttttttttcttatgccggagcggttggccgtttggaaaaacgatatttgaccgttggaaaaccgttttttcagtagtacgttagacgtataacttagtggattatacggaatataagacaattactaatgtttttgatgatgaagatacttatttgagttgtacactaagataaaattaatattagtggtaaatgttgtgttaaaaaaaaaaccatgataccatatgtagatgtccaaaacaacatattttaacaagggaatagattctcaattgtatttgactccgaatcccagaggctatcattgataaaaatacataatatataaaaccctgtttcatggatctttgtcatactcatgtaaaagttgaatcatcaatgtatacttgcaacagttctagagaattttcactttgttgcgggtggatagaacctctatctaaaattctgagctcccttatcacatataaatagttgatgtttagttatgacaagatttggtcaaacttttaaatatttcacaatcaatagcctttcaaatgactagttttttaaaaatgatatgcgcaatttttcctttaaaagtactacaattattgaaaaattactttagcatacgaaattgactgaaaattcccttggaccgaatcttgttaaaagtgtcaaatatctttcgactagagagagcaaacttagttaaaaaagtatacatcggtaaatatactggcagttaaaaaacttgcgaatgtaactataatgtaaatataatatactaaataataactacagtataatttagtttataacttttaaatagttaacttatgtactccctccatttcagattataagacgttttgaatttggtcaaagtcaaactactttaagtttgatcaacttcgtagaaaaaagtagtaatattttcaacccaagacaaatttattatgaaaatatattcaattattgatttgatgaaactaatttagtattataaatattactatatttgtctataaacttagtcaaacttaaaacaatttgactttgaccaaagtcaaaacgtcttataaccaacctgaaacagaggagcatgaaattacatatttctttatacaaatgcagtttttagaaattcttttttcatatcactatcttcccggagaggtagcagaaatgcgagaagagcccagccgccgagatgacgagggccaccgccgagaagctgtgcgccacccagaacctcgcattctcggcggcgagggtgctgctgctccttgctgcccgagcattctgccgccagccgacgaacgagccgtcgccgccgatgccgaggcttctctccactttgtgcctttcacgcatcgcctgatcatcgaaagatcacatgaacaattatttaatttcgccatgcattttgatatataagtacaagggatttctggttggtgatatattgacgatacagaaatctttatatttgcagaaggaattaattgatactgtatttgtggatggaggaattaataattactacatggtaaataaatctcccaaacagtttattgactagccattaatttgtacacctccattgtttgctcgttggtttatatatatcaactgtaatcaaaatttaaaatttgaaatgtaagagttgattttgaggggattttttatcacttattttttttcagctttagattttaaattttgttataagaaaataaatataaagtttttactcatagaatagttttggttgctatgtcaattttctaaccgcttatcggttgtagagcagggtgtgttcgttggagctggttcccaaccagcacagtacgcacggaaaacggagcgatctattagcgcgtgtattagctaatttttttttaaaaatggaataatatgatttttttaaacaactttcgtatagattttttttttaaaaaaaacgcatcgtttagcagtttgggaagcttgcgtgcggataacgagtcggagggagctgggaaccagccctttcaaatacacctgtgttcagcaggtgaggttgggaactcacctcccgcgcatgcaaaacagagtgacatattttcttatgattaattaagtatttactaattttttttgaaaaatagattaatatgatttttaaagtaacttttgtatagaattttttttttttgcaaaacatacaccgaatatgaatatggaggaagtaataagtactccatccgtcccaaaatataagtattttagcacagtgacaagtcaaatatttttaacttttactattaataaaaaaaataaaaaagatcaataatgtaaattgatgttactagatttgtcattaaacaaactattataatatacaacttttttttattcaaaacattttatttttatagatattgttgatcaaagtagtatctcgaaaaccgtgtcagagcttaaaattgttatattctaggagggagtactaattaaagactgtatgttaaccgtggtgttattgtttaaaactggcatgctgcgtgcgcccttttagctttgcgaaaatgtttctagaacctacaggtctgtaatatttaacgcgtggtcaatgctcactgagtcactgtcgattgattattatttataattcaattataatatttatggccccgttcgaaaccacataggatgtgattaaggttagacatgaaaaaaaattagtgcctgattaatttaattattaaaacttgaaaataattttattaaattttttattttaaaaaatttctatatagaaagttttcgtacgaaacatgctaataaaaacttttgtaaaacttagagtgaagtgcatgagcggtccttaaacttgtacgagtgtgtcatctagatccatagaccctaaaaatacatttgcgtctccaaacttttgttggctgtcatatctaaatgggttccaacccgttccatgcgatgatgtgacatgccatggtgtcgcctacgtgttagtcggaccacatgtgagtcacatagaataaaataaaaacatattttctcttctttatcttagaattattttttaaaattttattttttcctctctttataagaggataaaatatggtttttaattttatttatatatatgagtaatatatgggttcaactaacacttatgcatcaccgtagcttttccacattagcgtatggagcgggttattagaaacccaaagacactaaagacaagtacgaaaacccaaaatattttattatagaagtttataaacctagattatatacccatataaatttaagtaccgcatatcgcatatgtacttggctccaaaatttatgtcttcgatctgaaaagaatgtacctcgagtgtcctaggggtgaagataagcaggttggcgaggtcgtacccagcggcgacgaggaggaccgcgagctgccggcgctcggccggcggccacggcgggcggtggagccacgcgaacgccgccgcggaggccgccgtgcacgccgcgttgagcgcgaagcacgccgggaacaccttcccccgcagcctgcccatcgcgtgcctcggcaagttccttaatcaatcaattaattaatccacgtgagcacaatgattaattaaactaataaagcagggttaatctctcttactgattaattaatcaatccacgtgaaagacgacgattaattaaactaataaagcagcgttaatctcccccctaattagttattctctctgtctcatctctatctctactattataaaaattaaagatgtttttactagtattttggtacgccatctgtgtattagtcggttttaagttcgtttgcttttggaaatccatatccatattgtggtttttaagatcgttcactttttttaagatcgttcacttttgatagtacagaaggaatcatataagaaatctgtttgataaaactcgcatgctaacttaagacgatcggatcctatttgcagctcatgactttctaaaaatatatatatgtaagcgaactcacacagtgaattttcatcttaactaaaccatataacaataataagattaaattaggcttcatccgttgctacgcacgggtattttttatagtaatatataaaattttcgaaggatataatacatttaatactacgaatctggaaattaaacagaatatacaaatctctccaaaataagaaacgcccagcggttttcgccagttccacaagatggttgactaaccggctagtctgagtttgaggtctcaatcctttctatttgatattagttcattctctagtattcgtggtttctatatatctctttaaaaaaatttaaattataagacggaggaaatacattgaagctgcagggagaaaatgtgtagtacaggaacatgatgacgccgccgacgaggatggcccagacggtgacgccccaggaggtggcgaagcagaggaggtgcaccgccttcgccgccgccgccgccgtcatgccgagaccagcgccgccggcgaggaggaagaagacggcgagcagcagcagcagcatttccgaccaccgtactgaatgcacgtaaataataggcaccgagctggttgatcggcttacagataggagaggcaaactcgggaggcttacagatatgtttttataggccccgttctttggttgaatgaagtaaaaattaaaagaccaatttttgcgactatagtgcaaattaatgccattattataaacacaagattatgagttagcacaagattatgagtttttagaagatactccttccgtcctattttttaagtacagccataagttttcgtgtacaattttaacagttcgttttatttaaaaaagttgacaaaaattaaaaacataagtcacacataaagtattattcatgttttattatctaataacaataaaaatactaatcataaaaacatttcaaataagacggacgatcaaagttggatacgaaaaatcatgactacgtttaaaatgagatggagggagaatatgtttttttctagaaaatatgttatacaaatagctacaggcaatcagcaataatagtttttaattacacgcacgtcacgcacacactacagataactaacatcttcagttgagacagcgatgatatgaatgtgactagttggtggtctataactaataggaatggacgaattaaacatacagtaaatagtttttaaaaataaatttaactagctgatcatatatattccccgaggaaaaaaattaagttccaaaaaaaagtgatgtctatcgttccacaaaaattaagttccaaaaattaagtttggagctaagattcgtggagttgtataaatatgttgtataagtgttgtcaaattttttcataatcatttttaagcaaacgagggaacatctcctcaagatcaaaatagtttcccaattccatatactctgtttaacagaccttgagcatagtatgtcaccaacctaattgatcaaaagtaaatataaaattacctagtcataactaacatagtcatttactaggaaaattagagccccatcgtttggcctaaacagccaaagaataagccaaaatttgaatttttgaacttgattttgaagttgattttgagatgcttttaacataatttttgttagtgttggcttttaagtcgctacgaacaaatctataaaagttttacttataaattaatttttattttctaataagccattaggcaaaataggcaaccgatgggagccttactgatgtaatggggctgcacccattgaattggggatttgggtagtagccgtccctgttctagaataaataaaaattctagtcctcctccccatccctagggtgccattttttttctttgttgtcggctccatgcaggtacaagaggcaaaagaaagtctgggaggcacgcaacaagccaacagtagagctaatatggggctaaaaacttttaagtctctatcacatcagatgtttggatactaattataaatattaaaaatagactattaataaaacctatccataatcttggactaattcgcgagacgaatctattgagcctaattaatatatgattagcctatgtgatgctacagtaaacattctctaattatggattaattaggcttaaaaatttatgtcgcgaattagcttttatttatataattagtgtctaaatatagagactaaagttaagtccctatatccaaacaccaccttaagttacgctgtcaccccaagggagcgagtaaggagcaatttgtgattatgcaatcggaggctatagctagttttcggtgtatatatacatatatacagtgcgcctaggaagtagggtttatccggtccaaaacagtttgtctgaatgaaaggtcttacgagggaaccaagccatgagggtcgctatttccggttttttccagtatagttccgagtgttcgttgtatataggcaaaatttgacttcagacactgaaaaattgtgtaattagctgtgagacacccgaaagacgtgaatttacccgagggctctaaaagtgtggtaatttgctgcagaacactggacgcattaaaatataatatccactgaattgataagagataaatcatataaaatgacagttttgccccttctcttcttccctctctattttcttgtcctttttctctcattgacacaccctctctctacttctttctcgcacgaaggcagcacagcagggcgcagcagcgcgtgagatcgaatgctgattggcgcttgcgtgggttcaagtgcttggcgtccttgtcattatcgtcgcccacgccgccgcccatgtcgccgcaagagatgacgtcgaggtcgtcgctcctggaccgacccaccttgttctccacctccgacgcatccctcgccttcgtgcatcctcctccaccgccgctatcccgggctactaccgcgtccgcttgcctccgagcgaggaggacccgccacagccacgccctcctccccaccgctcccgcaccgcgtggcatacggttgatgagcccggcgacagcggcttcgatggcggcaatggtgacggaggtggctgcggccaggcagtggcggcgtcgatgacagtcggcgagcgcggcggcagcggcttcgacggtggcaaatggcgagaggcgctgagggcaattttgtctttttgaaatttctctctcatcttttttatcagaaatgatacaatattatctcaggtgtcttacagcaaattacatgaattttgtggtgtccatcagcaatgacacgattttacggtgtctcacggccaactacacaattttttggtgtcccagggcaaattttgcattgtatatattatgccaaacatgaattttcagcacctctcaaatctacaacgctgtagccccatcatcaattattagaggtccagaaagttgagaacaacacaaacttctgtgttttagtgttttcgttttcaatttgtacagtcatacttcacagctaacacgcaaaacaaaaaatacactcaactttttcttagcttatggcttgtctttgccggtattcacaacatcaaaacagtgacctttttactaagtctgtgattcacgcaaaattaccagaacatgtgaaagtgttcaaaggaatttaccaattgatttgcagaggggaaagctaatccatatcattttgaaattcaatccatgatactgagttttaatatctcgtaggcgtcggcaaggtaaaaatacttcatctggaaacaatattcaacatagagaaacataagcttttgttaccacgattatatgcaactgaaataagaaaaataaattgagaaagtatcaccaaaagtctaaaacgattatgtgcagatactgtgttgatctaatgtaccttaacaaagacgagatctcacgtgaccttcaattggtttggtacccatacatggacggtgcataactaacaggatatggcaaattaaacatacattcaacaagttaaaaaaaaaacattcaacaagctgacgatatgcagctctaattgtcactgttctttcaatctcaattcaaaaaatatatagctggcaaatatttctctctctctctctccagatgtcactttgttcttggcagttggcacaagtaacttttagcatatctcaaatctacaacactgtagccggttagccacatcaccatgatgcgaaataatcactccaccgataatgttgctagatgtttacatataaacagcagcaacaaatgtacgcgcatgtgtggatcagtgttcttcacctccagaacacagaaatctaaaatttataatagagaactcaatatcaggaggaggcagctctttacttcatgtgatcattaacatgaaaggaaattcctttaggtttggactttggaactagtgtgaagggattagagcactgataatctctaacttgacagtgagctttgaaacagccaagaaccactggtcctcagcaagggaggaaccactcagctttttgtttctgtatggtatttgtttcccaagagaaaagcattgcacgtataccgttcataagccaactgccctgtaaaaacaataaaaaccaattagtaaaccaaaacaaatggttcaggaagttgagaacaatacaggactaatgaatgcaacaacaaatcaggactggaggaccactgtacctatcgaacctacaatgtcagaatgtacaaaagagcaatatcaagctgaaatccctgctgctttccagtccatgtgagtataaaagcatcattgtttccttcccagccaaattctgtgagcaagttctcaaagttcattggaatgcttagttggtgttacatctttagtgggggcatgttggtagactactgatcgtgatacactgattttttccagtgactattttctgttcacaattattttaaaccaaaatctttttgaatgttttcgctttcaatttgtatgatgatgcttcacagctaatcaaatacaaggaaaattacaaatgcagttaagtttttcttagcttatgtcttgtctttagcagtattcacaagatcaaaaatagtgaactttttatgaagcctatgatgcaccaaagttaccagaacatgtgaaagtgttaaaaggaatgcaccgatttgttctgcaattgtttcctgagtagaaagcttaaatccatataatttttgaaattccatcgatgccatagagcttaatatctctatggcgttggaaggtacaaatccttcatctggaaacaatattcaacatagagaaacataagcttttgttaccacgattaggtgcgattgaaataagaaacagagtgttgagaaaatattgcgacaacagattatgtgaagcaattattgaggtgttgatctaatgtaccttaagcaaagatgaggctgttttgcacctttcactgaggatagggcatcattcatgtgtaaattagcatgcagtcaatagatcacacttcacgcattgacaacttgaacagcaacttcagactctatgctctgattagagccacaactcgactgagcatttctactgaggtatttatccattaactctcctgcctcactgaattgacccatttttgcaagtgcagcaacaattggccaatatgattgattattgctcgtgctgcagccactgcgctcccttgcaaatagaatttctttggccttattgactctcctttcatcacatagagcttttatcagggaattgtatgtgtaactgtctggaaccacaccaaatctcaccatgtcattgaaaatatcttcagctttatctaccttcctcatccggcaaaaactcaagatgagggcattgaaggaatatgcatcaggagtaacgccatctattttcattttattaagaagatcaatagccttgttaacatgccctgctgaacaaagtgtgtgcattaatacattgtaagtctgagcatttggtctaacaccccactctgccatctcttcaaagcaaacaaaagcatcatccagttgatgggtattgcacaggccatcaataagagaggtaaatgtaatgatatctggcatgaaaccatgttccataagcatcttaagaacaacctttgcattatgtacattccctaattttgaatatccacttattagtgtgttaaaggtgacaaggttaggcaagaaacctttgtcttgcatctccttgacaatctcctctgctttatcaactgccccggccttcacgaagcaatctatcaccatgttgtaagacatcacactagacaagagtccctttaaaaccatgtgccccaaatagtggtttgccttcgaaaaattcttgcagttcagcaaggatttgattaccataatatatacatcaaatcctggattcccgccattcttaatgaaagaatctagtaactcacatagatcactcacctccaggcatttcagagcacaagacatgacaatgccaaatgctgtgctgtcaaggagataacccctagcactcatcctcttctcaaactcaactgcctctttggccatgtccttcttcgacaggcaatacagcatcgtgtggcatgcgctcgggtgaagggacgtctcatggcctagccaatcactcaacatcctgtatgccttgtctctctccaagcagcgaaacacgccatgaaccagtgtcctgtaagtggcctcgctcggcgccacgcccttctccttcatcttgtccagcatacggaacgcctcctccaccctgccggcattgcagaacccgtccaccagcatggtgtacgtgaacacgttcggcctgatcccctccccctccatctgcctcaccagccggaccgcctcatcgacgatcccgcgccggcacacgccgtggacgagcgagttgtacgtgaagtggtcgggccggcacccgtcggcgggcatctgctggaacctgaggtacgcggtgtcgacggcccccgccctcaccgacgccgcgatcagcgcgttgtacaccgccgtgctgggcctcagacccagccgcggcatttgcacgaacacctcgtgcgcgtagcgtgcgagccccagcctgccccagctctccaccagcgcgcacaccagctcctccgacacctcgcacccgcaacccctcacctccgccaccagcctccccgacagcaccaccggcccgcgccgccacagcgcgcccacgagcgcccgccgcacgccgccgtcgcgcgcgaagtgggcgccgaaccgcgacgcccacacgtagagccgcacgcagagcagcggctcccccaacccctccctctccgccgccgcacgaagcgcgcggacgacgaagcgggggccgaggcgggggagcgcggcggcgaactcggcgttgagacgggggaaccagtcatcctcggccaagatcgaggcggcgcgggcagggtcggcggggtccggtgggttcgcggcggatttggtggagaggctggatctcggtggggtttcggggcggcgatttgcgccggagaggcggcggcagcggcggcggcggaggaggaggagattggggtgatggatgctcctcatttgcggtttgcatccaacaaaaatcgccgcctttctggtctgggtgttcactaatcactactgcctctctggctctctgaagcaaggagaagcaaggaggtagacctggccaaatgggccgtgccaagacgggccggcccgagcacggcagtactgtagccggcccaggcccggcacggcacgccagcctgtgggccgtgccggcacggcccgttatcctgtgccgtgtttgggccgatgcctcagcccgtgggctggcacggcacggcacgtttactgtagcgtgccggcacggcacggcccaggcatggcacggcccaccggcccatttatttttcctacgattttctaatttttcccatatatttctcatattttttatttttttccacattttatcctatttgtaccatatattttatgatatatttcctaaattttcctcacatttatcctatatttatcatttttttcctttatattatgttttttctgccttttttctttttttcccttcaaatttcaatttttatgggccacatgtactagtgggccggctaccagcccacgtgccactacagtagccgtgccggcccggcacggcccagcaccttcttgggccgtgcttgggccgtggccttggcacgtgggccggcacggcacggcccgctacaggagccgtgcctaacgggccgtgccctagtgggccgtgccgtcggcgtgccgtgccgtgctgggccgggccgcccgtttggcctgctatacaaggaggagcaagtaagtttttttttttttacattaaaatatatgacgccgttgacttttttccaacgtttgactatccgtcttatttaaaaaatttatataattataatatattttattatgacttgattgatatgaaatgttttttaagtatgacataaatattttcatatttgcataaaaattttgaataaaacgaatggtcaaatgttgcttaaaaagtcaacggcgtcatacattaaaatatggatgaagtattttctccatttcacaatgtaagtcattctaccatttcccatatttatattgatgttaatgaatctagattgatatatatatatctagattcattaacattaatatgaatgtgggaaatgctagaatgatttatattgtgaaatagagggagtacataataaaaaaatctaacttaaaaagagaaagaatgccaccctcctatcctagtacaacgaatttgaataaaatattctttagattcgttgtattgagtttttttttacaaaggaagtactgttttaggcaaagagtatactgtccatgaaaaacttagctgagtacacacttcatcccataataaatcaacttctagaaacgtatttttaggaagtattgattataagaaatactttagagaacgatatactccattccaactatataggataatcccaaaacgtcttattatataaaactatcataagaatataaagtgtttatctatattcataactaagagcttagtcggtttgaatgaaaaaccgatgattttggattcttaagaattaatttctagaagtgacatttaatttgtaggaatgatgtataggaaaaccaaaaaaaatcctcttggagagaaaacatatgaaattttttatccactcatgcgtgcatgtattcctattcttccattttttttcttattgttgtgggtcaaaaatcctcccaattaacaagcatataagggagtaatatggaatggatgattcggtcttttatgtatgccttagtgacaaatacagttatactcatcagtcatcacacgattttacttctattgaatggccttagcgtgatatcagtatatcacacgccatataggatcaattcatctatacattcataaggcatgacaattagatatttagatagcctatttagtttacatgcagtgtatagtgtggctttgcactcctctctcctcttatatatacacacatttttttttgttaaaaatgatataaataatgtttctctgtgccatcttttcttccaactatgaaaagggtgagatattgaagtgaaccaatgttataaaaatgtttattccaacaaacggactatatatgatttaaggtttaggagatatggagcagatagatattcatacagcgagatagaatgacttcattcagtgtcatttagtgtcgttcagtgtgattagttattttactatgtattcgatccaataactcatcgggcactacaagaagcaggtcatgaagaaaaggttcatttcatacatcgtaaccaagttagcttcacagcatcaaacctaagtagaggaatatcacaactctagtatatgattgatgtgagatgatgggtatgaagtattatattgtttttcgttatcactacgagaatgatgctataagttataagtgctatgaaacaaaacactataaggcttaatataattgtgatgtccattttcagtgacaatacatgtcaaattttataaacaagagtaaatttgacaaaactatatgaatgttgatcaaactatcacaaaactatatatgtaaaatgatgtatcacaaaactacatacttaacatcaaatttatcataaaagtacagatttaaggccaaattaaagcatcacaaaagtacagatgtgataatattaaatttgtcgcaaaactacagattttagaattcaaatccctagcaccattgttatgttggagctataagtgttgtaattttgtgactaaattgtttctaaatatacagttttgtgataattttggtactaaaatataattttgtgacactccgtcttgaatgtgtagttttgtggtaaatttgattttaaatttatagttttgtgatagttttattattaaatattccctccgtttcaaaatgtttgac

SEQ ID NO: 47764 - DNA, 23739 bp, Oryza sativa
tatttttagttaattattatttttccatatctatatgcacgtgtctggtcataaaaccaaaaatatttgtgaatcctctttagagaaggataacatttcttactattagcttattttaaaaccaatatatataatagattaactataaagttggctataatatatttcttctctctctatctctcatttatatatttaatatatttgtcttgtagcttgtgataagctaactcttgaatgagagtcaatacccttaaattttttgggttcatctcagcatggaaattgttttgcatcccttggtaacaaatgaatggtatatacagtatgtgcagtagtacttttttattatttttattttttttaacgttttcccgtctcttgggctagtggcccgactctctcatccctccggcttccggaatccccaccgccgaacgcacgatttcttcccgacgctgtcacttgctctccccccacatcggcggcggcggaggcgcggcggttggcgtcctgcggctgcggagcgagcggagaagccaaggtcgtgtgttgggtgaactcccagcctcggccgctcatcggggagggcactgctgcacaagggaagcggtttcttggttggggtttagtgtctgcattggatatgagtcacgggttcttggttagattctgaagaggttcttggttagattctgcgcatgatccaaattccgtagaaggataaacagattcgttgagtggcaaagaagaggtggtaagcagatgggtgtggtgacaaggggcaagaagaggaggctggatgatgaatccagcaacccacaactggcgcctcgaggaggagaagacctgataagccgcctcccggacgatatcctcaccggcatcatcaccctcctccctaccaaggacggcgcctgcacacagatgctctcgcggcagtggcgccctctctggcaatctgcgcctctcaatcttgaggccagggtcaatggctgcacgttgggaaaggatgtggccaccatctacagcacgctgctaacccacagtggtccggtccgtcgattctccctcagctagggatgtgacgactgtaatggtcactttcccgtcgccgattccattgttggatcccccaggctcgaccacctccaggagtttgaactgttctatgatagcgttggcgttcaaaatcctccggttccaccgtcggtactccgtctatcttctactctccgtgttctcaggattctttcaacgtgtgacacacttcagtttcccatggagactgcttgcacgctcgatttcccacacctcaaggagctcaccttatcccaagtcaacattgcagatagcattctccatggtattctttcacgatgcattgtcttggagagcttggtgctggatgcgaacaggggttgtagtcgtctccgtatcagctccttgacccttcaaagccttggtgtgtcagatacttatttctctgtagagggaatgctggaggaagtcattatcgaggatgccccgctcctggaaaggcttacaccaccagttatatggcatgaaggctttgttattcgggttattcaggcaccaaaactgaagacattgggttatctaagccagaaaatttccacacttcagcttggaaacatggttttccaggtagcttcatacacatatactgcaggcatttctttctcttgatatgttatttcttcacaacatttcattcaccatatctatttcagaaactggtgcctgttagtctgtccaatgtgatgcgcgctatgaaaattttagcccttcacaccgctcctgatctggatgttgttattgacttcctaaaattctttccgtgcgtggagaagctatacatcgtggtgagagttttttctttgttaaattcagtgagtacacactcattttgttctattgtgccatgccatcggccctcttcttgaatctatggttatatcatgtttctttcaactctcttttctccttgttaggcattaaatcagggaaacttcaagaatgtacggcgatatgtttcacttgagtgccttgatctacatctcaagatggtggaatttattaactatcatggaaacttatcagatttgaacttcatcaagttcttcgtgttaaatgctcaagtgctagaatgtataaagtttgtagcctgtcgtgacaaatgtgatgcaaaatggattaaaacacaacatcagaggctacaactttattccagagcttcacgaggcgttacacttgattttcaagctgattatggggtggatagtttggtacacgtgaagcacatcagtgatttgattacagatgatccctttgatagatcgttctgtagatgccgtgatgaggaaatatgaattcctttgaagctgtttatcagttgtatactttggtaagtttgaagcgcatttttagtttacacgcctaaaatttattattttggcatattttgttgcaagcctggaatatttattgtgccaaagaaggtgaatgacattgatctattttagtttcattcctctttctgtgtggtatgactctgtgttcctctcctattgtacacaaaactaggctaggttggtgttgttattgtagttttaattccactctgagctacatcattcattcttgtttttagtacctcattttggcatcaatgcagtctcacaatttcattagaattttggtttctgttttgaggtttttcgtcactggtttaatgctgtcagaatattgttttatgtgctgtcagaatatcgatattggttcatgaactttacgcaagtgccggtttgatacacactatattttcacctcaaatggatacaaacaagttgtaagtaactgagttatattagcaaatttgaatggtcaagaaataatagatatttacttttaatttggttttgtcatggaacatttatgtaacgacctagtccaatggcagtaagcacggaaggagattctgaatattgaatccattgtaagccaagcatcaacattgttatttttattgttttctttttgtgccacacggggctttagtgagacttcagttttaagttaagatattcgtctgtaagtttgagattccctttatagaggattgatgaagacactcgatctaaggcctctgcattctttaccaccgaattatgaaagcaatcctctcaactgtactatttgtgtatgtaccagtagtaagattgcaaatttgtcttgttttcatgctatgtgtggtacttgaaagacctaattgcagtattattctacttgcaggtgtatggtcatattgtcatattgatattgccaggcagaaaagactgctactgctacggagacaaccgagtgctgttttgtattctgttagacccaaggccaccttttggacaattcactggggatttaagttgtgacattattgtactctatatatagtaagtaagtaagtttgtgttttctctcaaatcctgtggccatgctaggactcatgtttagactgggaataaccacttaatgatcagtagtgggtagttttaagttgcttttatggacaacttagtgtatgaatctgatggattagtgcgttaaatactatcggttcaacgaaaacggtaacctccttggtatgatgggattaggattggtgacttgcaaaagatgaatgtttatgctccttggtatgatgggattaggcattggtgagttgcaaaagatgaatgtttatactgttctaacttgcaaaaggaaaaatcctcctagatttcctaacctgcattttggatcatgtgcgtgtagcatattaggaatttccgtgatattatttggtaagcggtaggccagtttaagaaaaggaaactagaaaaatatatcctgtgcattgctgtggtaattacagttagacatgtctaaagaaaaaaaaaactaacgcatgaacagatttatttttcatgatctatctctcctcttaattaggacccatctatgcaacccactatggatgctcttagtgcgtagtaattctatcagtgttgctgtcatattttgttcgcacgaacacagttcaaatatcaatccatttcgagatccaaagaaaagaaaccaggagctaggtataaacgaataaaacatttctcgtgacgcttcaatcctaatgaaattattgttgaccacaggtagagtcctcaattttttttcccgaatgttactcgataaataaggagtttccccgaaacagaatcatctagatctgttacttgataaataaggagttaaggagttaagctagctgcatgctttttcattccttaaatcatatgacatccttgttccctcacacaatatatataaacctcgttcttgttatatatgcttgtctccatgatcagttcgttgcacattcaaaaacgcatgatgactatatatattggtttattacgcatgatgactatatatcggtttattgcttcaaaaactcatgatgactatatatatcggtttattgctatgatacatgtgatttcttgataggtaaacatcatatttagcactacgatgagatattggagaggtaggatgagatattggagaggaggtcatcatatttagcactacgatgagatattggagaggtaggatgagatattggagaggaggttaccaatagatattggagaggagggtaccaacaagctttatttaacagtaggatgctatgtttatttaacagtaggatgataaacagtaggatgctatgtttatttaacagtaggatgatatgaaatattggagagagataatggagggaggtagtaggagatatgagatattggagagaagtaggatgatatgaaatattggagagagataatggagggaggtagtaggagatatgagatattggagagaggcaaagcaatgcccgcatacaatgtgaattataccgacattcattttgtttgatgttcttgcagatgcggtgccgcatataatgtgaattataccggcaatcattttgtttgatgttcttgggtatgcggtgataaaattactgtcgtttgatcctttgatagattatattatgataagttctgtattgattataagtaagaaaagtataaacaattgtacatatatgctgaaaatcaccccaaagagaaatgtccaccaacctttatatattttctctaaatttgtgaaaaatgactcaaatttgtgaaaaatgattctaatgtgaaatctagacaagatatgtgatatagtctctctcccttcatgaaaatttatactcagactgtatctaaataaacgtatcgtattagtacgagaagaactgaaaaacatattattacgagaagtatctaaatcaatgtatcgtattagtacgagaagaactgaaaaacatattattacgagaagaaagaagaaatgaaaaacatattattacgagaagaaacaagtacgagaagaatgaaaaacatttctaaaagaaccaacccacgagagaaaagagaagtaacccatgagagagaagaactgaaaaacatttctaaaaaaacatttataaaagaaccaacccacgagagaaaagataagagataaggaagaaaagagtatccaacaatggagaaaagataagagataaggaagaaaagagtatccaacaatggagaatttgttattcatttacagatattatttaatccattgatccatatatgttctaccgtacttgcttttctaagagaatctgtaccatctttaaactcaaaggttaatttgatccgtgtcattgcaaatgtatctattctgatgaatagcataacaattcgtctatttgtagccgtgccacttaaattttacaaaattggaaccataccatcgttgtcacattttctatcttcttccccatattgcacgtaggacccaccagtcagattccatcttcttcctcatcctcccttatcttcttccttcgacgggaggagtggtggggtacagtcggtgcggccgcgcccacatgtgcgggctcccccaacggacagccaacacgggcccccaacggcggcgcgggtcgtcaacggcgcggaggaagcgctcggccttaggggtgaggtgagcccacaggagtggctggaccgacccgttcgggctatggaggcaccggagcgcctgcacgcgttctagcaagtggcagagttggtgcccatcgcgcatgcgcgggggcggccgtcggcagcgcgcccccctcttgctttgttgtgtctccactcttcatccacgtcgcgttcatcgagactgcctccggctcagatgcctcatgctcctgctccaaccccaagcctcagaagaggccgacccggactcctcgcctccacggcagcgatgggacggcaccagccaaggggaggacctcagcgggaaccgaggaggctgatgacagcagcgacgctaccttcacctctgacatgtatatgtcggggtcctcttgttcgaggtgcggtgatcgagataaatgcattgttatttctccgcatgcactgcttgtcatcggctcattgctgatttcatgtctacggctgttgttgcagctgttctatacgttcgagacgatggaggagaagatgcgagcaatggcgaacctaccgcagtgcgtcttgcctccacagttgttgctcaagtggcccaaggaagcatcattctgtcagttgttgatgcaccctgtgccggacacctgaccgaaggaagaaggtaaagaaggatgaggaagaagatgaatctgacgggtgggtcccccagtgcagatggagaagaagatggaaaacgtgatagcgatgacatggttctaattttgtaaaatttgagcgacacagctatgaatagacgaattttaatggtatttatttgaataggcacatttacagacatggatcaaattaaccctaaactcaaactgtttagatctagtaagtcagagtgttttttcactctgaggatgcatgacacctgtccgggatatacatccggcagtccaagaacatagatgacgatggtaaagcttaaaaattataatgagtgtacaaattaaaagatgcgatttctttgtacataggttagacaacaagcatgcagtagaatatttacagagggcacaaccaaattgatcgacacaaatttgtatcgtacacccgcccactaacatatatgagaagaacgatgatcgacacaaatttgtatcgcacaccagcccactaacatatatgagaaaccatgtttccggtctcagtggcgcagctagggggccagagggtgccaacacccccctatccaaacaccaccacctagtttttactctatattaaagttaactaagataggtatttatctagtttatttgtatagcttgaaagtattatcagtttagttagttagcaagtctataaatattagcaagaaacatgatctataaaattagtttgtgatttctcatctttttcaaagtaaaatagataatacttatttgtgagattgttcaatagtttacattgaaagaatttagcaataaaaactagtttcaaactttcaatgatattattaaagagctaaaattcaagtttattttaaaggactagtttacgtattgattgttattgatggttactatttgacctcatttgctatcaatattagttattcggtatcatggcttatgctcaccccacacccccctattcttaaatcctggcttcgcccctgtctggtctaccaacttatcagaattactataacgtatatgcattttcagcgcacttttttttcataaatgaaagttttcttactttcatataaaagttctttgatgaaaggctttcacataaaatttttcggacgaagtgtgtgctagggataaacctacgctaaacagtagtaccccagcttattattggccacttcataagtttacgaagtttttttttaaaaaaaacaatggtttactgatagtagaaagcatggcgcatcaagcctcacacaaaaatctgatactcctagttcccaacggtaggctataccgcccacagacatcaggtcttgggcatcatgcacgaattaatataagtatgctttcggtggtacttcctccattttataatataagtcattctaaaattactcatattcatatatatgttaatgaatctagacatagtctaaatgtggacaatgctagaatgacttatattataaaacggagggagtagcaatcaaagtcagtgacaaattttgatagtaccaacccactaacacaataactctactggtgtagtggtgtggttctcaacttatcatcacatacatatagaatatacgttcactttgccatcttattgtgattcatcatgcatgaaattaattagatactagaggaagccaaaaccatatccatatgtcctacattaatgattttgccaattacaagccatgagaaatatactaggggcggaaattttatgagatcatgtaggatcccctttgatgttcacttgatattaaaagaaaggatatgataacgtttgagctgctaatcatgttaacagatgatattttgatgatgtatagctcaatcgcttatttaaattaaacagggtgtacggagagagagtatctatgctcctttcaaaaactttagtttatgtaaattgacccatgatattttctgatattacgtaattaatagtcaaatatttggttcagtcaaataaatagcataagatatttttaggcgaagttccatttcacctaaaatggaaaaaaatggtatttcaaccagtcgacatcgtttgaaagtggcatttcaaggaaaccacactgtgaagtggcattcgagcaaaacccaatctcgaagatggcaaaaatatcaattttctcctctctaaagtaaggagtaaagtaattatttttactattaattactccgtaatcaatatagacaatgggcttagttactgccttagaccaggagtatattgttcatgaaaaattatcctttgtttataagaaataactacctccatctcaaaatatatcaacctagagctggatcggacatattctagtccaacgaatctggatagccccttgtccattggactaggatatatcatctctagtcctaaattgctatattttagaacggagggagtactagacaacgatactccatttcaacaatatatgataatccaaaatgtcttatcataataatatgaaacagagatgattctttcttttatgtaggagtatatcttagtgacctttacgagaaactagcatttggctcttgcgttgcaccgagattttgattaaagaaattatcattaatccactatatcatctgtgtgctgcatatatttgttaatagtatgcgaatcctttagcctcaaaatatgttccttttgcttaaaaaaagagtttggtggggtcgatcgattgacacgcagaccctctagcatccagtccctttttcgtgaaaataaagcaaaaagttgataatggagtggcatgccaccctcttttaatagagatatcaggtatagaaaatatagctttactcatcacacaattttccttctattcaatggcctttctttcacacaagatgagcccactatcacacgccatataggatcaattcatccctacattcataaggcatgagaattatatatgtatgcatgcagtgtattggcgggtggttttgcactcctcactcccttatatatacacacatttttgttaggtaaatgatatgaacccatgtttcccaatgctatctttttgatttaacgatgacaaaaaaaaagagatattgaagtgaaccaatgttatcggtaacgctattccgcgctgtattagttcgagtgccgcacagcgtcctctgtttttcccttttttaccacctcatctttcctatgcatcccaccttttctcagttcgtttttttcattttttaccacttcaccttccgtgtttcttcttttccatctcattctttcttcatcaatgggcccaataaaatatcaaccatccagatttttctatttttcgttccttctatatagtttttctgttttcgcggttttagtaccgtctagtttttctttctgagttttctgttttttatctccgcacgtttcagaataacaaatttactcgtttttcatttactcccagcctcccacatttcctcattcagaagtaacaaatttattctcattcagaagtaacaaatttaatcgcatggatacctccacatcgtatgacgccatgtcgtaaaaaaaatactattaccttacaacactagtaattcttttaccaatattataaatattgtttagatttcgtggtctgtaagtaaaacaattactaccttcctctcgatatagcgcatgatctcgtagccaccgtgtagtattatgtttactgatgtgttcaatacataatataagagtaaaaactgagatttcgtggtctgcgaataaaacaattaccaccttcctctcgatatagccatgatctcgtagtcaccgtgtaataatatgtttactgatgtgttcaatacacaatataagagttaaaattgatactaagagtattgttgatctgtatcacaaaatagtcatatgaatgaaaaaattacaggctcaatcacacacaatcaataaaattactcacaggtgaatcaaactagaaaaaaaaatgattcagtcaaaaatccatttggtggctttattggatcttgctataaagatgaagagcacagtctgtgtcttgtgattggtagtggagagggcaactaggtggcaagcagtagtcggccatggaattatggaaggatgtagtggtgtggtatagagatgagctcgacgttgcacagtattagccatccatcatctagcaagcacgaaaaaaaatacaaaaacattctcgttcatgtcaatagagatgacgagtaaaacaaaaatagtaaacaacatccatcaccggcggactccaccctatcctctgcgcccagccacatggagcacgatgtgcaaatgtaggacctgtgcagcccatcaattgagatcaggtaacattggagattgcacgttaatttgatttgcaaaaaagaaaaaaaaatttgggcttcatgcgtgaagttgaaggagagtatgcagatgcaaatcagagtgtcattttcttacttgcttgttctatcaatgttggcgatgtggagcagccgctggttgttgctattggcctaggtaaacacctccttgctggttaaggtgctgcccagcgtccggcaacgaggcccgaagcagtgctttcacctcaaccgccaccggccaccgccatcaaccgccacggtgttgtcgtcctcctccatggtgtgtcgccgatctgtgggctggggtggtggatcgattcagatccgaaaaaaaggaaaaaaatgaagtgggggcgagagtggttggttgggtatgggaaaaatagaatttataccggaagcagagaagttgtttttatcgaagtaaatcatttactccgataatggtgggagcatgtggggttggatcggaagcagggagttgtttttattatcgaagtaaatcatttacttgaataaaggtgggtggttgaggcgcgcgatacgagtaaatcgtttactccgactttggtaggagtgggatgacaggatgtggggtggggcgggcctgggttgatgcatgtttgacgcttggaatattaggagcacgctgcgctcctactagtagttctaccaatggtatataaatatttattctaataaactagactttgatttaagatttaggagatatgcaggagataggctatctgcatgaattatgatgggtttatgggctctaaattaaccaattatgaagaagaaatctattccatacatagtaaccatttggagtcacacacaagtagaaaaatatcatatgcacatcaacagtctatatgacatgagagatgatgtagaccaaacagtgaagaactaactatcaagttaacaagtctacatgacatgagagatgatgtagactaaacagtgaagaactaactatcaagttgtgccattgtcactttgattcttacagctactgtggttttgttgttgttattttctttcccacaatgtgataaaacactgttgatactaagcgctataaaataaagcttaatataaaagtggtgtccacatcgttatgtcaaattcttcgtaattcgataggtattgtacagacacaaaattagtaacatgggtaaaaataaacattttaggagaaaaaaatgttttgcttccgtgataataataataataataataataataataataataataataataataataataataataataataaacggtaagttacatttttctacgtttccatctatccgtgatcttctgggccagtgggctgaccactggaatccccaccgccgcacgcacgatttcattcccgaagctgtcgcttttctctcccctcatcggcggcggcagcggcggcggcggcggaggagcggcggtggtcgtcctgcggcgaaggtcgtgtgttgggtgaactcccagactcggccactcgtcgatcggtgatagggcaccgctgcaaaaggcaagcaattttctcgttagggtttgctccaaaccatctcgaatttcacatgtctatatggatcgagagacctttttttccactctaaatctactaccgcagaaatttgtttaatttgccccagttggcattcttgcatttccgaacctgcaggggtttacagtctagtgtctgcaatcacttcaacaaaattaaacaagtggttcttggttaggttctatgcctgatccaaactccgcagaaggattcaagatttgggtgcccaattttttttgttggatcacaagaaggaggtggtaaacagatgggtgtggtgacaagggccaagaagaggatgctggatgaggaatccagcaacccacaactggcgcccagaggaggagaagacttgataagccgcctcccggatgatatcctcatcagcatcctcctcagcaaggatgctgcccgcacacagatgctttcgcggcggtggcaactgctctagcaatcggcgcctctcaatcttgaggccatggtcgatagcagcacgatggggaaggacgtgaccaccatcgacaccgtgcttcaagcccacaggggccgtgttcgtcaattctccctcagctggacattggactacaaccacttcttcatcgtcgattacttgcttggatcccctcagctctgcaaactccaggagtttgaactgttctattttaatattgacgctcaaaatctgtggttccgctgtctgtattctgtctagcgcatactctatgtgttcttaggatttgttcaacgtgtgacacacttcagtttcccatggagactgattgcatgcccaatttcccacacctcaaggagctcaccctatccaacatcaacatcgtcgatggggagaggggaggggcagctcgcggtgggaggagcggcgttgccggtggggagtgcgggaggggcagcacgcggtgggaggagcagtgttgccggtggggagagaggaggggcaccaccggtaggagagagaggtggcctgcggtggagggagggaggggaaaaatgaattagggttatggattttttttgccccggcggttttgatggattcagaaacgatctgagccgtccataaaaacgaacagctcagatcgatcccatgtcgggctagcctccattgtcgggccgcatcactgctgggccgcgcacacttcatgggccacgcgtgggccgacggtccaacaaaacacttaggttagacattcggttggagaccacacaacagtgaaaggagaagtaggaggagcccaattagacttcatgttgggctgaacgctttcttgcgggctgaggcggaggaaggagaaggggaaagcgggccgactcaattgcgggctaaagaataaaatgggctgaaaaaggctcagagagaaaggatgatttttatttaaataaatgctgaaataatgtttgtattatcaaaattagcaattaagctatggaaattccaataaaattccaaagagcataattaatcatggagaatttaataaaattaaatccaaccatatcattttatttctcacacttactttacttgtaaactaatttaattatacacctacctacttaaaaaatacccaaatatttcagaaaatttgtatttcaattaattacataatgtaaatctttctcaacttttcctcaattttctggtatttacatttctcgttgcaatgcacgggtacttttgctagtacgtagaataacatatataattcctttctctatccgtttatctcatgacgcaactcaaacaaaggatccaaaatgatccagatatgttctctccgagagtcctgtcctttgcatatcatgcagtattatgctaggattggttgagagaacgtgtgcagtgtgtaacaccaccggtcctagctcgatgtctcctattaggacccttctaattaaatgcaacccactatggtcgctcttagggagtagtaattaaatcagtgttgctgtcatattttgttagcacgaacacacatttcaaatatcaatccaattcgagatccaaagaaaataagaaaccgggagctaggtataaacgaataaaacatttctcgtgacgcttcaatcctaatgaaattgttgttgacaacaggtagagtcctctaaatttttttcgccgaaacagaatcatctagatctgttactcgataaataaggagttgagctagccgcatgctttttcattccttaaatcatatgacatccttgttccctcacacaatatatacaagcctcgttcttgttatatatgcatgtatccatgatcagttcgttgcacattcaaaaactcataatgactatatatcggtttattgcttgaaaaactcatgatgactatatatttactgctatgatgtgatttcttgataggtaaacatacatctctctcattagagagaaaggagggtaccaacaagcctttatttagccggatatttagcactagatgagatattggagggaggtaggagatatgaaatattggagagaggcaaagtaggcaaagcaattgccgcatacaacgcgaactatatcgacaatcattttgtttgatgttcttggggatgtggtgacaaaattgccgtcgattgatcctttgatatattatattatagtaagttgtctattgattagaagtaagaaaagtataaacaattgtacatatatgctgaaaatcaacacaaagagaaatgtccaccaacatttttatattttctccaaatttatgaaaaatgactcaaaatttgtgaaaaattattcttatgtgaaatctagacaacacatatgatatagtctctcacccttcatgaaaatttatactcttatcagactgttactattatctaaattgatgtatctcattagtacgaagaactaaaaaatatttctaaaaccatgccaggaaagaaaagaacaagagcatccaacaacggagaatttgtttctcatttcatcctatgagttagagtttttcaccaaggatggtcaattataaaaacaaagaatattcattttgcagagattatttaatccattgatccatatatgttctaccgtacatgcttttttaagagaatccgcaccttctttaaactcaaaggttaatttgatccatgtcattgcaaatgtacctattcagatgaatgccataacaattcatctatttgtagccgtgccacttaaattttacaaaattggaaccgtatcatcgccgtcacattttctatcttcttccccatatgcacgtaggacccacccgttatattcatcttcttcctcatcctcatttatcttcttcctttgacgggaggagtggtggggtacagccggtgcagccgcgcccacacgtgcaggatcccccagccgacagcaacatgggccccgaacggcggcgcgggttgttgacggcgcggaggaagcgctcggccttgggggtgaggtgagcccgcaggagtggctggaccggcccgtctgggctatggaggcgccggagcgcctgcacgtgttctgctaggtggcagagttggtgcccattgtgcatgcgcaaggggtggccgtcggtagcacgcccccgtcctgctttgtcgtgtctccacccttcgtccacgttgcgttcattgagtccgcctccggctcggacgcctcaggctcctgctccaatcccaaggctcggaggaggcccacccggactcctcgactccatggcagcgacgggacggcaccagccaaggggaggacctcagcgggaagacgttaaaggaagatggtaaaggaggatgaagaagaagatgaatctgacgggtgggtccccagtgcagatggagaagaaggtggaaaacgtaatagcaatgacatggttctaattttgtaaaatttgagcgacatagctacgaatagatgaattataaagtcatttatctgaataggcacatttacaggcacggatcaaattaaccctaaactcaaactgttgagatgtagtaagtcggagtgttttttggttctgaggatgcatgttacctgtccgggatatacgtccggcagtccaagaacatagatgatgatggcgaagcttaaaaattataatgagtgtataaattaaaagatgtgatttctttgtaaataggttagacaacaagcatacagtaggatatttacagagggccaaattgatagacacaaatttgtatcgtacaccagcccactaatatatatgagaagaacaatgatcgacacaaatttgtatcgcacaccagcccactaacatatatgagaaacaatgtttccattctaccaacttatcgcaattgctatttaacgtatgtgtattttcagcgcactttttttttccataagtgaaagttttcttactttcatataaaagttctttgatgaaagctttcacataaaatatttcggacgaactttttgaagtgtgcgctaggaataaacctacgctaaacagtactagggtccccagcttattattggccacttcatacgtttactacgaagtttaaaagaaacactggtttactgcgcatgtagtttccaacggtaggctatactgctcacagacatcaggtcttgggcatcatgcacgaatataagtatgttttcggtggtagcaatcaaagtcatcaacatatataaatttttataaattttgatagacactatcccactaatacaataactctactactggtgtagtggtgtggttctcaacttatccttatataatatagaatatacgttcactttgccatcttattgtgattcatcatgcatgtaattaattagataagccaaaaccatatccatatgtcatacattaatgattttgccaattaattacaatctatgagaaatactccctccgtactcgtaaaggaagtcgttttggacagcgacatggtctccaaaatacaactttaacttcttgtttctataaaaatatttattaaaaagtgatatatgtatacttttacgaaagtatttttcaagacaaatctattcaaataatttttatatttttaaactcaacaacttaagagttattcatgatttatattcccaaggtttgacttaaacattatcctaaacgactttctttacgagtacagagggagtatattggggacggaaattttatgacatcatgtaggatcccctttggtgttcacttcatatttaaagaaaggatatgataacatttgagctgctaatcacattgttaacagatgattttgatgatgtatagcccaatcgcttatttaaattataaacggtgtgcacggagagagcatctatgtactcctttaaaaagctttagtgatggtggcagtaaatatgccacattttaatagtttatgtaaattgaaccatgatattatgtaatagtcaaatatttggttcagtcaaatgaatagcataagatatttttaggcgaagttccatttcacctaaaatgtaaaaaaatggtatttcaacaagtcggcattgtttgagagtggcatttcaaggaaaccactctatggagaggaattcgagcaaaacccagtatcgaagatggcaaaatatcagttttctcctctctaaagtaaggagtaaattaaagtattttttactattaattactccatagtccatatagacaatgggcttaattactgccttaggtaaggagtattttgttcatgaaaaacttatgctttgtttataagaaatagtacctccatatcaaaatatatcaacctataattggataagacatatcctagtccaacgaatctagacaacccctcgtccattggactaggatatgtcagatccaatcctaaattactttattttgggacggagggagtactagacaacgatacccatttcaacaatatatgataatccaaaatgtcttatcataataatatgaaacagagatgattctttcttttatgtaggagtatatcttagtgacctttacaataacttagcatttggcgcttgcgttgcaacgagattttgattaaagaaattatcattaatccactattgctatttttttttctgcatgtatcatctctgctgcatatatttgttaatacttaatagtatgtgaatcctttagcctcaaaatatgttctttttccttaaaaaagagttggtggccgggttgattgacatgtagaccctctagcctcctgtccgtttttcgtgaaaataaagcaaaaaagttgatgatggagtggcgtgccactctcttttaacagagatatcagatatagaaaacatagctagtattactcatcacataattttccttctattcaatggtctttctttcacacaagatgagcccattatcacacgccatataggatcaattcgtccctacattcagaaggcatgacaattatatatgtatgcattcagtgtataggcgagtggctttgcactcctcactcccttatatatacacacattttgttaggcaaatgatatgaatccatgtttccctgtaccatcttttgattcaacaatgaaaaaaaagagatattgaagtgagccaatgttatataaatatttaggactttgatttaagatgtagaagacatggagtagataggctatctaattaaattatgatgagtttatgggtgctaaattaacttattatgaaggaaaagtctattccatacatagtaacaaattagagtctcacagtagtagagaaatatcatatgcgtatcaaaatatctgatatgagagatgatacaaaaacaaaaaggaagaactgttatgtcattgtcactttgattctcatagcgtgatcgtgtcgttatcattttcattcccacaatgtgattaagatattacaattataataataattgtaataaatggtaagtgcagcagtgcaattttttacgtttccatctatccgttatgttctgggtcagtgggctgaccctcttccatcccgacgctgccgctttctctcccctcatcttcggcggcgacggcagcggagggcgcagcagtgggagaagccatggtcgtgtacgtgttgggtgaactcccaggctcgtcgatcggggaggacacgactgcaaaaggcaagcaaattttcttgttagggtttgctcctaaccatctctcgaatttcacatgtctatatgcatcgagagaattcaccccctaataccgcagaaattcgtttaatttgccctattttacattcttgcatttccaaacctgtaggagtttagggtctagtgtctgcaatgatttcaacaaattaaagaaggggttctcggttaggttctatgcctgatccaaatttcgcagaaagattcaagattcaggtgcctgacttttctttggatcacaaggaggaggtggtaaccaaatgggtgtagtgacaagggccatgaagagaggctggatgaggaatccagcaacccagaattggcgcccagaggaggagaagacctgataagccgcctcccggacgatatcttcaccagcatcatcactatcctccccggcaaggatgctgcccgcacacagatgctctcacggcagtggcgaccgctctggcaatcggcgcctctcaatcttgaggccatggtcgatagtaggacggtggggaaggatgtgacaaccatccagaccgtgcttcaagcccacaggggccgtgtccattgattctccctctgctggacattggactacaaccacttcttcatcgtcgattacttgcttggatcccctcagctctgcaaactccaggagtttgaactgttctattttaatatttgaactccaggattagctccttgacccttcaaagtcttggtgtgtcagatgcttgttcttatgtagagggaaagctggaggaagtaattatcgagaatgccccactcctagaaaggcttaccccaccatgtatacggaatgaaggctttgttatttgggttactcaagcaccgaaaatgaaaacattgggctatctaagccataaaatttccacaattgagcttggaaccatggttttccaggtagctgcatacatatatgctgttgccatttctattttttggtatgttatttcttcacactctcatacatttcattcactatatccattttcagaaactggttcctgttagtctgtcaaatgtgatgtgcactgtgaagatcttagctcttgacagagctcctgatctggatgttgttattgacttcttaaaatgctttccgtgcgtggagaagctatacgttgtggtgagagttttttctttgttaaattcagtgagtaaacacccattttgttctattgtgccatggcatcgaccttttttttttaatctatggttatgtcatgtttcttttaactcgctttttttccttgtcaggcgttcattcaggggaacttcaagaatgcactgcgatatgtttcacttgagtgccttgatctacatcttaggatggtggaatttattaactatcagggtaatatgttagatttgaacttcatcaggttctttgtattaaatgctcgagttctagaatgtgtgaagcttgtagccgctcatgacaaatatggcagaaaatggatggaaaaacaacagcaaaagctacagctttatggcagagcttcacgaggcatcacatttgattttcaagctgattacgggtcaaatggttcagtacacatgaagcacatcagtgatttgactacagatgatccctttgatagttcattttgtagatgccgtgatgaggaattatgaattcctttgaagctgtttatctgtcttatatactttggttgtatcaaccgcatgcttagtttgtacatctgaaatttcttgttttgcaatattgcggtgcaagcctgggatatttattgtgccagagaagttgaatagcattgatctattttagtttttttttaactctttctgtttggtacgactgtgtgttgctcctcacctattgtagacaaaactagactatgatgttcttgttactgtggtattcattccactttgagctacatcattcttggttttagtacctcattttggcattaattcgatcccacaatgtcattgcaatctaggtttcttttttgaagtttctcatcaatcatcactggttttttgctgtcagaatattattttgtatgtttgaacatcttcctgtacttacgcaagtgccagtttgatacacactacacagtttcacctcaaatagatacaaacaagttgtaagaaactatgttagcatgaaacaattgaatggttaagaaatagtggatatttactttaaatttggttctgttatggaaaattatataactccctagtccaacggtagtaagcacgaaaggagattctgaatactgaacccgttgtagccaggcatcaacattgttatttttattagttttctttttgtgctacatggggttaagtgaggcttaagttttaagttgctaagttattatttttttatagtttatcttttggtgctacatggggttaagtgagacttaagttttagggctgtgttcttaagtccaagttcccaaccttactctctcgcttacagcgcgcatgcttttcaaactgctaaactgtgcgtgttttgcaaaaaatttctatagaaaagttactttaaaaaattatattaatctatttttcaaactgctaatcggtgcgtgtttttgaaattaatcacgcattaatccattacttcgttttccttgtcagaggtgagggttcccaaccctcaccaaagaacacagagttgctaagttattggtttgtaagggtgtgttcgctagtacaggttcccgggaatagtacgcgcagaaaacggaacggtccattagcacgtgattaattaagtattagctatttttttcagaaatggattaatttgattttttaagcaactttcgtatagaaactttttgcaaaaaacacaccgtttagtagtttgaaaagcgtgcgtgcgaaaaacgagggagagaggttaggaaaaggaggtgcggaacacaccctaagttgagactccagttacaatggtggaatacacatggaagctatatagcctatatatgatataagagtggaagctccaaaggtgaatcaggaatcttggtatgagatgatagtcttctttcccttgaaatggaaaattagaacgaaatattgcttttcttttttacttttggcaggatcaaatattaccatttttaagattccaagattttatagtttggcgtcttgacttttaactattttcatggcttaatccagctcactccgttagtgtagctcaactgcatgcttaaggttcatggtggtggaaactgcctatctatgttcaagttctaaacttggcgagatgcctgtggtaattttgtgaacctcaagatatgacgatccattcttcagatgtactcatatagatatagatagggagtgcatgtgtgtgttcgaaacacaatatatataagcgcctacgtgcgtactgtgtttcgaaaaaaatatcaaagtttgacatgtcacgagtttggatagaaacggtggcataaatttctgagcgatcaattatcatttctgtaaaagtagcacggtttctgaacgatttttaatcctaatgaaattgctattgaccacatgcatgcttcaaatcttgaagcatgcatgtggtcaaaaacaatatatggtataatggagctatgtaaccttactctaacaaaacaacatgggtatatataggaagaattattatatatatacggtagcataaaccacatgtaatcgtcatatgttaatcgttgttctctcacttacccaatatatgcctcgttcattttatatgtgtgatgtgtccatgatcagttcattgcatcgagtaacggggctgcaggaat

SEQ ID NO: 47765 - DNA, 24151 bp, Oryza sativa
  unsure (1)..(24151): unsure at all n locations
ccatagaaccgccaaggtatacaaacttttccatgtgcgttggcctaaccataagcaaaatacttctcgggagttctaacccaaactgccaaagaaaattcccataactttgctaattagatgtgtttatctctaatattcagctacaatatacactacgctgtcttatgcacgattcgaagttgtttgcagtttgaaccaacaacggcacatttttgggttcatgtcatttgataccctcgacacctaaggatatgcccgttggctaatatcaatatgatcatcaccaccaaaccaaagtcaaaatcaataatatattgagctttccttgttcaaaggtaacacggattctgaatttgtttttaagcttatgtagtttttaattttatgtcgtgctttgctaattttgtgcatttgttatgtgtgactcatcaatatttttcagcattcttgcaaggttgtttcacttcaaaatggtcattggcttagtcttgagtatgatcctgtgagggtgagttttgcatctgttcatacatttttagattggatctggatagggtgagctctgcatctgtttatgccttttacattggttatgaaagaggagaaaaaaaatgaatcaatcagctcgaggagtgtttttttctttcaagcaataaaatgatcgatctatacatttattcttttcctttcctgcaactaagaaacatatatggtgaaaacccataaaaacatgatctaaaagtttttcaattcatgaaaaattttactagagatatatagggtaaattaaaggcatgaaatatacacacaagatctcgagtccaaacttaactttatttgaaagtaacaaacaagacaaaatttaggtgaatagcatcatatatgatactatttacctaaattttttcttttttttatttctcccaaatattgaagtcgggtttggactttggagtttagattttgtgttaatgtatttcatgcctatatatagagcctatctctatttgtttcatgaaagaaaaaattactcttgttgaaatggaggcaggacctactttgctcgattggagctaaccacatacttttccttatcatatttatctcacagaacacatgacagcattcacgcccattgtacattcaaaaaatgcatgatactatgtgggttggttgctatactgtgatcttatccatatataaatatatattaaatatatattttcgaatggcctatcagatttgactggcattatattgatagggatcttctccatataaaaacatacatcttctcgtgcgagggaggctacatctgcctccatgtttaggtgccatcaaaccttcaaactttattcagcgaaggatgagatattggagagagccaaaacgatgcctagatccatagtgctcaagctaacaaaaccatcattattttaattcctatgttcctataatgtctaaggtaaatttttctacaggacatcacgacttcatggttttggcggtaacacagcgcacagggtgacttttggaaaagatactctcaaatattcaaatattcttttagggagacactctcaaatttcttttggtgtagacactctcaaatgttggatatttctctctatttcattaaaataataatttccggttgaagaggagagaggaatcgcctaaaatgtaaaaaatatcagccctcccatctatcttctcttctgtctctatcttcctcggcgcagaggcccggcgcgggcgtatgtgcaatgtaattttagtacaaatacactgtaaattttagtaaaaaaagaaggaaagaaatagagagaagacggcatcagcaagaaaacatgggtgtgtaaatcaaaatattcacatggccccacacagcctcatcgcccctcgcgccctaatccagcatgaaatccgcacaaatcatggtgtagaccctacggttaaaaaaacatcaaatacaaaggaaaaaatcacacgacagatatatagaaaattcgccacgtacttaaccctagatatattttcctctataaatgtctatgtacaccctctagaacaattgagttttatttagttgaattttgccaagtgccattcatattatctctagtcctcgttcgattagtcggcgactatagattcagagcctccaatagttggtgtgttgatttgctgggtcgattggatctaccacttcaatcgcaactattcctttatacttcatcaccaattcgcaatttttagattgcatctcactactagaaaaatgatttttgctagcggcctatggtgccgctagcatcaaaaggccagtgaaaataattcatttgtgctggcggacaaccaaccgcgaatgaaaatagggtttctctggcggcaacaacgactgacaacgaaaattggttttccctggtggcaatcttaagatacccaccagcaaaaacttttttggagcgaacaaaaatgaaaatccaggtccaaaatagtttcacaaattccaaatcattgtcccaaataatcacaatcccaaatccccaatcacaatccaacttgcaacatgttcagattcaaatccacatccaagttttcaggaaacaattcaaatccccatcaaaagagtttattagattcaattaacatgtaagtgtacatgcatacaagcattttgaacaatagcacaacattgaaaaaacagcatcaacaacagcgccacaggtttttgtggccgtcgccgaccgagcagcagctgagatggatctgatgagggagccatcggatttgggaaccctagccgccggcgaggaggtgttggcggcgagaccatgggattgtttagtctacatcacccgcccattagccttaccctaccctgttcatcacaccagtctgatcgtgacattttggttaacaaaatgatataaatccatgtttgcctatccatctcttttgacttgaacggcaagtagtccatagacaggggacaatttaggcattctacagggaggtgtagttattcactgctagacctttttattctcaactgttaccagaattcgggaatcacaaatgatatatagataacacttttttcttccatatatatcaaagatgcatcagcgatagatcacagttttttttatgcatgtttttatcagtgcctcgtatatatacatcgattattttttatacatgtttttatcagtgcctcacatcgattattatttaatttttgttttctgatcacagtattttcatctctttgatggttgttgaaaggtaagcaggaacatgttctgctcgattcggggctaaccacatgccttttcttatcatatcatgtacggttgttgtcccacataatactagatagaactcatgcacattagtctagctatattcaaaaacacattataactatgcctggtagatactagatagaactcatgcacattagtctagctacattaaaaaacgcatgataactatgcctgggtttattgctatctatggtgtgagtgataaacatcatcttcttgtaagtgatgagaggctatatatattctccatttctttcaggagccatttgaactagctagtatgatgagatgccggaggatgacaaagtgatacacatatgctacggcgcccatcctaatcattgctacgagacgtaatcttcactatctcatgtattcatataaatgaagacacaatattgtcccgggttatattcatttaaatgaaaactggattgttactatcttatgtattcatatatatatgaagacacaatattgtgccgagatgattattcaatggattattgtaattactagtagggtacctgtgcgttgctatgagaaattttgttgatcactggaaaaaaatcgggcaatccaatagacatccggaagtacggatggacggagtttggaggtggtttgacggtcagaccggcagggtccgagttcgagtctgttttcgtcgggtctcgggtttccttgttcgggaaggcttgtttcgtgtttcctttggtttctatcccgagtttggcatggagaagggcctgtagagggcaagaccaacccttatttaagggacaaggccggttcattgtaaaacccccgaatacaatctacttgaatcgttcttttactatgttttctattttaccctagtttagtccatctttgtcggtttgcgccgtaaaacatccgccgccactgcgagagtgcgatacctctttgtaggtttgtcctgaaaaccttccgttttacccacgagacgggtagttatcctcatattgatctaaatcggcctagaggctgattttgatctctaaatcggctccgctagccggtttagttgtttttctacaaaacccatcttgatttggccctttggctagatcgaggtggttggcgactctaggatcaccgcaaggcatttaggtgctgcgatcgtgcttgtcgacttgtcacaaaaagttgccaacacgattttgagatgcttatggctaagtacaagaaaggattagccggtcaacgatttgataatcaaactagtgattcaaaaataccaagatcatctcgttggaagagatttggtcaaacaccaaagcaatcggagccatcaactataccaactccatataaacctccagttgtgatgccatggtatccatatccaatgttactatatggttatccttttatgtattatatgccatggatgcctcaaccacctatgccgtgtcatcaaggattgaagcaatcacctaggacgataccaagtcattctaactcaagacaagaccgtttcccacgaaagaatcggtccggtcgatcaaaggtgaaaaaggtgtgggtgaggaaagaccaaaaagtgggacatttcctttcatgacgccttgatcggtcctaatgtattgtgtagtaatcacgttgaactcgttcccgctcgtcatagttgatgaataaattccttgattaaatccggccatataactcatagccgaaattgctgactgaatagattaatatacggtccttgatttccgtcggtatgctactgtgtgtatgtagcaaatatttagaaattgatgctattctctaagctagcaacacaatccgaaccatcacttggtttggctattccattattgtctaaattaataatacaatccggaccaacacttggttcggctataatggttgttgcatcattatctaagctagcaagacaatccgaaccaacatttggtttggctataatcgttatggcatcactgcacaaattattaacacaatccgaaccatcgcttgattcggctatacatgatattgcactatcatctaaactagcatgtaagctactgtcatccactcggctttcctgagccagagcttcattcaacacatgatcaacatcaagaaatatctggtcattcaatctctctttaatagaatcaagcaatccatcatatgcaatgttggccaaatctttgtcagttattttcaaactaaaacatcggtttttaacatccctaaacctttcaatataatcagcaacagattcattgtatttgtgcctaaccgatgttaaatcaaacaacctaagctcagtctcactagtgtggaaataatcatgaaatttttgttctaattgagcccaggaagaaatagaatttgccggtaaagaagtaaaccatgcaaaagcagtaccgaacaaagataaagaaaacaagtgcaatttacatgtatcccaattagcctcaccacattgcgctaaaaattgatctacatgctcccatgtggtcctactatcctcaccactaaacttagtaaattcaggaattttataaccacgaggatatgggataatatcataaaaattaggatacggcttttggtactccctagcacgattccttagctttgcgaaattctccctgatagtatttctaaaccaatcctccacagtttcaggctttggtggatctggtggtggacttggtggcctaaaaggtggttgttgcggcacaatattgttatattggccatacctagtatcgggaggatatcccctattaatatcattgtaggcattagggatatgtggaatagcatgactaacagtattaacaggtgatgaataataattaaaatcagtactgctagtcgtggtatgaaaacctggagaaactcccagggaaccggtctgaccggcccatggctcggtctgaccggtggtcagtggtgcggacagaccggccacaggaggtccgatctggccaaaatagggcacggtctgaccggctatggtaggcacggtatgaccggcataggatgcggttagactggtgtcatgaccggtcataccgttagctaggttttgcatatagccgattcctgtgtaatcggctgtataatcacccattgaacaccccccctagcattataagcatattgtataggagcaaaactagaagtagcatatgcatgtacacaatgattattaacgttttgaatagcaaaggacgggttgggcgaatcgaaggtgaaaaaggtaaagaaggtgtgggtgaggaaagaagctaaagctccggaggttgttactatcaaggaaaagtctcaagatgttcaagtacctaccggagatgcggcaaaaattatacaagtggagaagactgaggccggcaccgttactgtcaacattggcggtctaaccgagacagctggccggtctaaccgccagtctacggccggtctgaccgatcctcctgccggtatgaccgacggcttgcagccggtctgaccgggcccagaggccgatcagaccgaggggcattaaaggtgagcgggaaaattgagagcaacacaggagcttctacatcgaccaaaaatattaagaatcattgtttagctcctggaaaacaaccatagccgaagtggataccttccggcttatctcgctctcaaaagaggaggctacagcgtcttcgagccataggtcaaaagaaaaaagaggccgaagatgtaaagaacaaaacatgcaataatttagagcctcgaatgacacctaagcgagtgtggagacctaaagaagtaaaagttaaaagatcggtgatttcacggagtagcgatggattcaattcgatgagacaagaatcatcggtcattagagataagtctccttcacatgatgctatggatgttggtgcggtgttcgtcttgccttcgaaatcctgcaatcaagaaagctgactttgcttgggggcaagacattaatatgctcgtgaagaaaccaagagaagatgaacggcgatggatacaacatcacatctttgagccgccgtttgttggatgctaaggcaaggtatgggtttattgtgttcatcatcatattatatgcctatgccatgttagaacattgcttgatatttagcacatgtgtgttttgcttatcaaatccatattatacataaatgttgcaaatgccagttctaagtagtggaattggtagtttggcatataatttgtttcaagtatgatttggctcatgagtctttaatatttatttaaagccaaatcgtatgtgtttttatggatcaccatataagatatagatatcatatgtattgcaccatgaaagttttgcttattagtaattcggctaatgtcaatggtcaatgtgatgatttgttctagagttattttatttcagaacattggcattgttaatattttgcatacatgctcaagccgattacttacatttgtagtttattggaatctatgcatgtgatacatatgactttggtgattcattattgatcatacttcaattggctaagtgttttgatgccatgatgattattgtttcaaaagccatttgaattagtattcatctagacatgttagttggatgttatagtttttcatatgtctagagagaaggaattttggtccaataatttgatacaccaagcatctggctattatgtgaagaaaaattatataccaaaggccgatgcttgattttaaaagtttggacgaaattggcaaagtcatagaccaggggcggtctgaccggcattgcacggccggtctgaccggtggtaccggcggtctgaccggctctgcatggccggtctgtccgggcagacagggaggtctaaccggcattgcgtgtccggtctgaccgatctcgggcagagagctgggggcacgttataattgatttaaagaccgaattaattgtgaattcagacatttgtgcccataagtcagatagattggagaatccctttgaaaagaatatttgaaagatcctagtcttgggattgatcggaagattcggcggcaagcgctcaaatattatatcgccgaaaaataaatggagtattaattggataatgatcaatctgaagttgctaggagagtagtacatgaagggatttgtgaaattcatcaatcggcccgtaagataaattggttgcttaggagagtggggtttcattggccaaaaataattgatgattgtttcaaatgttatagagggagtgaagcttgttaacggattggcaatgttcagttagcgcctaccgctgtgttgaatcctatcattaaactatggccgttccgaggttgggctttagatttcattggtcaaatttattcttcgtcatcaaaagggtattggttcgtactagttgtaatggattacttcactaagtgggccgaagccgtgccactcgagaatattacttgtacggaggaggtaattgactttattttgaaacatattgttcatagattcggtattcctcaaacgttaaaggagcttctttatgtccaaggaaatgagaagttttgccgaatcttatgatattaagttgttgagttcttctctttactacgctcaggctaatggataagccaagtcgagtaataaaacattattgaaattgccgttttgccagttgaggtaaatcttgtctctcttcggtatttcaagcaagacgacttgtctgttgaaaattacaagaccttgatgggaagcaattttgaagacgtcatcgacaagcgtttgaagactttgaaggagatgaagacacttcaagatggtattttcagagagcaattaatgagagatagcttgaagaaatacttaccgagcatttggtaagatgcttaggaagtcctatggccggtaattggattatcgccctgagataacatgttctatgcttttaggttcacgtatgttcaccaaaaaggcagggggcatgtgtttacacccaaatttggcacctatgaacgaaatagggaaaattgccaaagtttggaaagtgccgggtttccttcactagggccggtcagaccacaggtatgtgggcggtctgaccggctagtaggaccggtttgaccgcaggtatgtgggcagtcagaccggcagggtccgagtccgagtctgttttcgtcgggtctcgggtttccttgttcggaaaggcatgtttcgtgtttcctttggtttgtatcccgagttgggcatggagaagggcctgtagagggcaagaccaacccttatttaagggacaagtccggttcattgtaaaacccccgaatacaatctacttgaatttttcttttactatgttttctatttctattttaccctagtttagtccatctttatcggtttgcgccgtaaaccgtccgccgccgctgcgagagtgcgacacctctttgtaggtttgtcatgaaaaccttccgttttgcccacgagacaggtagttatcctcatattgatctaaatcggcctagagactgattttgatctctaaatcggctccgttaaccggtttagctatttttctacaaaacctatcttgatttggccctttggctacatcgaggtggttggcgactataagatcatcgcaaggcgtttagatgctacaatcgtgcttgtcgacttgtcacaaaaagttaccaacaaagtgcttcggttgctgctgctgcgacttatttgataattgtaactaatcacgattaacatgatcgagccgtgccgtcaaaagcgaaacaatgaatccattggctggctggttgcttagttgaaccgtaacagtcagatgttatacgggccgattagacccataaggtccatagtttgtttcctttctcaattaatttcacgggtgcacagagattaggcccataaggtccatagcttgtttcctttcttaattaattcgtgcacataaccaagcaaaatattccatggcgggtgttgcagatctgctgcttggagtgccacatatctgatacagagagagcttcttggcagtgtgaagatctggaggtgcttgaaaatgctgaaaaaaaaaagcatgggaaagatccacgtgcaatgtacagtctcagccttttataccaagaaattggtgaaattagaggctggataggaattgaggagttggcttcttttagctcgaatactatctgctcagacacagtttgctgatgctaaaaccattattgatgcggctctcgatcagactgggaaatggagtcaaggagatttattgcgaaccaaacccagaactcaaggctgcacagggctaactcagggactgctgtcgagacatacaccaaacttctcgctgtcattcaactcagaaccaaaagtctcggtgctgggatcttcttggcaaaggtgctttaaaaattctattttgaaattcatcagagataatcaagtttcttgcacaatatcaattactcttacactaatagctcttgaaactctactgtttctgtttcattagttatctggtagcattttctaccagctgaacacacaatattctacgttcattttaattcccattttcatggcaagagaataattcctttgatgtaacctacctgatctcctttctgaaagcatattatctgtttaaaatgtaatcccgaacgatcacaattaagaaatcacatctcattttttcaaccagcaaacattgcccctatcaataaattgcatgatccacactttttatcagtaaaatcaactacagaaatcacaaatgccagcaacacttctgcaggaagacaacagagcatgttcaaccagtgccattggcaatgataaggaagcttcttgcgttgctccttccagtttacattcacatcaaggaaccaaacagctggtaatcagagtagtaaaacacagtactggctcatggtttatctgaatgatggagtataaagtaagtatagtgcactactcgtatacaatagcaattaatatttagcagaaaaagagtgtgcatataggtaaagaaggtatttctttgaattgtttaacaaattggtcaggaagacgtgtgaagaacagatcaaatgcattgtttcttccagggaattgattaagtcagatatgctgtagtaggagactttccctcctggtaataaccactctttccatgtattttagaaaatcgtggccatgtacacctatttgctctaaggttcatcaagataaaatgaagatcatcgtagcttgagcctgctgtacgcaagggccaggtgtttttccatagcagaacaaatgtttattgcttaaacaaataacagtgaaaattattcaaaggaaatgattatcggtcagtctagaatatcggaattaccacacaagcaattcacttgtcaatgtcaaaatttgaccagatgtattgcttataatatcaatttccattatgtcgaataatacactgttcatccaaggtgtacatatataacaataatgagatgagttggccttaccttgatgcaatgtagaagaatcgttcacttccaattggcacgttattaaatcagcagcactttttttggaaagctcgcaaagtggggctgttcacacgacgaaaaagtgaccgaagatactttttattagtacatatatatattacaactcaagctaaagcggatgctaaaagcaaaatattggatccttttaggtacttacctacatcactattggtagcagacttatttaaaacatgactttcctccttcttccgttttcttctctcacggtcattcttgttcctctcatcctttttctcctgggtcaatgatgcgtactagtttctagcacgctttcttacaactttagcatgggtaaggttagtaacatctccatgcgaacctgtgcacatgggcaaattgctgggtgtactgaaggacgtatcgcggtcatccgcaaatggttgactattaggcgtaactatacgatgcataactttatggcccacatcaaaagaatatattcagtgttggttgatacagatggatatatcaaattaaattaggaaacacacattctgatgaagcataccatttgaagcagttggagtgttttgttcagaggtgtcacagttatctcccctagcccgcgtatttctcgctccggaagcaagagggactaagaaaggaacacatgtgtgaaattagcatgcaaaaaaactttattgtactttgaaataaaaaacattaaaatttgctgcacattaaccagttaaaagaacatgatcagaaagaaaccagctgatgctttgagtctagcccacatcacacacatatagtctgcacattggtgttggtggatatagatggagattgaattaaattattagaaatcaaacaatctgataagtataccatttgaagcagttggagtgttttctttagagccgtgacactcttcgtcgtttcttcgaacaacacataacgacttggctctacccttgccccgtctattagtgaaaccgagaccacttgtatttgttatatcagcaagagggtctaagaaaggaacacatggtcgaaattagcacacaaagaatttttgcatatggctaaataagatgcacatagctaagctaagaaactcaaacatgatgttgtacttgatggtgcagcgcccccaacaaactctttcattttagtattccccaaaatctagttccgaaaccaatcattatggaaaaactaaaagcttcagatcccatagcaaagttaagaagggagcggtgaagaaattggtcgtaccttcaattcagggaatgagattgtgagggatagaagcagctcttcgcagtgatacgtgacgaggtgtgggcagtgctaccgtctttgtggatcccgcctactttatggtggtaagtaaattcttaagatgtttcaaaacaaatttaacaattcaacatggaattaatctagcgtcaatcgcaagaatcacttcaaaatatatggatgatactggtatcaccatgagtcatgacagctgatctgattcaaaacagaaaaacaatgtgagttggaatcctatattcctatatatatctatatagttgatccacactaagtgcaattaatttgattttcctgtgatatggttgctccacgtcactaagattgctttggatcgttcgattaaaattgcacggcaggagattaggtcgtttctgattcctccgttggtggaaaacacaacggatgacatgcagctccctggcttttctttctcggtcttccattctgatcgctccactaacccctgtaaccgatgaaaataatgcaacctcctagcgccctgacagttgaacagcttcgttctcgcctccatgctaattagcgtgccacaaatcaaaggaaaccgaagcaggcagctgagaaggccaccttaataacagccctgctttaacagctacatattcagtagctccccagggacagcttgaattttggggtccatctttctacttctgtagtatagcgcgctcttcctttcaacatctgcccaatttgctcgagagcttcagtttgcttcgtcatcgacggtgttagacaataattagaactcaattaatcacacgttattatcacctcgttttgtgtgaaacacttaatctttatcttcatcttaatctttaggagattcaaacaccaccataaggttctctcactccttcctgatagcagattatttttttatcagctgattttttttgtcccccacaaggtttagtatttttttcccctaggaagactctcctcttttacgagattatgcattcttacttctcattggattttcaatacatgtattttccttaatagccaccgagtttacaatacccttgctctcaatctttctactttatttgtttatcggcaatgagaattatgttgtcttttctcagattatggtactgtggttcgagaacatttgaagaatccactctgtttcctttttatagcacaatatcagttattatattcattcaatgatgtgatttgatcaaccatgataacaatctgcaacagtactacaaaggtactccttattattcagttcagaactattaacccgcttttatgttctcatgaggtattgttacttttcttgagtatagtgtacaagtatatgtgtataaactttttatgctttttggatcagcatttccttggttaccgattcaatgcatcaatcaaaagctgcataatttatttagttcatcaaaaagtaactttgcagggataatttcatctgttcacctgaaaaaaagtgcgcagcagtacagattgaggtaaaatcaatgtttcgtaatggtttcattcgttgaatgtcgcttcattttgctaaaaaaaaacgaacatatatgatttgctctatgtttgatataaaaaaaatttatgttgcctcatttttacagtttgcagctatttgtttctgtttctagggcatttagcaatgtcacatcatctatacaccagcttgctacagcctacgttatctttggctgatgtacctaaacttaagttaactattttagaaatgtatcggtgatccgcatgtttcagcaaataaaacctgataagcacttgctgaacatctttatatttccttccaagtgttttcagttaacagttgccttagttccctatcttacatatatatatatttatcgacaacattccacagcaacacgcactactacggaaatcatctttcgtggcggtcatttttggtttttcctagcggaaattgcagccgccacaaagcaaagttcagagaaaatatcaatcttcgctagcggttatcggccgccagcgataatcaattttcgctagcggctgtattataccggccgtcagcaataatcgattttcgccggcggctgtgttataccggctgccagcgataatcgattttcgctggcggctgtcttataccggagggagtacaacgttaatttgtaaacccctaattttttagatggtatacgtacatggaatcagtgttcgatctgcatccgtcgaagtgcaagacaataattatattttgtgaatttgccatgtgtgacttatcgatattttccaggcttcttacgaggctatttcagttcaaaatgtactggagtagttattattagcttaatcatgcggatggtgccatgaggctgtacgtctgttgatgcatttttagatttggatcgatctggatgccgcagagtcgaatccagcgtctgctcttgcgtttttagatgccatttttatttcacagcagacaaggctgcactcacagttttgttagttattcaccttcagaaacccaggcatgatcattacatgccctctcactatatatatatatatatatgcacctcttacgattttgagagagaggatacaattctatattttgatatgtcattttattttgatttatcgacaaaatgagaatttggagagaacctaattcaaatctattgacggattatacacgaacacttaataatatattaaaaaataatgatttttatacatggtaggcctctaatgtggataacaactttactccatgtattgatctgtcatctttgtcatctatgacacccagttaacaagctttggcagctcagtttgaatcttggcaccctacttttttccatataatcttttaatgtggcgtaagagatgatgcagcaaattgattttatcttatnnnnnnnnnnnnnnnnnnnnnnnnncaaattgaatgatgcggcaaattgattttatctgactcaatgcaccaatttaaatgtaattctcatgtatgcagataagcaggaggcaaatcaatctagattgatatcacatgcatgaaggttaaggccttgtttgttttagcttaatattattgcaatctagattattaaatcagattactctaatctgaattataataagctgagctgcgagctgtgtgtttctctggattattggagaatctaaagggattattgaagacatctaagggcagtggatctgtagccaccgtctgaaaaagctcctccagcagagattattagattatactggattatagattatagtaatctatttgtttatttcagcttactcctgataatccagattataataattctaagctgaatcaagtaggccctaaagcatcaaagatttttcatgcaaattagagagtccaagtcccaaacgtcaatttaaattggaactgaaacggagtactagacaagcctgtggaccgggcctcccttctaattccctcgtaaaatcgtacgcacgcacactttctctcccaattcccatctgcgcgggctgctgcgaattgaagcgagctaggacatgggagggagaggacgccacacgcacgcctgcaaagcgcaaggccggccctgggcctaggccggttgtgcgaccgcctagggcccaggccggtggggggcccatcaatcacaccccctccccacaacagcccagcccagcggctgcggcagaaacccagtgtgctgaacctgcgggctacggcctgctatttcgcgcaagcgcaagcccaggagggagagggagcgctttattttccgttttttttaactactttgctatatcttactcgaaagattttttcttatctcttactcgattttctcacttgtgtattttcttgtaagttacggtgtaatttatgaaacttacattataacttttgtaagttaccgtgtaatttttaaatcttcgcatgtaagttttcaaatttgtattggatttggtttttttttcttgaagatatggtaatttagtgctcattatggtgtttcttagttgctttttgtcttttactgtgtctatcagattttaatctaaagattaaaaatatgtgtgatacgattataaaaatttttcgaaagatgcaaaggtgctccctgtttataattgcgacttctttggcgtcttcgttttctttgtttgttttttttttctttccgcaaatcacgacgtactccgcctctggccctccgcgaccacgagcgactcgctgactcccggccaccgccagtcacgcgtcgcgcgcgcggccgcgccaacgacgtacgccgcacggccgatcgacgtacgccggatcgccggactcgcctctctcacgatctcggcgtctctcctggacctctcctgacagtggacgccgacgcccggggctacaggaggagggcaaactgaggttaaagacttcttgtttgttcttgtgttatttcttcaatttttcgaagaaatttaggttagcgacttattacttatggacttaggattttctcgcttgtatgattatatgatttttcgatttttccactctaaaagttaggttatagagtatatatattagaagtaaaaaaaatagcatcaccccttaagggcctatagtgtcgagttcgtctagtgccttccaaatgtcaagaccggccctagcaaagcggaaacggttttctggttagggttcgcgccgcccccatctatctttgcatgttgctctttctaatcatcaatttcgaattcctttataattaatcaatttcgaattcctttataattaatcctgatcgagagaacattatctctttttctcgtaatgtaatgcagcagaagtttcgtgaacattatctatttttcttgttgtaatgcagcaaaaatttcgtttctccattggactagcattaattaatttttgcattccattgccatccaaacttgatgcagattccacggaattttgctattatgggtcgcaaagaggcgaccgacggcggcagatttttctacgactggcagagaggcgaccgacggatggttgttgtgacgagggccacgaagaggaggttaaaggaggaatcctgcgacccggaactgagaaagatgaggagggtggaggaactgaggaggttgaggaggctggaggaggaatccggtgacccgaggctaggagaagacctgataagccgcctcccagacgatgtcctcaggggcatcatcactctccttcctaccaaggatggcaccagcacccaggtcctctcatgacggtggcgcccgccgcccgctctggtgctccgtgcctctcaatcttgaggcttaggtcaatggcgagacaatggggaaggatgtggccgccatccatgacacgcttcgagcccacgagggccatgtccgtcgactctccctcatctggagagatggccacgaccgttgctttcctgtcgtcgaatccatccttggatcccccgagcttgaccgcctctaggaatttgaactgttctatgataatgtttgctctcaaaatcctccagttccactatctgtactccgtatgtctgctgctctatgtgttctcaggattcgttcaacgcgtgatggtgcacttcagtttcccatggagactgcttgcatgcttgatttcccacacctcaaagcgctcaccctatccaatgtcaacatcatggatagcgctctccatggtcttctttcgcgatgccctgtcttggagagcttggtgttggttgggaacaggtggtgtcgttgtctccatattagctccttgacacttcagagccttggtgtgtcagatggtttttcctcggtagaggggaagctggagaaagtcactattgtggatgccccactcctagaaaggcttattattccacgtgacaaatggcaggatgactttgttgttcgggttactcaggcaccgaaattggaggcattgggctatctaagcgatggaatttctagacttgagattgggaccatggttgtccaggtagcaacatgcacatattccataggcatttatatttctcgatttatttttttcttcatgctcctcgctcatacatttcatttgccatgtctatttcagaaactggtgcctgttagtctctccaatgtggtgcgcactgtaaagattttggccattaacaccaatttttatccgaatgttgttattgactttataaaatgctttccatgtgtggagaagctatacgtcaaggtaggaattttctctttattaaaataagtgagtaaacacccattttgttctattgtgcgcgtcttggcattggccatcttcttggatcgataggcatatcatgtttctatcaactcttaatttttttccttggcaggtgcgctattatgcgtacttcaataatgtacaacaaaatgtttcacttgagtgccttgatctacacctcaagatggtggaatttattaactatcaaggaaatgtggaagatttgaacttcattaggttctttgtgttaaatgctctagtgctagaatgtatgaagcttgtaacccgtcgtaacaaatgcgacgtgaaatggattgaagaacaacatcagaagctacagctttatagtggagcttcacggagagttacatttgatttccaagctgattatgagggagatagtttggtacacatgaagcacatcagtgatttgactacaaatgatccatttgatagatcattctgtagatgccgtgatgaggaaagatgaattcctttgaagctgttgatcagtcatatatatactttggtaagtatcaagaacatgttagtttacacgcctcaaaatccttttttgttttggcatattttgttgcaagcctaggatatttatttttccaaagaagttgaatgacatccctattctgttttttttttcattctttctgatttgctatgactgtctgttcctcacctattctacacaaaacaaaattatggtggttttgctactaattagccaactgccggttagatacatactacattaattttcacctctaatgaatacgagcaagttgtaagaaaccatgttagcaaaaaaaattgtatgttgaagaaataatgaatatttactttgaattggttgttttatggaacattaactaactccctagtcgaacggcaataagcacgattggagattctgaatatcaaatcccttatagctaggcattaacattgttatttttatatttttcattttggtgccacatggggtttcagtgagacttgagttttaagttgttaattaagctattggtccgtaagctgagacaccagtataggggtttaaaaaaagcagatgctcacttattatccaaaattccttcatgacaaggagctgccttgttctttgttcttttacaacgaagaagttttttttcccctgcatgataatggcagcagaagtgttctgtctgctttaccaccgtgattcaagaaaggaatcctctcaattatactatctatgtgtgtatatatatatatagtggtaataataagtttgctaattgtttttgtttggataaaaaaatagttttctaccattacacctgttttttttttgtttttgctatgtatatatggtacttgaaagaaaaatctgattgcagtgttctgtttgcaggtgtatgcacatattataatgctgctactagatggaaaggagtgctactgctgctgctgctgctacagagacagccgattgttcttatgaattctgttaggcccaactatctactatttttgacgtcttttggatagttcagtagagatttaatcatttaagttatgtcattcaatgcactctgtttataaattttgttttgtctttcgtctcaaatcctgtggccatgatacgactgaggtttaatttgagcggaataaccacttgatgatcggtagtgggtaaatttaagttgcttgtatgcaagtgtagtatgaatttgatgggttagcgcttcaaatgctatcagttgtaagcttgcttggcacggtgggattacgctgtggtgagtactaaattatgtgctggacaggtcaagatcccatctagagaaatgaatttggtgagtactaaatttagtactttttaagctggacaggtcaagatcccgtctagagaaatgaaatttctgcctaaaaaaatgaaagtattcaacaattcagttcaatttacaaacagtacaattttataccccgtttgtaaagaaaaaccatgtgtcttgaaaactaggagtgaaataaaaatacaattaactgcacaaccttaccaaattttcataattttggagctagtgcattgcccttcttttagtcatcttggcttttaggtttggaccggtcgatgcatgcaactcaaaaagctaaaagagccataggtctctagttcaaatcctaggtagtgcacaaaataaaagttgcaacatacttatattccatgtctgaaatcaggggagcctccgcgtaaggggtgtgttagagtagaagtgaacgatcggtgtttgagtataagtgaaatgcactctacctgagggggtgttggagcataaatgaattgctggtgtttgagtataagtgtattgtccggctccctcatagtgtggtgccagctcgaggcaacggtgagaaaaaggaacctccagcactagtggcggtgcgacttgaagaagagaaaaagggaaaaggagataagagactggatgaaagaaaaaaataataaatgaaaagaaaatattccaagtggttctataatttgtcaatcggcataagagttagtgacaatgccacacccacgtctatgtggcatgccacatcaatgtcacattagcgtctaggaggggtcgtggtaaattaggatcaaaatgactcaatttaataagttttgagatcatatatccggtattttaagagtatgggatttatataacccacatacaaattttaaaaccgatcatgcgcttcaatataaatggaggtgtaatttactatgacaataaaatcgtgctgctcctatttgcttaatttgtcagccagcttgctgcatgccagggctggcaggaatagcgagaaaattatgtatgtgttagttaccgtctaattttgacaatttgaccctttgaaaaaactaattttataaatgaaccgtccccaaaacttatttcgaaaatgaccttttttttttcagcgccaaatcatgtggcgctgaacttagacaccttagcgccacgtcagctggcgctgaatgccgtgccacggcggatgggacgctaagtcagcgtgccaacatacattcagcgccaagctatttggcgctgaggtgtctaaattcagcgccacatgatttggcgttgagcaaaatggtcagttttgaaataagttttgatggcggtttatttgtaaaaatagtttttgcaaagggtcaaattgtcaaaatttgtgttagttacctctcacaacattttacttctattggatagttgttcaatcggacagcaatctttctggcacgccattttgtcatcacaccatttttcttctattaatggatagtagtttgatcacacaacaagctccctgtcatgccatatgtgattctcattctccctatatatgtcattacaaatataaaaggtgatccatgtttccatagatatgtcgttgtctattaattcagcaatgaaatgaatgagatattgaagtggcctacatatgtcattacaaatataaaaacatgtttccttatatatgccgctatctatcgattcagcaatgaaatgaatgagatattgaagtgagccaaagttatgttcatgttatactctaaagaactgtattcacaattcaacgcgtacatggaggagaacactcacttgtatgtttttatgcatgttctcaatccaacatgctggaaaaaactcatcgaacatgtcatgttatatagttttagataaaactagatcgagatccgacgatttacggtggataacagcggggaccaatgcataattaatagaactgtagctttttttttcaaaagtgatatctgacgtggtatccctaactctccagcaatccagcaatcccacggtgtttaagtaaacaaatatttcatccatatcccaaacattctattgatacctaagtaataccacaatattatttcttcttccaaaaataccacacgcatcaccatgtttatttttgtggacaaaattgccttcactgtctcccctcgagtgaatcagctacaaaattctcagatggacagtgagattgttgtcgtcccacgccgaaggtgacaacaaatttccacacaaagaatgtactacctctcgctcgtggacgatagtcgtgacgctggcaggatgtgcatcttgctccgcacctttacatggtgcgttgtactgcccaggtgaacatcaagcacatgtgttcgtgttcagcagtgacacattaatcagttggagagcagcaagacaactcacacacatcctcgtacattcacagcaagagctgttcttggctttagggaagaggtacaacatgacaggagaacacctcgatgcacttggggttgctacgccaatccgtgctagtcggctcccacggcggcaattgggagaactgccacggcgatcgcggtggcaatggttgaatcgaccaggggcaattttgtccatagaataatatttcctagttgtcagctaatttttgtggtattcttcgaaaagatgcttctaccttttggcatgcaatgaaggtggaaaaatcttgtggtattacttggtacctgtaaaatgtttgtggtatagatgaaatttccccatagttttatcatgtgtgtgcatatgctccatctgtatattataataggtgtcatcaaatcgtcgacaataacaaaggg

SEQ ID NO: 47766 - DNA, 4984 bp, Oryza sativa
  unsure (1)..(4984): unsure at all n locations
ctgcagccctaatcttaagtttcctcaatcatgcccaaagaacactttaagagactggtatttggctcctctacggcatttaggactggcgtagcctcccgcgcaagctgacatgtcactgcacccacgttgggatccggtgggatttcgcgagcacccgtcggcctgtgtgttcatgtcattgttggttgtgttgcgaaagaaacctttatttcatcaataatttgtattaggcccctactctttagtttctacgttctgaattattacgaacagtccctttacaaaatgacatattctatacgaagaagcaaaaaataacataataggactgcgctcggaaaatgggaaattaagggcttgtttgcaaaaacttttatccttatcacccctcccatgaaacttcatgatctatgatttggctattgagatctgccaagattgtccccttctttttgtagttcttgcagtatatgaagaacccagattgtccttttccttttttcggttcttgcagtatactgagtctgtttgtgttatgaaggcctgactaagtgttaggttggacctaaattacgtaatatggttggtgagtcagaacaacgtagtggccttggtgtttggcagtgttgggttgtgctaactggcatatattttttatgacatgggcttcatttacaaaaagccttatgttttttttgtcatagcagtagcctcatggttgcttgcaatggcagtagcatactagcatgaggtatttcgtcgggcctctgcttcccatggaaaagaagtggcttcattatggccttctacactattaatcaaattgaggcattgcatatagcactatagttcttaccagaactatatatctccatgcttcagttaaatagaagaacaagcctcaattcttaacagtaccatgttaattctcatgcgttggttgctcctgcttcactgattgcccacaatgctgaaggcctgaagtggatgggaaagtggtgattgagaagattgaggacagtgagtgggaagtcggttacaatgcgatgaacaacaagtatgggcactcaattgaggcaggtgttatcgacccagctaagatgagaagatgcatgctctagatggtttcttgcagagtggaggtacaatgcatggtacaaacgccacatgttgtttgacccaacattcaaatacaaatgttaggtctatcatgcatgtttttttaaaccgagccagccttggctggtgttaagcctgggcaaaaactgtacagataccacaggtggtctagagagaggaaacaaaataaagagagagaggaagaaagcatatcatagtgaaaaggcctattctcctggcatcaatgcgatcatcccttttgctccatccattttccatgtggccgattcttccatggtcttgctcagtacttgctgatgtgtggactcttccgccccgaagactgggttgttgggctcggtccaaatttccaagaaaagtatagacactttatatgcatatagagtatagccagccaaattatcactgcattttgcttaatacctgtagaacagattattagcatttgcttttcgcaattctgagatgagataatcaggtactcacccccccccccccctcccctgcttttctatggcttcatcttagccatagaaaacaattgatggcatggatttagtcaaatccaccgggtggagttgtagccaactccaggagatctggactcccacagggacataaaaaagaataatataaaacaaatattacgagatattttagaccatgtatcgtagtattcggtattcggtagttttgtaattatgtactttaccaattcaattatgcaaatgctaggactaatacaaattgtaacttagcatttgcttcaatacatattctaaagttctctccgttaattagtatttttagcacttccatcaagctgcagttcaacattgccatggtaccctcgagcagttcagtgccctcttgtcttgtctccagaagcaccggcggcgccattgtatcgcaagactattccttcgccatatatacaccaagttgctggctacaccttcgtcgtgcttcatcgtgctccctgatggcttcttcaatggcacaggggttcggaacccagcccaatgccttgccatgatggtgggttcgattatgctatcaaaatcaacatctatgtgttgttctaagtgtgggtttccgtgatggaaattagactgaatgtatgctgttggtttggatttgattcgatctgttctagaatgactcacgatttaaggccatcccaccctaaaattttacacttgaacgttcaaatacttgcatgaagtattaaatataagcttaaaaaataactaattgcacagattgcgactaatttgcgagataaatcttttaagcctaatttgctctatgatttgacaatgtgacggattaattaggcttaataagttcatctcacgaattactgttggattctgtaattaatctttttattagtatccgattaccccatgcgacaccctgtataatacccgatatgacacggtaaaactttagactctgaatctaaacaccccctagatggaaaaagatatgtttgcccttgtgctgtcaggctgctcgatctagagctgattgcagtctaagttgacggcaaaggagagagaagtgacggaaatggaagaaactttaggtgctattaaagtaaactagtaatttttagtgttataaatctaaaaacgtaaactttcgatgctatacaaccaatcttcccaaacttaaatccctcgtgaactatccaaaagacgcctaagatagtacatgttgggcctaaagaatttaaaagaacactcgggtgtctcagtagtagcaacagtcctttccacctatcaacatcaatatatccgtacacctgcaactgcaagtgcaaccctgcaatcagatttttcttcaagcacggtttctaggctgaactccatcatcagatcgcatatccaaggtggtattgatatggtactgatatgtgatgatttgcagataaattggtcttgtcgaagataaattggcctgcttatagactgcaattcaatattagggaaattcctgagatgcttcacatatacatgatccaaaatccaggttaagaaatccaggagaattaagaaaaaaaaatacaaattggatcagtaaactgaacaaatttatgaagaagacaagagacacatatgcatcgcattcatcacgactcaacactgcctaatcccatcatatcaagaagtttataattttcgttgatccagataggatttaaagcactaagccgtcaaagtcatacattagtatgaatttcagacaaaagacaatataaacagagtacattaatggcataacttaaatccctcgtgaactaaccaagagacgccaaatatagtaaacgtttgggtctaacagaattcaaaagaacactagggtgtctcagtatcagcaacagtcctttccaccttagcaacatcaatatatgcatacacctgcaactgcaagtagaacactgcaatcagatttttatttcaagtaccatacatagcaaaaataaagggggtataatggtagaaaactatgcgtatccaagcaggacaatttgcaatctaactaactgctgcatacataaatagtacaactgagaggattcatttcttaaattgcggtgttaatgcatacagaacacttctgttgcagttagtatgtggcaaggaaagctgcttcgtagtaaaagaaacacagaacaaggcagctcttagatctccttatcatggaggaatttaggataataagtgggcatatcttaaacccaacttactgaccattaccttaacaacgtaaaagtgaagtctcactaaaaccccatgtggcacaaaaaacaaaaaacataaaaacacaatgttgatgtcgggatataatagattcgatcaatactcagaatctcctttgatgcttattactgctgttggactagggagttaattaatgttccataaaaaaacgacatttaaagtaaatatccatttttttcatgagtattcatatttttcttactaacatagtttcttacaacttgttcatagccatttgaggtgaaaatgtagtacgtatcaaactggcacttgtcttagtacatgaacatgttcaacataaaaaataatattctgacagctgtaaaccagtgatgaaaaacttcgaactgaacctaaattgaaattgtgagactgcatggatgccaaaatgaggtacaaaaaacaagaataatgtagctcagagtggaatgaataacacagtatcaagaccaacatagtctagttttgtgtacaataagtgaggaagaacacatcgtcataccaaacagaaagagtaaaaatactagaatagatcaatgcaatgcaacttctttggcaaaatacatattccattcttgcaacaaaatatgccaaaataagatatttcaggcatgtaaactaaacatgcacttgatacttaccaaagtatatgactgataaacagcttcaaatgaactaatatatttcctcatcacggcatctacaaaatgatctatcaaagggatcatctgtagtcaaatcactgatgtgcttcatgtgtaccaaactatccaccccataatcagcctgaaaatcaaatgtaactcttcgtgaagctctgccataaagctgtagcttctgattttgtttttcaatccattttgcttcacatttgtcacgacgggctannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggggtgcagga

SEQ ID NO: 47767 - DNA, 7852 bp, Oryza sativa
aaggtgacatcactgttatagcatcaatgtcagtgtcatctgaatattaggatatctgaactgcacgcagcaagtgcctgaggtgcatgtttgtcatatggaagcccaagtggagcattgtacatagtactttagtagtacctgtgagcaacgttgaattaaagcataagttggcagaattctttctgaaagcgatcaagcaggccgtgcgaaattgtttaacgatttcatagaatttgggtgaagtttaagattatgaggaaccggacaggtggctgcagatttttaaacagatgaaatttcagccaagaaagaaagtccaatagaagaaaggtaggcggtagaagtactgtgaacagtcaagaatttctgtcccgctgcagaatcagttcaaacattttgcacattcacattggcaatgccaattattgcgcatacaagcaaaagaaaaatgagagatactccgttacaaggaaattcaaaaacataatacaacaaatcaatgcctcaagagcagagatgattcggacaaaaaccaaccaaaagagaacccagtagacaaatttagtattctctgaaatttcaccacactttccaatctcgtttagtttggactagtccacttaaattactcaaagtccaagctagagccgaagtcactttcgttctactgaaactaaaaactttgtcctgacaaaacgagacaccaaccaaacagtacttaagaatatgcactcatccaagccatgttccatacgcatcacaattccacaagctccctgcagaagaaaaagcctcaaacatgcagatgctgatcgtttccctcctaatgcttctcctctctaccccgaatctgttggtagctaaacagcttcccttctgcagcaacgcgaacaccatcacacacatgccagagggcacctacaagaccaacctgctccagctcgccaaaaacctgatcaccaatgtcaaccagacgcagctgcactctgccaacggcacagccggggcggccggtcctgacacagtatacggcgccgtgctctgccggggggactcctccgccgagagctgcgctacccgcctccagagagtgcttgacacggccagcatcaatggaactagtggcgatgactctggctactttcagaaccagaagaatgtcaccttgtacgaccatgatttccaggccctgctaagcttctccgacaaggatttcatctccagcttcagcaacgcgccggagtgcactgtgagcgcttacctgaaccctccgccggatgctgatcgcgcgcagttcagccagcttttctctgagctcatggagaagatcgctgcagccgtggtgagtagacggccggtcaactacttgacgggcagggggtggttcgacctcaagagccagacggtgtatgcgctggcgcagtgcacggacggcatgccgccggagaattgccggagttgcctggacggcatcatcgacgaagggaagaagatggtcggcggtggcctgacgggtggcgcggtgctcgggatgcgatgcagcctgtggtaccagacggatgtcaagttcttcgccggcgacccagaggtgtcgctgcacatgcctacacgtacgtcccaccttcacctttaataaattgtgccttgttgatttggttcaaccagtctttcgtcttcacttagtcttcagtcttcattgcctgattactactcagcagggacattctttcatcttgagatgcccttatctctgtgaaaacaaatcaaacgatgagattagttcagcattcaagcatgattttcattaccccatcaacaaaaatctgcatgcttttttgagagagatttgataatttaacataaatgggtttcgattatctgacatcttggcccactttcattcactcagatgatcctacatgtcatcctcacaagtgtcaattaaagcaactgtgtaacgaaaaaaatgtcaaattatcaaatttctccttttttttggaagggtttaagttgggatgcacaattattcccgtgtgaaaatcaaccaaaaacgatttcaaaaccaaagaaactgttcaccttcccctgtttaatatttaccttcaaagtgtcgtgtggccttcctattgtttccactagtcataactcatatcaatggatgtgcagcaagcaagttttggatctgggttgtaattggatcgttctccctcatggtatctatttcatggttgcttgttcatatttggatcaaacgagagagaaaaagaggtaaataactaaatattagtctcacaacattctcctttgcgtaaggatatatgcatctgattcaattatatagctgcccgctaagagcctatatgagtgacaagaatagactgcttcactattttctttttcagaacaagcaagatttgaactacgattgctgtcgatggcagtacagaatgtaataaatctttggaggattgaagaagggaactcagggttttcattgtatgatttctctcagataaaagaagctacacaaaacttctcaagggaaaacaaacttgggcaaggtggttttggagctgtttataaggtaaattatatacttggctacttgcattgatattcaacttatttatttttatctgtatattttaaatgatttttagtttttaatcagattatttctgctatagttccattttcctttttcaaaaaacattagtgtatgcaagatccatacttacccaatgtcacaagataatgtggcactcaacattgtaattgtaccaatgtcagtttttcaaaataaaaaaaaaacagaaacaatatcctccactgaatatatgattctagtagcaattgtaatgttctttattttcagggcttgttgccgggtggtcttgaagtagcagtcaaaagactttcagcatgttctgtacaaggtttattggagttcaaaaatgaaattcagctgatagcaaagcttcaacacaaaaatcttgtcaagttactcggctgttgtattgagggagagcatgaaaagatgctcgtctacgaatacttgcaaaacagaagcttggacgtcttcatatttggtatgcctccatatttctacatactaaaatttgaagttaatattattttgagaatttttcaataacctcaattcatattctgtagactttgtgaaaggagcacaattaacctggtcaaagcgtctacgcataattgatgggatagctcaagggattctatatcttcacaatcattcacgagtatgtgttgttcatagggatttaaaagcaagcaatattctcttggacagtgacatgactccaaaaatttcggattttgggatggccagaatatttggttcaaatatgattgaatcaaacaccaccagaatagtaggcacacagtaagtacaaatatgcatctgaaactatcagtataaatgaacatgcatagttttatatgttctaataagaaaattgcatagagcagtccattttgtgtctacttattagttactacaattcctcatattattaaaaacaactcgagattttctgctggaaaagcatataagttaattatgaaattgtatataaaaatttctatacttcatgtatcttggtaatgtataacaattctactactgtaattcagtggttacatatctcccgaatatgctttcgatggggtttgctcgatcaagtcagacgtcttcagtttcggcgtcttggtcttggaaatcataagtggaaagaggactgctggtttctatccctatgatggcaaactttgcaatctcatttcatacgtgagtaaaatgtactccagataatctttatgaaacaaacagtgggaccaggttggtccagatatactctatattgcaaaccattattttttcttttttgttgacagaaatacgcctttgtcttttaacaggcttggcaactctggagatctggacaggggcatgagctggtctgttgccgtataggaaacaaccataaagtgatacaaaggtgcattcaggtggcactattatgtgttcaagagagggcagatgataggccttctatcgatcaggtggtcacgatgctaaacagcgaggaaatgacattgcccaaaccaaaccaaccagcttacttctatgtccgatccagtggctcagatgattcatcatgcaataacagtataagtatcacattggcaaggtagagtagtggattcccatcatagccattcaatagaatgatccaaaaactacggatcgacaatgtcatttgtgggtgcaagcgacggtccaatgcagttgcttctctgttatccgatttatttgtctttgtttaggcgtttaacccaaatgtgtttcagatctttttttctgtttcataatgtagattagtgtgattttgtactgctatatatgatgttctcttttcaaattgtctgtagacaaactgtaagacagtggacagtaatcagcataaacatggacggtagagtatcaggcagagctgcaattttcaaatctaagtacgagctgtcagccaccgattaacatcaatccctaatttcttcagcatttaacaacaaaacatctttagctttccaatcaggttccacaattttatgatcggaaaataggaggagctttcaagtttcaaccaaaaatggtggggaaattagacttaaaatgctgggaaacccaatgctcgaatccctaaactttaacctcgcaaaatagacgaaattttcgaataatctcacctcagatctgaaggcatttcagcccccgggtccccggtgcacgcccgtactcggagagcgacggccggcctccctcgccgacggcgacgttggacgacgggtggcggcgcggccacgattcgccgcgcaggggaggagaggattcgccgcgtggcggctaggtcgcgctcgcgccgcccttgggagtggttgggctgggccgcgccgccgtgtgctctggtgggccgtttggtgggctcgccgctcgtgtaaactggccagcccaatctttgaagatttgaaggtgatttgttttttttttcacgaacccgtaaaatgattacgtcaatatatattagaaaaaatacagagttttaagttacacggcgcaactagccagaaggccattgaaggtgatttgcacatattcctaatctcaaatttccattctctgtttcggtctaaatttcagattctatgctcatattccccatgagtttgttaaaagaattctttttgaatttttatatttcagaatttcagaacgaggaggattttggatggcaacatgagcatggcatcagctggaggtgcagctcgtgtaattacattacacattccgtaagttcatgatccagacccaaatatagagctgtcagatttcaacgattttattcgagtctaggatgacaggacaggcaatcctgcattaattcctcttcgtctcaggaaacaaacaccaaattgaccaagcttagctccggagaaaaaatctgcatataaatccagcaggataggttagcaatcatagaaattttgcagtccttgtctgctagcatgtcagtatccaaaggatgaaaggagaggtttgtctgattaacgagtttgacttggaattcaggcaactttcaaccaatcatgccaaggatgcaaacttctcattctggcattctgcaatacagcatgcgtggattacgaacagatcttggtttgtttgcacgttggactcaagagctaatctaaccgtgggtctttttttaagtacatgttttatttttttttggaaggaaggcaaaagctttgccttgtatatattaatagagcaggagaaaattatacagaggtatatacagggttagccaaagaaaaacgaatagcgcacaaaaggggaattaagaaattaagtgatatctcccaaaattctaagctcttgtagggttgttgcccctgctttgactcatgctcttccttcctccttgatctttgctagaattgaggatggtggtgacgcagagtttcggaaaattcttgcattgcgttcgcaccagatttcccataagattagaataatcaaagtcctaagaggcttgcgggggggtgtttggagactccgctacgagagttcaccgctgctcaatcgagtgacaagtttcccaactgcccatctgaaggtcagtgcctgtccatctctagatttctgcccatattctctttgttagtcctcatttggccaggaggtgtagggccgattcatccaccgtgtagcagagtgggcagatcttttggttttgccatcctcttttctccagtatgtctgttgtccataccctgttttgagtgaccaaccaggagaagaatttgcactttggcggcgcccatccagattgattggttgaagacggatcgcgcagcccaaggaactggagtctataagccgattttgcagagtattgcccgtctgttgtgaggttccatcgaatgttgtcttgattttcgtttagtggcctcatgtctctaatcattttccagaggcggacatactgttggaggtggctcgcctccgtgatatgagagatttcgatgtctcggatccagttgttttctattatggcatcgtttactgatctgttcttccttccagaggccatgaaaatatccggggcgatctgttgcggagtttgatcctccggccatttcgagctccaaaatcgtgcagtcttgccattgcccaccgttattgttgttgcggccacgaagaggtctctatctagctggttgcacggcaatgcggtccctacccaaggtttttctggcgccacccattcattccaaaaccatctgagccgtagtgctgatgcgaattgttgcagatccatgactccaaggccacccaggtctttgggcctgcagattcttttccagtttactttgcattttccgccagagatattttcgccccccgcccatgcgaccttacttgaacaggatctgttctataggctcgtaccgttgcatcctttaccagtacatgttttaaatgccagatgctgcgaaggttcaagctggtaactggtatatgtaactttcatccttaacaaggtactgtatttttttatgtaaatcttggtatctccacatactatatattttaaaattttaacatatacatatagtttctcaagaaatttaaaattaggaaacggctttgacgatgactgggtgtggcggcatcaacttatatccccctcatctcatgcttgcttgccggtgaggggtgttggcgtctttacgataggtgagtgccacaaggtggtggtgatggttggacttgtgtagggaagcacgaaggcagccctcctacaccgcagcctcctgcttgtgtttactggttggtgttatggcgctggtcgatggttgtgcaccaaaggtgctcgcagggtgggggcttctggtagttaagtggtcggactaggctttcaccaggttaccctttagcacgtacgaagcaacgatgaaattgtaaatgagatggtatgtgtaagtgagtccatccgtcagacgagctggactgcgcggttctggatggtgggctgttacaaatccttaggtgaaaaccacacccttgtttcccaagttgcgcaacaacaacaccatcagcgtcgcaacctctcaagagaggatgttggaggtcaatttctggccaaactcttatctagacggtgttctcttgtggcgatgtcctagtcatcacaaattggccacgttggtaggccttgtggagagtggatccacttttctctctcagggctgcagg

SEQ ID NO: 47768 - DNA, 707 bp, Oryza sativa
aatagaatttcccattctcatattttactacatggactatgcagtagcaaaacaaataaaaacaacgtatacagttgtactacttttcttcaaaaaaagcaccttgagttccatttcttgtgctacagtattctgttagtggtactctggtacattcagtttcatagctttatccattcatattacaaagtgatcactccactcttgaatatcatattgcaactagaaaaccaccagtccagacttgttaaaaaaaagtcacatctgttcgtttcagcaacaattatactgcgattctccacatcccaatcctttatttattcaatggtggatcattgcttcttttcttttcgaacaagccgtacagttttattcttattttatttttattttttagatgcagttcccttcagttcctgcgaaacaaagacgaaggccaagaaacttacagcaagtgaaggacaaggcgacggcaagcgcgctggagaccgcggccttccatggcaccgctcttccgaggtcaccggcccaagaagcagcagcaaccctgcaagcggcggcggcggcgggcggcggagtccgacaagcggagcagcggccgccgagggaagaagcaaatattggtcttggacgagcagataatggcgacgacgcaaatgcggatgctccggaaggtgttatccgaagggcgtggcaaggaaggagaa

SEQ ID NO: 47769 - DNA, 18671 bp, Oryza sativa
  unsure (1)..(18671): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaaattttagctccgcccctgtctactccatccgttccgaaatataagcatttatagatatgaatctacacaactgtatgtctaaattgtaaattgttaagtataattttggacgaagattgtattgaacaaaaagagagaataataccgaagatgaagaagtccaggcttctgttgggcatgtactcgtagaccagcatcttctcctcctcctgaacacagcagccaacgagcctgacgaggttggtgtgctgcagcttggcaatgagctggatctcgttcttgaattccttcagcccctgcccggactgcgctgccagcctcttcaccgcaatctcggctccatcagacaactcaccctgaaaacacgaacagacaaagcaaataataatcatgcatgttagcatcaccaagtcatccgcattttcgtcaacattgactgctaaacaatagggacagcaactatgatgccgcagattattagcatatatagcgacaaccattcacacattttggtcaaaaatcgactgtaaaaacaaaaattataggagtttcagataacttgccctgtagacaggtccaaatccgcctgtgccgagcctgtgatcttcagagaagttgtccgtggcagcggcaagatcgccgaagtcgtagagcgtgaaatcggtgctgctctcctcggtcctccacagcttcagtgcctcctctgtcttggagctgttcctggaatgtgcttccagctgccgattcgacttcctccctgtgatcaatgatggattggacatttgtggtttggttgattaattaagaactttgtgatgctgaaatggagggagaaaatgatgttcattatgagagggagttagtggcatcgtgttgttaccgtctcctttccgtagtttttttatcagtaggaggcagccgaccagcatgaaacagaagaccgtgattgacacggatagaacgataactaaggtcttcctgtggttggttcctgcataaataaagaagaaaattagtagtgatcatacagagattgtttcaatgttatttgtagaaaagataatgcactgacagaaaacaccaccattaagtggttacgtatttgaccattgtgagctcacaaccaaacatgacagtaatagtaataataatatgatttgtctttgccaattcaaacaaatttatggggcgttcagatcgtagtcaaaataaattttaccaaaatttgatatttttggcaagttgacaatattactaaaattttagcaggattttttatatatttaccaatgtttggcaacaactaaatataggcattttttaagtaactttaccgaaaaaaatattatgattgaaaatgatataatctgaacagcccctatgtaacaaatctatctgtttacaccttatactaattaagcactatgagatctctcatgttaaaatgaaagatctggttgttgattaggtggattatattatcatgccatagattgtattcagaatttgagttaaataaaaagatgacattaaaattaataccatgcatataagctggacaatcatgaaatctcttattaatagtatataaacgtaacccccaaattcaaaattaataattactactagcaagttttaattgatatggacccttccttcaatctaagctccaataattccaaaaaaaaaacacaatcaatatggtcaaaagtttaacatttataacaacgtacaacaatagtagttaagctccaactatagcttttgagcaaatttattcggaggagaagaaatgatcgtgtgtgtagcatatgtgttggttgttaccattgtttgcggttggtgagggtgcgacgtcttgcaggccgatcctgacgtccggcgtgccggcgtagaactggtagctctcgtaccggaagttgcaccggacgccgaggatccggccgccctgccggccgtcgtaccactgccggttctgctcctggagcccctggaagcagtgccagcactgcgccggcgacaggtccggcgtgcactgcgccagcccgtacaccgtcggcagctgcgggttcacatacatcacggcgctcgcgtaccgccgcgccgacgagttgtacgacccgtacatggccatctccccgaacagcgtccccaccagcgacaggaagaagctccgcgtcgtcgcgttccgcccgtcccacccgtagtaggtggacgcgttcgcgtccagcgcgttgatcaccggcgagttgtcgtccggccgcgacaggaagtcgtcgccggagtagcgcaccacgcacaggtcgtggtagtacgtcgcgtcgcggtcccggccgcagagcgcgcggaggcgctggaacgcgccggagacgcaccccgcgcacgcggcggcgtccctcatgtcgccgcggcacagcgccaggccgaacaccctgtcctccggcgccgcggcggcgcccacggccgccgacgcgaacagcgaccgcgacgacgacgcgttggcggggagctccgccgcgaggagctccaggttgagcccgaacgcgctcccctccgtgaagttgccccgggtgccattgcacgagtactccgtgtaggcggcggcggcggcgagcggcggcgagaggaagaagaagaacaagacgacgagaagggacatggcgtgtcctcttcttttctgattgcttgtgaacagaagaagaagaagaagaagaagagattgtttgattagtgcgtgtttctttctcagctttctccgtagttatgggctctctcgatctctcgcttaagtactttgggcgatcacacaagtcaaagggcttgaaattaagaaggtggttggcaaatggaattgtagccgtgatttgttttgttgtattagtcaaatcatcaggctgctgcgctgttgctggaaaatgttttttttgttctttctttctgaagcctaattgttgtgctaaatattgactcatagattggcagcaatggaagattctatgttactgcagaactaggtagtactacatgatatacatctgtaccacatggtgtgcactgaatactaacagtatttactatgaccatgtcgtcgaatgttcctggacgcaattaagttttctgttgttcctagcatgacgttacatgcgtcctggttatctgcaaacagttagagctggcatcagccatcatcaagtgctcaacgccgccggtgtcctccttcgatgagcctcagcctcatctgcagatcatcgtgacgagtattgcagataaacatcacggtgtgcaagtgcaaatgcaatgaattgcaggttttgcaactgcatttttgtcgttggaacgatagaaatttgaaggaggagcaaccagccaaccatctgaacccctaagtgtgaatgccggcgagcactgcgaactgggaaggatgcagatgatggtgtcgcattattaggttaattgtccgatgacgtgttctattggccccaccacaccacactagctgatctttgaccttaccatgacatgtataatgtgttgaaacttgaaaggcttcaaaacatcgctgttgctgggagttttattttcaaaagagaacatcgttatcttattttctactgcaagggatcaaagtcataatagtttggacattgacagcaaacgggaagtttggagaaaatatcatactaaattcaattacagagaacaatttatttgcgactactctacaacacagaaatagtttgggaaaacggtgacaactgaaaactaatgctagatttgcatagctttctttgcaggggatgcccaaatatggtttaatacgccctttcatgtggccaaaagaaaatatccaattatccattgctctttctcgcagcgggtctgaaaggaagtggagaatcggatgtaactaccaggtctcaactctcaacaccacaataattattgggaggcttggtcactttgacagtaatttagaacagagataattgaagagaattagaacaaaatttatgccattgttgatttaaacatgttgtaacttagaggaattcaaagtggaagtaatttagaatggagacaattgaagtgattgatacttgttggaacttaagaagaacataatactagtttttatcatggtttgcagcaggtaattgggaaatttcagaagggtgatcataaaaggaagacagtgcagaatagtttaactattttatcactttttggttacccatctttgttatctttcatttctagaatgttctgcagtttcttgttggtgcaccattgtacgtgctcttgtttgcactctcttcttctccagcaagtaagggcaggggaagcaatgcccaaattaatgagcattatagatgaccaaacaaaaacgagtggaaatgatccaggagacaataagctgcatgggcacattgccgcaacacagacaagtagttcagaaagaacaaaaggggaaaagaaggcagaaataaaagaagtacatatgatccaacttccaaagcatttgtcactgttccataagctgactgctggtacaatcaaaaggtatgtcttgttaacacaggacataaattttaactagcatagggcatagggtaaacaccagtgaaaaacaagacataaccttcagaacaggacataccttccgaaaggccaagttacgtgccatctatgatttcacaacattcttcaaaacaacacaaatgagccatcacacaagtacgataaaacagaaattcataattcatattagagattggctgctgaccctaagcctgattctcattacggtacaaagatggttttgcaataacataagtggagccgcacctctgcatgttagcaccacccatcaggtaatgactcagagaacattggaacatatggtaggtatggcaggcatgactcatgtccgagtttgcgtatgacacggacttccttgcgatccatttcatacgccatcaaagtattgtgccatccataaacaaagaagatcaaattgcattctggatgaactgcaattacttggtagtcaaaatctaattggtatttctttcgtccaaacagattaattgagctaacggtgtgctttaagatccaattatctgtatcatagtcttcaagaaaccaaattgacagttcgaggatatcatttggatcaacattaaaagcacacaagcgaccctgagtttgatgaattatcccaatatcaccatcaggatccggcatgggaatcttcctccatttcttcccctccatgtcaacagccacaatatcgcaagtcgtgacagaatgcagaaaaccattaaggaaaacccttgtccgatcgaccggaaggctaaccataacttcatcatcccatccatttacatggagactccataacccagttttagacgaatagatcaccacccctgtgaccagtgcgtcgtattcatcttcatcctccacatactcttcatcctccacatactcgagcacatggaaatgcgacgagatggctggatcgaaacacaagcaggcggtgcggttctcgtcaatagcccagttggcgtccggcaacatcacacattccccggtcgcaggattgcacacagcatactggaactgcaaagtctcacgagacacgtggcagcggcagaggaggaggccattgcagctatccaagatgacgacgtggtggcactggggcaggaaggagaaggtcgggcagacgagaggcatgcctctcccagtggcgttggtgaaatggcgcgccatgtgcgggcagcgctcgtagtcgatgctcttgtagaagaagcccgatagcgtctgcggcagcttcttgcggtgctcgtggtcggcgatgagtttgcgccatgacttgctgacgcacttgaagcggcacacggagcggacggggaggcggcggaggatctcgacgatgagctcgtcggtgatgctggccgcctgctggggaggttctcctccatcgggggtggggtggaggagaggaagtcgtcagcctgcaaccgcgggaaaaggattcaccgcggcaagagcagatcaagcaggtgagcagatggggattaaatcaaacaagacatcaaaatggtgaagaaagaaaaatctggctacaaatcgacatcatgggttcgttaatccacctactaaacgaactaatctgagatcaggaacctaccgatcaaggcagggaagagcgatgctgccgcgcgcgtgacttgccgctcggcctcggctgacctgtgtggagctcgtcggacgggacacctggacggcaaacctagcgccctcgccggttaaggccaaccattgcgcccgctaccctgctgcgatgtgcgcccgtcacggagaagaagagctagaagcggcggcggcggcgacggcgccgagacccctagatgccccaaaatccccaattcaatgtctgctgggacattggttccaaattctagtcaccctacgccattaagaaagttggagattacgtgtgttccaaaaaaaaacttttgagttacctggcatgagacaaactttcttttgcctatgcgccactttggatggaatcagcactaacggagacaaacggaggtttcaaagatctattttacccttgctaatggatggaatcagcattaatggcacgccggcaagggccgccattagcgccgaaagacaacgttattggcgccgacgaccggcggcggcggcatgccggcgacggcgtgccggcggcggcgacgaccggcagcggcggctagaggcgcgccgccggatagacgaggcgaggcggcgtgccggcgaggcgacgaccaacagcgacggcgacgaccggcggcggcggcggcgtgccagcgaggcgaggcgactagagaggcggcgacggataaacgaggcgaggcggcggcggcagatagacgaggcgcgtcgccggatagacgaggcgaggcggcggggacggcgtgccggcgaggcgaggtggcagtggcggcgtgccggcgacggcggctaggctagggcacgggagaggagtagtagagatgaaaatgcttcaggggcaatttagtcattttcatacgtgggtcccacatgtcagagctcattctctaacagaaggtggatggaatggcacgcgggtaaacgaaagtttgcgtcatggcatacaggtgactcaaaactttttcgtggcacacgcgtaacctccaactttcttaatggcataggggtaaaagactctccaaattccacttgaatcgggcggtcgggccttagtttgaaggaataagttcactttgggtccctctatttatcgcccaatccaattttcatcccttcatcgcaaaaccgggtacgacaggttctccaacttacgaagccgtttaaataaggtccctcagcagtattgtgcccagttttggctgaggtggtgcctacgtggctaattttgactaggtctttgtccaacgtttcattgacgtggcgattatgtgacaattagatcaaaaaaaaataataaaatctatgggacccataagtcagttgcacatataaataataaaaaatggtgggcccatgtggacccatacgtcatcctctatctctcttcccctcctctctctctccggcggagtaggcagtgcccggctggcgaagcgggttgggcggcggccggagcgggctacaagggggtatcgaggatgacgtgtgggtccacatgggcccaccattttttattatttgtgtgtgcaactgatatgtgggtcccacgggttttattattttttgcgaatctaattgccacgtaagcgccatgttaatgacacgtcggacaaagacctagtcaaaatgagccacgtatgcgccaccttagctaaaaccggacacaatactgccgagggaccttatttaaacggtttcgtaagttgggggacctgtcgtattgtcacaccccaatccggtaccgccgtacaacggcacctgacaggagcgtgtcgtaggaaaaacggcgcgaaccgcttcctacgaaaccgcgatcacagtaccagtcccaggacatagtactggtacccacggtgacaaatatgaatcattgcaatccttaaaataaatagaggacttatttaccttaacttaggttgcagctcaaaacagcctgagaaatgcaaccgacgacacagacgaggaaacaccaacaacagcagcagcagcggaaccaacggactaacacccaacaccacaggcgacggctgggaaccaggacgaaaccctattcttcacttcacatcatcttctcttcaaggcggaggaactataaatatttatatagagcaagggtgagtacttccgtactcagcaagtcacgggaatttaggtgtttaatgtaagcttggaagagaggcaaggttgttttgcaaatcctttgtttgaaatcattttgaaatcgctaggtgattaatttctttttaggtttgggtcaaaaagagacttgcgtctcgattcaacttaagagatgcttttcaacagctcaattggtaatgtaccgacctcccaggtcagatcattacttctcggctcccagaaccatttcacttgattaagcggctcccagagcctttttcattttctcagactcccagagtccagctgcctagcagcacaacaatccgcttccactcgggaggcctagtctatgatgcccgtagacatcccgaatcacacagattcgtttccgaccactcgagtcatccatctgccacataggctgattctggttacgattcccaatccacaataacttttcacaaagcacaggcaaacaaatctacgcaacgagaaccacctcacatccgcccatgaccgtgggcacggctgttcgaacagttagttaacctctgcagaggggtacactttacccacaagatacgaacttattccgaacacccgtcggtatcggaggttcgcaacaaagcctttcccaagccgacccagggttacctcatgccacatagaaggataaaatccttcacataaatataggccatttcagttttcgcaaatcaaactccaaccacctcgatcggtaatctggcaagcttcgcgttcttgccttaccaggaacccgggttggctccaaccgaccccgcctcggcgttccccaactattggcatgcgaggtttccctgaaccgactagttacttagctagggtgtcccattccaccttgtggttgcactttgttatgcttgatgaatttcccacaggaatcggtccttatatgtgaatacggaacagtgccacgcaggcacaacccccgcatcgcgagttttcacaattcattttatttttaaacacaccgacaccacatgtcgggttttcaaggcttctcaaacccattcacaatttttcgacaatcaacggtgtatgtgggatatttggtatacgcgctcagagagcatggatactgaagtaccgcaaaggtggagcgacaaggaatctggatagtacaacctacaggaattagtgcaactactaggtaggtccgtcggtttggcacgcaaaccgaggccaagcaaattaagtgtgtgattctaataatgcaagttacaaacaaaataataatgattttccaattataggagcaattggtcaaagggagacttgccttgctcaaggtcttcacggagcttcacgaatcttcgagaaaacccgcgatcgacgaaaatctggtaaccgcaactatacgcaaacaaacaaaaacctaaacaaaagaccaagaaaaagaccctatttagactaaataatagtgccattgaatagatctcaattttacgaaattactggaagttgaacgaagtaaatcggatgagcggttcaaaagatatggattttcgaagtttaattggattttccggaatatgagaaatgatttattgcaattctagaataaagaattgatttagggaacaagggaaaaaggatttattgaattttctggaaaagaacattctcaagaatattcttttatcactcattgacatgtgggggccaacatatggcgagagagaggtgaattgggagggagcagatatagacttttggtcactgtgtttggggagggagttataatggacttcctttctcttatcaggccgaggaggagggtggccgatgggccaagcccacaagcacgggagagagaggagggggtggctgactgggcgctgacggggcaggcgcgaccggtcagcttgacttggtcaagccgatgtggctgccacgtcggatggggagggagaggaggctggcggcgcatcggacggctgacggcgcgcggcggaatccggcgaacggtggcaaaccggagtgggcggcgggcaccggaagcgagagggggtcacggaggttccatccaccggctcggatgtgggagaggaggcgcgacggaggccgtgcgacggcgggatgggtggcatggcgcgggagcaaaagaggaggccggcggcggaattggcggtttggggtggttcattggagctcaaggtgggtggcggcgaggggattcggcgcgggaccgaccggcggcgcgcgggcggcggcggaagcaaagcatcggcaagggcgcgatttggaggacgaacgcacaaactaccatgccccagtgctgtttaggagtcgctagaggatatagacgagaggatttgggcggggagctcacccacgagcgggaacggcggggcggatggagtcgcggcgaggcagacgcgacggctgggcggcacggcgcggagatggcgcggccgggaaagcaaggaggggcgcgagggactccgttggcggcgcttggccgagcggcggcgcacggtggcgaacgcgacgccgaggcgggcgctccgaggaaggaggggacacggggtggaacggcttggtgtcggtgcggcgttcttggccgtggcgacgaaggaggcgggggtagtacttcgttccaaggagcacggggcgaagggggaaaggattgtgggcgtggggttgggattttataggcgaagaggcgctcggctggcgacagcggcgttttcgtgggcgatgcgaaagcggcgacgacgtggatgcattgggcggcgaaggcggtggatcgtgcggcggaaattgaaccgcgggagcgggaggagcagcgccggctggcgcggggcgagctggcgctgggtcaaggtgggggcggcgagctgacggctgccgtcagcggctctgccttcgagcgcaagcggactgtaacgccccgattttcgttcgggattaaaaatcatttaataatacattttctggaaattaaataaaagttaaagcaatttaatcaagtgaaataatgggagaattaaaatttttcccttaaaaatcattggccgggaatattttgtaatattctttgtgccctaatgtactctccggaattttccgtgaattttcggagctcgagaaatagtttcaataacacaaagatcattgcatcaaataaaataaaaagaaaacaaataaaatttcccccttcctctctttgggccattttcggcccaagtcttctttcctctcccgcggcccgcgcgccttctccctctctcgggccggctcccctctctcttggcccgctcgcaaaagtctgttttgcgtccctccttctctcccttcgccgacaggtgggaccggcggtcccacccgtcagctcctcctcctacctctcgccggccgatcccaaccgccatagccgtccacgtcgccgcaaaatccggcgccctcccgcacccgagctcgcatccaacgacgtgggcacgatcccctccacgtcctccaccatttcccccactctccccgcgaaaatcggcgccggttaacccctccaccaccccacgtcggcgccccacttcgccggccgattccgccacgtccggcctcgatcccgccttcccgagcccataaaaaggcatccccgtgctcccctcatccattttccccattttccccaagccgccgcgccctccctcgctctccccgcgccgagcccacgcaccgccgctctccggcgaactccagcagcgccgcgccgccgctcccgtccgccccgcactgcgccgtcgccctccccggcaccgcagtcgccgtgcgcaccccgtccaccgctcctcttcgccaatccaccgccgcaacgccgcttccaccgccaccccgagccaccttcgcctttagccgcctccatccgctccccgccggcgagcgccgcctcgcccggccgtgcttttgcctccaacggcttcgccgcgtcgtgccgcaccccggcatccactccgtcctccccttccacccccgcagcaccattcccaccgtgcaccgagccacagccgcctttcgtcacctccagtcgcgcgccaccaccgctcccgtcgctgccgcgctgcgctaccaccgccatcggcatcgccgttcctcgccgcaccccggcccctactccgtttcccctccctgcccctggaacgccgccgccgcgttcaccatctctttccgccgccagccgcctccctgtggtcgtctcgccgtcgccgtcctcggtgagaatccccaccgtcccttctcctttttttcctcctccgccgctccccgtgcccgctgccgcgacgcgccgctgtcgccggcggtcgtctggccgcacgccgccgcgcgctatcgctcggccgagccggtttcatgccgtgcccgtgccctagccgcgccgcctcgtggccgtccgatcggcttcgggccgatctgggccatccacgtggtggacgcgcacccgaggccacgtgtggacttggtccaccgtgcgccgcccctttgtgccgctgacgtgcggggcccgcctgtcggcgctggtttccccttgctgacgtcagcgaggtccatttcctttgtaaaaataaataataattgcgcaataaatcgagtttaattctagaaattcattaaaatggctcaaaacttctaaaatccatatctaattcattcgaactccgaattgagctgttcaacttgcaaaattcatctaaaattgagctctacatgtttgtttactttttatgtactgtttccttggtttttattagagtttttcctcgttttgcgtgccagcgtgtagtttccgtcgtttcggaagtccgcggtcgcgaggaaaagagttcggaagatcaaagtgaagaagcaaggcaagtcacacattccccttgagcatgttgatcctaatttacaaatgttttaccgtttgcaaataaatatgcatgttttgctaattacacgggatcagggtttacctatctgctcgcttgtgccatgtttacttgatatctgttctttgtcaaccttgggtaataaatcgactagctcatgttacttatgtgacctagctagaactatatgcttagccatgcttaattactactagctcagttgatggggtaattacagtattagacctttttagtatcagattgagctgtgtgctcgagacacctggccatgcttcatggtcgtaattatccaactaaaatgcgactacatggtgggctgtgggtgcatggttttgctggtcgcacccatggcagttaaggaccggttcgcgggatgccctggaagaacttatcgtacttaccacaagccagcgtgggcaacggctgggcttgtagtgtagctttcctctagtcgacgcatccaggcaagggtgggcgtgatggagcggggcgggccctgcgacggcctctgtcgcttccggattcacctaggcacgagaggggactgcccgttgcccgctggggacgggggtgaaacctgaggtgtggtgtgcttggctagagggggttatgcgaagggtcctgtcacggcctctttccggtatgtcgtggtggcatgtcggcgcacggaaacgtgtcgtggggctgtgtcttgtgggtacagttgtacacctctgatcagagtaaaactattcgaatagccgtgcccgcggttatgggcggtcgaccagattcaccgtgattagtcccacctcaataaatcgacctaatacactgtagtttaggtgggttggttgggcctgttcaacgtggtgtagcgttgatcagtggagatttaatgttactttaattactcaactgttttactgttttgctcaataaaatgttttacaaccgcctttatgcaaatagccacaaaccgtccttgtgttccccttgcacgtctgcatcgttggtgtggcttgctgagtacggtggttgtactcagccttgctattattcccccttttcagaagtgtagtgcttctgagctgaagacgaagttagaggaccaaggctcagaccccagttgagttttgcctgtggagtggagctgaagccccgctaggatcgcctttttccgctgctgctgcttttgtttcggtgcgaggactaagtgcctcttttgtaagtattttacgctttatttacgtttggaactgtatattacttgtcgttttgtgtaccctggctggtcctggacagggatttaatacacaaaatagtctggaaatttgggctaaatttctgggcgtgacacggacaagggcgagagagcgagcggttgagcccgagggggaaaaaaggcgaagagggcggtggaaaggggaactcgtcccttccgttttgggcggcgggcaggcgagtcgcggaaaggcggtcacgcgaggcaggcgacgaccgggtggtcggcctccacgcgagcgcgcgcgggaaaggcgaaggcggtgggagcggcgtccttgccggtcggccatgcgcgagcgcgcggaaaacggtgacgcggccggaattttggggcggcgtcggcgggaagcgacgccgagagagagagagagagaaaggagacggcgctgtctctcgctcccgaacacgtgcgacgcacgcgcgagagagctgggccgagaggaggggatgggccgggagagaggaatcaacccatcgacaagggaggcaaaatagactttttctgaaagattttgatttggagagatttggagtttgggttttgaatctaaatttgatactttgtacacaagggttcaaggagtcaaggaaggaaacaaaacgggagtttggatattttgggattcggaaatgtatttggcgaggattcaaaggaaggatttgaatttcggaattgatctaggaagttaaatcgggatttgaaatcttgaggtggagggttttgacagtgacgagagggaacaaggagattaaaactgagatccacggcacgacttagactcgcacacaaagaacgaaattttcgcaattcggattttgccgaattagtttttaacgtctcacgagaagcggagcgttacacatatccggttttgcgaccaagcaacaaaatcagactaggcgacaaattgagggacccaaagtgaacttattcctagtttgacagacaaaactcaaccacgggagttacatgggctgggttactcgtttttgactaactctcaaattacaggggaaataagtttatctgtggtcccttaacaacgaatccgatttcatcctttaaccgaaaaaccatatacaacggtcccttaactgtcaaaaccgatgcaatataggtcccatagcggtttgaacggcggttttcgctgacgtgatgcctacgtggctattttgactcggccttcacatgacgtggcaatgacatggcgcttacgtgtcaaatcgatttggaaaatattaaaaattgtagacccacatgtcagtttacacaaaaaaaattagattaaaaatggtaggacccacgtgggccccacatgtcattctcaccctcctctcttcccaactcccctgtgataatgaagttgtcgcagacccccggctcggtgaggtcgttgttgtcgacctcgatgtctctcagaaatggtgagtgcttgccgagctccgccggaagctggccggagagattgttctcgaacagcttcattatcaccagcgatggaagctgagcaaggcttgctcgtatctcgccggagaagttgttcgccatcaggactaagttagttaggttcatcaaacttccaaagctctctgggatcgttccagtaagctggttctcagatatgtccagataaattaagcttgctgctccaatcttgccattgacgacgacgtcgccggtgagctggttggtgtacaagaacaagtactgcagttttggaaggttccagatcccaggaggtatgcctgacgtctgacgagcactaaaacctggccaaaaccgaacacaggttttaggagagggattaggagaggcaaagggaatcatcccccacagggtttaagtgagatgggagggaccctggataggttcctttggggattaattcccaagcaaccgaacaaggacttatggggccaaaagaatattcattgctctttctcttcttattcttctgagaacttccattgctctttctcagaacaggactgaaagaaagtggagaactatatggaactaccaggtctcaaaaccacaatgattttagggaggcttggtcactttggcagtaatttagaacagagataattgaaaagaagaagaaaattcataccatagttgatttatacatgtcggaacttgaggagctcaaagtggcagtagtttttatcatggcttgaagcaggtaagtgggaaaattcagaacggtgcccatcggaggaagccagtgtggtaatagtataactattgtataccagtctttgttacctttgaagtctaaaatgttgtgtagtttcttgttggtgcacaattgtatgtgctcttgtttgcactctcttcttctccaactagtaagggtcagagaagcaatgttccaattaatgatcattgtggatcacttaacaaaacgagtggaaatgatctaggagacattaagctgcatggatgtaacatagacaagtatagttcagaatgaagaaaagggaaaaaggaaggcaaaaatcaacaaagtacatgtgatccaacttccaaacattagtcacggttccataaactgactctgctggtacagtcaaaaggcctgtcatgttaacacaggacataaattttaactagcctacggtaaacaccagcggaataaaacaagacataaccttcggaacaaccggacataccttccaaaaggccaacttacgtaccatctaggatttcacaacattcttcataacaaaggagccatcatccaagtactacaaacagaacttcataattcatattagagattggctgcccactctaagcccgattctcattagggtacaaagacggttttgcaataacaaaagtggagccgcacctctgcatgttagcagttaccgcccattaggtaatgactcagagaacattggaacatatggtagatatgactggcaggactcatgtccgagtttgcgtatgacacggacttccttgcgatccatttcatatgccatcaaagtattgtgccatccataaacaaagaagatcaaattgcattctggatgaactgcaattacttggtagtcataatctaattggtatttctttcctccaaacagcttcattgagccaacggtatgctttaagatccaattatctgtatcatagtcttgaagaaaccaaattgacagtttgaagatatcatttggatcaacattaaaagcacacaggcgaccctgagtttgatgaattatcccaatatcaccatcaggatccggcataggaatcttcctccatttcttcccctctatgtcaaccgccacaatctcatcagcaggcgtgacagagtgcagaaaaccattgagcaaaacacttcttcgattgaccgaaaggctaatcacaacttcatcattccatccattttcatggagagtccataacccagtttcagacgaatagatctccacccctgtgaccagtgtgacgtatgaatcctcatcctcttccacatactcaagcacatggaaatgcgacgagatggctggatcgaaacacaagcaggcggtgtggttctcttcgatagcccagttggcgtccggcaacatcacccattccttggtggcaggattgcacacggcatagtggaactgaaaagtgccacgagacacgtagcagcggcagaggaggaggccattgcagcaatccaagaggtcgacgtcgtggcactggggcaggaaggagaaggtcgggctgacgagaggcatgcctttcccggtgacgttggtgaaatggcgcgccgtgtacgggcagcgctcgtggt

SEQ ID NO: 47770 - DNA, 2499 bp, Oryza sativa
ggacatgaagaccgagtgcattgctgctacagtaattcggcttactgtagctagcatgtatcatgtgcacgtgtgctgccatgattgaatggcaaggagaccaacaggagctggccactaggcttgtgggctggcagttcggttggcaggaaggccgagccaacccggcctaagcacgttgctgactcaagatggtgaaggctaggccgagcaagccctagacatgacgatggcccagctcggctcagcaaatgcacaggtgtgtgcatgcgcgcgcggaagcgggagatcgtacggcacctggaggcgtggcggccttctgttcgtcaaggaagcgaccgggtcccacgcggtttttcgcatggtgcgcgcgggaacatggttttcgcgagcgcgcgcagaagcggctcggtgggaggaacggcgacgtggcggcttcggactggtggtgcgcaggcgtgagaggagcaggcacgcgctctctgggacgcgtggcgcggatgcgttggcttggaggagcacgacgcggatcggtgcacgctgattggcttggagtggaatcacgcggatcgcacgagggcgcgcaacgtggagagctcggatcaacaacgtggcgactatccaggaggcttccttcggatctaaggaacaatggacagccaggattacatcaaggctagggtttcgccctagggatatttgagacaatgtcttaggggtcttaggctataaatagagagatggatgcaagggtggaggttgctccttttgtaatccttttgagatgctcggtgagagagtttcggtgtgagtttggagtgtgtttgcccgagaggcttttgtattaggattagtttggagtgtgtttgtccgagagattttaagtttgtgttaatgttcctctgaaggaatatgtttgctcttagttgagcggttattttgcatcacctttgaatgaaatgatttgaaggatttcgtttttgccttgttcatttaaattccgcaatttaaattctacttgcaatttaaactttgcgatgatgagttttgttatctcctcctcacctctcttctagtttgggaaattccttttctctttctcttctagtttcgggaatttctttctctcttcttttctagatccggcttctctaatagccgcggttctagtaaggatttttgagaaatccggcttgatgagtattttcgggggtaagatttgaattgctatattcaccccccctctatagctgttcttggtctttcaattggtatgagagcaaggttaagttcattgtaacctaaccgtggcaacgaacgccgctatggaggaaaaatattctgcgaaaccatttgttttcgatggacacaattttgtcatttggaaggcacgaatggaggcctacctccagtcgcaagggcataatgtgtggaataaggttaaatcaccttacactgtgcccgatgatgctgacatcacgcctgcaaatgtggctcaggttgattttaattatcgtgcaagaaatgcaatcattggtggaatttcttctggtgaatttaattgtgttcaacaccacaagtccgctcatgacatgtggactgctctgtgcaatttccataagggaaacaatgatattcaattggttcgtcagaatcaatttcataaagaatatcaaagatttgagatgcacccaggagagtccattgattcttatttcaagcgttttggagaaattgtttcgaagttgagatctgttggaaaagaattttctaataatgataatgctcgccatcttttgaattgtcttgattatggtgtttgggaaatgaaagttacttccatcacagagagtgcacctctgagtgaccttaccatggacaagctttactcaaagctaaaaacccatgagatggatattttccatcggaaaggcctcaaacactcgatggctttggtagctgatccctctggtagtacttcttctaatgactcagcttttgtgtgtggtggcttctctcttgccgctttacactcagtcactgaggagcaattagagaagattcctgaagaggatcttgctctttttgctagaaaattctcaagagcttacaaaaatgtgagagatagaaaaagaggaaaaaccaatgaaccatttgtgtgttttgagtgtggagagcctaaccacataagagtgaattgtcccaagttgaagaagaagagtgacaagacgaccaagaagcccgagggacaagggcgaaaggggaataaggatttgatgaagaaggcgatccataaggtcttggcggctcttgaggaggtgcagcttagcgacatcgactccgacgacgatgatcaagaaaagggggacaaggacttctccgggatgtgctgtctcgccaacaacgaggacttcatcaacctgtgtctcatggcacttgaggataaggatgactcatcggagcatcctgaggtatgtcttgatgatatcccttccttgg

SEQ ID NO: 47771 - DNA, 4064 bp, Oryza sativa
ttgaaagcaaatccgttttgaatgtgttttatgcaaataaaatttgctttatgctaaaaagaaccatactatgccttccttgattatataccttgcaagtagggtgtaggcttgtcttggtgcttgccagtacattatttctaataatgtactgactcttgctgtggaattaacttttgcttgcaggatttagacttagtctttgagtgatgcgggttatcgactgcttcttctaggacttgaacataatgggtaaacccctagtcggtgtgcttgtggattgggtagacaagtttccgctgttctattatttatttggccggtcggccaatgtaactaaagtagatgtagtttttaatcgctttcatcttatttgtgtttgctatgtataatcatgcttgagatgaaagtgtgaatctagtgcacatcctgggaactagattcacatgagtatgagttaggaatatttgagatgtagaactttagccatttttgtcaagtctcctgaatgtgtaacacatctggtcgccgccttcgagtggtttgacgggcacatctcaggctgaagttgactggcaggctaaaggcctagcaatatctccaatattcctctctcgaggcgtcggatatttcattatgcttgtttgatgacttgaattattcacttcatctctcaattataatggaaggtccggagagcctacgacataatgttaatagattgttgctagagaaaatattgatggtttacaactctaatatggctaattatagtacaaaactataaatgctacaagtcaactatatgggtatgggtacccattggatacccgttacccgcacgggtgtgggtatggggaagattttctactcgtgatgggtgtgggtatttaagtgggaatatttagacgtcacgggtgtgggtatggggcaagagaacccgatgggtatgcacccgttgccatccctagccgcgccgcacgcgcctgtcacgcgcgcgcccacgcgcgttgaccgcgcctggcaggcgggtcccgcctgtcggacccgtcttcctcccccagccggcctcttctctctcacgtgcaaacctagcgccgttcctcctccaaatccaccccattcaagccggctctttccaaattaattggggggttttaatccccattgaatcctcttcaattccccccaatttcccccttgaatcgtgcccccaatcgccgggaatgcccgcgccaactccggccaccttccatggtcgccggccgccttttccgccgccgttccgacctcccccgtggccggctccctctcctctcctataaaatggaaccccctcgccccgttctctcgttttagccccctcccgcgatctcctgtggtccctagccacctccccaccgtggcccttctctttcccccgcgccgggcgcctccagccgcctctccctcctcgaccgtgcgccggccggccgtgccgtcgccttccccggcctcgtagccgcctcctctcccatggcctgccctccgtttcgcgcggtgaccgccggaggcgcgttcccgccgtcgtccagtggcgttgccgccattataccacctccagccgcctgtgccgcctcgccggtgcagcggctgtcgtcgtcgccatcctccctcgacatcgccgcatcgccctccaccccggcctgccctcggtttcgccggaacgccgtcgtgccgcgccggcctttccatccgcctcgctggagttccttcggcaaccccttccgccgtgcccgtgtgccggccgacgtcgccgtctccacctccggcatcgcagcggcaaggtcgccctcggcctcgcctcccctccccctgaacaccgccggtgtccgtcgtcgtcttcaccgttcatcctcgccggctcgtcgtctcgcggcgccgcctccgtcgtcggattcgcagcggcgcgttccacgtcgtccccgtctccgtgcagctgccgccggctgccctcgtcgcctcctcgccggccccgggcgtcgtcgtcgtcgtcctctcgtcgttcccggtcgtcgtggcgttcgtccctccgtcgagccattctcgtccgtcgtccgcgttcgtcaagcgagccgctgcagccccgtcgtcgtcttcgtcctcggcttcgcatcgtcaagcgttgcgccggccgcgtctcgccttcgtccaaggatcgccgccgaagtcattccctcaccgtccgtctccgcctcgcccgttcgtcgttgtcgttcccacgcctcgtcgcgtggtggtaaggatccctctccctcgctgccccgtcctcgtcctttcggtgtcgcccatgcctattgtgcggttgtcggccccggtacccgtgtatcggtgtcggcagtcgttcgcttgtgcgtgtggtgaccgtgttagtgtgtccgctcagtagcagcgtggtttccacgtgtgcagcccgtgtggtgtctagtggagtccgtttgtcggccactcgcctcggttgacacacaggatccgcttccgtcgacccgtggaccgtctctgtgtactcggtctaccgcggtcctttatgttgacatgtgaggtccgcatgtcaacagcgcagccttcctgtcttttccaggttagcgcttacacatgttttgtagttgcaaaaccaaattacaataatccgtaaatctccatgtaacagcattaaacttcggatgatcatatcttggtcatacgaactctgaatcgacccgttcaagtctcctaatgtttgttataacctaaagaaccgtgtgctttctttttatgtattgttattgcttctttataggcttgtagctttgcttgtgtgcttcgcgtagcttctgtcgttccggaggttctcgaagcgtggtttgcggtcgtcgccgagggtttggaaggccgttctctctgagcaaggcaagtcacatcatccttgagcatattgaatcccagtttataaaattattttgatttaaattaatgcattatcgttttatttaaattcccgcgttatcactgttttatttagccatgcctatttacctttgttatgatattattattgctattgttattattaccttgttcaccctagaataaacaaaaccccaactagtgggcactctattcatggttccactagtatgaatttaggtagatgcttcgctaattaattaggcaacattaggtggttttataactctagactttgggaatattcatatcacttggacactatggaatggttggattattgtggaattggatgcacacctccccctctattcaaaaccctcaaaatggttttaggctgggctcggggtgcatggttttgatagtagcacctcggccacataaggaccggtcttcgggcctctgttgcaaagcactaccgtacttccacatgtctagtgggtaaggcttagtttgtggctcagtctggttataaacaaaggtacacggatggagatggacgaagtcgggggtcgatggacatctctaggacaaatgaaggctacacgggctgtggcccggtagtcgagatgtcatggcacagggttggtgtcctgctgctaggggctcaattctgcctgcctgtctgggggttccggccgtaggtgggttgggtcggtactcttgtctatggctaggatgggttggaaactatgtcatgtcttccgtccatatgccgtggtggtatgtggcacgtggttgcacgtgaggaagacgtgtcttgtgggtaaagatgtacacctctgatcagagtaaaacctattcgaatagccgcgccctcggttatgggcaagcctagcaatgtacccaagttagtgttttaaattcttaaaacctgcttaataactaaaatgtggaatggttggcctgggttggcttgggacgagctgggacccagggtcgggttgccagttcggtctgaatcatcgtaggccttgggttaaggcaggttcgtgtgggttcacggccttgattaataatactgtgtagctctaggatcgtctttataaaatggctttgggcaactaagtgacttttaa

SEQ ID NO: 47772 - DNA, 2635 bp, Oryza sativa
ttgcattctattagttacctactataaacatcaagattttgcccttacgataatttaattattttccccacttgttgaaaatatgtatagcaatgcacttttataacataaaaccagttgcgaagtgatggggaaaaaactaacatttttttcttctatcaatcttaggggcaattgagcagtggacttaaaatagcagtcaagagactagaaacatgttctttacaaggtttactggagtttcaaaatgaaacccaacttatagcaaagcttcaacacaaaaatctcgtcaagctgctgggctgctgcactcaaggagatcaagaaaaaattcttgtatatgaatatatggaaaacaaaagcctagactacttcatctttagtgagccctttattttctatgtgctcgaatgtgatgctgtttataatttatactaaatgttaactaataattgcaaatgttctgcaggtaatgtaaagggagcacaactaaactggtctaaacgtcttcacataattgatgggatagggcaaggacttctttatcttcacaacttttcacggttatgtgttgttcatcgggatttgaaagccagtaacattctcttggatagtactatgaatccaaaaatatctgattttgggatggccagaatattctattcaaatatggcagagtccaataccaccagaatagtgggcacacagtaagaacatagtagcacatccattttgttgcgcatcatattgagatttgagatatgcttctttcttcttcttttgggggttgtgtgtattttccttgggggagggggggcatgcatgaagcatccaatcagcaatatttaaattctatctttttcatcagtgacaagtatcgattttgcttccttcacacagtggctacatacctccggagtatgcatttgagggggtttgctcaatcaagtcagatgtgtttagcttcggtgtgttaattttggaaatagtaagtgggaagaggacagcccacttctatcaacacaatggaaagctatataatctcatttcatttgtgagtactgataccccaaatcctgatttacttttctatcataccagttgtttctataatgaagtgcgcatgacacttatttaacgaaagcacactattctggtattaggcttggcaactttggagagatggaaaatggggtgatctgatttattatcctccagggaataaacatcaagagatagaaaggtgcattcatgttgcgcttttatgtgttcaagaaagtgcagaatttcgaccggctatggagcgggttgtcacgatgctaaacaccaagaatgtgagcttacccatgcctatgcaaccagcttacttcaatgtaaatcctagcgaggaagaagtttcatcatgcaacattactgtaagcatcacattagaaaggtaggaccacatagccaacaatgtttttcactacaaagttgttctcaatgctgttaaagatacaagttatattaaaaaaaatgtttacatctaatatagtgatttgagattgcttacatttgttgggctgaacttctttggattgaatcttcattgccccttaaggcacggagcattcttgatcctatgctagttgtccattcctagaataaactgcacaggaggagtatagaggaagcaaagcagcatataggtcagtagctgttaccagcgaggtggctgtagttacagctgatagtaaaatggccccgcaaaaaaaaaaaaaaaaaaaaaaaaaaaggctgatagtaaaatggaattggcaatcaaccgaaaaatagtcgcgcttcctagctatccccattcgagagagggaccgcgaaaagggactcctaccaattaatagcggaagatttgcaattcctaaagcatctcgcacctatccaagttacagttttgctgccgcgccatcgatctctcgccctcacccgcagaaaagataagataatatcatccattcgctatccctagccaatctaatcccaaaaagtgaaatcgcgacgtctcgatgttcaattcgaaaagcagaacaacaataatgcagctgcagagacgaacctgcggtgtgcttcccacccccccccccccctcccccctcttctcgtccagctaggcgaggttcggccgcgcgcgcgcgcgcgcagcgcggacctcggaggcccggatccgccgtcacggtgggggtgcttcgccggtggagctcgccgcctcgccggcgccggcgccggcgccctcaaacccttgcgccgccggccaatgcagccatcctgggcccaaaaccgccatggatgacgaaaggcgacaggccgaagaacatttgttgggctggcgggcgtgacgtaagcgacgccggcccatttttggtggtcctttctcttgcatcttgccaaagcgaaacatccaatccaaccgtgtcaaaaaaaaaaaaaaaaccaaacatccaaccactgccattgattttataataaaataaattaaaatggttcatatcagagctcctctagcgaggagaccagacacccctttgtgagtttggttagggtgtaagttttaagctcgggtcacacatgaagattgatacaaagaagtatacagattcgg

SEQ ID NO: 47773 - DNA, 1271 bp, Oryza sativa
tacaaaagtcttcatcatgactgccacacgggcccacctgtcagccaccgcagctagtgtaagggggctcatgaggtaaacatcgagggcatgccatgttgcgcaccttttttctctagggcgacatggcgcatgaaggacaacatgcaccgtcacgtctctcacatcgctggtgagttgtgcacagggatttgtaccgccctgcaactaatatggagtgacggtataaagaaacccataggacgtgtcaaatccccttaatgggagtaggatggatctttctggggaaagcctaggtcctgcaagtgtcctcggggccctgattagacctcgcggtctcgaggcgttgaaggcttgtcccagggctaccgctgtgctcgggtcaccccgtgtgcttggagccacaaatgtcatcgtgtgtggacttcttttcatatcgggggaattaacttagtggactcttcagcaagcttcccgaatatatcgttgttgaagtagttcgaggtgtatctgcttcagttgcccaaagatgtatatcttgtacatctccatgctcttcttcagcaccttaaagatacagatcttgtacgtctcgataaggctcgcattgccctaggcatttgagggaacgggaaccctcgttcccacttccccgatagatcatattgaaataagtccacattagttacaacttacaaactctaaatgtaaaaaaaaaagtattttgtgaaacacggtacggacacgtacactcatatacacatgcgtacactcacccttctaaatatacacacggtccatataagcacctcctctgtggattggtcaacacatcttaaaattaacaaagtcatcgctagtgccttgttattgacgggtgcttaatttgtataccgttgaaagaataaatattcgagtcatgccaagtataaaatttaaacctaaatttaactaaatctattatatctataaagtaatagaaaaagaagcctccacgttcgctctcacagtctagaaatccatgttaatcggaagaaaataagaaaaaaaataaaaatagaagggtattaggattaggttttgtgtaaacggaaaaaaaacaaagagtaaacggacaaaaaaaaaattccaatcggacaagaaagataaaaagtgaaaacggacaagagaaatagaaattccaatatttgtctctatctctactatttaaaaagctatttaaaaagcaaaagaagtttccgttgtccgtgtaaagaaaagggcgaaaaaaa

SEQ ID NO: 47774 - DNA, 714 bp, Oryza sativa
cctgccccccgctatttctgctgcttgttttatctccaatcgtgtgtttttgagaactatcttgcacaagacgccatatgagctcagatttggtcgtcgaccaaaagtttcacatctcagggtcttcagttgcaagtgctttgttcttaaacctggaaatttggacagttgaatctcgatctgtggatggcatttttcttggctatgctactcattctcgggcttatcgagtttatgttctttcaactaacaaaattgtggagacttgtgaagtcacttttgatgaggctagcccaggagctagaccagaaatttcaggtgttccagatgaaagcatccttgtggatgaggattcagatgatgatgacgatgattccatttctccacctctagacagtacaccaccagtacaagaaaccggttctccatcgactacatcgccttcaggagatgcaccaactacatcatcttcagcagctgaggagattgatggtggcacatcaggaccaacagctccccgacacatccagaaccgacatccgcctgactcgatgatcggaggcctgggtgaaagggtaactaaaaatcggtcttatgaacttgtcaattcagcatttgttgcctcttttgagcccaaaaatgtttgtcatgctttatctgatgagaattgggttaatgccatgcatgaagagttagaaaattttgaaagaaaca

SEQ ID NO: 47775 - DNA, 9111 bp, Oryza sativa
tgagtacggtatttggtacccctgctcttctgccctttcagttcgagctttttcagatgctgattttgctgggtgtaagattgatcgcaaaagtacttctagcacttgtcattttcttggcacttctttggtctcttggtcctctcgtaagcagtcttctgttgctcaatcaacagctgaggctgagtacgtagctgctgctagtgcatgtagtcaagttctttggatgatttcaactctgaaagattatggtctgtctttctctggtgttcctctgctttgtgataatacaagtgcaatcaatattgcaaaaattccagttcaacactctaggaccaagcacattgagatacagtaccactttctccgagacaatgttgagaaaggtaccattgtgctagagtttgttgaatctgaaaatcaattggcagacatttttacaaaaccacttgatcgctctcattttgagttcttgcggagtgagttaggggtgatccacccctatggcttgatttgagggggagttgtttttcttttacatgcatttgtaacatattgcatcatgtttactttatgcattgtattatacactcttcaattgagctttgcttgttatctcttggtcatcactatgctatgcatgtattactcttatgctagtttgatcttttgtctagctttcatttgcttaagtagcttgtgtgatcatgttatgctgttcaagcttgttgaaacctgcttaaattgactattcatttgaacttaatcaatgtgcaatgcttgctctagaagtttgtttaagttgaagtatccatctcatactcatgctatgttttcattctttttgcaataactgtcagtacatgctcatgaatgctcatgcttatgcgtccatactttgtatcaatcttgctttacaagctttatctctgtttttgtccgggctactgagtgtgtttacgcatgagtagtgccgaagatagcactgagacagcctgtaatgggaactctagctggaaaacttgattgaggtcagacggcagtgtttggcacaaccatcacttgctgactgataagatcaggtggaccgtcgtgattgtgctattgtctttaaagaatttaaaaaaaaaatcataaaaagaaaagtcatgagaaaagattaaaagctcatgttctatgctttgttaccatgttgatactctttatgaactgggcattagcacattagcatgggttcattgctttgattatgtaaatcttgcatgattatgagctggtttgcttccttttaagcttcttctagaaatagctatgcacactaaatcactaatccacttgaaagctgtttgcttgctggcgatactatcctgatattcataacttgtttcatacttcttttgcacatgcttagctaggcttgagcacatgcttgtatctgtgtgatccatgtctactttttgatgcctttagataactctcaaagctctcagaactctggaatttgcaagtttcaatcattttcattttgcatttttgtctctttttggtcttgatggcatcattgacaaagggggagagaattttgcacttattgaaaattaaaacttgctttagatcttggtgaaagggggagtttggcacatagggggagcattcttgcatttgcatttgcatcccttttcttcttgtcacttggtcttgatttttcgcgatttcaaaatgaccaaagttcgacttttgcaaaatggtttgctttgtgtcaaaaatcaaattttcaaaattttgcttgagattgtcaatgttcccatcaagggggagattgtgaaaccatgtgtgattatagttcttttgtgatgggaaattgacaagtaccggaagtgcaagaagtgtgtgcgtagactaacattggttaggttgtgacatctatgccaagacaacggttgtttggctcatgtgtgtgcaggtgatcgcagtcaatcttagtcaacggcggatcgggactagactcagggaggagttgaggtccagaacgatcaagaatgctgggtgacaagattggacgcaaggttgcacacggtgggcggacaccgtgtgaggaggtctttacaacgggcttcacaaggtcaagtgtgcaagcatcggattcgcgaagaaaattggaaggagaagaggactgtgcaaggacatgaagaccgagtgcattgctgctacagtaattcggcttactgtagctagcatgtatcatgtgcacgtgtgctgccatgattgaatggcaaggagaccaacaggagctggccactaggcttgtgggctggcagttcggttggcagggaaggccgaaccaacccggcctaagcacgttgctgactcaagatggtgaaggccaggccgagcaggccctagacatgacgacggcccagctcggctcggcaaatgcacaggtgtgtgcatgcgcgcgcggaagcgggagatcgtacggcacctggaggcgtggcggccttctgttcgtcaaggaagcgaccgggtcccacgcggtttttcgcatggcgcgcgcgggaacatggttttcgcgagcgcgcgcagaagcggctcggtgggaggaacggcgacgtgacgtgtagcgcccgttccgtcgtggcacctagcgggaaaattatctcttaaaaaccctaattgcgaaatttgtttctttgcttgttgtctagtgtccgtgccatctcggatctcaatccccaatctatcgtcgagtccatttccgaatccaaatccttccaaatcaaatccctccgcaaaagtctattttgcctcccccggggtcgatgggccgaatccctctcggcccatctccccctcccttcccctgcgctctctctctctctctctcccttcccccgctccgcccgcgcgccgcacgcgcgtgcgcgagagccgcgccgagcgctccctccccctccgctctgcccgcgcgcgtgcgcgtgagccgcccgcgccgagccgagtcctccctctccgctccctcgctgccgcttcccgcgcgccgtgttcgcgtgcgcacgcccgcgtggtcgccgcccttgccgcgcctgcgccgtctgtgccgcctggccccgctgccctgccgcgcagccgcccggccccgctagccagcgcgcgtgcccgagccacgccgctcaaaccgccacgccgcccgttgcttcccgcgcgcgcgtgccgtggtggctgaccgcctggtcgccgccgtcgtcagcgcctgccgcgcctgtcgctcgtgtcgccgctccgctccacaccgccccgccgtcatcgccgtcgtcatcgcctcggccccgcctctccgcgcgcaagccgccaagagacggaggcagagccctcctccctctgccgcgtcgcccccgctcccctcctccttttcccaaagaagcaaggggcaagccccctttctcttccccattttcctcctttttccctctcgccggcgtcacctctgtcgccgttttggctgctagccggagcgccagctcgcgccttgaccgccctaagtcggttcccaaaccgacattgccgcccttaaaacccagctcccccctttcccttcctctcccattcgcctccacgccattgccgccgcctcccgtgctctgttcgccgtcgccgttcgtcgttgcgcgtgtcggaggagccggcacgagcaaggacgcggaaggggactccgggcgcgcccttttcttcctcttcctcggcccgaggccggagagattactcccgcgccgtcggcctctcgtcacagcgcccctcctcatctcggtagtgcctccctccgttcttcctcctcgctccacctctcccccttagttttcggtagtagcacgagtagcctccccgtagctagccggcgccgccccggccgttgccgccgctcgccgggtgctcgccgccgtcgccgcccgagctcggaagcgccgctcgtcgccggcctcgctcggcgtagctccgcccaatccgacgctagcatcggattcccgtggccgcgtagatgctcttgccaccgggaattggcccctcgtgacctcgtcgccgttttccccttttctctccgccggttgccgccgccgcaatccgccgccgacggactccctccggtgaatccgagccgttggctcgtctccccttgtcctgttcaaccacccggtgtactcgcttccgcctatatcgccgtggttcgctccgccgctcgccgttgtcgtccgccgtccgtttcggccggcgtcgtcgtctacctcccgccggcccgcgtggcagccacgtaggcgccatgtcggcgccagctcggccgagatcggatcgggccaatcccggtcagcccctccccgtgcgcgcggtccaccgcgagccgagaggctgcgcgtgggcccgccgcatccgcgtccaccgcgaaccgcgcgcgtgcaccgcatccctcccccaccctagcgccgcgccgcgtgctccctccgcacggtgagccgagccgctgacaagcgggtcccacccgggaccgcgtgtggtgagcccggtctaccggctcactctctcctcccttccgcgcgcacgccttgggccgctctgggccgccttcttgggccggccggcccatttagctcggccggaccgcccatctctctcgggccgcgccctagccgcccgaggaaaagtctattttccctccccttttttttcttttcttttctttttcaaaaaggatttaattaaatccttttcctttagaccaaaaatccaataatcttagaaattcaatatcttcccaaccgtaaatccgtttgactccgttcaacttccaaaattcctcaaatcttgagatctatctaatggcacgcttagaggtcattaatagggctttattttcgccgtttgttgagttgtcccgtttcgcgtgtagtttcggagcccgaagatccgcagcgcgaggctttcgaggatcaagctccagatctcgagcaaggcaagccacctttgaacatcttgagcctatatttgaaatttaatcatattgcttgcaaaatattatgcattgataggattgcacttaatatgttgccccgtctgcaaggcagatcggtgggcatacctaacttgttgcatttgatccttccattgttaattgctataccatgtccccttgtaaccatccagttgcgcctcgatattcgtgcactctgtgcgagtatcgacggtcgccttcaaacttaaaatctgagtaacaacttgggtaaaactggagttttacaaaagacttggaaaacccgacacctgggtcggtgcttgcgaactaaatgaatttccaaaaccgcggaccggggaacgtaccgggtgtacggttttcccgctcttgcacttaaggaccgtttccttggaatttcatccaaacataagataagtacgaccatatgggtggaatgggacacccctggctgagtaactagcttatcaggggagccttgatgccgagagacatgtggattcgccggggtggtgtcggggaggacccctgggcttcctggcacagtatggtctgggacctaacctgttgttagtctgggacccctctcgtcggtatatggtaaacctgtgtcggctttggaaatgccttgtcatgaaagcttggaggtctcccgacgtggctgatccccacgggctgggtgatccgggttagtaatgtcgtgtgggtaaagtgtaccccatctgcagaggttaacaaactgttcgaacagccgtgcccaccgtcatgggcggatgtgaggtgattcctagcgtagttttgtttgactactgcttgtgaaattgttgttgtagaaaggggttcgctgtttgaaaaatctgcagctgatgggatcagctaggcccgggtggccgtttgaaagttgttggcccgggtggccgtttgaaaagctgttggccgggtgccaaccttgttttcaattttaaagactgatacattgcacatactccgaccggacgagacgcactgtctcaaccgtgtcgtttgagaaacactcacttagctgtttttagaaaagagttcaaataaaatcaacagcaaaaacaacagcctttccttgaagcctacattaaacacttatttcccttggcttgctgagtactcccgtactcacccttgctctatataaataatccccccccagttgctgaagaagaagaagcggatcctgctgatgaggagttctttcaggagcaagccggctacgatgagttttagggtttcggtctagttcccaagtcgcgcctgtgttggttggtcctagtcctggcttccgtttcccttttgtaatgcagttgtgagctcgggatctgtccgtagcccaacatgactgtatctctactctataataaagtgaccgctgttgctgtgatattctgtctccctgtgataccagcactgtttcctaggactggtatcgaccaacaggttaatttggagcgtcacgggctagttccggtcgggattagttcggggcgtgacatgacggcttcggactggtggcgcgcaggcgtgagaggagcaggcacgcgctctctgggacgcgtggcgcggatgcgttggcttggaggagcacgacgcggatcggtgcacgctgattggcttgaagtggaatcacgcggatcgcacgagggcgcgcaacgtggagagctcggatcaacaacgtggcgactatccaggaggcttccttcggatctaaggaacaatggacagccaggattacatcaaggctagggtttcgccctagggatatttgagacaatgtcttaggggtcttaggctataaatagagagatggatgcaagggtggaggttgctccttttgtaatccttttgagatgctcggtgagagagtttcggtgtgagtttggagtgtgtttgctcgagaggcttttgtattaggattagtttggagtgtgtttgtccgagagattttaattttgtgttaatgttcctctgaaggtgtatgtttgcccctagttgagcggttattttgcatcacctttgaatgaaatgatttgaaggatttcgtttttgccttgttcatttaaattccgcaatttaaattctacttgcaatttgaactttgcgatgatgagttttgttatctcctcctcacctctcttctagtttgggaaattccttttctctttctcttctagtttcgggaatttctttctctcttcttttctagatccggcttctctaatagccgcggttctagtaaggatttttgagaaatccggcttgatgagtattttcgggggtaagatttgaattgctatattcacaccccctctatagctgttcttggtctttcagccaggacttgctcacgcacttgaactggcacacggagcggacggggaggcggcggaggacctcgacgatgagctcgtcggtgagactggccgccgggttgcgccgcttgttgggaaggttctcctccatcgggggtgggtggaggagaggaagtcgtcagcctgcaaccgcgtgaagagggattgaccgcggcaagagcagatcgagcaggtgagcagatggggattaaattgagcaaaacatcgaaatggcgaagaaagaaaaatctggtaacaaatcggcatcattgggttcgttaatccacctacgaaacgaactaatctgaggactaaatgtgtagatcaggaacctaccgatcaaggcagggaagcgatgccgccgcgcgcgtgacttgccgctcggcctcggctgacccgtggagctcgtcggacgggacaccaggacggcaaacctagcaccctcaccggttaaggccaaccattgcgccggctatcctgctgcgatgtgcgccggtcacggagaagaagagatagaagcggcggcggcggcggcgaaggcgaaggcgacgaaacccctagatgcctccaattcagtgtctgccgggatattggttccaaattggaaaataagggtccgtttagttcacggctgtcacatcaaatatttgatacatgcatggagtattaaggctccgtttagttcgcgaaataaaaatttttgggtatcacatcagacgtttgaccggatgtcagaagggtttttcggatatgaatgaaaaaactaatttcataactcgcctggaaaccacgagacgaatcttttgagcctaattaatccgtcattagcacatgtgggttactatagcacttatgactaatcatggactaattaggctcaaaagattcatctcgtaaattcccccttaaatgtgcaattagtttttatttttatcgatatttaatacttcatgcatgtgtctaaagattcgatgtgatgtttttgggaaaaaaaaatttgaaactaaacaggcactaaatgtagaaaaaaaccaattatacatattgcgtgtaaattatgagataaatctttttaagtctaattactaaatcttttaagtctaattacgccataatttgataacattgtgctaagtaaacatttgctaatgatggattaattaggcttaataaattcgtctcgtagtttcaagtggaatctgtaatttgttttgttattagactatgtttaatacttcaaatgcgtgtccgtatatcccatgtttcacaccaaaaattttcgttcgcgaactaaacatggcctaagttcttttgactcccttagctactggccaaatctgattcgtatcctaaccataatatatgatatcgcgaccccttaagccattactatcttggactgtgcactccacgtcttcaaaacacatttcctgaaaatactttttgttgcattgcgtacaatgttttttaaggccatgtttagattctctggcaaattttttcaccctatcacatcgaatatttggacacatacataaagtattaaatatagaaaaaaaactaattacacagattacgtgtaaattgcgagatgaatattttaagcctaaatgctctatgatttgtcaatgtgatgctacattaaatatttgctaattacagattattaggcttaataaattcgtctccagtttacagacggatcatgcaatttgt

SEQ ID NO: 47776 - DNA, 10336 bp, Oryza sativa
  unsure (1)..(10336): unsure at all n locations
tactttttaagaattaagataatggaaaattttcgtcacttgcttcagcagaagccaaaagccaaattattagtttgcagcactctatctgcatcacaaagtgataaaagaacgttattaagagcaaaccctattggtaaataattgatggcgctgattaacttggtagctgtttctttatactacttataaaattatggtttgaaatgaatatagcaatgtactccctccatttcttattataattcgtttaactttttttaatcatattttctttaagtttgactatgtttatagaaaaaataaatattagtacaaaacaaacatgttataaaaatatattcagtgttaaatttaatgaaactaatttagtgccgtagatgttgctattttttttcataaacttgtcaaacctaaagaattttgatcaagaaaaaagtcaaacgatttacaatatgaaacagagggagtagtttttgacctataaaatagtataatatactcccttagtttcaggttataaaatagtatgaaagtttactggcacgtcgttaacaatttgtttgaagtcatcgaagaactaaagatgtggtttagggtagttcattgtgcaacaaaggcaaagttacctagtctaaagtgaaaagtgaaaagattgaacaaatggtagtccaaagtgaaactttagcaataaaatatagctcaaagtaaaattaactcttattttttctataaatttggtcaaacttgaacagcttgactttgaccaaagtcaaaacgtgttataaccagagtagaaattattgctgatcaaattgaaatggagaatcaacgaggcgaacctatggagagaagtgaggagggttggtcatactattttagccctctgattataaatagttgatgtttaggataaaatttgagtaatattttaaattttgattaaagttaatttctgaaaatgcttagtttaaaaataaaagaaatggtatacacatatatttttgttaaaagtattataataatatcgtaagacttattagaatttataaacttattataattgccaaaattacaaaagtttgacaacattttgtcctaaaccgttaaatatttatgatcgaaagtagaaggatggtttgttcaatttctatgaaattaaggctctgtttgtttcagcttaagattattataatctagattattaaattagattactttaagctggattataataagctgacataaaataagttatgtgttgtttatttctttagattattagaggcatctaaggttagtgagtctttagccactcaataatctgaaaaaagctcctctagaggagattattggattatagcaaaatctggcttatagattataataatctaccataataatctacttgtttgttttagcttacgcctaataatttagattataataattctaagctaaatcaaacagggcctaaaaggtagtatagagtattctattaggttttttatgttgagacacgcctacgagtaaggttcatatctctgcatccaaattttggggtaaaagaacacgattactattgttgactactactctctctagtcaataatatttgacgtgagagaagattagttagtactctcaacgttaaatattattaactggagtgagtataaaagcatgggtacatgtttcatttcccacaaaatatatatccatcacatttctcttttttaaaactttttattgagcgagagataaatcacatttcccttgtaccttgttctcaccttctacattcaatccaacaaggcacctacaaagtacacgtatatagtagttgaacaagaatgaattaagtggttgcaatatctaagctattgtttgtcgatcataatcatcatgtcgtcatcaacaaaatgtggcaagacattcacttgccacgagcccgtgtttttctgtaacttctctacatacctctaatttcttaattactaaagtttcattatttgacagaacactttagaagaagcagttaatcagttcaatcgatgtgacgacagacgactcaattatcatcaatctgtgaacgaatttaactcgacttcttctctgctaataattaattaattaattaaatttctggtcggtgaactaaacgatgatctagtacttgcatcgatcagcggtcgtcgcagccacgatcagctttaaaaacgcggtgatgttcttagtttcgtgttctggatactttggattaagtcaatcaaattcatcttacttttttttacctaattttggaccacgacggctgcgaaagagatgtcctagtaatcatcatccaacgaccacaaaggtctcctctttatagaatgcgagtttgaacgcttattgcctgcacgccaaactaattctacacctaatgactttccctcaataatttagcccctaatcttcagcatcatcctcttgcttaattgtttctagggttgctataatcacaggtgcaactgtgcactatgttgtttcgaggcaggagagaggcaacctgcacctgcccatggaggactcggattagactagagcacaagatggcgtgcttgaccaagtatcagcacgccacgaatgcaacgaattaacgcgagagatgttgtataagtagtgtgatttgatgccaagttcttgcatcttgtcaaatagtatttgggcgtgttgatgatgagcgtgcaaatggcggcgtcgctacgtgtgatcgttgtgttggtgtgtgtgacggcgggcgccgccctcgccgacgcggcggccggcggcgtccgcgtcgggctgacgcgcatccactccgagcccggggtcaccgcgtcccagttcgtgcgcgacgccctgcgccgcgacatgcaccggcgcgcgcggttcgggcgggagctcgcgtcgtcgtcgtcgtcgtcttctccggcgggcacggtgtccgcgccgacgaggaaggacctgcccaacggcggggagtacatcatgacgctggccatcggcacgccgccgcagtcgtacccggccatcgccgacaccggcagcgacctcgtctggacgcagtgcgcgccgtgcggggagcggtgcttcaagcagccgagcccgctgtacaacccgtcgagctcgccgacgttccgcgtgctcccgtgcagcagcgcgctgaacctgtgcgccgccgaggcgaggctggccggcgcgaccccgccgccggggtgcgcgtgcaggtacaaccagacgtacggcaccgggtggacgtccggcctgcagggctcggagacgttcacgttcggctcgtcgccggccgaccaggtgcgcgtccccggcattgccttcgggtgcagcaacgccagcagcgacgactggaacggctcggcggggctcgtcggcctgggcaggggcggcctgtcgctcgtctcccagctcgccgccggcatgttctcctactgcctgacgccgttccaggacaccaagagcaagagcacgctcctcctcggtccggcggcggcggcggcggcgctcaacggcaccggcgtccggtcgacgccgttcgtcccgagcccgtccaagccaccgatgagcacgtactactacctcaacctcaccggcatatccgtcggcccggcggcgctgcccatccctcccggcgcgttcgcgctccgggcagacggcaccggcgggctcatcatcgactccggcacgacgatcacgtcgctggtcgacgcggcgtacaagagagtccgcgccgcggtgcgctccctggtgaagctgccggtgacggacgggtcgaacgccacgggtctcgacctgtgcttcgcgctgccgtcgtcgtcggcgccgccggcgacgctgccgagcatgacgctccactttggcggcggcgcggacatggtgctcccggtggagaactacatgatcctcgacggcggcatgtggtgcctggcgatgcggagccagaccgacggcgagctcagcacactcgggaactaccagcagcaaaacctgcacatactctacgacgtccagaaggagacgctgtcgtttgctccggccaagtgcagcacgctctgatcagacgagagttgtacagatcgattcatgtgacacgtgtacatttttctggttattagtagtatatgtttctggttatttttgtatagtttctacctcgtttcttgagggtcttgatcggtagaaatttctgtaaaaagcttcttaaaaaaatgttgtatgagactaaaacaggaaagattcagcttagaattcacactctttcgtaggaattgataatttgcatttgaccaggtggaaacagttttttccagtgatagtctaagccactattaattgtgactaggactttggaacacggcaatgctgtaaggcatcctggaaatttcaatgtgattgtaatgtttaaatgggagcaaaaccaaacaacatacgctgaaaatagttaacctgtaattcagagagtacatctggacggtgagtttgtgaacatgatacaactaagttgaaagcaatgaaaaaactgtgaaaaaacagaaataaaattagctataagtaaaagggactttactaaaatctaacttaatacccactcaattttcacttaacaatttcactaaagaatacatgtaagatgtaacttaaccagaacacaggaagtatctatatatgacaaagtccggacaatgacatactagcatatatctaaaaataacaaatgcggataattgacatttttcatgacctcgtcagtacgcatcaccaaaaccaccatagaaagttcaggcaaatatgttatccacgtttggtgtcctcaatgacctcatctgtcagcatcctttgttgagctacaaccacaaatgtgatttattttcttccattgtactttcctcttcgccgtcggtttccacctcgcccttgacctctagctcgtaaccagttcgtcctactcgttgatgcacccgttggtcggtcattatactgacctttcatgagcaacagcttgtgagcttcagcctctcttaatgtccatagcaggtcatagtacttctcatatcttgcagccctgtattgccgatgtagatgaaggttaattggatgaaatgtagataatgtcttctcaattaactcctcctgcgtgatttctctaccacaaattttgaatcgagagattatgagatggagagctgagtcatattcagacacaagcttgtagtcatggaaacgcaagttcaaccagtcattctgagcttgatataggaccctggccttctgctcttcttcaaatcgatccttcagggattgccataagacaaatggatctctttcagcgcgataatcagtccgaaatcctttgtttaaatggcgccaaagaaaagccaatgcctccctcttttgggtctcggtacactctgaattagagataagtgccgtacagagacctttcatgcctaaatggatttgagcctcaatagcccgttccaagtaattgcttccatcaagagcaagctcatcaaagtcttcgctgttgaaatcgaacatgttttcctacagttaaaagtatttagtctacagatagtcatgaataaaataaagattaaacaaaccatatatatgcgtcagggcttgcaatgatgtcaatgctaatatgcagtacatcctgtccaaactacaatctctgttctataaatgaggctttaaggagaacttatcatattaccaatatttttatgaattttatatgaaacctaactgcatcatccttaatactccctcttgtcataaatatttaacgtgtaggaaaatatttggtccatattgaaaatatactttaaccatagataatttttcaaatgcttagttttaagtaaaaataataatgtgcatagatttatctcgaaaagtactaatcacaatatcataaacacattttaatataaaactgatggccaaagtttcacaattttgacctctaaacatcaagtatttattaccagcatcagtatttaacggctaagcatacagcttagacagatcgtttgtcctgacgccaaatatagtattgtgaaagtgtaatttataaacctgatcaaataccatatctaaaacaattaactaggcttaggtctactcccagtgtcccaaaataaaataattcctcatcccaagaagattttagtaaggagggaaaatgactaagttcctcattaatcggagatggttggtggatagacaagaggtattgaagagtttaggaatacaactttccaaacaaattttgaactctgtgaatcaacttattttgagatggagggagtatattattttttgtgttattgtcttggttgtacttgggtgagttactataagacacgaaatgttcatgtctgtattagggttattatttttcttttctaggcatccctggttgatgtagaggttacgtgtaattcatttttaatgaattttttctcgttatcttaaaaaatgtatatgttatttgtgctactgatcaacaaattaattgttacttatgaactgattcaattgactagccataataaatactagacgaaagtatctggctatgaacaatgaagaacaaagaatctaaaagggacaaggtagccgaatattatcacacagcaacaaacaaggaattaatagtccataacacaatatctcgtcggagaggatgcccctctcgtacggcacggcggaggaaacgggagcaaaatctgggtagaactagagttaatctacatgtatgatgtatctcagcaatttatctttgtagggcaacgtctagagttgaaaatggtcaaaggggaaaatgcggaaatcaaatttcatatattggcgccggggaaggcagggaagaaatcgagaaaatcagtgagatcaaatgttgtgatcttgttgatgagattaataaaggagattttcaattgtgagatcgtggcttccgaacttgaaattggaacagaaaaaaaaaacctttcagtttcacaacactcaccatgatagtgccggacgcgctggccgctgtccgaaactgaccctaggctaaccgcgggcgccgggcggcggcggccgcggcggacggcggtgcagcgcgaccggaacggcgtggttattggattggaaccgacggcgactagcctgagagcgactgttccaatccaacagcggagtagaggcggagagatccatatataggggaggcgaaaaagaaactgacagcccagagaggaacgagtaaacgggccatccgtggacagcccacatggctctagccatccggcccatctagcccacgtcgcgtgtaagttgaaggttcgccgcgccacgcatcaaaccatatctgcatcgacgtgcggcgcacaccgccgcgactaccatttcgactgatagatcacccaccggatcgcacgcactctccatcaacgtgccactccggattcaactaacctcactgcgatgaaacaagccatatgatattatgattgatcaagcgcaatgtgggcagaaaacgcaacaaatcacaccgtcttcggttcggcttcgtgctctggtcttggctccaatggcggcgtttctggtatggattctcctcttgttaccgtacgttgccatttcgtccacggcgagccatggcgttcgtcttgagctcacgcacgccgacgaccgcggcggctatgtgggggctgagcgcgtccgccgcgccgccgaccggagccaccgccgcgtgaacggcttcctcggcgccatcgaggggccgtcgtcaacggcgaggctggggagcgacggtgccggtgctggtggcgcagaggcctccgtgcacgccagcacggcgacgtacctcgtcgacatcgccatcgggacgccgccgctcccgctcaccgcggtgctcgacacgggcagcgacctcatctggacgcagtgcgacgcgccgtgccggaggtgcttcccgcagccggcgccgctgtacgcgccggccaggtccgcgacgtacgccaacgtgtcgtgccgctcgccgatgtgccaggcgctccagagcccgtggtcccgctgctcgccgcccgacacgggctgcgcgtactacttctcctacggcgacggcacctccaccgacggcgtcctcgccaccgagacgttcacgctcggctcggacaccaccgtgcgcggcgtcgccttcgggtgcgggacggagaacctcggcagcacggacaactcctccggcctggtcggcatggggagaggcccactgtcgctggtgtctcagctcggcgtcaccaggttctcctactgcttcacgcccttcaacgccaccgcggcgagcccgctcttcctcggctcgtcggcgcgcctctcgtccgccgccaagaccacgccgttcgtgccgagcccgagcggcggcgcgcggaggcggagctcctactactacctctccctggaagggatcaccgtcggcgacaccctcctcccgatcgacccagccgtgttccggctcacgccgatgggcgacggcggggtcatcatcgactccggcacgacgttcaccgcgctggaggagcgcgcgttcgtggcgctggcgcgcgcgctcgcgtcgcgcgtgcggctgcccctggcgagcggcgcgcacctcggcctcagcctctgcttcgccgcggcgtccccggaggccgtggaggtgccgcggctggtgctccacttcgacggcgccgacatggagctgcggcgggagagctacgtggtggaggaccggagcgccggcgtggcgtgcctcgggatggtgagcgcgcgggggatgtcggtgctcggcagcatgcagcagcagaacacgcacatcctgtacgacctcgagcgaggcatcctatccttcgaacctgccaaatgcggcgagctttaggattcgcatgatcaaagagatacatgaccatatgtacataacttgaattttctatcagttgcttttgcaattattctatggaggtgttttcgttcccaaggcgacattccctctgtttattgcatgtcgagaaacacacttttcccttgttctcttgcatatgcttggttgattatgcgtgtgcttggtggtgtgttctgtgttcatgttcttcaaagaagtctgatgttcatctgacttctaaaatgctaaataatttcagctgaatgcagctcaatcactgcagctaaatctgaaatccaaacttaacatacttttatttacaagtgcgtgtatattacacggactgtacattattctccacatccatatctacaagaatacgcgctgacatatgaaaaggtgatcaaagccgaacaacaaatgtatgtaactcgaaattctagccagccaagagaagtacgatcaaataattaaacaacataatatgtacatatgcaaatacgcaatagagatcactcccatcgatcgatcagtacgtgcgtctcggtctcgatcagatcttgccgcaatccgcgggctgcacggacagcacggagttcttgagctcgtacagcacgtggaagtccatctgcaagtagttcccgatgcgcgagccggtgctcgacttgccgatcatcaggcacagcacgtcgccgccgccgccgccgctctgcttaccggtgtaggcgaagtagttaccgaacagcagctccatgtccatgccgtcgaagtgcatcgtcatcgtgggcacggtgacgacgttcttgctcgcgtcgtcgacgaggaagcacaggaggccgctcccgttgacggcctcgtacgtccgagacatccgcgccctgaacgcctccacgacggcggtgtaggccggctcgaccagcagggtcgccggcgcgccgatctggaaggcgacgccgcgcgtcttggccggtgtttgggttgaacgcgaacgtgtcgttgggaatagcgaggcgtgtcccgtcgacggagatgccgagcaggttgacgtagtaattggcgtcgtcgggtaggagaggggtggatgaaacgccattcccgtccatgctggccgtggacccgaacagcacagggctggcaacgttagggttcgacgcgaggcagtaggagaagcggtccaagcccagctggcccaccagcgacagtttgcttctacccagcccaactacacctgtgttcctgtttaatttgatatgaaaaaaagaagagcccacttataccacttaattaagccatcgcccatatatattcttaatttcttattactgtttgtgnnnnnnnnnnnnnnnnnnnnnnnnnnnnnnnnnnnnnnnnnnnnnnnnnnnnnnn

SEQ ID NO: 47777 - DNA, 2507 bp, Oryza sativa
cttcaaatgtgccatacctcatctcaatgatcttttgtttggctctccaggcctttgcatagcttatggtgtacttgaatttgttctcgatgtgcctaataattgattttggttcaaagccaatgttaccaacaacactgctgtacatctcacttgccacaaaagctgaagtgatgtttcggtgatacttctccaccccttgtaagtagcacttgtgctcggtcacaatgctaactttccaataatcattccatttacccttatatgcatggacacgccacggacaatcttccttaatgcacctcacttcatacacataatttgttgacttgaccaccctaaactctctctgcaaggaaactgcccaatgcttcaccgcctccttcatctcatccttatgagcataccttgcaccctcaattacctcgttctccttatactcccagggtacatgatcaccctctgatataacaagtccagagaagtcctcatttgcccaatcagtggccattacatcaccttcctcatcggatgatgcgtcgtcgtccacttcctcattatccgaatcttccctctccatttcatcaacaattataccgactctctccccctcatccgccatgcccatagcctgctcctcccttggttgattttcctcattttgcatcgatggtccaacaacatcccctgcattgataggaccctctacatcttcggtttgcattgaaacatttatatctttctcttgtaccgacacaaatataacgaggggccatgaccgttcaaaagccatttccacataccgtctccaagcatcagtgctgtccatcggcattagttcccaaaaataaccttctgttgcacgactcactacaactgacactgacattgtgtagacttcttggtctattctaaatcctctcaacaaccaactataaattgactgaaatgttctctccgcaggcctatcgatgcccttagatgtcattacaaaatctgacagatcaacaccatctggaccaaatctaatatttccttcaccgtgaactatctgaaatgtgaccttacttgacattgtgcctgatgaaaacaataactgcgttaacctcgcatttctgtactacgccctaagttacattctctacaatattgttctctaaatttctaaaattacgttacattctctggatcaaactaaactacatcttacaattaacactactgtctatgtctcaattcatactattatattctatgctctggatctacacatatgtgttgtgtgctacagatgtgctaaaatatatggaactaaaactaaaacgcaacatatatactcaaacataacatattagtacaaatgcaaaagatgtatgggagcatacctgtgatgaattgagcgaaccagcagggcttcgccgctccccttctgctgccctcccctctctctctttcgttttttttggatttttagtgaatataatgaaatttcacagaggagggactgggctttatagggggagaggcaaaaatcgccctcgcggagggcggcaagggagccgcctgcaaaattccatgccccctcgccgcccatttgcaggcggccccccccacagtacaaaatcgccctagcggagggcggcaagggggccgcctgcaaaattcgttgacggccgtcgcccgagagcgaacggccgtctgccacgtcattttcgccgccctctgagagggcgatttttaaaaatcgccctcccagagggcggtaggcgactaattccgtcaattttcaaaatggaaaattatttttgtaaaacttttaataaaaaaattataaataaaaaaaattcgcttggaaggccggttttaggcccaaatccctgtggaaatgatcggcctgaaaaggttttcatggtgggctccaagtgctgtttaaatgggccggtttccggtttaaatccccggttgagcccatatctatctatctatctatctatctatctatctattattctattatattattaaaacagctttgaaaggaggcaccacgttcgctgtgggagctagaaatttccatattaatcggagaaaaagaaaaaaaaaaagaaaaggagagtccaaatagaagtacaatttaaaaatagctgaaattcggaattaaaaataagcaatattgaaaaaagtttccatataagaacccaatacgagattaatcaaaattcaaaataaaaataaaataaaatccaaaataagacaaggaaaggaaagtccaagtaaaaatacaatttaaaaatagctgaaattcggaattaaaaataagcaatattgaaagaagtttccatataagaacccaatacgagattaactaaaattcgaaataaaaataaaataaaatccaaaataagaaaaggaaaggagagtccaagtagaaatacaatttaaaaatagctgaaattcagaattaaaaataagtaatatcgaaagaagtttccatataagaacccaat

SEQ ID NO: 47778 - DNA, 913 bp, Oryza sativa
gagttcaagaaggaatacaatttaaaattagctgaaattcggaattaaaaataagcaatattgaaacaagaatccatataaaaacccaatacgagattaattaaaatttagaataaaaaataaaataatatccaaaactagaaaactaaaagagagttcaagtagaaatacaaatttcaaacaactgaaattgaaaataaaaaataaaaacatcaaaagaacacaatacggtattaactaatttttttttaaaaattctgaaattaaaaaaaaaagattttaattaggaatacaatttataaataactaaaatttgtgataaaaataaagattattgaaataaaagactatctaaaacatgtgacgagataaattaagtaacatgcctataaaagaagtagagtggtggcggttgatacgacatataaaaattgttaataaaacaccaaatagaatcctaataacgattaaaaggaggaacatcgggcaggccgtgaattaagcgagtaaggcggttgtcgagacttctataaagtaaaaaaaaataaaccacattgatcatcacattcgatttttaaaatctcagtgacaataaaaaggagaagcagcgggcggggtgtataagagtatagttgcagagccgccgaaggttgacgggacttctagaaaataaaaaatgaattccaacgatagttatgtttgatttttagaatcacaatgacaataatgagtaggcggcatacgggctgtagaggggcatagtggcatcgtttgatgggacttctaaaaattataaaaaaataaaattacaactccaatttttaaaggttcggaacttctaaaaagtaaaaagaaccaatgataatcatgttcgattttaaaatctcaaatttcaatgacaataaagaaggga

SEQ ID NO: 47779 - DNA, 12063 bp, Oryza sativa
ttaaatgcacttttagacaaagtatggttttagccggttaagaactacagttaatctagtttttattagtttgactgttctttgaggtaccaaatttagttattaaattataccaaaattacagtgagttgtatgtgttgattagagcctacatgaattttcccatgattttatcttgcatgaattattttagataattcgcaggacttatgtcttatatgtgtttctctttcctaaatgcatgtaaatgtttataaaagttatatttggactctcattaacatgaggtgatgttgatatgttagaattacagtttaccttacacatgtcataagctccttccctatttatgcctaagtttactttagtattaaattaagagaatgcttatagagatgattaagatagaatataccctatatgatataatttatttgttcactttcatgttcatgacatgtcttcagatggatgtccaaattagttttgtgaggcttgacattatccatgttgatttttttttaaggtgtatggtttctgtgtattattttccattagttagcactaggccctaatggtttagttgtttgtctagattgcaattatattcatgagacctattatgaaatgcaaatcgaaaatccaaatgcatatgaaggactcaagtcaaaatatgatttatgcaagtatgcatgctttcacttgggttgcatccaagtcctaggttaaagatgaaaaagtttttaatttgttctcaaattttattcttgcaagagttggatcaactccaactaggtttaaaatagaaatttttggtttacaaaattgaagaacttccctttcaactagttttgatggaattccttaatcctagaattcaggtatgttacacattagcgttcaaaggtaagtaaaaaattatacaaccacattacgtaatcaagaaatcaagtaataatttcatataactagaatggaacaatgcttaagatgtgaaaagagtttcatactatgatttagtagtcgttgaaacttatattgcttatagttttaggctcaatcaacgggtttttttcacccacgggttggtgggtatgggtgggtaaagaatggacccatacccacgtacccaatgggtaagagttttgcccattagtatacccatgggtacaagagttagaacacaattagatcctaatagagtaaaaacccgtcgggtcacggtttatgggtccccattgccatctctaggcgcggcctgaggaggctggggcggcttgggccgggcaggaaggagggaggggagggggcggcccagaaggaggaggagaggagggagtgggccgggaggggaagaggaggcccaagagaaagagggagagaaagagagggaggagagagggacttcggccgcgggccgagagggagaggggagaaaccttgggccagacttggcccaaagggaaggagagggttatttttaggtttttctttttaataaactctgataattgtttttgttgcttaataattatttccggtgctctgaaaattcaagtaaaatttgagggctccttttagaccaaggagaatttaacaaaaatttccgggccacatttgaatttttcttgtacgtattttagtgtttgccaatttcttttcgaattttaattaattctattattccttttagaaaatgatttttattttgagatggatttatcaggacgtgacaataacggcgaagattgataacataaatatatgtaatacaattgtatctttagaactaaataatggtatatagaggagtatagtgacaacgtttgatgagaattctaaatattataaaaataaaatccaacgagatgataaactctaaaaacgataaggtccaatttttaaaggttcgggacttctaaagagtaaaaaaaaccaatgatattaatgtttgattttaaaatctcaatgacaataaagagaggatggagcatgcgagccatagaatagtatagtggcaaagctgttaacggtttggcgggacttctagaaagttaaaaaataaacccgaacaataattatgttcaatttttaaaatctcaatgacaataaagagaggagacagcaggcgggccgtagaagagtatagtggcagcgtttgatgagacttctaaaaattataaaaatgaaactcaatgagacaataaactctaaaaactaccatgtcctatttttaaaggttcggaacttctaaaaacaaaaaaaaacaacgataataatgttcaattttaaaatcttaatgacaataaagaggggaggcagcaggcgagacgtagaacagtatagtggcaaaaccactaacgatttggcgggacttatagaaagtaaaaaatgaacccaaatgataactatgttcgattttaaaatcccattgataataaaaagaggatgtagcggatgggccgtagaggagtagagtagcaacatttgatgagagttctaaaaattataaaaacgaaacccaatgagacaataaactctaaaaactacaagatccaaattttgaagtttctaaggagaacgagtagaaatagtggtagatcgagtaatcaaataaagaatagggtgacttaaaaattataaaattaaacacggggtgatatggtttggtttttaaaagtcttaaaataacaagatagagaatgagtagaaatagtggtagatcaagcaagcaaattaagaatagggtgacttttaaaaactataaaattaaacacggggatgatatggtttggtttttaaaagtcttaaaataacaagataactattaaataaattttaagtaaaatcatattaaaaatagataattttatatggattctagccgcgcaattgcgcaggccaccagctagttgaggtgaagttacagcaagaatcaagggaaagaaaatgggactacctattgatcttttcaatagattcgaagttttaacttttgaatcttgcaaaattttgaaccaatggatatagccccttttttaaataaaataataataataaaagagacaaacatgtcaaaaaattgtaaatctaagatacaaaatcagttgtaaaatctaattttgttagtgcaagtgcactgcaactgagtgtaagtgtaataagtaactgagtgcactgcaacttcacttcaaaaatctgccacaagtgaaatagcaaaaaattaaaaagaaaactccaaactaacgaagccaacaaagaaaagaagaataacatgttggttgaattgccatcgactatgtcatcatgttctgttccttttggtttccgtctgatcataacaaatcatatacacaattgccaagctagaacttcaccaatcgtgattaatcgcttactacaatctgaatctacatgattataaacgtgcctgcactgcaaaatgctatctgccgtcctcctccatcaacgtgacgttgctcatgcagtacgactcgccgaaggagctggacgacacggccaggctggagatcctgacgttgaagtacgccggctgcctcggctccggcatcgtcaccccctcgctgccgagcatggcgatcacgtcggacatgttcggccggtcgtcggcgctgtcctggacgcacagcagcgccacctgcacgcacttcatcacctccatcgccgggaagtcctcccccagcgcctggtccaccagctcgtgccattgcccttcttgccatagctggtacgcctgaaagaagttcagaagttttcagttattagcggccgtgcattttcaggtgaatttcagtctttcagggtaactgaaatttgtgaattttggatgtcagagatttgtgcttacatatcctgtgagattgaagaatttgccgtactggtagaatccggcggtcctcttgccgcttatgatctcgagaagcaggacaccgaagctgaacacgtcggatttgatcgagaagagaccctcagaagcatactcaggagcgatgtaaccactgaataaaaaagcacaaaattcagtcattacaacatcatcaatgcatccgactgtagctatcactaattcttttctgacacaacaaaaacacatgtgctgtgtaacttgaccatcatcggtgattagtacttactgtgtgcccacaaccctggtcgtgttggcttctgtcacattcgagcagaatatccttgccattccaaaatccgagattttggggttcatctcccggtcgaggagtatattgcttgctttcagatccctgtgaataactcgcaaccgagagtgcttgtgcaggtaaagaagcccctgggcaatgccatcgattatacggaagcgtttgtcccagttcagcatcgcccccttttcagtgtctgcatatcaatacgtcaggcaagacaaaagcatcagcaacattcagcaggtttgcacaaagattttggaaatggacagagagaagttgaaagcctattgatcgagatggatatgtgagtgattgtaccaaagatgaagcaatcgaggctcttgttgtgcatgtactcgtagatgagcatcttctcgtcagcctggacgcagcagcccagcagcctgaccaggttggtgtgctgcagcttggctatcagctggatctctgtcttgaattccatcagcccctgcactgaacaggatgagagcctcttgatcgctatctcaagcccatcaggcaattgaccctgaaacatgtaagaaaagaaaacacaatttagtaagtagtcagatgaactgaaaactgaagaaacactgaagagtcgatcagtgtgtctgcaactctgcatcagaatgcaagaatgaatggagaaactgtgcttaccttgtagacagggccgaagccgccctggccgagcttgcaggcgtcggagaagttgtcggtggcgtcggcgatctggtcgaagtcgtagagcgagaactcggagccgctctcctcgatccgccacagcttgagcacctgctccatctccatggacatggtcggcacgctcaccgtccctgccatgttgatcactgattcagctgacagttagtgaaacctacagttaaccggggcagtgaagcatgggcgcgagcaaggtgtcagcaaatgcccgtgcgcacctctccttcttcgcctcctgatccagaggaaacatcccaagaagccgaggaggagcacggcgacggggacgacgatcgccacgatccacaggccaccgctgctgctgctccctgcgtgcaaacattgcagaaactgccactgtcagatccatggccccaacttttcaatgcccatccaatgctacgaattttcgacagaaaagatcatgcatgcgttttttcctgtaccactacaaggttttcatcaccagagtttgattcggttctgtctaactggaaatcccgactagtagtcgcaaaagggggaaaacgatcgatgaacgtgtgatgtgacaatattctcgatttcgacaacgatgagatgacaactacgtaggcgcatgcgacgcaggttcgtagttagcacggatgatgctgatgatgatgagcatcaccatcggttttgggcggtagggactgctcccgtagtcccaaatggcaaaggcgaaaccgtggttggctggacggtagtggaacggggccccgctcggtcaccggcaggcgcgcgcgcggtggacgacgaaggcgacgaccgagagaagggaagggggattcgtcaaacaccgtgggtcttttctctttccgccggctaaatatcccaagtaagctcggcgcgggaggtcgccgtcgtcggccgggacgacgacgacgacgacgcgacgtgacattccatagaaacgaatcatggcgagcaacttcacagcgaagcaaagcagcaaaaacgaactactgcagctgcggtactagtgaaatggcacgttgcctagtggttgcagtgatctgagtagcatcctaaggtcctgagttctaagtcttcatatagaacgaatttcagattggaatatttgagggctaagttctctgtttgatgggctaagttccaatttaaaaagactatatatatctggttggatgcagaggccggataaaaattaccctcttctaataaaaatataaaaaaactgccgcactatacagaggtacaaattctctcttgtcgcacactaggcagatgcatctggtatctggaggcatgggggaggaccatggctgtgcgctgtgcaaatgcagggacgacggtgtctgaggcagccggtggccacggtgaccgaccgtggaaagtgcagggagaaaggggaatcgaacaaatcggcggagatagatattctactgcaagaccagcttgtttgcagtgctccgtacttggcagtagcatcgcgtgacgcacgtggattcgctttcgtgtgtcgctggaacatcactactagctgtagctgcctacgaggggcaagagatcgatcgtgtgaaaagaacacagctaaaaaagggttaagaaaaccaatagtactatattcatatacaaatctcgttgctggctagctagctagcaccccgtctcatggcggatttctgaacaaagcaggggggcatgcatcagcatgcacattcatgttcttgagatggaacacgtttgattgggaataaaaatggacactatactgctcatggcgccccatctagtcaaaaacaaactacatcgatcatgtgtcgttcgagacgcccagatctcctgttccgtaaagatttaaaaaaaaacattttttccctgcatttcctggaccccgtacgctcgatcgattcctcttcacatgggaaagctctacaagatggaatatttttcttgtggagaaggggacaggagcacaccgagagggtaaaacaatgagcaagacggagacattaaaatatcagaaaaaaaaaatggccctacccaagtgtctggattgggcaatgggtattctccaagagtttaataaactaataaacacaaaaggtgtttggattgaggaaatttgatggtcgattcgatcatccatttgacatcattttagaacccttttctttttctcagatcttgaaaggcaagactttgatcgatcagctgtcacggctccgggtcgtagaatatatttgcagccggaactaatactcgtggccagcaaacaattcgtttctataggctgatgtggattggggaattctttttatggacaggaaagtcaagcgggtcctactttaagataagcacgcataacaaatgatgcaagcattgtgcattgacacagagtattttttttcccccaagtgtgtgaattttgttaaactcaatagaaggttgtgttatttattatactgattgatttatcaagttgggtatggaaaatttgttgacatttctgacagtatatattttgtctatgtattatgtcctataccctgcaaacttaagaaaagttgttgaagtagcgtttttttcatccttggcttacaaatttgaccatttatttagcatacaagttgttgattagctattgtgtagtgtagtatacctagatgaacaacgatattgatgcaccaaattatttaattaagttggaacctaattcccttaatcatatgatcaagaattaacgaaccgttatgcatcatagaaaagaaaaatgctgtttcatataatcatcacaacatcttctcgtttaacacgagtatacacaatgttcctccctaataaggaaaataataaactttgcaaaatgtaatcactgtctgtatagatctgttgcttagataattaatgccctttaaagtcatatggatatagtttagcttacaaaaattcaacgatgttcccattcaacaaaaactaatcaagcatatgaaatcaacacactacatactacttataatttaaaggaaaaacaactagctactcacgtgagaactcaacactactaaaccatcaattaatttacagaggaggaaagcatatatatagtttgtgaaatcaaataactccatcccatttcagaaaatgcaaatgccctgtacaaatcaaaggagcaagcaattgatactagctaactggtaacggcagtgaggccttgaaaattgaattgagggttaaaaaagaaaaacaaaaacaagactactagaagtccattgatatgatcgatgaactgggggaatgaattcatctctaaatttaaaccgaatgcatcaaatttcaaaatttgtgagaggatttaatttaggactaaccttgtgacgacggatccgggagcgggctaagcaccaccatgtcgttggggatcttgaagaatggatccttctcgtacctgaagtcgcagcgcacgccgaggatcctgccgccgacgcggccgctgaaccacttgggcatctggtcgatgataccggcgaggcagccccggcactgcggcggcgacaggtccggcgtgcactgcgcgatggcgtacacggtcatcgcctccggcgcgaacccggccttccccgcggcgtacctcctggtcgcgttgctcgccctgtcggccaccgcgttcaccagctccgccaccagcgcgtcgaacgccgcgacgtcgcccgcgtcggagacgttgttcatgttgaacgcggccgtctccggctcgttggcggcgccggcgccggcgccggcgaggaagtcctggtccgagtaccggagctggtactggtcgtagtagacggcgacgtccttgctgtacaagcagctgctcgccgcctgctggaacgacgacgccagccgcgcggcggagcagtcgttcccggtgaagtcgccgcggcagagcaagaggccgtacgccgtgtccggcgccgcgccgaacgcccccgccgcgtagcccgacgccgaggcgttcctggacagcacggcgaagaggccgttgagattggcctcgaacgtgctgttcggcaggtacgtccgcctggccgccgtcgtgttacagaaggaggagatcgggttgagcaccggcaaggcgcccccgccgtcgccggccaccggcgccggcgaagagacggcggcggcggcggcgaggaggagcaagaggacaagcatggtaggttgctaaccgaaaacacttgggagttgggaccgggctaacgttgtttgcttgctgtacatggaatggaatggctaagcctaaagagagagtgacacaaaagctattctgctctcattgctccagtggtttgtatattataggggggcatcaggattaagctaagttaattagggcttaactaagattatattaggattatggccaggttgattagtgcatggttgcttcagctaggatgacagtgacagtatgctagcttgagcttgagggggttgacctgttgcaaagcctgataggctgaagcaagctgcagctagccagcaactgatggggattggaggatgaaatgaatttgagaattttggctgtacttgtgtctgtactctctttaggtttttttttttttttctggctggttgagctgctccgttgctcatggttttcagagttgtttacaatggatgcttgatgagatgagtatggagggacgtgtcagttgagtgttttttttttttaagtagtaggtgtgtgtacagcatttgagatctatagttcaagctgttatggatatcgttttgagtacatcagatcatcggggcaatgtttgtcgccaaaaataattgactagtaccttttacctactatactaagtattatcaccagtagggtgatctcaattttcagtaagaaaaaagaatccactaccagtataaataaataagatccattgaattataaaagataatacttaattcagtctatactgatttcgagatagttgttgttgtaaaacatcttaaaattgaatttccgataatcatctctttattttctcaaaaactattgtattttggataggcacttgttatgaagtgtaaattgccaaccgatcgaatttgaattggatagaggtcttaccatatttatcttatatttccgaacaggtatatatgatggcatttcaatatttactactccattatcaagttattaacacaaatgcaatgttgtaacaaacatgaattcaaatccaatatctgtgtaatttggtaagctcatacaactacagttaaccatccatcatgcaactacaagcaaccaagcaactgcttctatatatattttatttgcgaggtgcttctatatttacttcacatgatcaaaatatgaattcatgttaaaattattaagattgatctaaattgtttagaaatattatgtaaagcatcctattttgaatgttgaaaccccatacatattcaaatacataattttcacttggtttcaactacaaatattatgtaaagaatgatgttctcttaaaacagcaaattcttgattggttacaactcatttgatttagggatcttgtttttacctttgtaaatattatgtaaatattttctttagtataatataactattaggcaaagccttgacagtattttggtaaaaaaaaataaagaactacaaataccatcgggggagaattcacaccattgtatgtattttcctcctatattcgttactctctctagatccagatattggataattcggaaccaattgatgccccaaattaggctccattagaaacacatgaattttcttttgtctaaaggtgaacacattaatttcacaagaatgtttcagtttcccagtaattggtatgaattttccaatgttccgttcagagctttatttatatctgtctatctgattagtcgttctttcgtgtacaagctaatagccattttaattagaagtgttaatatctgcagcttagatctactcgactgtgttaggtagctgttgcagattatcaaattgtaatttctcgatgactccatttgataagcgggtctctgatcagatttggcagcttctggctacagctagtagatgctggattgcctgtgtcctctgctcgatcttagtgtttttccagattgaactaacatgcgtgataaattatttgtggatcgaaaacattccgctagtatgtacaatgcacctggttttagtactctgaaaaaagattttgaattctagatattttaggtcactagatctgttcagaaaaaaaagatggcttgatctaatagcaacaaattccgctataatgccctatcacctgcccatggtataattcatgagaaatatttacttccgagaggaaccatatttttcagtgtaaattctactgataactcatcaatgttaagattagttagtataaacaaacactaagttacgatgtctattggtatctcctcgagtaccataaaaattattggagtatcattcaatcagtagcacgactcgatattctatatgtttatatgttaataattgagtgaagtgtataagcggttcctaaacttaagtgagtgtgtcatctagatatctgaactctaaaaatgtatttttaggtccttgaacttgtcttgggtgtcatatcagtctaaccaggctccaacccagtccatgtgttgatgtagcattaccacggtgacgcctatatgctagtcggatccacataccagttacataaacaaatttaaaaaatatattttctccactctaccttagattattttttaattttatcttttttctctctacctaagaggagaaaaatatatggtttttaattgtattttatatgactaacatgtgggtcccactgatatgtagacatcatcgtggtattgccatgttagcagatggagcgggttagaacctgtttagacctatatgacacccaagacaagtttaaagagccataaaagtattttaggagttaaaaatctaaatggcacacaccacataaatttagagatcgtccccatgtacttcactaattagagggcaacatcaacaaattcttctcattctattaagaaagcaattggttgttggatccttctagctaaatcc

SEQ ID NO: 47780 - DNA, 3851 bp, Oryza sativa
tgtttttgggtggaaggaggatatcactgcgcgcttcgagcaggtgatgcgccttccacacctaggaccgaccaccacccttcctccgtactctacagtcgggcctagcaaggcttggttgctccagttcactgtaagtaaataagttgttattatcatacgtgcttatttgcgaccgaatgagtgttttgtactaacatttcattcttaattgtaggcggaccttctgcaccctgacgctgatgattactcggtccgacgctcccttgaggcgtacctgttgtggttgttcgggtgggtgatgttcactagcacccacgggcacgctgtggacttccggctggtccactacgcacggtccatcgcggatgctcagccacaggacgtgccgcagtggagctggggttctgccgtgctagcagccacgtaccgtgccctctgtgaggcgtgcacgaagactgacgcgggagcgatcatcgctggctgccctatgttgcttcagctttgggcagccgagaggtttgccataggtcgaccagtggtggacagcgcaccctacggggttggtcgcagcgcgcagtggccagaggacggtcccacgatggggacttactggtgtcgacgtggggttagtgcaacttcgctgcgttataagtttatcagtcgtcttttttttttcttcacataacatgtctaattccgatcatgtttattgcagcgtcgttacgctcacgtccaggtgagacgtggttacccggacttcgtgttcgagtttgaccgtctccagccgagcgacgtcatctgggagccgtacatagaagaggccgtcgctgcgagagcaccgctaggactttcgtccttgtgcacacgcgaccaggcttactggctcaccatcctgccgatggtgttcgacattttcgttgagcctcactgcccgcagcgtgtgatgagacagttcggacttaggcaggtgtttccgggcaacgtgcagccgaccgtcctccctgccgaccactcgtgagttcggattgttcatttctaaatttttatgataattacttcatcgagccatataatttacctctcttcacaggttgactcgacggggacagctagcaggcgcactttgggctccacgtgtacagcagtacgttgacgactgggtgttagctacagaggaggtgatcaacgagctcttcccacacacggaggagaactaccgtgactaccttcgctggtaccttcctcgcactcgtgcgcgtgtgaccttcactccagatgccccagagccgcacgttgccgctgtcacggacgcgtatcccacgcaccgtgaccgagactacttcgtggcggtacgtccaatttgtattacttcttacaattatttcatttatcttgcataatataggacaactactgaatttgttatttccatcttgcataggctgatgccgcacgggatatcagtgccgatatcaccgcagtccaagtgaggttgaacagaggtttgcacttgactgacgttgagcagagggtgaccttcgaccggatgcaggagaagatgcgtgcggtcatgcgcgtcttctcctgtcgcagcgccgtggacgtcgtacctccagctggtccggtacaaccacggcctcgcgcgcctactgtcggagcaggacctcgacctacggcacctatttcgcacggtactgctcagcccagaggtttcttaagttttgtttctgtttttgtacgaaaacatcaccccgtcgtaacttgatgatccatcctcgcaggacctcgtttgccttcgagcgcccctagcttcggatcagtgcgacctacagcaccggtttcgcacggtacagttcagcccagatattagttcatttttgtttcagcttttgcacgattatgtcaccatgttttaactgcacgtttcctcatcgcaggacctcgtctgccttcgagcgcgttcgcaggcacgaccggcgcttccacgagctccgcaggggcgttcgccacctcttcgggcgcgttcgccagctcttcctctcacggagcgtcgatccctcgcccacacggtactttactttttattaatactgttaaatacctgtacgaaactgatggtccttgtccagcaggatttgcagccgggatcttcggtactggggcctcttcgtctcacgccggtaggactggtcctactagccagttctacgacgacgacttgcacggtgcagaccaccacgacgtactaggctcctctcagcttggaggagctccagaggcgcacactcaggagcagccagaggtcacacctgtacaggcaggacgggttggccgtgccgtacccccggaccgactcacgtactcccacgggcacattagggcgcagggtaggagggacaggggtaagaggcctcgtcagtagtgttctacctcttcagtccttatgtgaccgtttcttttggcttacaaacttgtaaagcagtactacttttgctattactactgcagtactacttgtgtttgtctcgtctacatagttcttttcattcatatggtactagaacaacttatgctcacgacaacacactttcggcgctgcacggtagtgtcagatccagtagcgcgcacagtccacaacagcacacatgaaaagcggcagctcgagttatcactatcaactttcggcgctgcctgtttacataaagtgaatcacgcccacgcgtgatcgtcttgtcatatctaatgaataatgtatctcattgagttcacatatattgcagtgaaaacgacgctatataattgacaatctgaaggcaacctcttcatatcttctttcccactagcacacaacacacgaaaatggaagcctattcattggtaatacgtaatctagatttgagattatgtagaacattcttcactacaattttacattttggcagcaaaccaaatatgatcaaatgcaattttactttaccaaatatttggtcgtgaagaaaaatttggcactaacaatccaaatatgccctaaaaattaataaaatatttgtacggtaacaaaatatttgtacggtaacaatccaaatatgccctacaaaataataaaattgtattttaccagtcttggagattttaatcttgtatagttttcaatataaaaagatttgataactattgatatttatacaaaaatatagagcacagtacaaaatcgccctagcggagggcggcaagggggccgcctgcaaaattccatgccccctcgccgcccatttgcaggcggccccccgcacagtacaaaatcgccctcgcggagggcggcaagggggccgcctgcaaaattccatgccccccctcgccgcccatttgcaggcggccccccgcacagtacaaaatcgccctcgcggagagcggcaagggggccgcctgcaaatttcgttgacggccgtcgcccgagagcgaacggccgtctgccacgtcattttcgccgccctccgggagggcgatttttaaaaatcgctctcccagagggcggtaggcgactacttccgtcaattttcaaaatggaaaattatttttgtaaaacttttaataaaaaaaattaaaaataaaaaaaattcccttccaagcaggtcacggtcggactcatgggtgtactgaactgcaacggcattcccacatcggggatgcgtcgccgccgcttctaggtcttcttcttctcggtgaccggcgaggcagccggcggcccggcgcggctttgccggcgagggctgtaggttgccggcgcgtgcgacgtgctccgcggtgagcgcacgggggctgccgtgacctagcggccgcaccacgcg

SEQ ID NO: 47781 - DNA, 2506 bp, Oryza sativa
caaaattaattcgtctagtgcatggattgatgaaccgttggtgttgattcgttgtcagatttttacttctttgtcatttcgatgtttctgttcgggtaatccaatccccatgttctgctcttgccggcgaatccccttctcttcgcggattgcaggctgacaccctctccgcagcttcacccgagatggaggatctccccatggggcggcggaacccggcggccagcctcaccgacgacctcgtcgtcgagatcctccgccgcctccccgtccgctccgtgtgccgcttcaagcgcgtctgccggtcctggcgcaacctcatcgccgaccgtgagcaccgcaagaagctgccgcagacgctgtccggcttcttctacaaaagcatcagcggcgagcgctgcccttgctcggcgcaccacttcaccaacgtctccgggaaaggggtgcctctcatctacccgtcattctccttcctgccccagtgcgacacggtcgtccccttggactgctgcaatggcctcctcctctgccgctgcttccagcccgggcctaacaacagcgatgatgagattgagccgttccattatgccgtgtgcaatcctgcgaccaaggaatgggtgatgttgccggatgccgactgggctaatggcgagacccgcattgcctgcctgtgtttcgacccagcaatctcctcgcatttccatgttcttgagtatgtggaggctgaatatgaagatgtcacgggggttgagatctactcttccgaaactgggttgtggactcttcatgtgagtggatggggcgatgatgtgtttctaaggcattgggccaatccgagaagtgttttccttaatggttttctgcattctgctacgtgtgctgctgagattgcggtggttgacatggaggggaagaaatggaggaccattgctatgccggagcctgaaggtgatactggcataattcatcaaactcagggtcgcctatgtgcttttaatgttgatccagatgacatcttcaaactgtcaatttggattcttgaagattatgatacagataattggatattaaagcacaccgttagctccttgaggctgtttggagggatgaaatatcggtttggatttgactaccaaataattgcagttcatccggaatgtaatttgatcttctttgtttatggatgggacaaaacgttgatggcatatgaaatggatcgcaaggaagttcgtgctatacgcaatctcggacatgactcctttgagccatatctaccatatgttccactctttaatgagtcattagcagatgggtgctaacgtgcagagtgtcgcttcacttctatcactgcaaaaacatccttttgcaccaaggataaccaagctaagagtgagaaaagccaatctctgatatttaattaggaagttcagtttgtactagaatgatgtcttttcctttgtgttgttttgagaatgctgctaagtctgatggtacgtagtaagtaaattggcttttggaaagtttgtcattgttctgaagtgtatgacttgttttattctactggtgttttactccatggtagttaagcttggatgccgtgttctaagactggcaggtctttttgactgtaccagtgttatcagtttagggtaccatgaccaatgaccaatgttttggaacttcaattggaagttaggaacatatcacatatgtacttctcgatttcttcattctttttctttttttcttattttctgaagtatttgtctacacgtttcttttctgtttggtgatcgatagtgatctcatttattcaaatattgcttcccctgccatttctggctagagactactatagttctaactatccaggctagccgctggcttcctctgattgttacccttctgaatttgcaaattacctgctacatccatgataaaggttatcaaaactgcaactactttgattccttcaactatcgtccgagtatgattcatatcctccaactacaaaaccgggtatatcgactccaactatcaaaatcagtgcaaacaatgtcccttggtggtggctgacgtggcggtctcgatcgatctttgccctgtgcggcgcttatgttgaattagaataaaaacaaaaataaaaaaaatatatgtcggaccatatgccattcgcacaaaaaaatgtattgtggtagccaccgacatgtgggacccacatgtcatcccttcttcctcctccctccatctctcttccccggcttctctcttcaccttggccggagcggcggtggggatggcggtggggatggcagtggcggtgaggatggcggtagggagcgaaagcgacggcggcgacagcgttcagccgaagcacgaagcacaagatcctccccgaagctggagcagtagtgtgactccgaccaaccaccccgctgccttcttcggctcaccccgttcggcccttcccgtggctcgagcgcaccgaaaaccccactagcgagct

SEQ ID NO: 47782 - DNA, 5331 bp, Oryza sativa
tcctcctctaagttccaatatattattctgttcagaacaatagaacataatgtttatctgcgccgtgaaatttcttatcgtttttaacaccaaaatgcacttgcaattcattgcaccgtgatgttcatttgcaacaatacgaatcacaagagtgtgatgcgagctgcaaaatggctcatgggagggcattggcagcattgaggccttgatggctgatgccaacttgccaagctgctaactgttttacagataaccgggacgaatgtacgtcttgctaagaacagttgatcacaattcgaattttatttcaatgtataatgcttgttttggatactgtaacattctagacacgcctctgcatgcgccgttatcagctatcagagccccagactcagaactagtagttgcagagcaaatcaagagacataagcagaggaagaagaaaacagagaggagcgaatcgtactggagttggagtgtcgcggcggcgtggcaatggccggataggaccgccatgtcgccgctcgccatgcccgagtagaggctctagagcggaaggctctaacagccgaccaactcacaagcaagattgtcgatgagatcaacctttggatctactatggtgcaagagatatcgtgagaatcttgagatagcaatctgaaggggttgtacagtagagtgtttgttttatttttccctttttttttcaccttggtgaagttgtaaataacttttttctgctgcatatataacaccagcaatgcttggctcttttttttttaaggctgatttggtcgtattcaagagcagatttttttttctatggcaagatgaagagggccaaggtgaaggcatggtttggtgaggcctatcgtcttctgttaagagaaaaggaggaactaaaaatttggttttggtgattaatgataaatctaattatataagagtaatattgttataaacatttatttgtctactagactcatgtggatatgaaagtgaaatttatgagaggtgatttcatatgagttgagataaaaacgtttattgatggtggacctaaatcacaaggaacatcctgtagtaaggaacgcacggcggcggcggcggcggcgctccgtcttgctgctgctgcttttccttcttttccacccccctcaaacgcacgacaacctcgctccttcgtgtcgccggtggcggcaagccggcctcctcccgccgccaccgcgaacgccttcaccgccgctgtagggagcaggccgatgggttcgcatcacgcccgctcatagcaagcttcacagccacgcagccgcagggagcgctgccgatggcggcaaggaggtgagggagcaacaagaagaggagcacgcggtagggccggttgcttcggcgggaggtcaagctccatggctggccgagtgaggccgggacaacaacctctacttcgatggcagtcgtgccttcacgcttcgggtcggtcctccaccgccgcgtgaggcccgcccccaccggtgtggatggcggtcgagcctctgtactccgggccagtccttcgcctccgtcgcggccgggtcgctgtggccgggtccctatcggcagtcgaatggcggtcctcattggtggttgaatggtggacgcacctccgcgctcctggccgttcttctgcctctgccgctgcctcgtgagccccacggcgccaccaccgctcgtgctgctatcgctatcatcacaacgctagaagatgggaagaacgaaggaagaagacggggaaagaaggagatggatggaaaatgtgatgacgatggcatggttctagttttgtaaaatttgagtggcacgcttatgaatagacgaattgtaatagtatttttttaataaccatatttacattggcatggattgaattaacccaaatacttcttgttgcattgtgtagaatgtttttgtaagccctccatccaataataataacaatttactattagatgtgacatatcattttattaggttatgtcttatccaatactagttttttttacggagagagtatttgcttagtgcatttctaaaagtatttaatttatctctataatcaaatatataaccatgacaataatctcacgaataatctgtatcacttgttgaatgatttcgaagcatttctgttgctgggagtattttgaaggagaacattaccaccatcttttttagtgcaagggatggaagacataataatttggaaatggaatatttggttagatcacactacaaaattcaattgcacgacaattgaggactataacacataaatagcttggaaaactgctgcagaaggtaaatgctaaatttgcatggtttcattgcagggatgttcacatggttaattatgccctttaggcggccaggagaatgaaatgtcaaattacaacgattttaaggaagcttagccatgtggctgtaactttttttagatgcatttgcgatttgacagtaataacttagtaaggacataattgaaagaagtatataactttttttatgtcattctgaatttctggtttatacacattcgaacttagagaaggaacataatagttgaagttttgataatttttatcacggtttgtagcaggtaattgggaaaattgataagggtaaacatgagaggaagccagcatgcatagttgaactattgtagaactttttggtttaccaatctatgctatcctcgatgtacccttgtacgtgctcttgtttgaacatacacaaactttctctctctctctctctctctcaaactagaaaaggtaaggaaagcaatattccaattattaagatcattaaaaatcaccacacagaaaagaaaagtaagggtctgctgggaaggcgacgaaatccctagatgcccccaattcagtgtctgctgggacattgattccaaattgaaaaataaggctctgtttagttcacggctgtcacatcgaatatttataaatgtatggagtattaaatgtagaaaaaaaccaattatacagattgcgtgtaaattatgagataaatcttttaagtctaattacgccataatttgacaatgttgtgctacagtaaatatttgctaatgacggattaattagacttttcttctcgtagtttccaagcggaatttgtaatttattttgttactagactacgtttaatatttcaaatgtgtgtctgtatatccaatatgacacgccaaaaatttttcttcggaaattaaacagggcctaagttcatttgattcccttagctactggctaaatctgattcgtatccctaaaccacgacacctgatatctcgaccctttaagccagatgtgaggcggggctagccagcatgcagaggagaaggggcaatgggagagacatccacgatgctcttgacgatggtagcccgagtgaagctagccaccgcagtgagcgagctgctttgatgtgtaggtttcctgatctaaacatttactgatttaccttctcggattagttcgtctagtgcacggattgatgacccatggtgttgatccgttgtcagatatttatctctttgccgttttgattgttttgttcgagcaatccccatctgctcactgttcacctgctccatctgctcgaatccctcttcgcggattcacggattgcaggctaaaggcctctccgggctccggcagcttcacccgatggaggatctccccgtggggcggaacctggtggccagcctcaccgacgatcgacctcgtcgtcgacatcctccgccgcctccccgtccgctccgtgtgccgctccaagggcgtctgcccgtactggcgcgacctcatcgccgaccatgaccaccgcaagaagctgccgcagacgctgtccggcttcttctacacgagcttcagcgaggagcgctcggcggcggagcaccacttcaccaacgtcaccgggataggcatgcccctcatctccccgaccttcgccttcctgccgcagtgcaaagaggtcatccccttggactcctgcaatggcctcctcctctgccgctgcctgcagtttgatggtgttagcaagttccactatgccgtgtgcaatcccgcgaccgaggaatgggtgatgttgccggacgccaattgggctgatggcgagaaccgcattgcctgcttgtgctttgatccagccatctcatcgcatttccatgtggtcgagtatgtggagatgaagctgaatgcgtcacaggggtggagatcaattcgtctaaaactgggctatggagtgtccatgtaaatggatggaatggtgtagttcttgtcagcctttcggtcaatcgaagaagtgttttcctcaatggttttctgcactctgtcacgcctgctgatgagattgtggcggttgacatggaggggaagaaatggaggaaaattcctgtgccagaccgtgataatgacattggcataattcatcaaactcagggttgcctgagtgcttttaatgtcgatctgctcgatatcttcaaactgtcaatttggtttcttgaagactatgatacaaataattggatcttaaagcacactgttagctccttggacctgtttgaagggaagaattatcgacttgattttgagtaccaagtaattgcagttcatccagattgcaatttgatcttctttgtttatggattggacaatactttgatggcatatgaaatggatcgcaaggaagtgcgtgttatacgcaatctcggaatgactactgctggccatatctgccatatgagttgcgatcatctcctgtaatgcatgtgcagtaagtgccactgacatgtgggcccggaataggtgggacccacacgtcagtgaaacgtactgcaggtgcagtacagcagtggatttgcatccctgccatatgttccactattctctgagttgttaactgatgggcgctaatggccaacttgcagaggtgcggctccacttctgttgttgcaaaaacaacttttctcccttaggagaatcaggcttagagtgggccagccagtctctaataagaattatgaagttctgttttattgtatttgattaatcctcttcaagttattttgaagaacgctcttaaatcgtagatggtaagctaattatgtaagttctgttgttccgaaggttatgccctgtttttattccactgatgtaaccctatgctagttcccttcaaaaaccctatgctagttaagcttgatgtcatgttggaacatatgtactgtccttttttcccgcattctttttctctttttcttcttttctgaagtacctgtctgt

SEQ ID NO: 47783 - DNA, 6005 bp, Oryza sativa
ccattgtttttattacaaaacttttgaaatttgatcacttgtcatgcactcatgcttattagcagcacaatgatgtctttgttttggcaggaaacattataaatttcaatgttggtgcattagttgatttagacattcctcggagcttttggagtcgtgtttcagggaagtacggaaacatgttcttctggaaagaaaaggtaacattttgttattcaatctagcagttaacaataaattacatattcatagtgatgttttttttttgtcctcctgattctacaattagaagagcactaaaatatgatcattagcaatggaaacagcacaaacttttaaaaccatccaatagaaactatcctgcagttacctttcaaataacaaaattcctccgactgatcaggttctctctttttgtgcttcagattttccttccttgtctaagctggtttcaatgtctgaatattttgaacaacaatgtaaattgttagcaaaaatatagtaagctcaagttttttttggacaaaattttatgttttgccctgtgaaattgtggataaccatgccagtccctgcttggaaactctcttctagtttctatatatgttgtccacaccattgccttcttgaaacatggaacagggggaggatgcatcaattgaagctgctgtgatggccgtatcacgctgtctgagagagcccactggggcaaataactgctctgaggttctgtagatgtgaagacaagcaagtgcaacatatgtatagaagcgaaaaaaaaagtccaagagctatactaaatagtacgaggccaaggaccattcaggtttcttttttcagttgtacacataaactcatcattttgactaattctgattttttagcaaggatgaagtctctcttgttaatagatgcgaactactttgagatttagggcctgttcactttgatgccaaaaaaaaaaacctatgttgctaaaattttggcaagataattattttgaatgtgttcactttgttgctaacgtacattctaccaaattttggtaacatctggtagcgtttagattgcatccgaagtttttactactacccaacagacgtgctgtaccaccctctgtcacctgattgcttcaagcagaggcggaggcggaatagccaaaatttgggctgcgctggcccatgccgattttggtcagtactgtgcaagttaccaaatttctagtgtttttaccaaaatttggtaagaaactaaacatatacacaattttagcaaatttaccaaaaaatggtaaggttagaaatgacatcaaagtgaacaggcccttaagaccaaataaactattaaccctttttaaggaataagttcatttgccttccctcaactttacgtctagtctgattgatatgccatgggacccaagttacacggttttgtatagtctaggaatgccaatcaaactcgttgagggacagcaagtgaacttatctcttgttttaatcatctccacatggacaaatccagcccactcatgagcaaaatcggcccacctcttatttcacgtgaacaaagtctgcccacctctttcactccaacgaattggcccacctctttaatgtgaacaaaggcaacccacaaaggaataagttcaccactgtggtctttttatcccttaaccacaataccgagtattcctctgcccttcatccccggtccgactcgccactgctaccctcccatgtccaactcaacatcgccaccctcccccgatccggctcaccaccgatgtctacttccttttttttctctcacctatcagtttttattttctcttaatttattaaatgggaaataaaggagaacattatccagtgtcagaaatggagcctctattgccaatttgtcacaagttattctcttgccagtttttcattgcaacaagtattatttttttcataaacatccatgctaattgtttattatcatttgcaataaatctacttgctataagttttcgcagcaacgcggcatagtgctatctagttttttttaattctaatgttaaataagcgtcacggtgaaagccacatgattatttttttaattagtatttgattaatcaaacactaataaaatctttcgtgggggagaccagttttcagcatgtcatgcattttacgtgcaggggagatcaattttcaacgtgccacgcggcccacgccgaacacagccagttggcagtatgcgcagaagaacaccaaaaattcacaattttccaacggccagaacacggcaagttgaaaactaatttgcccagcgcagcgcatccgtgtccccggccgccacgatgcttgcagctctcctaatccttctcctctcctcgccgccgtcgccggcggccggcgaccggtggttctgcggcaacgccacgacgtacacgccgaacagcgcctacacgtcgaaccgtgattccctcgccgcatcactcatcgccggagccacgaagctgcactcggctaccggcgccgccggcgcgggcgccgacagggtctacggcgccgtgctctgccgaggagacaccgccgccgccgactgcggcgggcgcctccgcgaggccttcgccggcatcgtcaacggcaccagcgtgtgcgcgctccgcagggacgtggcgctctacgacgagctgtaccacctccgcttctccgaccatgacttcctctccgccttcagcaactcgccggagtgggtcgacgtcaccaacctgaacaccgcgccggccgccgacgccgagcggttcgaggaggtcgtcggcgagctcctcggctcgctcgccgacgcggcggcgaggcgaccggagaggtacgcggcgggcgatgcgccgtggccgtcccgggagagggaccggactgtccggacggtgtacgggctggcgcagtgcacgcgggacatgccgccggagcgctgccggagttgcctcgacggcgtcgtcgccgagaggcggcggaagatcggcggcggcacgatgggcggcgcgatccatggcgtgaggtgctcgctgcggtacgagacggacacccagttctttaccactccaggcaagttaattagtatatagcaatactaattgagcagtattaagtattaacatccttcacccaatctgaacgaacattatgaaagtaacggctcctttgaaatgcatgatttttcaaaagacaaaaataagaaaaaaaatacatgtttgaaatgtcgtagcacctcaaatccaatagattgaaataaagcaagagagctactagaatgaccgtttggatgaagcctatgaaaagtgcatgaatgaaaacgatccccccagtcgttcaaaaaaaaaaagaaaagaaaaagaatcctcataggaaaattttccatagggttgaatttctccaaaattccttcaataatccagtcttccaaaggagccccaaggtcatgactccatttactgtgttattctaaaaatataattccatttggcattttccatataccttgaattctatttactgtttttgtcttcagagtagttggaccatggattggctagataaacctctaaaaaaacaattttgctttcaggctgctgaatgcatactaaatataaaaaggactgcatgctactctgcttgccaaatatgtatattttacatgtatatattgactgaaagtttaagatgaatcctttcggtatggtacaaattaagattcaatttagctgatcaatttggccaaaaagaaagaaacgaacacttgaatccaaccgtaaggcacactatcttagcaaaattcaggagctaagtctttgatattgtagaactgattcattcactacatgtaaaccattctatgtttcaaaattcagggcaaaagaagggacatgcaatcttgatcattgctactgtttactctctttccatcatctgcacacgcctgtttttctgtttcctaagcataagaagaaaacaaaaaagaggtaagcaaatgaataacagtacatgatactggcagctaaaatactagatcatttctacttacttcagttacatgcaagaactaatgaaggatgtgcatctagtgaaaataaacttgatggagcagaccacagacatggatgaagttatgcggctttggaagatagaagatgctggttcagagttctccttgtatgatttttcccagcttgctgatgctacagacaacttctcagccaataacatattaggcgagggtggctttggcccagtttacaaggtactttcttgtaacagtatcatctaattctgatggcatcatatgtatgtaggatttcattgatgaaatttacaggggctgtttcctgatggacaagagttagcaataaaaaaacttggtgcacagtcaagacaaggtctagtggagttcaaaaatgagatccagcttgtagcaaaacttcagcacaaaaaccttgttaggttgctcggttgctgtgttcatgaggaacagaagatactgatctacgaatatctgcccaacaaaagcttggatcacttcatttttggcatgttttactccctagctattgataaaaattgcatttattctcgtgtgtagtacaagtattaaaccttgagcctgcattatattgcttgtagatcctatcagacggacatcactaaactggaaaacacgaagaaaaatagttgaaggaatagcccaggggcttctataccttcacaagcattcacggctaagaatcatccatagggacttgaaagcaagcaacattctgttggactctgagttaaaccctaaaatttctgattttgggatggcaaggatattcccatcggatgcctctcgagcaaaagcaagcagacttgtgggaacattgtaagagcaagaaactagaaatgctagtagttactaaagtttctacctacacatttgctttctaactctactgcatgccatcttgtcagtggctacatggcacctgaatatgcatctgagggccttatctcaatcaaatcagatgttttcagttttggtgtcctgcttcttgaaattatgagtggaacgaggagtgcaggttttcagcactatggagaatttcaaaatcttcttgaatatgtaagcaattgaattggcagaaaaaaaatgttcctcacatatctattactgttgaggggtggttgtagatcattatccagttttcttttccataaatcatagggataatttcccttccttgctctgatttattgaatttgagtttgcatttgtatccaataactgaagaaatatatggatattcctaccatcacacttagcaattattttttttcaggcatggggaatgtggaaagacggaagatggtgtgatttcattgatcaatcatttggtgatgaatacgaacctggagaaatgatgaaatgtcttgtggtggcactaatgtgtgttcaagagaaatcagcggagcgccccaccatgtctgatgttgttgctatgcttagcagcgatgacatccccttaacggaaccaaagcaaccagcttactcacatatcagattagatgtatcagtagatgtcgatgtatcgtgcagcagaaatgatataaccatcacccttactgatggtagatagtacaatagatatacactagcaaggtgtgggctagtggtattggtcttcttgcactaattaattagatagggcattgtttgtaatctattgctcatattccatacgtaaccagattttccatgttatcatatatacgtgtttcaaaattatcagtaaatatacatttaagtctccaaaaacattccacaaaatattatcataaacctgctggaaagaacttgacaattccaaaataccagaacagatagacttgtgcagaatattcaaaaagacgtagtcattgacacagctagcaattttagttttttttttcacaacttaattaagatatatttcccggcttgta

SEQ ID NO: 47784 - DNA, 957 bp, Oryza sativa
gcactaaagaaaagaataaaaaaataaaaagaatgatgaaaacaggaagtacatatgtggtgtgctccaacattcaaaacattagtcacactgtcacagtaccctaaacagattgtgctgatacagtcaaaagacctttcagtgttagcatattacatcaaagcttcactataatagggtaaacaccagtagaataaaacaagacaaccttcagagtaacaggacaaaccttccaaaagacaatctacatagtactagtactaccatctgacttcttaattcaagtacaataaaacagaccttgctaaatccttgtactagagaatggctttctgcccactctaagcttggttctcctagtgcaaaaggatgttttcgcagtagtaaaagtggagccgacgctctgcatgttagcgcccatctgcaaatgactcataaaagagtggaacatacggtagatatggatccgaggagtcatgtccaagattgcgtataacacgcacttccttgcgatccatttcatatgccatcaacgttttgtcccatccataaacaaagaatatcaaattacattctggatgaaccacaattatttggtagtcaaatccaaactgatatttcttccctccaaacagcctcaaggagctaacggtgtgctttaatatccaattatctgtatcataatcttcaagaatccaaattgacagtttgaagatgtcatctggatcaacattaaaagcacataggcgaccctgagtttgatgaattatgccagtatcaccttcaggctccggcatagcaatggtcctccatttcttcccctccatgtcaaccaccgcaatctcagcagcacacgtagcagaatgcagaaaaccattaaggaaaacacttctcggattggcccaatgccttagaaacacatcatcgccccatccactcacatgaagagtccacaac

SEQ ID NO: 47785 - DNA, 877 bp, Oryza sativa
atgagttttcgtgtccaaatttgatcgtctgtcttatttgaaatttttttataattagtatttttggtgttacgagatgataaaatatgaatagcactttgctcatgacttatgttttaaaatttttttaaaaaaatttaaataaaattatggcagcacttaaaatgagatagattgagtggagtttttggaagaggagagtcctgcatacagccatacacagtgttgctctgcatttataccagcactccagcagtgcacagttgccggtcaagagctgcaagagcagcagcttgacagtagtgtgacagcgtctcagccttcgtcacgcagcagcagcagcagcagcagcagcagaagaagagcatggaaatgggcttggttgcaaggacttgtttgatcgtctctctctctctctctctctctccctctcctagtccctacgcaggcgttggattcgatcccttctgccattttcgcgcatgcggcacatctccttctgcgtcatgatagaaagggccttcttttcacgtcactgaaaaaaggcgtgcatccaaatgaaggatggcactgccatgcatgcatgcccggtagaaaccaatgcagggccctcactcaactgtcaccttcctttccaacatgaagttttcacatggatcagtttaatttctgagataattaattcttcacttcaaaaggatgtgtgagattgtgagagaaaagaatggccctaattaattaaacagatatgaagggaatgaagagtttttttggcaagtggaagttggcactcatcgtacagtttggtggtaagcagaagtggacaatgtggcaactcaagacagctggaggtgacgaagtcgaacccccccccccc

SEQ ID NO: 47786 - DNA, 11920 bp, Oryza sativa
  unsure (1)..(11920): unsure at all n locations
atcgatgcttatcgtcgctaaattaaatgggagtacaggctaaacacatgagacatccctcgatttaaaaacagattacaaacacatggatgttcacttcacacacacgacaagcaggaggaggagcagctgctgaaacaaaacgaccagcggcgaacttaatttttttgaaaaagggagaatcataacacggtagaactcatcatcatggccaattgcttcatcaacgccttccagccattatcccccaacaatggctgctcgaactcctttgatatcacgcgttgctcctgaaggagccgagggctttgatggcgccggcccggaggatgtactggtggtagaacgccgcgatggcggcgccgacgaacgggccgacccagaagatccactgcaaccggagacggggaagacgatcagtcacaattcacacaacccaaaaaaaaaagaaaatcatgatcaggccatgcccaattgaggtaatttgtagtagtagaatgtatgtgtcttcttacatggttgcgccacgccttctcgttgttgaagatgacggccgctccgatgctcctggccgggttgatgccggtgccggtgatcgggatcgtcgccaggtggaccatgaacacggcgaagccgattggcagcggcgccaagacctggtgacatccacacacacatgaacaaaaaacaaaaaatcagaaattagcataggtttgcaagatgttaggcgagtaaccaaactatcagtagtactgttcagcaacaagtgtcgttttaacacagtgagtcaagtgaggcacaataattcacaaaactgtgctgctgccaaaccaaaccacaccctgcatgacatgtgtagggtgtcttttcagccacatgacccatgtatacgttttaatggtcatcaacatcagtggactattagggagcaagttagtggccaaaaagcccacaagccttcttgtcacgaaatgcccctttcaacaaggaactggaaacgaactagctagagcaccaccaaatggctgcttttagccttggcttagtgcgcatttcacctcctccctaaacaccaggtcacccagggcatattttgacaagatgtgtgcaaatctgcaaaagcagagaagcacagcacccccaacgcttcttcacgccttgtcacctccaccaaagggaagaaagaaagaaaggaagaccctcatgtcaagatgcccaccttcactcacacaacctcacatgttcaccaccatataaagtgacctatccatttccccttctccagaaaaaagaaaaaactactactagtactcctctacaatttcacctaataatatttggtcttgttttttagtgaggagctagcacaaaacaacatggcgtgaaaggacacgaaatagttttgggaaaaaacagaggggggtggtgaagaatttgtaccggcggtccagccaaaattcatcatggagatcacatgaaaacctagccgctgcctgcacggaccagctcacccccggtctggaccatacagtacaccggaccagctcagcctttttggctttgctagggccacatgtagtacgcgcgcgcccgcacagccatgctaccgtgatgggatggaacagtaatagcggcagacgtgacaaatgagctacagtaaataagttatagggtcccatcggttgccctattaagccgaagcaaaagccaaaaatttaaatttttaaatttaattttaaagttgattttaagatattttgaacttagttttttttacagtattagcttttaagtcagctagaaatacatatataaaaattttaactacaaattattttttattccttagtaaaacattttatcttattagggaatataagttttagttataaattattttttattcgctagaaaaacattttagcttattagaaaatatatgagcaaccgatgaggcttatagattatttgtaatcctctccgtccttccgtgtgtactaggaccatcttgaatcttctactaccaaaaaaaaaaaactactactactttcaattatgtggtgactatctatctactgctagtctgctactgtactggagtgatacggagtaagaacggtaagagcaaattcaacactacggtatgcttaataatgttcatgtagtactatctgaaggagatctgaaaattgacaatctgtaggcatgcgaatagcaataaaactgtgtaattttagaatttttttcttccgaaaagaattaagagtttttgaaggaaattattgcttctcttctgttcaatatgcgcttgcttttatcaaagaggatatataggatattcttccactgcttttcattcctttttgtacacatctgtcattcttccgatctaaacaaactaatattctcatactaacacatgcatgttagttgttagattaaagcatctaccgtcacttaagctccaattaagcaagcacaattttcaaagagaagaaaagaaaaagaaaaatttgggagagctagctccgatgcttcttaccgggacatgtgagtcgcgggcgttgcgcttggggtcggtggcggagaagacggtgtagacgagcacgaaggtgccgatgatctcggcggcgaggccggtgcccttggagtagccggcggcgagggtgttggcgccgccgccgtacctgttgaagtaggcgctctggaacgccttgacgaggccgacgccgcagatggcgccgaggcactgcgccacgatgtagaggatggcgcggaccagggacaccttgcgcgccaggaagagcccgaacgtcaccgccgggttgatgtgcccgccggagatgccggcggtgcagtagaccagnnnnnnnnnnnnnnnnnnnnacgcccacgcgatgccgagcacgcccacgccgccgcacgccgcgtcggcgccggaggccgacgcgtccgtctggtgcttgtacccgatcaccgtggccacggtgatgtacaggaacagcagcgtggcgatgaactcggcgatgacggcgcggtacagcgaccacgaccccagctccgccgcgtcgatcagcggcgccggcggcgggtccgtgtagtccttggccgcgaactcgccggcggcgccgccgctctccatcacctcgtccttccccatgcccgacctagcttagcttgctctcgccgccgcgggaagcttaacgggaggagtgacacgaccagctttgcaagcaatggtggagagcttagctgagcggagagcttgtgtgcgagagtgagaaggaggtggtatttatggagaagaaagagagttggtgagtgacaacgaggcaagctgagactctggcgtgtgggactaccctcctcaacgtatgagactctatttctgtacttttttattttgtcttaaaaaaatatactttttatttccttttttattttcttttgctgtccatggagcagaaaatttggctgtttttcttttatttaacttgttttgataagaatggatgggccttttggttttcttgctccaatgatgcctatgacgagctgggatgataagctactgcgtgttggggcctggggcttacgtgcttcaaactcagaagaatgtatccaagccaagaattcccggttttgttctaaaaacaaaaagaataattcccggttttgtttttgttgctgtgagtggaagattccggaggagagaagtgaggcagtgtccaaaagacacctttcaatcctaaccattcatttctcattttctatttaatcttaacccttcattcatttcctaatcccaatcacaccccttattttccattatccaaacacacactgaaaaactaaggggagacagagaggagatttgttgcgtgttgccgtgataagggataggatcaatgtacccgtgaccattgtgacaaaatgatcatgtgcttagtgtttttttaagacaatgatgtgtatattgcttgctataggtttatttaatacgcatttggcaactaattaagctgagttctttccttcattgaacccacctctacgtataatagttatgcatagcgcattgttatattacttattgaaatgcatggttgagaaaacagaagattaggaaaacatagaattttaataggaatatataagtgcaaacaaaatattgcaagacataaaaatgattgtttgaatagaagcaacaaaaaatacgcagtaaacagacttgaaaggaaaatttcttagatattagaactcttgttaacttcccttccaaatctacatgtattgagctatttctaaggaattttatatgatttagaaagcttcaatcctctatttcacaaaacgaaaaaaaactcctatcagattttaatactacaaattcctccacaaataatctaataaatgaaaaatgtttttacacatctgtttttggcagccaaaagatcatgttaaaataaattacttcctctatttttaaatataaggtgtatttttttcatcaggacaagctttaactacctattactttattgtaatatattacttttgtcccagtttagtactatccagggtttcacttatcgcatgataatcgcgcttatcgcgggggtacggtaggggaaaccggcgatatggtttggatgaattttgaccaaattcaaaattctggaaaaaaatcgaaaaaaactgaaaatattcatggatgtagttgttgatttgtaattgccaatggtgaagaatttttttgaaatagagtaagctaaattcaaatttgagtgcaaaaccaaaaatggtttacaaattgaaaaaggaagaggatattgggccttaagtatcctacatattcttccaattattctcagtttctagttttctacacatattcaaccgtattttttattttttaccctatttattttacatttacattatttcagctatacagcccgcgataaccgtgcgaatatcgcggttatcgcggtaaatcgtgcgattatcgcggtgaaaccgcgaaactgtcgagttttgaattcaaatttttggatgtgatttttgtgcgattttagacgattatcgcgctattatcacggttatcacgctaccgcggggtggcgataaccccggccctaacgataaggtaaaccctggtactatctccgttctaaaatatctatttttagtacagtaccttgttccaaaatgaaactatttctccgtctaccttcttctctcaaccaatcacaaccatttttcttcatctactttcttctttttaaccaatcacacactttctcctttcaaccaattacacactttcttcaatcattattacatactttctcaatacccatgccaacctcaaaagtgtttacattttgggataggcaaagtagttgttctaggagagaagcgataaaatatggtgttgtagaaataaccaatgtgtcccgacgttaatcattttaatgcttattaaaaattgtcacaaagttagtactacgtcagccattttgacatatctgctacaagtatggagaagaaaattaatgggagcactcttgctagtggctagctgttggttgccccacgcctaaacgatctcttttttagacaatgaccatatatctccaagcaacaactaaattgtgacgaagggaataatttttcgtggcacaaaattgatatgagatttattttggaaagtatttgtgacgattataatttgcatcacacaagcaaatatattagtgaagcaactattaatcaaagccttatcctaacaaaataaaatgcatctaatatcttgaaattgaggtagttgtagaaaacaacgaaaaatttcctaattaatatgaaaattaaattctaaaactgaaaattgactgtggcttataatcgagggaggggtcaaatagaacctgaattagttattaggataatgtgggcaggaattatatattcgcagttgtagctgttttgaaggcccggtgttcctcgcggggatttaattaggttatcacggacgggacgtacgtaaccaccataaccgcaggtcgctccctccgaaacggcgccaccgcacagagcagaagggaagcgaagggaaggaaggcaatctcctgaccacatggatgtgcgcgcatcgcattaatattccccacgcacgattaaattaattacacgggattcagtggcgcgccgagtcgatatacgagacgtaacgtactcgatcgtggctgggcatgggcatgggtccggtcgatcggtcgacgtccatccctaatcccttccgtttgggcaccgcacggccggttggcggttgcatgcgaccatgttccgaaccgacgacgccgatgcgacgcggcctcacgataaggcgatggcgtacgtcttcgcccgggggggaggggggggggtgccgttcggtcgtggtcgatcagtagtactaggtcacctgcaggccgttcctgcccctgcgctgcgctgcgcctgcggcggagagtagtactactcgcgtgtagcacgatggccagccagcctcgcgtcgcgcgtgggccgcgccgcgcgcgcggccgcagcagcgcaggttgcgcacttccgccgcagatggctgcggctggctgcgggtgggaagccagcctggtccacgcgtgtgcatgcatgcgtccatcctatgatgcgccctccgtccgccaatgcgttgtggtggtggagtggtcaggtcaccaacaccagggccgcggccaggtaagatgagatgagatgagacgagatgaggtggagagagatggtcgcatgtgatgtgtgtgtgtacgggctgggtggaggacaaatcagcagcagcggcatagtagtaggagtaggtgcgtttcgctcgctgtttttgggagcaagttgcgggcgggcgcggcgccgtccggacggagggggctggaccgccatatgatagatcggtccatccatctgcctgccaggggatcgccgtaaatcagatcacggttttggttggtgcgtacgtgagtggtgacacgctggcatccacacggcggagagatccgtaatccccatctgcaaacgatcgatagaattttgcatgattcgtttagtactggttgaattgttttgtgcgtgtataaatattgtggtaatttttttatgtgaatttggtgcgctctaaaggagacatgagggagccaacaaatgatgtggatattttcatcaggatctgtttattatatttttttatgaaactgtttattatattttgaaatgtgtatagttttacaataatttagccgttgcacacgcagaataggcactttttggtgcgaagtcggttaacgtagcagctgcggctaccacgtaccacatcgtttgatatatagcacaatctacaggtaagtatgcctggatgtggcctttaatggtttgtcttttcctctggattcgccgattagccgatctgtcggggcgttccttgttctctttacccctttccttccttagccggcgtgtaaagtgcaatgtattcctatatccacttcaccttcccctacattttttttctctttcctgagaggattaactttttccttgttcagttggtgtgtttcaatctgtgtgcacgctcccgctaacaaacatagtactagaaacaactaaacaaaccgttaattaagtataagagcatatacttgtcccgtttgtcttggagtgctccggtgtggacttgcaggccggctagcagctagatcgccccgagtgcagcgtgacagcagcaaaaggatcgaagcagttgcagccagttggtgcaatgcaatgcaagccaaaaaaggggattaccgccatcatggcggttagctacatatcatctctacccgcgcacactaccgttgctggatggatcggagtagtcctagtcctagctagctgccgccgctgggaatccaatgatttggtccctggcccgtcctcgctgtcctgtccatacgtgcggccgaatcagctgcccgcgccccgctcccggcacgttgcgtcgcgtcgccttcagcgtgcggcgcgggcgacctccgtcgcgacgcacgcttttccctggcacacgcgccgcgcgggatcggcatcgcgctcggatgcggccagcgtccagcgagcgtgtaggccgcgatatgatcgagtggttcggcagtgtgggccgccacggcacggcgcgcgcatcacgcacggacgcgcctcgccccagcgcgcgaagcacaacggctagctgcgtgtcgcgcctcggctcgattgggtggtgtgccgcgcgcggtttcccccctttcaaacccccgtcgatcgagacgcagacgctcgcacgttgatctcgtgctactacatgttacagcagtcatcagctgcttgtatagtgctactagctgcttcgcggcgtcgcgcgactacgcgcgtacagtaccagcctaccaggacgcgactggcttgtgcgggtgcacgcgacgcctagcaaattacgccaccgaccggtcacgcgcggcctagatgctcagcgtgattgctagcaggggagtcgtacttctcttgtccacggcttcttttcgcctttgctgtttctggcgatgcgggcgtccacctgtccatcggaatcccgacatgccagattcccaatatctccggccaccgtgacatcgtccccgatcacacagataatcccctgctttggaatcgtcgatacttgataggactactgtgactgtaagagtgtgtgccctaaacaaaaataggttctatttgcggtaataattgaggctacctgttacacgtggagcaagctagttccatgcattccaaatcaagccatagtcaatgtgcagtcttcgagcttcattttaatttacgagcacgttgcgtcgtggggaatgatgagcccgtccatgcttcttggaagggctgcatctgcatctgcttcccgaccgagcaggatcagtgatgtttgaaaaggattactctactgtaattagcccaacgagcgatcatactatactcctatacagtactctactgtaaggcgtactagttaattaaccagtccttgcattaactacttggtccgaggcgcattaatcggcaggggtctgacagaaggaaattaaatgtgtaatcggcgggcgacatatccatatccaaggccacgctgtggcacgacggccattgctaattccggatagcaacggcggccacgcgtaacatccggaccctgtagtcgcacaccctgtagtcccacagccccagaacgcgaactcactgcctaggcctaggcatgcgagccagcaaagtgctttgtcactactactcctacagtgctatagtactcctatagtagtcctattatggtgggatagttctaatgtcctagtattatggtgggatcagcatatgggcatggcacggtgtgacatcgatctttgatttttcctgaccagatatcaacgatgataaaacacctaaaaacatttgtttacctgttccaactttttttttgactggaattacctgttccgatttgacaagtgctataaggatgtgttaatttgccttccctccacagacaaacgcaaattaacgcgtgattaattaagtattagctatgaaaaactttaaaaatgattaatatgactttaaaaatgacttttctatttaaaaatttttgcaaaaaaaaaacactctataaaaaacgcaccgtctaataatttgataagcgtgcgcacgaaaaataaggaatatgagttgggaacttaggataaagaacatagccgaaggctcgcatcgtttggcttatttgtaaaataagacaaacggcatatttgtaaacaaaaaataatttgtggataaaacctttatatacgggttcttagcgatctaaaagcaaagctaaaaaataaacttcgacgaaaaaccccaaatcagcttcaaatttaaggttgaaaatttaagagtgaagtacatggacggtccctaaacttgtgccggtgtgtcatctaggtccttaaactcctaaaatgcatttttagatccctgaacttgccatgtgtgttatataggtccaaacggattttaacccactcgatgcgctgacgtgacaatgccacggtgacgcctacatgtcagtggaatccacatgtcaagcatatataaaaaataaaattaaaaaccatattttctcctcttaggtagacagaaaaaaagataaaaattctaaggtagagaggagaaaatatgtttttctacttatatttttttatatgtgactgacacgtgggtccaactaacatgtatgaactatcgtggcatgtcacatcagcgcatggaaggggttggagctcgtttggacctatatgacaccccaaaacaagtttaaggacccaaaaatgcattttgagagtttagggacctagatgacacacctgcacaagtttagggaccactcgtgcacttcactcaaaatttaaattttggctaataagtataagcataagcataaacataaacgaaaagatgaggccgtaagttattttaaaactccactcatgatttgagcattgcaattgtaaaaggccgctatcgaagtaatcatattttgaaatggtatgatatcaagtggatactagatactccctccatcccaaaataagacaacctcgtactaggatagggagttgttgacgaaaaatccacacttggctgatggtgctagaactgtgttggcccaaactaagtcgacgaacacaacggcctgggagatctgcttagcttcagtgcaggttcaaatgttgatgagatgcgggcgtgccagtcagtttgatcctacaactaacaagatatacaaaaaaacagatcaatgagccgatcggctgacaagtcgatggagtaattccagctgatgctgataccagccgatagcaataggattttgagctatcgtctatatggttgatgtacaatctaacacttgatataaataaagacaacaggcttatgataatataacaaaacaacaatataatctgtaaaatcaaaatgtttttgattcttattccgtgatgaacaattggcatctaatattattagttttgatatttggagattattggtgaagtggttttgaagatgattgacttgcaggtgatgaacagggtccgctgattgaatgggtccagtcaaaccggcgtgtaccatgtggtcagaccggccagcccgcagtcaatctagctgactctgtgtctatttctgttttgggttgatttgttgggtatctatggataattcgtgtttatgacttctagatagatactatgcgtatgtaatacttttgtttgctaacaatgattcaagttggtgagaacttgtgttcggatatggttttttggttgatgcatgtgtaggtggtcttgatgcctcgagagagtgtcgccggtgatggatcgggagtcaacttgggagaagataacgcccgaacgatcaggatatcatgcgggatgcttaggctaaagatcaatgcatgtggttggtgaagattccatatggtatacgatggatatattgtgtgcgtatgggatatggagtcgaatttggaaggagtccaaatttagtacaattggagtttattaagtttgtttcttgtacagaaatgtttcttaggggattagtacttcttgtatgagttgaattcatggctttaggctacctacttcgagtacaaatagagagggagggtgtggcctcccagtattgcttcagagagtagagttgagagataagttagggtttcgagtttagtcaagattttcgtgagtagtgctgttgttgcagtttataaacacagagagaagtaatatagttgcaatctactttgagagat

SEQ ID NO: 47787 - DNA, 1168 bp, Oryza sativa
gtagtattatgaaccatcacaaaagagaccactcatctctgacgggtctttaactaacacacgtcacagataacgttatctctgacgggtggtagttatgacccgtcagtgatgagtgaaaattcaaatttttaaattttgcaaaaaacctcggattgaaacatgtactatataaaagttgtagctctcaatgatatccacaactttataactaacaacatttctattagagatcgtttacatccctgaagatgcattacaagtgatcagatctacttttaaaaacaaaattttgagttttttttcaaatgacatggatggatacatgccccgtatcaaagtcatagaactcaatcagatctacaacattataattgaaaatattttcatttcacaaaatttacatgttataaagtgagatatattttgaaaaataaaattttgaattcttcaaacaacatcggatgaagatattttctatgtaaaagttataaaacacgatgagatctataactatttagttgataatattttcatttgaagtcatttagggtgttaaatatatgttaaatgattcagacaagcatagacaaaataataacattgggttagtagtcaatatgtgttgagtaggtgagttggtaagggagctctatatggaggttgaggtcttgggttcgaatctcacttgtagcattcaagttatattacgtgaaaaattgtgaatttgtaggtagtgatgtgtaaccatgtataggatggctagtaaaattcaaaatatttttttgaggttttttgttgcatttaaaattcaaaaattgtatttctttttgtcatcagagacgggtcgtaagttacaacccgtcagagacgagtccgcagtgaggctcaggcagtgacgacacgtcactgatgactcatctgtgacgggtgacaagttttaacccgtcagagatgacttatataccggtcagagatgggttatctgtgacgggtgtttcatccgtcacaggtgattttgtcatcagtgaccactaatcactgaccaagaccaaacccgtcaaaggtgagggtttgggcccgtcagagatgacctggtccggcgtagtgatcgttctaagcacgactagggctgatgtagcaaaaagtatgaaaagggctgcaggaa

SEQ ID NO: 47788 - DNA, 9350 bp, Oryza sativa
  unsure (1)..(9350): unsure at all n locations
tcctgcaccccccacccaattaatcctcgaataaaccatgataatatatatgcaataaaaaaagaaaaatacctcagttttactttacacttacttttcgttgacatgtattctaaagaaaataagtctacctttttcaagtgatgaagaagattataaataattgcttatagatattactttaatatgatataatataaaactaatatgttagaaaattataaaagaaattaatgtagacgaaaacaatttatggagaaatcgtggtagatattcacggttaatattttgctcttataaatgtctcaaacttagcgtatgacgtatgcccgcgcattcgcgcgggctaccttcctagttttataaatagcctaaaaatatcctaagtttggaccccttgacacggagttatgggtgattaggttccacactttctacattttttgatgcaccgatacaatagttttcagctgttctggtatcggatatatgtatccgatacagtgataagccactactgtataaaagctcataggtaccggttccaaaggggtagccggtgctggcaccaattattcaataccaatgactttgggtctatgtgacactataggtgtcggttctaaattagaaccggcacctttaggggtgcacttattttttaaaatttgcaggtgctaaaaaaattgaaaaaaatatttggtatttccattaggcacctatacgatcactcttcttccaaccagtcacatggatgtttcaacaaatctatactttctgtatagttgttacccactaaagttaaagctcaacatgtaagcatgccacatcatcacccactagcaattactattctagcccatttaaaatcccatgcaagcatgccacatcttcactcactagcaattattattctagtctattttaaatcccaagcaagcatgacatatcatctacaatattctattatagagttcaacaagtatgtgtcaaatcatcttcctcacattattttcttaacatttcaactttcatcatttcgacaatatttaatatatactcatccgtgaatcccgcaacagagcgcggggtatcacctagtattcatatatatgtgtgtcatgtaagattcaaactcaaaatctctctcttcaaccaaagcttcctcaccatcttacacacacgcacttgtcttgaaaacaaatgttattcttttgagactattgtcatccaaacttataattcataattaacaccttagatgagctcaaataaaaagtttgtcaactacataaatgtagatatcatctatctctacaacttttatatagattttgtctcctttagatattgtttagaaaatttaaatatccacttgagcaaatagatccaagaccttgtaacacatttttgatatccaaacaaccttaaatcgaaaagtcatcaactagaaaattataaatctcgtcgagttctacaaatttgatacaaagtttatctttgtccgacttcaaatgaaaaagttagataaaaaacacacgtatattgtatcatcataggcaccggttttaatggtaaaccgctacctatgggctcataagtgccggtttttattgaaaactgacacatgaacgatgcccgtatgagctggttcataataaaaaggtacctatgataccgcacttattggtgtcggtttattataagaactagcacctataccatgtccatgtatatcagtttgttataagaaccggcacctataactttagaggactattggtgccggtttttgaaataaaccggtaccgatgagtggttataggtaccggttctcaattttacattgaaaaaaatgtagaaaaagcttcatagccggttttaaataagccagcacctataagactaatctctatgtgatgttttatagtagtgagcgggatatgccagcgatacggtatttggtaagtattgttaattcgttagaaaaataaattaagaaaaaatagagatatgtcctcgatacataccggaggagagtatagatgaagctagataagagagtttgggcagtccaatgtgtaacacagataatcttaccttattccaatgtgagaatattagttaagggtagtaagtaaaactttagtaataaaaggtggtccaaactgtcaattcactcaatagtaaaagtatggtcgaatattcatttttcaaagtataccaaccgtttcatattataacacgctttaattttattctagtcaatttttttacgtttgaccaattctatagaaaaaattagtaatatctaccacatcaaatttgtttcactaaatctaacattgaataacattttgatcatatgttttttagtgttgaaaaatgttgttgtgtatttctataaatttgattaaacttaaaaattttgacttagaaaaaaaaaggaggaagtatataacaacatatttttcttcttaaagttctttaggagcatgtcacttgctaagagcctgtcacatggacaatttcgcccttaatttgtaggcacccttgatcacttcaactctaccacctcaatttattgacttttggttcacttagattcttagaaacatgaagacaacagagggacagagtttacacttgcattgcaaacactgaaacatacaccacactgcagggcttctcacttaaactgaagctgcttctactactgacgaacaggtgctctgttctctccattcaccttaaactctgaaggagaaagagcccaaacaatgccgacttgaccacggatatcaccagacgagctcaactacgcgttgctccggaaggagccgtagccccttgcactggcacggaggatgacctggtggtacagcgccgcgatcgccgcgccgatgaacggcccaacccagaagatccactgcgtcacacagatgaacaccaatgcaatgtcagttcatggccaattaaccagccaggaatgagaaacaaacaaagcaattcttgcacaatttggcagtaaggtagtatgtacctgatcactccaggccttgttgttgttgtagaccacggcgacgccgaggctcctggccgggttgatgccggtgccggtgatcgggatcgtcgccaggtgcaccatgaacaccgcgaacccgattggcagcggagccaacacctttgatttatcgaaattaaatagaagcaatgagctcgagttcttgcaatgtgcaaattgctgcagggtgcaaacacaaatcgatggaaagtttatgcacttacgggaacatgtgagtcgcgggcgttgcgcttgggatcggtggcggagaagacggtgtacacgagcacgaaggtgccgatgatctcggcggcgaggccggtgccggtggagtagccggcggcgagctcgttggcgccgccgccgtacctgtcgtagagcgagctctggaaccccttgacgagcgcgacgccgcagatggcgccgaggcactgcgccgccatgtacaggagggcgcgcaccagggacaccttccgcgccaggaagaggccgagtgtcaccgccgggttgatgtgcccgccggagacgccggcggtgcagtagacgagnnnnnnnnnnnnnnnnnnnnacgcccacgcgatgccgaggacgcccacaccgccgcacgccgcgtcggcgccgttcacggcggcgtccgtctggtgcttgtacccgatcaccgtggccaccgtgacgtagaggaagagcagcgtggcgacgaactcggcgatcagcgcgcggtacagcgaccacttgcccagctcgtcgacgtcgacgagcggcgccggcggcgggtcgatgtagtcccgggcgccgccggcctcgagagtggacacgtccacctctttgcccattgacctcgttgaggactcgattggtttgcaagaagtgatcacagaaggaggaggcaggagctaagctgcttgagagaggtttgcaagtgttgtggtttgctggttgtgttgggatgtatatttataggggtttcagtggtactgggatttgttctagggtttatgtttcattgattttaatcgaaatttgaattggttatataatatacccaattccctggcattctctggagcttccctggcattaacgcgtgttgtttgaatataacgatatagttgtttcgacgatatttattgaactaattttgaagattaggtcctgatattgatacaatcgcggatatccttgacatcagattataaagaaaactagtaaatcgttgaagattttgacttcctctatggtttgttcttaaacatcaataggaccaccatatctgttgatcattaccatgttttatgacctgcatatgttattatccaacatttcgtaggaatatcactgattgaataaactatatttcttaaataaataatatagtcaagagtataactaaaaatcagggctacactaattttttgggagtgttccaattaattattactttatttaagctgctagaaatattgaagatgtatatgtttttttttaaaataaagtgtactgacagaatgatggtcctcaaacttatatagatatgttatctaggttcttcaattctcaaaaatacaattttgggtccctggtcttatttgggtgccatacatatttaaacgggctctaacccactctgtaccacagtgatgcctatgtgttggtggcaccaatatgttagtcacatagaaaaaaaataaaaaaaacatattttctcttttctccaatctcttctttttctctatgattggcatgttgatcctgctgacacctaagcgtcaccataccatgtcatgttagcgcacagagcaagtgaaaacccatttaaatctatatgacactcacaacaagttttggtataaaaatacattttgaaggttaaggcatctagattagggatgaaaacagtacgtaatttttccggattccgggccagttttcgaaaacggaatcagtcggtcggaattttttcggaatttttcgaaaacggaaacgaattcggaaatattttgccggaaacggaatcgaatatgataatagcagtttccgtcggaactcggaatcggttggaaattttccgaaaactttctcggaatttccgaagttacagaaggcccatacaagtacaactacaagtccataatacctccccagcccaacccaactcagcatctaccctaagtcctaacctaattcagaatagagattagagaatagagaagagtgagagacagagagtcagagcgagccgggcggaggagcggcatacagatctcgcggccgtcctcgccccctcgcccctcgcggccctgcgcggccgcgcccctgcggtctcgcgccgccgcgccccggccgtcctcgccccccgcggccctgcgcggccgcgcccccaccgtccacgccccccatggccccgcgccccagccgcctctcgtagccgctgaagcctcatgctccactagtccactgggcaagtgggcagtgggcactggcagtggcaagtggcaactcttcctcaccgccatcgacgccgacgacacctcgcatcgcaacagccagcagtgagtgaatgttgaatgattgatttatgaatgattgatttatgtgtagtctctgtatatattgttgagcaatgagcatgactgcatgagtctatatatatatatgtgtgttttttgtgatatattgttgattgttgagacttgagaattagacttgacaaagtttgaagctcagtttgagggtttttttttattccgataaattttcgttaccgtatccgcgccgattcattttcgtttcgttttcggtttcgattatattcgattccgttttcgtatccggggtttccgattccgtttccgattccgaaaaaaaaatatgaaaacgaaaacgataaagatggtttccgtccgtttccgtaccgttttcatccctaatctagatggcatacttgtttagagatcgctcgcacacttcactaaatactcccacatgtatagtaattatttctttagactcctatcggtttgccatttactagttgtaagccatatggtttatgagcaacaaaaaatattttgtgggttaaatttttcaaaaaagtctgaattacacccctaacctgtagcgattgtacgaattactcctctaaaccacaaaagaaggcacccttcacccttgactattcatactagacgaattactcctctgcctcactctggatggttttggtcctacgtgatgcactcgtggcagtccagtcagcataaaaaaacgaagggacccacatatcagttctgctttttgggcccaccgctctttaaatttttttatactgattggattgctacgtgtaaattacgtaggaccaaaaccgctcaagagcgagataaggggtaatttgtccggtataaaaagttacaggtgaaggatgtctgttttttaggggtaattcgtaccgtccttatagtttaggggataattcggattttttttcctaaatctttatacacgttaataatttaaaatccaatactaaaagataaaaaaacttaaaataagatttaaaatttaacagtggcttataagctaatacttttctatggcagcttaagacggtgatatgatgattttggaactacggatgatagagcatctcaatgattacctgtaggccgggttggatcattggatggccgtccaacaccggcttgatcctcatgctgacgtcatctcccctatcctgctcacgggacccaccaccagaggtccagcgtatatatatcacttcggatcatcttgtggccaagatgcactagcagactagcttagcattccacaaattaattgttggcctaatttttttatcatttttttcttgagatggcataattaagttagttcactctcaataattaactaggagcccaagcttagccacaattaatcagtgtggcaactagttagtgttgtgctagtgttgtcatgcctagccggtggttgaacgccatccacaaaggaaaagaaagttgggcgccgaaatcaatctcttgtcaccgttttctgtcattgctgatattatatgtgcatggctaccaatttcttggcttgattgggtcattatttttttctggtctatctgaatgggtttttgtttgtggctatgtacatataagaggagaaaggcaagcatgcatgcgccgaccaaagaatgagagaatcttagggaaatttcacatgctagctagaagctataggttgacaaaaagttgttgtgatggggagttggttggatcaggggcggatccaggaacaaaaaattagaggggctcaattacacaatttcttcaacctccagccatttagggacttttagtttatcattcatggtgaaaaaattaaagggggtgctccgagggtattcatgggtcttgtgggtgtaggngnantnnagtccccctgcaccacgttggatccgcccctggttggatccaagtagtgattagatttatcagctagttcatggtctcttttcatccaaggtttttcttatggatcaggcatttataattccctttaaaaatgtccttttttacatgtctggaaaatgagagggaaattgtagtaaagtctgagaacaaatgggtctaattcaccctttttttttttcaaacaagtcctaagtgattgtttacattcatttcacattacgcctaatctgttcgggttggcagtgcatgtgaactacggccttttttttaatcgaaaacactttcccgttgctatatgaattcgttatcagaaaaagaaaattcatagaggaattgaactaattactataaaaagatgctataatatttgcattctaattaattaaaggaggcataaaatttctgtaaaaccaaagggatccaggtaatccactttctatgggcctgtttggtatagctccaactcctaaatttagctccaggagttgagtctagagtggagttgtggagctgtctaaacccagctccataactctagtatattttgtgagagagctccaccctactccactcccagttttgatggagctgaaactgtttggctgaactctagctccaggagaggtggagctgaagctgcagctgtgccaagcaggctctatatatcaaacatgtccaggcttgattacatgataattaatctgcttaattatctgcacttgttcttctgcaatgcagctatcagcaactaaatgtatgatcaggagcacgtacggccgcgacgcctagtcataggctttccaaaaggaacaagaaagcgaagtgagcatagctcaactggctaggtttcttgtggtggaaccagcccacctagatttaaattatagatttgacgcgggtgctcgtatttatggctaattatgctttcagtggtaggcgacgtacccgtcgacagcgaggcgcctgtggtgacttcgtaaatcttaagatttgccggcccagtcttccggaggtgcttacaggggtagggtgtgcgtgtgtgtgtttatagggggtgagtgtgcgcacgttgtgagcgcctgcgtttgtactgtgtttctaaaaaaaaaaaagaagaacaagaaaaaaaaactgtagctacgttttgagaggagcagttgcaaaacatggtgaggtgtgacgaacgtgatgaatgactcggattcttgtctgtttccccggtggtttctattgcttgtcccttcttctggattcagtcattactagggcaacgatctcaggtttcatatttgattttactttttttttcctttttaatatttgtatggtaactaaatcgtttgattttcatggtgttgatttactgtttttcttagggggcaattactagaatatcctatctatgcaagtcacgtaaaaataaggaataaattcatctgagatcccttaacttgtcaacgagtccgattttcgtccttcaaccagaaaaccagatacaacgggtccctcaattatcaaaactagtgcagatgaggtccctcgacggttttgagagtggttttggttgacgtggcgcctacgtggcaaatttgacttgtcttcatctgatgtggcattaacgtggcgcatatgtggcaatttgatccgaaaaaataataaacttcgtgggacccacatgttagtctcacacataaattaataaaaaatggtgggggcccacgtgggccccacatgtcattctcagcatctacctctcttcaactacagcccctcttcttcttcctctctctcacttctcccatccc

SEQ ID NO: 47789 - DNA, 2611 bp, Oryza sativa
accgccgcgagcctagaactgggtgatacaggatggtgtatcatgggccccgccgccgctccgtccgccggcatgctcctgccgccgctcccgcgaggacgaggaagagcttagaggaagagaaacgagagccgagaaggacttgtggggcccacgtgggccccaccattcttttattgatttatgtgtgagactgacatgtgggtcccacgaagtttactatttttccggatcaaattggcacgtatggcgccacgtcaatgccacatcaaaagaagaccaagtcaaatttgctacgtagacgccacgtcagccaaaaccaccctcaaaaccgccgagggatctcatctgcactggttttgatagttgagggacccgttgtatctggtgttccggttgaaggacgaaaatcggattcgttgacaagttaagggacgtcatatgtacttattcctaaaaataacggttacactaccaattcaagatttcagtgttcgcttaaatggtcaattagttgctaaaataagtgtaaaagcttttacctatccatcgaccgttgtcttcctatagctgccatcctccacctcacacgtgaggctgtaaggcaaggactataatctcctgacccggtttactgccttcatgacaatccactatattttttttatcattgcattataaggtgtacgtacgcatcactatacacgcaacatcacatgcacacatccagtcaaaagagatgaaaatcaattataatcttactaaattcctatagtaagtttatttgaatacgcataatacttatgtccacccatgacaccatgtcaacaataatttccttcgtaaccatctgctatattagtaggtccttccatgttaatgtatttcgttcgagacatgtattgagagatggagcaatgtggaccgtttgatcgagagagaggggcaagatacaaaataattggtagtggagtaattaactagtaaaatatatgcgttttatttttattgaatacctttactacaaagtattgtttggtattgttaggtagaaatcaaagtaaatattctaataaacaatttaatgaatcgaatcgtacataaaaaaagattgatgcctcttttttttttttttgagaacctttcactttgttcttgtacttggatttatacatgttcaccgaaagaagacagagaaagaagcaatccccgtatggttaagggttgaagaggagatgagatggaccgatcaaaggttaggcgcaaccgcacaagcgcatcagagaacggagaacccagttttagatgtacatagcgctactatggagctccagatctttctggaagcagcatctgagaatcgatcgagtgcttgattacaccagcaacggggcggttgctcatggcccacatccagtacacccgagtggcgtccacatcagaggtcaccgtccacggtcaggtcggcgcacgcgcggtaaaatatcatcagttcatcttgcctgtcacatcgccacctttttacgacacaccctctcaccctcaattccgttcaaaaaggtggcagtagtactactatattataatggacgatttaaccagggaagattatgtacgataccattggaagagctaccgttttgtgaaaagtttttctttttttatttgaattaaaatgtttcttttactttgggtatgaatttgatgaaaagttatcatgtttatacaccataacactagcagattcgtgctcacaaaatgataaatacatggcagatatacaaaatatagtaaactaataatttgaggtcatgaatggaacttataccaataaccatgaaaatttatacgagcaagacaacagaaacatgaaatattttcatttgatgataacatcgttccgaaaaccgactgccttcacagcactctgatgacgatataagcaatccgaaaacacattgacgatggtatataagattcctgacaactactttgtatattttctttaaaacacgaaaattagtcttccttgtttgacatttccataccaaacaaagaccaagtaaagccgaaaagtcaaaaccatgtaatattatgtgtaagcctgaatgcaagtacgtctatgtatagtactgtggtgcgtttctctcatcccagctcaacaaaggcatgtgatggctgcagattatcgtcgccgccgcaatacttccatcactgctgcaaaaacttgttcaatgccgttatgtccaatgctggaaattcacttacggcagtaagcactgcaagcccaagcttaatggcatcatccttgctcggcgcctgtgcatgcacatgttcacatgtcagttaaatggatgattggaaggcttgggatttcagatagggcaaagggaggctgacctcgatgttaaggggaagaactgggtcatggagggataaccgcaataagaaccagccaccatatcctgaaactcttacctgcgtagtaaaaatatagcatgatacagcaataagaaagcccagctactttacccaagaaaaggtagatatatcaagatatatactcaaacttgtgaaaacaagcaaagaataatgacatacgggggcgcag

SEQ ID NO: 47790 - DNA, 1147 bp, Oryza sativa
gctgtgatggctagctaaatcaatccgtcaaaggtgagtcacttgtgatgggcttcaatgcagatacatacatgtgatcatctgtgacgggccatcaacttcggacccgtcaaagatgtgtcacctgtgacgggttgcaaccatgagtgacttgaggggggccctcgcctgtgacggcccagaaagtgcaggaccatcagaggtgatgctcatttctgacggtctgccacccgtcaaaggtgattggagtcaccagcgatctttattcagtgaccaaggccataaccgtcaaatgtcaccgtcacatgtagggtgatctggtgtagtgagaatcatctctattttttataataggtaaagatttcacgaggatttcatgtatatgaaataacttttaggctgactgtatcttacttaccaggcctgtcataagaaaaaaaaaatctttacaacggggacaattacaatggtgatactggaagttgtaatatgaaactcttccgagaaagaattcggttcaaaagtactctttggagaaagaagagtaaaaaatctaattaaaggcacaataaataagcccaggaattgaaatcttgagccacatacctaattttctactcatcatatatgatactcgtaaccctgctgtactcatcgtcagatttcatctgtcgtcgtggtagtagtagtcatcgtattccatattttttttggcgtaatagtcgtcgtattcgtcattgtcggaatagcccggcttgttgtccattgggctccggtggcagctcatgcagcggaaagatttggagattgccgcgccgcaatactggcattttcccctggtcggtgatggtcgcttcactaccggtggcggcggcagaatcgtcggccgctgttgttttgccggagcaagccgacgcatctgcacgacctgaggtcgcttcggtgcgctcggttgcggctttggcggaggacctggtggttgttgcctctgcgtcgtcttcggtggcggttcaggaggcctcttggccgccggtggcgtcgccggcgcggcggctgtaggcttggtacgaaacaggtcttctgcccgcatcggaagcgtacacaccgaagcggcggcggcggtggcccccggcgggggatgcctggt

SEQ ID NO: 47791 - DNA, 769 bp, Oryza sativa
agaagagaaggggtggacggccttcccaaggtccttgcgaaaccaacggaggagacagcaaggtccggcgatgacgggtggtgaagcggcaaggcttcgccggagatcaaaacaaggcggcgagctcggccttcatggtgagggtggcttgcggggttcggcgcaggggagcgaatgtcaggggtggagcttggccttgcggagccgagggaggtggcggcgcaggttggtgacggccgaggcgacggcgaacgacggctggagttggtggcggcgacggagagagacggagctcgcttggagaggtggctaaggcatgggaggctcgggtaaaagagggaaaagggagaggaggtccggggctagcaatttatagcctcaggaagaaaagatcggatcgggtttgagaggaatcaatgatggaaaagctatggttcaccggataaacgatgctcgaaatcgtgtagaatccacgcaattttattcgggaatcaaggtggtttcttggggataaggtacagcagatcaagacgattccattctcgcaaccaacttgtgaaaaagagtaatggggaggctggatttgacggaggacgcggcgtcggctagagtacacgggcactgcacgggctctgtccaagctggaaaacgacactgtagcaggagggaatgagtttaaacttttctttctttcttggaccggatgaaagagggaggccaattggactttggccgagagatggagagggctgcaggctcggattgggcc

SEQ ID NO: 47792 - DNA, 1330 bp, Oryza sativa
tagagctcgccgccgcccaccattcgtcgtcgtccatcgcgtttgctagtaccggtgagttcgcgtcatcgtcctctacgtgtagatgactttagatagccctgccgacctctctatcgccggcaaggtcgttgcccgtgaaattgcgcgatgatgacgtcagcatgacgtcatattttctttttccagttttttttctagatgcaaatagattaaaacttcagaaattcataactaattcatcgtaactccgatttgagtggttcaagttgctaaatttttctaaaatcgagatctacatgttaaaaatatccacatgtattgtttatgcttgtttttgtactgttttgttgattttgttctttcgctttagtttccgacgttctgaaggagagcgttttcgttgaggaaggttcagaagcgcttgatgaagctcaaggcaagtcacacagatcccaaacgaccctttgagcatgttgaacccatttaaagctaatgttttatttcaacttatgcattattttcgaatgtcatcgggtggtgagcctttcccaattaattattggccgaagatgactttattttcctatgggttagaattcgattagctagaaccttatatattggtttggttcagctaaatgctatatagatataattgcttagccatgcttagaaacattagctcattaatggggtgaatcatattacattattacttatggttagatttaaatgtagcttacgatggttaatcgtgttatgataattaattgataattaaaacttgtcaatggtgggttgtgagcacatggttttgaagttcgtgctcatgacaattaaggatcggttcgcgagctactgttgtgagacattaaccgtgccaaccacaagccagcgtgggcaacggctttaccttttgtatagcatggttcattgcggggcaccagactgtgaagcggcgagaagtccgtgggggtcgctggggagtccatgcctctggttattgaggggatgattatgatccagggacggtgcgctgtggtggattgtgttgtgcaaggggtactgtcacagttcctatccgagatatcgtggtggtattgaggcgcatggtaacatgtcgtggagctgtgtcttgtgagtacagtggtacatctctagctagagtaaaactattcgaatagccgtgcccgcggttatgggcaagttgagcaatgtttttcgtgattatctcataataattatggatgctataactagtaataatttatttagctcctggtttggagtttgatctgtatagccgggtatggttgttcagaatggt

SEQ ID NO: 47793 - DNA, 2115 bp, Oryza sativa
attattcataatcacatgagacacctttactaattaatttagagaataaatctattttcccaaacttatttacaataactaatttattgaagtatactttatagttacgtcaatagtgtgtataatatacatccatcaaattgatacttgatgtgttggaattcctcaactataaaaaaattatatcatgagtagtttattgtgcatgttacttgattgttcatttgttgccaaaactatttagaaaagagaaaaacatagatatatgaccataaatctcatggtggattaaatggttgtattatagcaagatcattggtatgaaatatttttttcataatttctttacatctatgcaacatttatgttgcccacttattagatactaatgaaatagttctaaagattccaaaaaaaaattgagaatcttagtctcaaacaaattaaaattaaatgaaatatacttaaaaatacacaactaaattgtgttgttttcatttattttacatatatggatttaaattaccattgtatagtcgtcaagtgatatttgacacatgaaatatgatgtgaaattatttaaaataggaaaaagcaataattaccccctaaacctgaaaaccagacatctttcaccctcaactattaatatcggatgaattaccctaaccaacccggagtgggtttgttcctacgtgacagtccagttagcacttttttttaaaaaaaaaaataggtggggcttacctgtcacactctctaccctctatatatctctctctcctctctctctcttccacaatcccattacctagcctctctctcttctccttctccttgctacaggggccaaccgggtaggcgagccgccgccccgccacacttttccttcctccttcatctattcccctgcacttgctctcttaattgatccaccttgttgttcttttattgattggtgctttctgtctcgtcaggagaaaggcattggtggtggggatcgattaagaaccatggtgggatggcatgctgtggtagacagagctacgggggcgtagccgaacttggccatggaggaccagcgcaggtgctcgcctccggcggccatcacgtgatgatgagatgtgacagaaatgatggtgaagacagcctccatcagagtgcgcatgtggtggccgagatagccgaggaggagccgcctctgctactcactgccctcgttcgcctccaccgcggttgtcctcttcacgcgccagtggatgttgaggagaagccacacggccatcaaggaggcgcgcgccagcagagaccgagaggacccgctcactgcccttagccttgcctattgatagacatggagggagaagaaagagaaagggggaggggtgaggcagagatatgataggtgggtcccatcaatttatttttaagaaaatgctgacgggactgccacgtaggatcaaaaccacttcaggctgtgtcagcggggtaattcgttcggtattaatagttgagggtgaaagatgtctagctttcagatttatgggggtaattcggtctaccataatagtttaggagggtaattcgtcatttttccttgaaaatattatcataacattatttattatatgtcagcctcatgtgttatgatgtatttaggaacatagacatcaatagtttatttaattaaaggaatctgactggatcacaaattagatatataattttaaaataatttaaagataggatatttttttatattgtagaagatctagtttaacttaattttatagagtattatacttttgtttttaaatagtagaaaatcatatattatggaccatcgatttttttatggcactacatactacctatgttacgtaagtttttttactttattgattttatcgtcagttcgtacataggttttctttaagattcattgattcttttccagcacgtaagtacgtacaccaagtatacttatgtttggtttcttttttgggcccacattatgagaggaaattattaccttcttaaaataatacatctaatctaacgatctaaaatatcgggtccaccaacttaagtgaaaattaacggtgagattatata

SEQ ID NO: 47794 - DNA, 6773 bp, Oryza sativa
gactagggctgatgtagcaaaaagtatgaaaataaacataatatctagacaatcaagctcttgactgatttttagggtggtagatagcttacctagtctaatatggtaaagcaatttagccgatgccagcataaacgttaaaacgaatcttagctgatataagtaaattgattcttatatgcattctagacgcttctcgcaatcttccttgttttttaattttaatttttaattatttctaaattgaatttctatatgaaatgtaaacttaactttatttttttaatattttgactttcacttctaaattcctacatggactctagactattattttaatattccttattttttattttggattttcattatttctaattgtatttttatatgaattctaaactcatctttcaatattccttatttttaaatttggaattttagttatttataaattatatttctatatgaactctacacactttttctaatatttcatttaaaaaaaatcgaattttatttatttaaaactatatttctatatggattctaacctctatttttaattttcttatttttaattctgaatttcaattagctctaaatttattcatgtatagactctagtttccttttctaatattttttactttttaattttgaattttagctgtttttaaattctatcatatatgggctctatcttttccttttctccgattaaaatgagaatttctaagcagtgagagcgaaggtgatggctcctttttctattacatttataagttaacagatagatttggaaaagatataaatgtctggatgcaccaatatttcaggcaaatataaaattaatgcatcccaaatgaagcctcgtgccaacatttgatcatcagcacttagtgattggtttctgttcgcctgtactacgaggtaatacaatctgatcaccactccaatgcctacacgttcgcacgcccatcgaccggggattaaccgatgattaatcactgatcagcacgcagtcaggatgtcctaatcactcactgtcaccgatccagcacagtcatcagcatctaacaaaccgtgctgttaaggtaagaaattgacgtgcctttactttagctactcatcttgccccctcccgccgaatttcacggccacggcacgagcaaaatggagcacccacctgcctgcctaggacgagaaaaggtgtagctacagatgtgggcgatgtgggcagctaggttggcttgcttgcaaggcagccaaggtaagggggaagagcactactcgctcgccgaaagcaggctgatcatagtacaagccagtgaggtcatgtacatgtgcgcagcgtggtttgatttgctcgctttgccggtctgtcgagcggagtgtcgacctttgaatggagcacttgtcccttgctgctattccacaatcagctggacaagtgggactctccgagttgatacatataataaggtgctatttgatactactcatgaagatgaagattaagttgacgtgtgtaaaacgagaaaactattagcatataattatttaagttttaattattacaaacttgatacaaagtagtttgaaaaacgtgctaaccgaaaccgaggtaaaatctgtatagtaagtgatcaaataattttccttgggtcagctcgggctcgttagcgggttgcaacgtatcagtggtggagccagaaaattttcggagctcgaacaaatataaatatattataccttaagtatctgttactgtcgatgggagatacccgcaactatattttagggtatttggctacattggtacgaggatctacacgatatggcatcaagcataaaaaagataaggattatactggttcaggcctctcataaggtaatagccctaatccagtttatatgggattatagaataaaccacagagtacaagagagaacaacaaaactccaagattaccaacgagattcctttcgagagagaggctcgacgagatctatcagcgaattggcttcaagtcctccggattgtaatagccctaattcagtttatatgggattatagaataaaccacagagtataagagagaacaacaaaactctaagattactgacgagattccttccgagagaggctcgacgagatctgtcagcgaattggctttaagtcttccggattgcttctgtggtgttgagtgtcttgcaggccaccttggtctccaagtacaattcggaaacaacggaccccgtacgatatgacaacctcattttcccctccgagtagtactctgatatttcctattcctataaattatttccgtaagagcatcaatcattactgtatactttataatataccgtatccgtatacctcacgactcctaggataataggtatgccttatctgtaaccctgataattgaaatatcactttaatcataaagtagtgtccaaactataaggcacattcgagcctaggctgtcactcggggtcagacactgcaactctctactccatccgttctaaaatatagtaattttttggtggatgaaatatattctaatactataaatctagatatactctctatccagattcatagtacttgcatatatgtcttgttaacggctgacaatatttctaaccatttacacatgctatacgttggctaggcttattttttttattataaatatgtaacataagtacttaaacatgagagaaataatttatcaacaacctgagatttgaaatggaagttatctctggcaatgtttgaattgggagatatcttttctcgtactttgcagtagtacttggaattgagctcttccatttccaaaattccaagcggaagtcctcagtctttgctgtccatatcacacttctccttggaacccagtgggtggatatatatagttctagaccctgctagaagggaagaggaattattagagacatcgggaccgggattaattaacaagtaatgccacttagggtccttatcgatggagacagtgtgtggtagtagcgtagtagcttttgtggtcaggagaggcacggcggccggtgtactgctaccgccagccagccattctacccgtcacccacgacgcgtccacgttggctgtcgctctcaaggccggctgcccgggagacgtttttttatggctctaatcgatcttgtgtcctcgctacctttccctcctcccggatcctctacggagctgtttggatcagggcacgtcggatgtttagatattaatttagagtattaaacatagattatttaaaataattaattatgtgaatgagagttaattcgcgtgacaatttttcaggggcaattgcttatttgaccccgttttaaaccgtaactaccaatttgaccatactttttaaaatttgcttatttaaccctcattttcaaaaacgaagctccggtctgaccctattctgtttgggtgagttaacggtgttaattttagggtaaatagtctattttgcccttacttatttgaccatattatatcttgcttgtttgcttgtttgaccctataatgttgaaatatttgtaataatttttgctcaagtttgacagatttgccattaatttaataaattttaatcattttgtcaaataaattaaataaaatgtgacgacagatttgccataaattttgacaaatttgattcattttgacagattttgacatcacggcatgagtggtatatacgaccagaaactaacaaagcagatgagctcttgagtgaaatattcaaaacattcacatccaaatgaaatcttgatgccgccactggaaactaacagcatcactccgccgccgcccccacagacctctcccgcgcctcctcagagcgccgccgctgccgccctatacctccacgagccggaggcccgctggcacccgcttcacgacgccgccgtccccttagagcgctgccgccgccctctcgctgccgctgccccctctccaccaccgtccccatgccgccgccgcccccacagacctccgcgcctcctcagagcgccgccgccgccgccctatacctccacaagcggaaggcccgccggtgcccgcttcatgacgccaacgtcccctccgagcgccgccgttgccccctcttcgccgtcgtacccacgctgccgccgcccccacaaacctcctccgtgcctcctcagagcgctgccgccgccctatacctccacaagcggaaggcccgccggcgcccgcttcatgacgctggccgtcaccttagagcgccgccgccgccccctcgccgccgctgtccccttgccgccgccgtccccacgccgcgctgaccccacagaactccttcgtgccccctcatagcaccgctgccgccgccgccctccacctccacgagcgggcgccggcggggctctgcttcacgtcgccgccgccgctcgctgccaccgcatgatttgcatgagagagagagtgttgcacgagacagtagatagggtttgggggtattttgggcattaggaatattagaaacattttctctttttttttttttaaaaaaaaccaatcctatcggagtcatggaatggggtcagacgagagcttcatttttgaaaaggagggtaaataagcaaactttaaaaaagtatggttaaattggtagttagtgctcaaaacagggtcaaataagcaattgtcccaattttaattttttaagcctaactgatccataattaggatatgtttactgtagcatcacatagactaatcatggattaattaggctcaataaattcgtctcgcgaattagtctagagttatagaatgagttttgttaatagtatacgtttaatacttctaatcagtgtccaaacatctgatatgacaggaaccatccaatcagggtctacgtcgcgtccaccattcactgtcactagaagaaccgtactagatggtggttaactggctattaagcagtgagattgcacttgatagtgcagtggtaagaaatgtcgtggtctcaattctaaagtcctgtgttcaattctcaatacgcttaaaatttcttcttaaaaatgtttggagggacgtttttcctttatagacaaggattaaggtcatttcgtcccaaagtttcgtaaagttttgtcgtttagaaactgacccctttttttttgaaaaaaaatgaactgatttcttctatgtagaaatgttgtgaagttcatctatttctcttttttttttccccctaaaagcacgatacaaatgccaaccatgtgaacaccttcggagataggtacgttatctgaagttaaatccgaataagtttcaaaataaactaataacctaacgagttaagttacgtttatttcacagtttctaattagggtttggttgatatttctctagaagtgatgcatatgttgattgggtaattgagggtgaaaacaaggtgtagaaatacccctaaacacccctaaacacactgctgtgtaatttatttgttccgtacattaaacaggtaataaatatgtgaccgtagaggcgcagaggatcgtcgaaactaacataagtaccaccaactaaaggataaagcacacgacgggtgtaattagtgcgcacatgattgttcttagcatgctaagtgacaaacattcttgggtggctaatcctcctctctcccataggctagatcgagctaaagccagatcttgtgtactccaaaagtcagcaagtgctgctactctgtctcttggattgtattgcctcttatctctcggcaagcagcgcctcctctgcctttgcaggccactactgagttcatcgtcagatttgttgggattccgatttccatttcatccatccatccatccatccatccatccatccatccatgtagtcgatccactattgattgatccatgcgtgtgagcgtgctccacgaccgactctggtaaaaaatggagaatatttttcacttcaccgcccgattcgtgccgtcagattctgggtgtctgttcctatctgctggaatgtgcgatcccctgactctgaatccatccatcaggagacgaccggcagaatttcttgtgatagggatgcgcaacttgtagaattttaacttggggatgcaagatgcatatggtttaatttcgttaatttgacatggccgtgacaaggacttattttgagctggtgcaatggcggttaaattatatggttgttttatacggcgattattttgtactgccataatttgttttgactacttaatagatcagaatcagaatgacacatagaagactgatatatacttcagcatgaggtgaatgataattacgccacaacttacagatagaaaaaccagtcaaattgtttctgatagaggcacagaatcaaactaaagtatctaaaagtcattaactactatataatatattctgtaagaccataaagcattacaaaagccatgcattattcacgtatgtggagtggtttttcactcctaatctcctccgaaaaattgtactaataccacttgcttttctttcccatatctttgatttgcttatagcccataatcttgtactcctacatagcaaacgccaaaacacacataattcagcagcagtgctccgtaaatattcaagtcgcaaaccacaactaacctagtcctcttggtcggcagactttgttgctgatatgacgatgatccagacaaaacacaagtaccttgcacccaatga

SEQ ID NO: 47795 - DNA, 6820 bp, Oryza sativa
aagcatggtagaataaacccccgtccgatcattcaccagaatgctctccatgcatctcccttccagataattcaaggcacaatttgcttggttttgtcgctgcattatattattgccatctctggattgagaagtgatgtgttgaagtgcagttgtttgaatttaagtttcagactaagcgcgcaggggtattgatagggatgggtattgcccagccataccgaccagttcaatcaaaaagcttaagctaataagaaaatgtgccgagtagtagtgctattgttttttttctactatttgttagggaattataattttgcaagaatgcttagctgttcatcataacactgccgaattaaggtagatggtcgaatctccacgagtaagaaataaaacctaggcttagaaacagctggagctaaaaggatatcttcttctttcttttttaacttgtggatagtattagcgttgtcgccgtaggagtataattttgagaagacagtgacttgtgagctaactggagccgatggtgagacgcctgaagaaacctgtgtgatgctgggaatagaaaatggtatttggcaggccagcagctagcagaggcattgctggtaatggaatgatgaggcaatgaagttgtttgattaaccaactaataaaggtcaccgtaggattaacaaaatctcatgctagtatcagcccccagccagccacaagatattgtgactgtagtaggttaccttttcctattagcccccagcacagaaacaaactcaactgacaaaaatgaaaatgtgaaattaggagtagcaagaacaaattctccacttctaactgttgtatgcatctgatctgatgatctgaacccaccagagctgttattacaatgacagtatggcacggcccaatccagtttatatgggctactctatacctgtatcatcgacacggccgttcagcccaagcaaccgagagcccgtgagctgaggactagtttgcacctccgaagctttattttacgggactacctatactacatttgttcacaaattttctcctaaaaatttgacaaatgtaattatagtatcattatagtgtaattttactgtaacttatatgtaattacactgtaacttgcatgtaactaaagtgtaacttatatgtaagtttcacataattttgaattgttagatctattacaagatttattttggtgaggaagaaaacaaatcatagcacacacatatgtgaaagagtttgttcccacgacctccattttactgaaataacatgttacggagagatttttgaaagttacatacaagttacactatagttacagtgatattacatgtaagttacagtgtaattacactatgattgtactgtaattacatctgtcaaatttttggaggaaaatttatcgacaaatatatagcaaaatcgttattttacacctgcaatttccctaatcgatcgaggttttgacggaaaggtttattacgaaatcatatatgttattattactattatttaattttactataaaaagttttactaggtcattagaacctcattttaatattttgcacggggacccaatttaaccgggatgcccctgccgacaacgagtgccgtggcggagtcgaaccacagcatgacggcggtgggcgagggaaagtgggaggtgatgagcatcccgatcaaggcggaggatcaggggagcaagacggagctgtctcaaggtgcgcgccaggagtacatcgacgccctcatgagcattgtggattgcatcctcttcccagagctccgtgagcacatccgcgccaccatggccggttttggcgagactgtcaggatggcccaggctgagcaagccaacgctactagaaaaagcattttcacggacgtgaggtttttttttccagacgggtatgacttttgaagttaaatgaccgtctatgaaaatataaaccagggtgaagctcggcgtccgcctatgaaaatcaattttttctagacggaccacttaataggttcacatacgaaaatacctttattttcgtagagtgacctcttaagtggtgcgcttaaaaaagattaattttcgcaggagaaccttatgtggcctgtaatagtaaataataataataataataataataataataataataataataataataataataataataataataataataataataataataataataataataataataataataataataataatagcagcagcagcagcaggagggaatcgctcgatacgtaaacttaaatacattctattgtgacagcagcagcatcagggaatcgctcgatgcgtaaccttaaatacattctattgtgactcatgaattgttttgcgagaggaggacagataaataaatatcactgagtcttgatggataggatcaaacccttccaaggtaaggaagagagagacctcatcatgcctctggacagatgtcctccccagactgaagaaaacaactctatttaagccgtacttgatcctacaccacttgtccatcagtagtacttactacttttttctgctctggctgtggtgaggtccgtgagaaatttgagagcattagagctagtagaagtcttctaggtgggacgcacgggtagaacagcaggagacctggcaagactgcgcccattagctattttacttaatcatctctaactaaatttgtttacctgtattatattaagatggtgatactaacaatctaacagtaaatattattaacatccgaataatagatcgatgattttatcagtgaaaataataatgtgattgtgatactaagcctgagacgaccgatatttgagacaacgatatcgggtcggctgatatcagtgtgagatgaggaatgcctcacacaagtagggaatttggcggcgtgattctcagatgagggtatcactagttggggaggaaaatggattgaaggaacgagattattttaatacctttgtagtgtatatttaactcatttactctgtgtaatgtcttttattatttctcagttgttaatatctacgggcaatattatttttcttttaaaaacatatatatatagctatatgtactaatcttgctgagtatgtacaacatactcatatattattactatttgatgtgcgcagaaactaatcaagatgagatgtctgagggaaatgatgacacgcaaacctagtggggagtgtggtctacttagtatttagagtcatacaagaggacatatacctgcatgctaggtatagggaatcgtcatggtgataataagttggtcagtgaaccaaccgatgtattaagcaatatagctggtgaaaaataaatggaaccattactgcaggtgtccaagctccagttgtcagggtaagacattacatctcgccttgtatccttgtggacatatataagtatttggtatatatgcttataaggatacgacagactgccacaaatttttttttggtagtgacatagtctgcctgcaaaaatcatgcctacagaaaaaaaatctaagttctatccttatcttttcctctagcatcttatcctctccacccctcattttcctcacccccctctctctctcatttccctccagctccctcccctcccctcccatattaggcggaggggaggtgcggctgccctctctctcctctccctcaggtctactctccctccgcggtcggccgcgccgacgccgacgccgactgcgacaacaccaccgcctagatccgggcatgggaggggaggcagtggcatagacggagggcgggggggggggggggaggggcatcggcggtggcgcggctcccctctctttcctctccctccgcggctagccgcaacaacaacgacgctaatgatgacgccgcctggatctagggaggagaggggagacggcggtgacgaggagcttccatggcggcacggcaggaggggaggtgtagctccccttcctctcatctccctccgcggctggccacgacgacgacgacgccgactgtgacgatgacgccgactggatccagggaggggaggggaggggaggcggcggcacggctgaaggggggcgtcggcgtcggtgcggttggagcggcacctcccctccctctcctctcccgtagctctactcctccacgcccggccgtgacgacgatgactaccgcgactgcgacgatgacgacaacgcctggatccggggaggggaggccagtggcaccgccggcggggtggtggcgccagattttttttattcgctaaaaatatttttgcaggcggatggttctaccgcctataaaaatagatgccgcctgcaaaaatgattttcaatggtggacccatctattttcgcaagtctttgcatgcaggcggtcctttcccccgcctgaaaaaccatttttggctgcctcgaaaaactatttttctagtagtgcaacatcatcgagcagtacagcgcaactgcgttgcctacgtcgatcgaggtcttcgtcaatcacgacaacaccgagaggaaggcacaagtaatgtaggatagatcaggtgtcaaaggctaatcggtgttggtttgaaaatctctcgtaagtgccggtttttccaaccgacaaccctcacacggcaccgatgaccctataacaatatataggtactggttgagtggttgtcgacgataaacaacacttgcagctttgaacgagaaaacaaaaaggggaagctgatgaatcagctcattcgagccggttttgttttgcatctaaggtccttcgtccaacgaatttgatgtttctgctaagacttagatttgctggatgtggcactcagcgcttaccagattttggactggcctaattactcagttcaacatcaagagatgctaacgtacaaagcaagcatcagagcgaaggagattctgaaaaaaaaaaaagtttagtcggcaaatttctccgggatgtggcggatgaaaccataaaaaagttaatccaggatctgcaccgtcgcgccgactgccccctaattgaaaacgatatttgaagagaaattcagtgcacatctaataattgagcacaatagagcagcaacaccgaccaccgtcatgaactggtgaaagtccctgctaataaaagatgaaatatttttggggcaattgctgttctctgccggtctatatgatgtgtactctaatttgggcaagacaaggacctaagaacgaacaggaaccatgaaaaagacctcagtgatgtaatgctgttggcccttgaaagggctctttaacttgcagcattgcagtgacgcatgcttttgttgtttagcctcggaagatgtcgctgttaccaagaaagaaaagtgaaggttggatttatttggcatattgatcgacaattttttttggtgaacacacaaaaatattgcacgtcaatggacacggctagatcgcgcgctagcggcatatcgctaaccagcgacgcccttctcttcccaaaacgttactagtacactcaacagtacatgccttttttttttcttccttgagaattttctcctaaattacttatccgatctataatccgattacactgttatgatcattgcaattaaatctttacaacaagatcttaaacgattatattctgataaaaaaatatctatgttgtaaattacttttattatatatgtaagttacttttgtcctatatataaattacttatagattcaagctctttaataacttatatattttaaatcacgtattattttcatgatctatttatttacatcattgtactctacataagatatgagacaaaacaatatccatgttgaatatattcaaacatttcattaatttaaaagtaatttatttaaattgtagtagtaacttagctatgcaatagatgtaacttagctatgcaatagaggtaagttagtacaaaatagaagtaagttgttacaacattagaagtaaattcgagagaaaaatattttgtatctaaaaattaaatttaaagtccataaattatagaattgactaaaaactataataaacataatcgacttaaagcattatgaatatataaaaagtaatttatatatatgataaaagtaacttaagtatatgataaaagtaacttaactatatataataaaagtaatttacaagtataaatattttttcatcgtagtataatcatgtaagatctagttttgaagatttaattgcaacgaacgcaatggtgtaatcggattatagatcggataagtaatttgagagaaaactttgtaagggaaaaaatacatgcatgtgtaatagaaataaaaggcatgcatatgcgctggcttctccacggtttctatggttggcgtcacgtgataagacaatatcgagaggcctcactgattagtttttgtgcacgtcaatgtattagaattctgatcgataaggaaaaaaaacaatgtacgatggatggtcatctaaggggcatctacgacgcggatgttcgtgcaagaaacaagtcaacgaacgccacgttaatgcgctaccggttttccttgatttggtacgttttttcatagggaaatttgtatgatcaacagctaccacgcaggtgaatctcaaacccttttattcatctatcgctatatggcttcaggtgtacgtgggtcatattgctatacacctgaatcgtttgtatagtgagactcttttctcacatttattttctcaggtccgtttttacgcactttgatcaaaaaaatactccggg

SEQ ID NO: 47796 - DNA, 6497 bp, Oryza sativa
aaaatatattaacaaggaaaaaatcactaatttttaaaataactaggaaggtagcccgcgcattgcgcgggtatgtattttagattgtgtttgaaaacttatataggtggaatatcaaccggatgacaccagtttttcaaaagtactactacaaaaaacttatattgccatgtttgaaaaacttatattgtacgggcatgtatttagattgcatttgaaaagcttatataggcgaaatatcaaccggataacacctgctttcaaaagtattatttcttcatcaacattgcttagatatttttccatgctatttgttagcttttaaaatatataatatttaatccatcggtataaacaattatgtatgatccatataaacgcctgccatgtttcaaaaatatctatttttttctttggataaatctaacggtggtaaataacgggtccacctgatttaatgaaaatcgatggctagatgtttagtttttatttcttagaatttttagaaatttctctaatttaagatgccacgttgtggcttaggagcatttgtagtaaaactctcttaggccgtcacgtggtattctacaatcttattgttgatttttatttaaattggtggacctgttattttagattgctagattatatctatttagaaagttctctgtcgattttcatttaaattagtgggtccattattttagaccattagattatatctattttagaaagttatttttaataagataacttatgttatcatcatagattatatattgtgttacaaatattatatataaaattaaaattatgctcatcatagactacattaaaatccataaactttagactgcactgaaattacacatcagattatatgtaatgggtcacaattatgctcgttgcaaagaatcccatataattgacagctcatgccatcctcatatttcaaatatgtattttttttcccgtaaaatatgagacccatgaagacacattttttacttacagtaacatcgagaccactcttttatataacagtgattgtgtgttcgctcccggctaaaactccatggaaaaacagatcttttgattccacggtaacaaattatggtgtgtatttttgactgccttaattaggaaagaaaagaagagattgatgggggaggaatttgtacgtaagtacgtacacatgtggggacggccaaggaaagggtgagggggattaagttttgatctaatggttaatagtatcgggtccaccgttttaaatgaaaattgatggttagatgttttttcttttttcatattttttctctaatttattaaagcgtcacgtggtggcttaggaacgtttgtagggtgccacatggcggtttaggagcgtttgtaggaagtttaatggacttttagtatataataatagatagatagatttcaaaactccatagaaaactttgactagaaactaaaaatctttatatgtaaaaacattatgtacaaaaacttcagtttattataaaatagattcaaagagaaaaaccactcaatctaaaaataatttctataggatattcaaaactttcatgtaaagactaaaaattacatgcccgcatgcaataggcatgtagatgcaggggtgggaagatttgaaattggaattttttttgcaatactaaaataaattcatagacaagcggaacatccgacacacattatgaaccctgcttacagctcagtcataatacttccaccatttgcccaattaattttagtggttcttccttggcttctggttgtaaaagaaaacggggtactttttaagagagattttacagtacaacaggcaatccggtacaaaatctcagtcattggcagggtctgatcggatggttggtgttaatcagtaccttgaggtaccatttactccatcatcaggtggtaactgaccatgttgagcgaggtggatggataaaattaaaaattcgtgttggagattaggatcaatcaatgtgagcgatatgtttcggcgaggcatgtggaaactggaaactgcagtttctaacccaaatccctgagacggcgatgcacaattgtcgtcggcagcgaggtggccggtttgtgtcaccgtgtggagcgaagatgctccaggagtggtggtcaagcaatggatttggcggtgctcgaggactcaattagcagtggtggcagcggtgcttggcaaaagcatccctccatgattctactaccactaagtatggtggtagtagaaatagatatgaactattaaatcaaatgagatcaatcgttcagatttttttctacggtaggtagagagcaccggagtgagacttctcgatttttagataatggaaatggattacatctccggcttctgtcataagacacacagccataagtttaataataataaaaaggtaagataaaaataaatcaagtattttcttctcgattaccctcctagattgaatgtcctgattcttgaaaaacctggtggtattggtaccttgaggtacgttggaccagaacaaaccttttacttttattacaccaaacatggaatttatgcttagttcttcgcaaataagctgtacgaatcccacaatattttgttaagagaatcaatagaagaagcgacacaatttctcctcatatcttgcattcattcatatatatcataatttattcgatcgaacaatgtcacacttgcttttgatagcgcacacacaaaacacttgagggtgcaggcttcactcttcttaattgaagccgcttctactactgatcaccctgtgctctgttcttcccattcaccttaaactctgaaaggagaaagagcacatttgattgcggcttaagcattgctccggaaggagccgtaccccctggcgctggcacgaaggacgatctggtggtacagcgctgcgatcgccgccccgatgaacggcccaacccagaagatccactgcgtcacacagatgaacagcaatgcaattgcaatatcagttcatagcttgataattcagagttcaaccgcatgatgaaaccatgcatatttttctgtttgatagtagtaatcttggaagaacatatgtacctgatcactccatgccttgctgttgttgtagacgacggcggcgccgaggctcctcgccgggttgatgccggtgccggtgacggggatggtcgccaggtgcaccatgaacacggcgaacccgatcggcagcggcgccaacaccttgattgattaattcattgaaaaaagagaggcaatgagatcgagttcttgcaacgtgcaatcacaagtatgaagtgtgtgtctccggtgcttaccgggacatgggagtcgcgggcgttgcgcttggggtcggtggcggagaagacggtgtacacgagcacgaaggtgccgatgatctcggcggcgaggccggtgcccttggagtagccggcggcgagctcgttggcgccgccgccgtacctgtcgtagaacgagctctggaaccccttgacgagcgcgacgccgcagacggcgccgaggcactgcgccacgatgtagaggatggcgcggaccagggacaccttgcgcgccaggaagaggccgaacgtcaccgccgggttgatgtgcccgccggagatgccggcggtgcagtacaccaggatgaagatcatgccgtccaacgcccacgcgatgccgaggacgcccacgccgccgcacgccgcgtcgtcgccggacgccgacgcgtccgtctggtgcttgtacccgatcaccgtggccaccgtgacgtacaggaacagcagcgtggccacgaactcggcgatgacggcgcggtacagcgaccacctcccgagctcgtcgatgtcgacgagaggcgccggcggcgggtcctcgtagtcccggacgccgccggcctcgacgtcggcctctttgcccattgcgtttgctctcgcttgcctgattggctcgacggacggaggagagcaagaaacggaaatgcttgggggttgcaagtgtttgtgttgtggaatcttgggtgccatgggggaggtatttataggggtttaagggttttgtgagaagaacaagaggatggtcttattgtatggtttaatttggttttcttaattttggaaactttgtagtgatcttggctatagctgtcaacattattgtacagcaaatcccatgagctgtgtgtgcctgtgaaccatgtagtatgtacaactcccttaatgctccattaaatgttttgttctggcaccatagctacaacataaatccacggcgacatagctcggttttgtggaagggatgacctgctgatgagctgagttatgaaatatgtgcaaataaatcaggaatgcatcgaaatagtcagtagtttaaactgaacttggtattcaaatataggcaaattttgttacatcacattgtaacatcatgattttagctataccgtaaaattgggagaacgacactttcaaaggttggatatttattgatggacaccataactttaaaatatttatttctaattgaataggagaaataaatcgtttgaaatgtcaggaatactcacgggcccacatttcagctttcccactcctatctttctctcatcccctccgtccacatcaacacaaaagtgtggtgaggcagggactcgtcgtctcctgagacggccgacaactccctcgaggccgagctgccactgctattgttgtgtcaccgcctctccttcttcctctacctggaccacaatggcgttaatctggacggggaggaggtccacatgggcgggagggaggcgaggagttggcaagggatggacaagaagatgtggtggtagtcgtcggacagcggtgatctacacaagaaggggatttgcgcgggccgacagggggagggaggtggccttggcagccaaggatggcgacgatagggttgtggcggcggtcattggacagctggtggatgagaatggactcacatgggctgattgctagagggaggtagtgaaggcgattgagattggggacgagagggcagtggcggcggtcctccggcattgctgatgtggatggaggggatagagagaagagaagatggatgggagatatgacatgtgggctcaaaggtattttcgacatttcacacgatttctctctccaattcaactaaaagtaaatattttaattggtgtagtgtacactagcaaatatccaactttgagtatgtgatcttctaaaggttcacttttgtggcttcctatgttaaaacgtgaagttaacgatgttatgtagcaaaatttatctcaaatatatacatgtatatataaatgggataggcagcacaaacttttcaactagaaaagatgtccgtgcgttgcaatgggtagagccaatttaatttgcacatatgtgtcagatagaaaggggatgacatataggtcccactattatttttaaaaaattttctaccgacttagcataaacaattgtctaaaccactaatggagctaatttgcaatttgcaccggttttttatgttgagggaagcattatacccggttttgggttgagagatgccatttgatcataagcaaaacaggagataggtaaaatagacttattccttttcctcaagtttacaacccatatatgttagtttggctatctttctacagcccaattatatttgagagaatccattatatgccactgactttgtcactcggctatgatttgccactgactttgtcatgttctacaatatgtcattgaatttcgcctaacttctacaatttaccatcatcgtccggttagcctctgttagcattgtacaattttgtctaaatgaccaaaatacccctagtacaaaacttccaaaatttggataaaattatcaaaatatcatattataaacataagattgtaaacatccattttttttccaaaaacttaaaatatgatacttcagaatttttatccgaattttgaaaattttgtcctaggggtattttggtcatttcaacaaatttgtacagtactaacggagactaactagacggcgatggtaaatcgtaaaagttaagcaaaagtcgatggcatattgtaggacatgataaagtcagtggcaactcgcgacgtgtgacaaagtcaatggcatataatggattctctcattaaatttgcacacataaagcaagaaaataatcattttctttacatagctcgattcaatcttcattgtcagtccgagcgagcgaacggtggctgaatcatgccgaactaaactgatacgacaacggaaacaaatcggacgacatacacaatttttaggcaaaaacaccttaaacttttataataataatagtagagattacctaaagatgaacttgtgcacacccaccatatcacacaatacacacgcacacattacacttgtaaacttgcaaatgcatctttggggtgca

SEQ ID NO: 47797 - DNA, 8467 bp, Oryza sativa
caaaatcccttatatttagggacggaggaagtaatcaattagtacatccatgccaagaatcaatgatgcaatcggggtttccttattatgtggttactgtgataaccgtacgtaccataggtttattgtctgtgggtaggtaacgtgtcccacgccattacctgaccaagtttattttaaacataaattaaaagttttgataaattttgttccgtttctatcggtttattagaattaccgtggttggatatcgccgggtgctataaccctcccccaaacggctaaactgaaagagaaaccttggagacatcgtatgcaataacctgactcaaattattaaactaccacagaaaattaacatcaaaactatggttcaactgcctcaacaagtaattgtcgttgagaaggtaataattgaataatcccatgatgatctattggtttgggcagccgttcagcgccgaccctcatccccatctttgctgcagtatgggcccaccaccagcatcatgtatccttccatctaaatcctgtggccaggaaacactaataaaagctagattatttaaccagccagttcagtgatctcaatcaagacaatggaaaggcttaaccacataattaattaatacaaacgtaccaaatgtaaagtgtacattctgcctctggatgttgtcatgctgagccggagattcaattccatccacaattaagccggttgttctcctgtcatgaactatggatataattatctcacctttttctctgcatatctacctgctgcctgcctgcttgatagctatcatttagtatcaagatttactgtttgcctaattagatatagaatgagatcgagccttctctgtttggtattatgtatgcatgcgccgaccaaataatctagattaattaagtaaattcgtatgaccaaaaaaggctgagatgaggagctcagttcactggatacaacttgattagcccatggtttttacacttctgaccaccattagttggatggattcgagaatttacttgccaattgccattgtcttggaccttgtggatgctggattggcttgcattatatttgacatagatgtggtaatataatccatggctcctgattgttttgctattttacagttgtgtgtttatcatgcgaagacagtacttagggtgtattatgttgataaaaagtgagctgttcaagttagtatgtaagatatagtagattcttttctataaaaagttagactctctccagcaagtgcggtaagttgataaatgcaagcataacgctgacaataaaatctaggcaagttaatttgctcgtgtaactatgttggacttgagcgtagactgcttgttgcacttagagcaggtacgatagtagactataaatcagctataaacatattttaaggagagataagagtagcggtctacagatttgtagccagctgcaacacgaactccaagatacatgtggatatgacaagtgggaccatgcattaattatgtagtacatgtttatatgtaactattgtatgaattagctactaaattaactatagatgatttagagccaatagttggttatactattaaacttgctcttactcaaatttttcttttgaggtaatattttaatgagtaaattttacaaaactatagatactatgaccaaattatcacaaaactacagatttaacttggtgtatcacaaaactacacatataacactaaatttatcacaaaactacacatttaagatgaagtgtcacgaactacatatttagtaattaaattatcacaaaactttaggtttagaatcaatttaatcacaaagtaatgatgtttatagctccaccataacaatggtgctagggatataaactccaaaagttgtagttttgtgataagttcaatattaaatatgcatttttatgatacttaatctaaaatatgtagttttgtgataaatttggtgctaaatatgtagttttgtgatgcaactccttaaatctatagttttgtgataatttggtcaaaatacttgtcagcagctaagggtatatgtgctcttttagatttggaaaaacgtgcacatatactttcctcatcagttcaccacgctccatttaactcactaaatatttttttgttgttattctatgtttgtttagctattactcctatattattacaagaagaccgaagtagaagtagaaccagaaccactgtgcttactgtattggtaaaaaaaaatcatgttagaaagagatgtttctactgtcaaatcatggtgggtctatcttatgacggtgttgattgatttatatagctataatgtataattgtatttatgaaaatagtagcaatagttgaatatcaaattcaactatagttgaaaatatcttactatagcagaatttataactgggtattgtccgtcctttagctctcttcagggatatacaggtttatcccaggttagacgcacgagagattttacaaagttgtaggcctttctcagtgtaacaatcctacaccctattgtatatggaaatagttaaaagatatatatgcagatctagtctagtcctatatatgtacatagtctcgtcgggaactctgatggcatggcttgatgaagcgtttggctctatagattaatagatggctcgttgattgtagacttgatgcttgattcaatacttgatctgagattcaaagtcctggctctatcttaggtccttaatttgaacccctagattcttttgtatttgggatggacttaaagatttattcttggaagtcttcggtagagttaggtctttgagatcttactgaagttggtcttgtgatccttatctctgtttgcggtcctatacccatttgagaaaatcctttccatagaagtatatgtattcatacatgtgtatttaagtctccaatgtcatcgggggtatctcatattttaccaaaagcaaatttgctactttagtcaataccttcaagctttctaaggcctactcatccgtttcatattataagatgtttgtttttttagtcaaacttctttaagtttgactaaatttagagaaaaagtataataatattttcaatacaaaacaaatatattatcaaaatacattcaatcctagatttaataaaactaatttgataatttagatattgctaattttctataaacttggttaaacttaataaagtttgactagaaaaaaaagtcaaacgtcttatatatgaaacgaagggagtatgtagcaatcaggtttcatgtggttttggcgccattgggttcagagtatttccatacggatactttagtactttacacatgcggattcttaatcactatgtatggtttggtttgggaatgtggtaaggtgtgttggacttgtacttgtttttttgatgggatgatcccattcatctgtttaacataagggatgatcctatgtaataccttttaagtgatatccacatgtcagcaagagggaaaagtggattgaattgttctaccagttttttagggacaaagtcaacccggatattggattacatctatctccaaaccaaacaccgagaaaattttgttcagagtatgatccatcctgatccatctcattcctggaacccaaacacacggtacattggtacatttgtacatctcagtgtttagtggatttcaaaaaattattgattgattttcaggttcaaaccgaagggcatacatagaaaaaggtcacatttgcacgtacgcacaaacacacgaatgcttgcactgctgcagcactgcaatcttcacacttagactgaagctgcatatctccactacggataaaaagccagcgctctagctatctgttccctccatttcatcttaaactctgaaggagaagcagagagcctgaataataatggcttccacttggccatgcagatcacaggacgaacgaacgagctaggttaggcgttactccggaaggagccgtagccccttgcgctggcgcggaggatgacctggtggtacagcgccgcgatcgccgccccgatgaacggcccgacccagaagatccactgcgtgtgcgtcaatgcaatgtcagttcattatcctggcttgtgatcaacagcattattaattattctcgcacaaatttggcagcaagattacgttacctgatcactccatgccttgctgttgttgtacatgacggcggcgccgaggctcctcgccgggttgatgccggtgccggtgatcgggatcgtcgccaggtgcaccatgaacaccgcgaacccgatcggcagcggcgccaacaccttgatttttaccacagaagtgaagcaatgagctcgagttcttgccatgtaacacaaagttgtgtactccgatatatgcttaccggaacatgggagtcgcgggcgttgcgcttggggtcggtggcggagaagacggtgtacaccagcacgaacgtgccgatgatctccgcggcgaggccggtgcccgtggagtagccggcggcgagctcgttggcgccgccgccgtgccgcgcgtagaggccgctctggaaccccttgacgagcgcgacgccgcagatggcgccgaggcactgcgccgccatgtacaggagggcgcgcaccagggacaccttccgggccaggaagaggccgagcgtcaccgccgggttgatgtgcccgccggagacgccggcggtgcagtagacgaggacgaagatcatgccgccgaacgcccacgcgatgccgaggacgcccacgccgcgtcggcgccgttcgcggcggcgtccgtctggtgcttgtacccgatcaccgtggccaccgtgacgtagaggaacagcagcgtggccacgaactcggcgatgacggcgcggtacagggaccacctgcacagctcgtcggcgtcgacgagcggcgccggcggcgggtcctcgtagtcccggacgccgccggcctcgagagtggacacgtcaacctctttgcccattgttgccttggaagagacaaatggagaaatgctcaggaagttggaagtgttttgagctgtggtgtttgtggttgtgataggaaccatttatagagggtttatgagtgaatcagggaaagaagaagatggcttcatcatggtttgtaatgaaatttggaaggcattttcagctgtcaatgttgatggacaactaacggcgtttagatccttccacatttattttgtttgtcatttggatttttcttatctctactgctaaaaacagagtcatcatcattccatcccctcctcccacaacacgttcgtacactcagcgtacatagccacgaggccgaatgttttattcttaatcatccttctcgtctatctctaattatatgaacctggttcattacattatacagaaatgttattactaatatatataggaagacatacatatattacttatacacgcaatcaacgtatacaacgacaaatctctaataatgctaaatttctattgagaacatatccgcatacgcgggcagcataacatatattctggtgggtgtaggcatacaccctaaccgtttttttttctattatagttttagagtttcttactatgttttcttatttggacaatacatttttcatactccaactagatttatatatttgattatgattcttctcgttaattgaaatattttacattgacaaagtttgaaatctggtaagacctaagaagttcgttcaaactattgctaacgagctggtaataaggatggaaggggttatcttgaaacacatgggaatccctattaatgaatgagactgttatgaaatggaaaatgctacgtatatgatgtttttgtacgatcaaatgaggacggcgcttggcatcttaacgttacgtggtgcacgcgcatgttgcagcccaatcccatacgcatatactcattatttttctttgccttttttgctctatctatatccaaataaatataaaccatgtcaaacattggctcatacataaacgtttgctgcatcttatcctgatttgtgccattggaaatttagaatacttacaactaggggtgatgctaccagggtccgagatgcaaggaacatatttgcatgggtaatcctatatatctataaagctcatccccactaaatgtagttaatgctaattctctcttctctcgtgaagccacgtcacctcaattgtttttagcccttggatgattcatcaagggtgcaaattgcatctcttcttcctaaaagccacaacatataactcaaccatttataacttttgaataattgatcgaggtacaaaatatacaagcacataaaacaaaatcatatagtaaataagatattttttctacaactcatatctaactattttatcacacaattctcccgtagcaacgcgcggggtacctatctagtttacttaaactaggttcacggtaaaataatttacttaacttaagctgggtcacatgataagtgttaagcgacagtacgagtatataagatttattaggaaaaataaattactctggttagctgtgccaggaggcttaattgtaagatgtcaggacgatgatgtgatgagcttgggtttttggatatagggtcagcgctagaagaggtccagtgtgggaccagaacttgcaacgttaataagctttatgagcctagaagagaaacaattcatcgtacaactatcgtaacaaattagtcgtatgtatagcagcgccggttataaaatacgtgaggtgtactagtacttgagtcaggactttacatgtcctctagcgtttctaaaacttcttgtggtcataaagttttaaagttttgtataagatataaaaaacacgaatattagggaatgacttaatatcaaataattagaagtggtgagtccccgcaaaaaaaaaatagaagtggtgaggttctgaaactctaggtcgtttagcccaccaccttgtggagctagccggaagacctctagacgtttctcttgtgtaagatttcatcgaacttttaaaacttaaatataggacagtttcaatagaaatcgttgaatttcatcaacaaatcctgtgtgttgtatggtctgtcttctaatttatagttgatgtaggttcattctgccacccttattagcgtttgttagtgttcctttgctaagtggcacctctggttgtaacaaaaccgtccatcatatatagcctcattcccggagctgacaccatctctccatctagcacactttttggttcatgtcttgtggctaagatgcactgacactcatcacctaactgatagaattaattaagttagctcactttcaagaattaacaaggacaaagaaaagcttgatcacaacacagttggatcggtcatcatcagtcctctggcacgttgctagtgctgtcattctggtcaccggaggttcaattccatccacaaggatgaaacaatttgaaaagaagcgagcattctgttttcacgtcaccggccggccaatctgtacatcctataccaaaagcttgtcatgtattgagcaatatcatcttaaaaaaatattctcatgctttgatcttaaccatccatttatcatatgtattaaaactcactaaatatagttattgcacattgaactatgacacttagaaaactaatagtcactggatccttcttatgtttgatacataaccatccaagtatcatatagaattgcaatttcacatcaactaatatagaaaaaatgttatctatttagatattatgtgtaaacaatttacttattatattgttttcttcgagatttctttgaagtatattaaattttccgttgtaatgcgtggggtatctaatagttattttagccggcacttcccctaagcttgtcaacagccacattcctgagctcgccccatagtgttgccatcacttgcatcatatgttgctgccgctagcctcatgctcactttcgcatgcacatgcgcgggcatattaattatgtttcatagattttattatgttaagatgtactggtgattttactttattatttgttaaaaattaaattatatgatcttcatcgaaaaatgtttggtattgctgatccttcactggttgtatatatttacaaaaaccacaaaggtatttatatagataactgtgcgggcatcttgttaatatattacaaaattatacaaccatgtttttttttcttttgaatatgagtgtttgatattttaaaaacaaaatgttgaacatatttggtcactaaaatatttgaatcaaattaaattatattctatatgacggcttagtccagcatcgtaccattatatcttttcctcacgcgtgcattattactagtttcttcgataaaggatttatagttctggcctctacatgccaactaag

SEQ ID NO: 47798 - DNA, 1254 bp, Oryza sativa
agagagagattagaggattttcacaaataagaaaggatttttattttgaaaatattgctaaggtttgggatctacggctcgtcctagggtcaagggggctctgataccaacttgtcacgatcggaattaacccaacgggcgttccttacgtgcgtgtattattccttgtcccaggaggcaaggtacaccaaaagttgatacatttcagagtttataaagtggaagcgtaaatagttaatttattacatgggcggcgaagacccagcacacacaaaaacaaacggaaaacagcggaagactagggcgacgaccacaggcgcttgacggcaggcttttgtttataaccagactgagccacaaactaagccttacctactagacatgtggaagtacggtagtgctttgcaacagaggctcgaagaccggtccttatatggccgaggtgctactatcaaaaccatgcaccccgagcccagcctaaaaccattttgaggattttgaatagagggggaggtgtgaatccaatttccacaataatcaaaccattccatagtgtccaggtgatatgaatatcccaaagtctagagttgtaaaaccacctaatgttgcctaattaaccagcgaagcatctacctaaaatcatactagtggtaccatgagtagagtgtccactagttggggttttgtttattctagggtgaacaaggaaataataacaataacaataataaggtcataacaaaggtaaataggcatggctagataaaacagtgataacgcgggaatttaaataaagcgataatgcaataatttaaatcaacataattttataaactgggattcaatatgtttaaggatgatgtgacttgccttgctcgctttcccaaacgtcggcttcaacttcaacgaagagcggatcttctgaagctgcagcgtctacacgaccaacggaaaagaaaaggcttttactctaataaactccatataacaagcacgaacaaagcacaaaaatgggttcttgacttcttaaggaaaaattagagacttgaacggtccaattccgagttcaaatggccaagttatggccatttgaaggttatatgctctttaaatgaatatttgcgaatttcttcatttaaattttaattttaaaagggtttattgcgtcagccgaggggagggggcgcgcggaccgggtccacgggagtggggcccacgcggcagcctcacggtccacggtggaccgggtgcact

SEQ ID NO: 47799 - DNA, 24821 bp, Oryza sativa
taagaacaaaattagctacgatactattgcatcacgctgatggagcatgaatatcttccatcttatgaaaacctacaccatcaaaaccatcatcactaccaaagcaaccactatctatcttaataaatagaaaaaacaagccaacttatccatcgtaatgatgtcttctttccaaaaaaaaaaaaaaaaaaaaaaaaaaaaaaaaaaaaaaaaccctctgatgaatcttctttgtaatatgccacgtacttcatccagatcctttgggttctcccagttctctcgtcaagcatcttcttgaatatgccaccatcatgttctcctagttctctcgtcaagcatctgctaccatcataatactgatagacaattggaatatataccattaggaataatacactgtaacgtagcaaaaatgatgtaggactggagagatgaaccttaccataagaaaaccaacttacattggttacatattaattgtttataaatatgtccaacaccaccgtgtcatcctcctctcaccaacactaatccgctctccttcatcctacctagggttgtcactgggtattcattaaccatccccatatccatatccacattttaagtggtctctctgaatgaagcaaactggaatccgtgcaacttcgtaatccatccacatttatatttcatcctgtacatacatgttagtaaaagcaaatttgccaacaattgtaagtgaacttcagagttaatgcataagttcagaccaaagcgtgctacacataactggctataattaaatttatgcaaattgatctcattaacattagaaaaaaaacaatcagtttacgacggccaattgtagaccgaaccgaaacatcaaaaccatttccactgctttataaaacataacctttatatagaagcaaattaaagctgcaaattcgcccaatacctgtactcaaagaagcaagtagttagttcattctcagattaatcccaattatgccacccagcagtcttagtgtagctatccacaaaaatatgtgcaaaggcaaccctcccaaatggttcacatcaatgacccatgaacataaaatacgcatgaatgtgttcatccatccaaatataacatcaagcaggagaaaaataggcatgttaaaaatgatcaaatttattgttttctgtagtgcaaatagtgtggcctgaattctttattggataaaagtaaaaatcttataaaataacaaaagtaatgctggtgtatcatcttaactaattaagtgatttaaacaagagttggataagtgagcatacctgccaatgaaggaacctgcaataaggcacatctatatgttgttactacatatatttgcccatacccctgcaccacaactggtagatcagttatctgcactcatcagccatcacataggtgtctctctatggaacgcgaacaagttttgttagaaaaaaagaacaagtaaacattaagcaccttaggagctgagttgtcaaacatgacaatctctgcagtgaaaataattgctccacatccaaatgttcccgtcccaataatagtggatgaatttacaagagaaaagggagtgatgattaattaaaaagataacataactattcaagttacacaaaaaagggccacttagcattttgcagactctgcaatcaaaattagaagggtcagttatggtattgcctactgaaatgagcattgtttttctaataatctcaaatgccttcacttctttgggggtaaaggtgaaacttgaaagtgctctacacctatctcttcataataatctacagaggtacgatagacatacaatctgctaaaattacctatttattcctattaacatactattggcagtcatgagtagaagaaatcgatgaacataggaaacacataatggcatattggcagtcatgaaacagtgtgatgagtgcacagggatatgcataaaagtacaccattacccatgctctcaaattaaagtatatactactgactacttctcaggacctgtcaagtgttaaccacaaggatagtgcaaactaaagaaagtgaagaaacaaaaactcttacaaggtaaattatgttccatatgtggtggtatagaaccagtaggaaatattcatggcataggcctcaataggaaaatcgacctcccttcttgtttcagtccaaactgaagaaaagaaagtgctcatgtcacttgatgctttcacgcagggatcatccattctatctgaaatattcagaaactgtcaagctaggaatgataaatattcatcccgcattgttgtaatctaaaacatgtagctaaagttatgtcaataaatagagcatgcatgccaaagagatctaacaagcccaccataagttatttcatttagctggcctcatcaaaacaagtgcagacaaacttggatgaaaatgagctcgtataactctgtttttcttcaatggaaaactattatactaaaaacagattatggaagtgctcatatcaattcagaaatatgatccgtgaaaatgatgactcactatatttgtttggacatgctcgtgagtatccaatctggaagcatggagaagatgctacaatcagacagaacggaaaaatagaagaacgtgtccttgagccatgaacgagtgtgaatgatatgattcaagtaaacaaaaataatcatcctccaggtaattccaccaagcatattgtgcgggaaaaaaaaaaggcacaatggccagtgtcgatattgaacgtgcctccacccttccgacgtggatgcgcatcgatatatcccctctgccgcccctctgtcgagccccttggtggccatcgccagcttcgtccgcggcggccacgcacctccgatttcacccgcgccaccgccgctgccacccacgacgacgctggtcctatagatgcggcatcggcggcggtggcggcggcgatgaagcggaggaggatacggggcaatggctgcggaggaaaagtgaacgccgcaagatcggagtttggcggaggaaggtcggcgactcccgtcgatccggcggcggggcaggtgaaggtgctgccgtcggcgggggagcggcaggagggaggaaggggcgcgaggggtgggtgcacggacggagggggcggttggcggctgaagggatggacggatggtggcgcagcgatatccggaggaaaagaggaggcgtggaaggaaacaaagattttatgcccggtgactacgcgtgcgcgcgatctccctcccactgcgtgatccgcgtgcgctgctatcattgaatcggaaatgtttgatgattttcatccgttggatttgatgaatgaagttagtgaattataggatagatatgagtaatcatcgtagcattagcacctgagtgaccagttcttatcgtaaactgtaacctaccaccatgattatgcttcataagaatatacattattatgtatttgctaatccaagagccaagagagcctagcaatgatatttgccggtttattgataggaatgagagaacttcaatcgtacatgccctattattcaataccattacaactacccatcacttggtaaactattggaacaaactgtaaaaaggaattaaggtttgctaagattgtaaggcaaatatgatgattttcattggtctttaataacttattgggacaaattgtgaaaaggaaaaaagatttgctcagattgtaaggccaatatgatgactttccttggtcttcgtgcagtcatctaatatgacgatcaattaggcgaggtaagagtactacgcgtacacacgtactcagtcaaaaaccaagaattggaacaatacagtatgacaggttttcatccttttgatccagtgaaatggggcagagaagctgactggactactcacaagttgcaatcacacagcatctccagccaatcctaagggaacgccgaaaatcaaaatgatcgtgacaacgataatcacttgtcatcacatacatactagtagtgtagttatgtatcaaaaagacctgactgaaaacaagaggatatataacttgtactagaaaggcaagacaagaacattcttaatgctaactcctggcagagaattggggaacagggcaatatcagcatcttagaagagtgaagttcccttgcccttcttgtctccaccgatttcaaagtgcttgcacctctgaagtcagattgcaacaagacgggtcagatgcttctaaaaaaccgaatgctataacatgatgaggaggaaaaaaaaaaagaagctgaaagcattgataaagaccttgatcgggtgctgagagtagtgcttgcagctctggcactgcagcttcagaacgatcttctttgttgtcttggcctgaatgacaacaaatattagaggtaagtaaattaacacacagaagcaacactaccaaacaagctagtagctatcctttaaattcgcaaggcatagagaaatcaaggtcaaaccttcttgtgaaaaacaggctttgtctgcccaccatatcctgactgcttgcggtcataacgacgcttcccctgagcagaaaggctatcctttcctttcttgtactgggtaaccttgtgtagggtgtgcttcctgcattccttgttcttacagtaagtcttcttagtttttggcacgttcacctaaaaaacagtgataacatattcaatactacaagaatacagatgacattaagcataaatagtgctcactttctaatgccttatttgcaatatcagattaactaatttgaaatgcaaatacagagaactacaaaaccaaaaagctacaggcatgtcagtacacacaacacactggaaagaacagaagcaagtggtcatatgtaagacaaataggacaattgtgaaatcaagatggcacttaaattataccagtgaattcagggtgatttaagaacgccaaacaggaaatgtctaagcaagaactcttaacatacatagaaaatatagaagatgtcacgctaatttctgtaaccagtactgttcaggtccagttcattcacaaaaataagaaaccatacgtcatcagaggctggtcttttagaaaaggaaaaaggtaaaatagctcataacagggtaatatcttctggtatcaacaagctttccagaatagatggactaattattttagaattttcctaaaaaggattattttttggataatagcagaacagtgttgttagacaatagaatgatgctgattgctgaaaactaatatgtcaggcatcgcattagtgtaaggatttagtacacatgcagatatgacatgtccaacaccaaaataatgaaacctatataaattttagattaatgccaacgtacaataggataaaagaacccttaaattggttcacttaccctaacttaaagtgaaatacacaatactaaagacaccaccctattctaaccctattctaactagtactccctccatcccaaaatatttgacgccgttgatttttttaaaaatgtttgaccgttcgtcttattcaaaaaatttaagtaattattaattcttttcctatcatttgatttattgttaaatatacttttatgtatacatatagttttacatatttcacaaaagtttttaaataagacgaacgatcaaacatgtttaaaaaagtcgacggcgtcaaacatttagggaaggagggagtataagataagatgctacaaagtagcacggtaacccactgataactagtcacactaacatacaattcggcataattcaatttccaaatatacttccagccaacagagaagcagaaaccactttctctgttaaggtttcagctcagaagctcaagaggcgcaaacgataacagccatcatgccgatagcaaacatcctctattgcaagggcggatcagcaatatctcaaatactgaaaatcctaaataacagagaccacggctcatttcctctctggaagaatcagaaacaccgcccaatgggctacaatttgagatgcaaaagccctagacaacaaactctatgataatgcagccaccaaagcaaatccctgcttaaaacaggccgaaaacatgacatccacagactagccaaccaaaaacagcctaatttggcatattttcgatactgagccgctggaacccacacccaagatcgtgcacgatctaggcaactacagaaatggcaagaaacaagcaaaatctaaacagggcaaagagtaggaggagagaaggacgagacacggggattctgaccatggcgccgagctttgggttcctctccctccttcggtgggtgcgatggcggcggcgcgagctcggtgccgaaaaccctagcagcctggtggcggcggctacaatatagaggaagtcaaacgggccggcctgtttgtaacctatgggccgaacggtcggcccaaatgattggctcgaaagagagaagaaaaaagaaggaataagttcatcttaggtcccttaattttacgccaaatccgattttcatccttaaccccaaaaccagatataaccggtccctaaattatcaaaaacggtgcaaatgagatctctcggcggttttgaaggtggttttggctgacgtggcgtctacgtctacgtggctggtttaactaggcctccgttccacatggcattgacgtggcacttacgtagcaattatatctaaaataataataaaaaccatgggcccacctgtcagctaaaaataataattttaaaacggcgtggcccacgtgggccccacatgtcattccctctcccctctcagctctccctcttcctcatcaagccatctcctcgcgccgcggcgccgcctcacagccggcaggagcatgccgacgaagcggagaggcggcggcggcggcaggccgcggggtcggtgcctactcccgcgccgccacatcatgttagatgctgcacagcggtgaggaggagaggcagagttcgagctcagtacagcgaggattagtgtacagatcgagctaaacagccaacaggattagtggcaggcaccaacaagcagttgctgctgctgctgctgctcgagacatgcatgagctcgtgttcactacagtgaggccggccatctgcaagactgcaaccatgtcagatttggcacggagacgaaaaacacacatgttagtgacccaagttgttgtcgtcgtccatgctcgccaaggccgccgccattgccgccggtgtcaatgactgcccgactgaccgtctgtcttcaactcgttcttctcgttggcagagagagaagctgggagagagggggacagaggaggaggtacagccgcatcgcctcgctgatggtcgcgtgcagccgtgcaggtagtgcatccgcttcagctcgtcgtatccgtcgcagtcgccgtcttctccggcgtcggcgcggcgagcgtccgcgtgccgcgacacctcctcgtgcacgcgccgctcgcagcgcgggttcgcggcgaggagccacaagagccacgtcagcgcgggtgctcgtgctcgtcctccccgcgacggaggcgctcctccgacgccacgtcggcgggagaggagggagcggcgcgcggagatgtcggcggtagaggagggagcggcccctcctcacctgcttcctctccaacctcctcatcatccccggccgccgcctcctcccttcctagttcctccgggctccggccccctcatcttgagcctcgtcctcctgctcttcccttcgccggacgccgtcgacctcgctttcctggtgccgatacacgcctccgcccgcgcgagccaacccgacgctgctactcctcgatgggacatggaagcatgccaaggagatgcaggccgccagcctcccgttcttgtcctccttcgtctcgtccccgtgtcattgctcgtctactgcgatgtcggcgccggcggggtcgaggtggtggagtatgacgacggtggtggaggcgggttgcggcggagggcgtgcgccgctccctcctctcccgccagagccgccgcgcgctgcgccctctctgttgcgcctgagagaggagatggggagagagaggaggaagaagaggaggggagtgagaatgacatgtggggcccacgtaggccccaccattttttattaattcatgtgtgaaactgacatgtgggtcccacgggtttattatttttcttagatcgaattgccgcataaacgccacgtcaaatgaagaacgaatcaaattagccacgtaggcgccacatcagccaaaaccaccatccaaaccgctaagggacctcatacgtgctggttttgacagttgagggactcgttgtatctagtttttcggttggagaatgaaaatcggattcgttgacaagttaagggacctagggtgaacttattccaaaaaagaaatcgatgggctcgttggggattctgttctgtcaatggagttttccttcgaggagcaagaagtcaacgggaatggcgatgattctgagcgccttcgtgtccgcgtgcgcctcgaagctcgcgggcctgatcgccgacaggagcgccgccggcctcggcgtggaggacgacgtccggagcatgcagtggcggatggagcgcgtgggtgccgttcttgaggacgcgggcgacggcgccgacgaagcggcgtccgccggcgcgtggatcgacgagctcagggacttcgtctacgacgccgacgacgtgctcgacctctgcaggtgccgcggtgaccgccttctggcggaacgccggccacgctcacggccaccgatggcgccggtgaatctggtctcgtcactccaaaaactgcaggctcggcttgagattggggcacagattactcgcctgaaccgcagattcgaggagatatgcaaggataagctgttcttgagcctctccgtcgatgactccaaggcggaggacggcggctctcgcggtggcggtggcggcggcagccgggttcgaacacgtacgagcacccctgtgctggaaaccaacgtggtgggaaaagaaatcaagagcgcgacggaggcgctggtggagaagataatgcgcgacgacggccgtggagaggtcgtcgccgtcgttgggatgctccgagatttacagcatttgtcaaggagggaaagcatctgcggaaatttacaggcagtcggttgttcttcgtcccttatcaagctccgccgactgtcgctgatgaacttagaagaggcaatggtgccatgcaatgcaatctcccgtgatcgaaaatgtttccggactctttctaatggccatcccaaaggttgatggtaggctcgtggtaaagttttgcggtcttcggacattgttcctcagtgactgtaacatcggcaaacttcctgattcaattggggatatgatgcacttgagatatctaggctttgacaacgttgacatgccagcactaccggagagcatcggccaccttactaatctgcagtttctgaatgttaagaggtgcgcattgcgcattgccaagagcactcactcggattcaaagtttacggcgccttggaattgaagaaacaccgataagtttggtgccccgtggcatcggagggctgcattcccttgctggtttgcaagggttcatagtgggtagtgcaattagtagcagcacaatgcagcaagggtggttcttgacagagctagaaagtctctcccggctaagggcccctttgaatcaaaggatttatgtaggaatttcataggattcaaatcctatagggaattttcctatttggccctttgattcaaaggattgaagctttccaaatcctatgaaattcctatagaatggcacattgcatgtggattttggagcaaatttagtaagagctccaacctcttggaaaatttcctttgagtctatctctctcatccgattcctgtgtttttcctgcactccaatcaaacgacaattcctatgtttttcctgtgttttgcaatcctctgttttacacttcaattcctgtcagaatcctgtgttttttctattcctccgttttttctaccctactattcaaaggggccctaaaatggcttcgtattgatagttgggaaaggcagcaattgacaatgtagatatcgttgctaccgaacaacatctgaagagattagagctgtcatgttctctaaaatcaaatggtgaccataacccatgggatgaaatagaggttaaaaagactgaagcaatctttgagaagttacttcctgcaagttgtttagaggaccttctcatcagaggattcttttgccgaagatttccaacatggatggagtcatcttctctctgcaatgtgacatggttgaaacttattgattgcaggttctgcctcaaatttccaccactgggtcagctgccacatctgaccttccttaagattgtgcgtgcaaattctgtaatcgcagtgggctcttagtttcatggccatggagcgactgcctttcccaaacttgcgccgtgtttagttccaaaatatttcttcaaacttccaacttttctatcacatcaaaactttcctatacacataaacttctaacttttccgtcacatcgttccaatttcaaccaaacttccaattttatcgtgaactaaacacagccttgagttcttgtggattgggaagatgcctaactgggaagagtggtcatttcacatagcacaagcaacacacagttcttctcttcagacattcccttgtctgcatcaacttgaactgaaggactgttcaaaactcagagctctacctgaacagctgaagcatgcccccaagatgcagaggctgcgcatacagggagctcatgcactgaagaagatcaagaaccttcatgaactttcaggctcgctacgtatcaacggaagccactctctcgcgagcatttcagacctgtatcagatcaaagagctctatgtagctgactgccctgcactgcagtttgtgaacaatctaaatgcgttgaagtggctgtacctcgaagatgagacgatggactgtatcccgatgtggctctcgaggctggcagagagtggtgagcaagccggtgaggacggcctcgagttggagctgcattgcagcactgaaatgctcgataggtggctaattgagcgtcaggattggacaatcctggagaggttcacaagtgttgctgcatattgcaaagaagattacatgtgctattcgagacacccagttagctaccacacaagcaagagtggctcaaactcaaaaatagaaatgcatctaagttagctactgccttgtgtatgtctgtttggacaagaaatgcaagattagtcaattcatcaaacttgatgcgcactgcttcgtgcataaaatttccctgttaaaataacagaatgttcgacagcaacagaagaacaaagcagcgaaatgaatcaccagctggggaatccaccgccaccggctcgccgcgccgtcgaattggtggtcatcacgacgaggagtaagcatatgtgtttatgattcgatacgttttgcatatttcggggaaaaagattccatgtctctgatctctgaacctgactatggaatttcagtgtttcggttagctctgtctgcctcggagtggcaagcattcattctgctgattatctcgatgacagagatattggatctttagatcttgtctgctgattatctcgatgatagagatattggatcttcagatcttgcccctgagtggcttgcattttgttgaacaacccaaaacagagttggggctgcggtctagtacaatgcttggaggtttttaatgaggcttcaggactggggggccatcatagttcatttctttaattttgttgcttcttcaacggaagaaatgtgaagtatgtaagtatgtactattccaaacacacaattaaatacagaagtagacaattaaacacacaattcctctgtgtactagtgacagtttttctttccataagtaagaccctgtttagatggtaaaacttttaagtccctatcacatcgaatgtttggacactaattataaaactcatccataattttagactaatccgcaagacgaatttattgagcctaattaatccatgattagcctatgtgatgctataataaacattatctaattatggattaattaggcttaaaaaatttgtctcgcgaattagctttcatttatataattagttttgtaagtagtctatatttaatactctaagggcctctttgaatcaaaggatttatataggaatttcatatgattcaaatcctataggaaattttcctatttggccctttgattcaaaggattgaagctttccaaatcctatgaaattcctatggaatggcacattgcatgaggattttggaggaaatttagcaagagctccaacctcttggaaaattttctttgagtctatctctctcatccgatttctgcgtttttcctgcgctccaatcaaacgatcattcatatgtttttcctgtgttttgcaatcctctgttttacacttcaattcctgtcagaatcctatgtttttcctattcctccattttttctaccctgcgattcaaaggggccctaaattaatgtctaaatacagggactaaagttaagtccatggatccaaacaccacctaaaactatcacaaaccgcttagtcctagcagtctaacagaagtggtcagcaaattaatgtactactacttgtagtactagtagttaccttcagaacaaaatcatgcgtgcaacctgaacactcgacaaatacacatgtcattagcttgccacaagctgcctacaagctacagctacaagaaaacagatcactcaaaacatcagatcaaaccgaagagaccatcataagtaagatcttgtcggtctactagtacatttcatcgcctagcatttactacatctacaagatcatctacatctacaatgcatcacggagaaaatggccaccgtcgacaccggagatcgcctccggcgaacacggcggcggacgccggtcagtcgagttcactgcagcatccggctggttatgcgggagatgtccgccggtcggacgggcttgagcaggaagtcctccgcgccttcttccaagcatctgaaaccaatagagaaaaaaaacacagcatctttcttttgtcaagggtaacacttggcaagagaattaaaaaaagcatgtcacgcttgatcggtgaagagacgggctcactcacctgctgatccttgtgggcacgttctctgacgacattatcaccaccgggatctgcttcagctcagacgattcctgcttgcagatttcgttttgttattcagaagctttgacatggccgcgcaatgtggtgtgcacatcaatattattagagcctttttagaggccaattaattgtgcacagtgatgtagttagaattttctcaagtctaagattcaactagtataatttacataatttaattttatctttcatagtttgaagttttgaaatgtaaattttgatggatattgaaggttaggagtaggtgctgcttcccctgtttcgggcactgattatgcggttgcagtggttctgttttgtgttaattaattaccttgatcttcttgagcaggtcgtacccggtcatctccggcatccagtagtccgtgatgatcatgctcacattaggttcctgattaaacacatcaacatttttttagaaactagggcttaataatctgataaaagaataaaaatggagaagaatgacagaagataccgagcccaatatctccagcgcccttttcccactgtctacggcagtgactgcatcaacaaaaattaaaacgcgccatgagaaactgatgagaatagtgtacggttgttgccacgtataacaaaagaaaaatgtaaaaataaatcttaatactacctgtaactctgtaaatttgttggcacgtgtgttgggtgtatgtgcttaccgcggtacttggatcgccggagcagcgccgtgatgacggcgcggtcgacggagctgtcatcgacggccatcacgtacggcggcgccgcctcctcctcatcgtcctcgtcgtcatcatcatcatcatcttcgtcatcgtcttcttcgtcgtcgtcgtcgtcctctgccgatgcgttgtcgtgcagcggcaccacttgcgccatcctcgtccagcccttgacgacgacactcttcatctcatcatccttcccctcctcccagtcggcgagcttgccaccaccgcggcagcaacctccgccgccgtcgacaccgcatccgcaccctcccgtcaccgccgccggcaccctcatctccatcgatcaacaacgttaacaacaagtattcaacaagggatgaatcgatcacacgtagctgtgatatatggaccaagtgattgatttcctagcaacggaaactgtgtgcatatatatatatagcggaaggagaagatgaatcaatactacacgatcgaggcgtatcgctgtatcaggtgtaaggcagggccggccgattcgtcgaatcgggacagggatcgcgctcgatctcgcgctcacctgcccactccctcccggccatatacgtgatgtacgttggtacagaaccgtacgtcgtcggtgagcagcagcagagaggagcatcagatgatcgacgatatacgagtataggagtatctctcagcggatctcacgtactacgcatagatcgaattatttatccaccacggacggccgcatcgtactataactctcgtatcacgagggcgcagagcgagcgcggcgggatagcgtggcaggcggcggcagagaagggtcgtacacgcgcgggcggatgctggtagagatttcgggtgatccgctagctgctgcacgccgtgcgcgatcgaggacagcgaggtgcagcgtgccgcgcgctggctaggcagctggctgtgtgccgggcgctgggcatgatggcatgtggagtgaatgttcacggcagcatcgtggatacgcttgccggccgctgaaaccccctttgcctccgaatctcgcctgtcgcgcgggccagcggcagcggaatcttacgctcggctcggcgtctttttggggggatatccatctcgcgatatggacgttcattgaaccgccaccggcctcgttgctgtctgcgcggccggcatgtacggcagtatgtactccaatatcgatctctcggcgcagcgccggcgtcggcagcggggacagcgccctctgcttacagtacgtatgcccgtactgtaccagggggtcggggtcccgtccccaggcaacgtctcctgcccgtcgtactccctccgtcccaaaaaaaaaaaaaaaaagacaaaccctggtttccgtgcccaacgtttaaccgtctgttttatttgaaaaaaaatttaaaaaattaaaaagacaagtcacgcataaaatattaatcatgttttattatctaacaacaatgaaaatacgaattataaaaaaaattcatataagacggatagtcaaagttggacacgcaaacccaaggtttgccttttttttgggacggagagagtatgctgtgggggtggtgggtccacaggattatatcgctggggagaaatttgcatatctgccattttaaaagccagcttcgttagaatgtcatggttaaaatgagatttgctctaatgccactcttaaatcgtgagcattctacaatgtcactctagttgtttcttatatttctaaatcatcatttttcatccgattcaatttatctcggacacttttacccttgaaccataagtttttcatctcgctcttattcatctcacgcgaggagagacgaggagggggggggggggggcgaccacgaccacgctggcaccacacaccacctgctccgcccgtactctctccctacctcagcccccttcctcaaccgtgtcacctctccccaccgccacctctccctgtcaggtgttcctagcctgccacccccatgcacgtaggccgctatcccctgaacccaccgctcccccctggcttccctgccaagcctagtcgccatgtccttcggcggcaaagtgctgatggccacaccagtagcgcgcgggggcaggaggcagggtcgaggacgaggatgcaaaagagtgtcctggacgacgcggcgtagcgccaacggtggcaggcgagtgcggcgtggaggaggtcggcggggaccaggtggcgtaggatgctgcggatgctgtcatcggtgaggatggcgaccatcgtcgtcagcgcttctgacaccatcgatgagcgagaagatgtggttcggttcaaccacaactagggggcaaaaatgtccaagaaaaaatatttggatgaaaattgtcttacaaatgtaagaaacgcgcggaagtggcattgtagcgaatacccccagcttaagagtggcattgtagcgaatcccattttaacgatggcattctagcgaaactggattttaaaaatagcacatatgcaaatttctccttctcaacctacttgttgccccttttcttcgtcatttgaattctaaaattcgatcataatcatcatttactttttttctatacattttagttgtcctactctttcatggctcgtccgctcaccctctcccccccccaacacccctcttttgtcatttgccaccattgtgttataaacagacggttctttcagatttaattttttaattccaaattttttttaattatatttcttctcgaactctttttttttcaaatttgacaattttttattcataatattctcaaaattctatttcaattttattttttctaatttctgaatttattttatttttaatttcgaattttacttatttctaaattatattcatacttcaactcttattttcatttttctaatttcataatttattttatttttattccaaacttcaattaatctcttgttgtaatcaagatggtttctttttcactaaaactttctttactctgaattttagttactctaaattatattcctacttgaaatcttttttagttttataatttcattatttattttatttttactttgaatttcagttatttataaattttagtcctcttcttttttttctttttttctgattattatgtaaatttttaacccttacagtaaattggttatctccttttaaagttgttttggtaatataatagattttctatatctctaggcctctcttgagagatatataagttttactatggagaaagaaaaaaaataatatcagataatagaataagtttccaactacattaaaagataaccagctgaattaaaaaaataagacaaatcatatactaagtaattttataggtattacaacatccaaagcagaataaaaaatccttgttggctaccaaatccaacagtacagcatcactgcacaccgtatcccacttcttatgtgatagtatcaaatactgagctagcaggtatatgtgaagatatagggccagtttggtttggtgccctaccaaaatcttggtagtaccaaagtttaggcaacttttggcactaccaaatttgggtggataaattttgtactacctaagaactggtgttggtaaaatttagcaccaatccaaacatatagaagcactattcaaaattaccaatgaattggtagggcataatttggcaccaaaccaaacaagcccataacctacactatcgttttgacaacgcaaaattaaccaatacagttcactcaccccaaatatttttgggttaattagatccttgccattaaaaatttgccggttttgaaatatatcattactatttacgtatttgtaacgatatcactgctacttatttgtaatctcaatggtgccattgaaatacgtattttgcacgtattggacgaaaatgccctcattttctacctttctcttccccatcttctacccctctctctctcttctctactgcatagcttgctccatagccgttcccgccgctgcttgctccgtcaccgttcccgccgccgcgcgcacagcttgctgctccgccaccgtagttgcttgctccgccgtcgtccccaccaccgcgcgcgccgcttgctccgccgtcgccgcagttgctcgcgccgccgtccccgccgccacgcaccgcagcttgctccgccgccgccgcagatgctcgctccgccgccgccctcgctgttgctcgctcccccgccgtccccgccgctcctcctgctgttgctcacgctgcagcttgctccgccgatgccgcagttgctcgcgccgccgtccccaccgccgtgcaccgcagcttgctccggcgccgccacagttgctcgctctgccgccgtccccgtcgctcctgctgctgctgctcatgctgcagcttgctctcccgccgccgccctcgctgccgccgcccgctgctactcgcgtcgccgtccccgcttctcctgcccgtactcgctgtgctgctccaccatcgccgtcgagcgggaagaagggagaagaaggggaggaagaagaacggagaagaagggcaatttggtctaaaatttattataaatgcatctaagaggtaagtagtggtatatctcgaacacgtgcaaaattataatggcatggttacaaatacctgaatactagtggcatattttaaaaccggtaaatttttaatggcacgtatataataaaccctatatttttttacatggaaatcatagtaagccagttagatttgtgtgctggtacctaagaggcacctactagatctaaatattgacacgcatctgcaaccaattagatagtatagttcatataaatatatattacatcattaattaatatttgacccacctatgatacacatggtgttttaaacatgtactacaactatctacaaatttataccccttttcttctctctcttctacctaatcacaaatctaatgtgataatttctagagcccatttacctcacttaggccatgtttagttccaaattttttctttaaactttcaacttttccatcacatcaaaattttcctacacacacaaactttcaactttttcatcacatcgttttaatttcaaccaaactttcaattttaatgtgaactaaacacaccccttattgtactatctctaactacagtacatctccgctgtgcgctcagctcacagtgaaggtagtccaaccagggttcacatcatctgcctttgaggggccaaagacaaagtttgccattgctttcatccacgtcctccattttcgatcaacagttacatggtttaggcctcttccatgactaactaccgctatttaattgatagaatttactctgtagaaaaagacaataaaacacctctaacggtaagcgggaaaaaaaacagaaaatagctacacattttttcgctttttggaaccgtttggtatagaactaatattaggagcgtcgcgctcctaatattccaagcgccaaacatgcattagcttaggctcaccccacccccacatcccttcattccactcctaccgttgtcggagtaaacgatttactcctatcgtgcgctcaccacccacctttatttgagtaaacgacttacttcgataatagaaacaactccccaactttcgatcccaccccacgtcccgcatcgtgcttccaccattatcggagtaaatgatttacttcgataaaaacaacttctctgcttccgatatatattctattttcccatacccaaccaaccactctcacccccacttcaattttttttcctttttttgggatttgaatcgatccaccatcccagcccacggatcggtgatacaccatagaggaggacgacgacaccgtagcggttgatggcggtggcaggcggcggttgaggcgaaggcactgcttcgggcctcgctgctggacgctgggcagcaccttaaccagcaaggagatgttcacctgggccaatagaaacaaccagtggctgctccacgtcagcgacattgatagaacaagcaattaaggaaatgacactctgatttgcatcttcatactctccttcaacttcacgcatgaaggcccgattttttttttcaaatcaaattaacgtgcaatctccaatattacctgatctcaattgatgggctgcacaggtcctacatttacagatcgtgctccatgtggctagctgcagaggatagggtgggagtccgccggtgatggaggttgtttgctatttttcttttgctcgtcatctctattgacataaacgagaatgtttttggtattttttttcatgcttgctagatgatggatagctgctactactcaatgtcgagctcatctctataccacacggctacatccttctatgattccatcgtcgactactgctcaccacacggttgccctctccactaccagttacaagatatagaccgtgctctttatccttatagtaagatccaacaaagtcaccagatggatttttggctgaatcattttttttcttttttagtttgattcacctgtgagtaattttatcgcttgtgtgtgattgagtctgtaattttttcattcatacgaatattttttgatacagatcaacaatactcttagtattagcttttactcttatactgtacattgaacacatcagtaaacatattactacatggtaactacgagatcatggctatatcgagaggaaggtggtaattgttttactcgcagaccacaaaatctcagtttttactcttatcctgtgtattaaatacatcagtaaacatattactacacgatggctacgagatcatggtctatgttgagaggaaggtagtaattgttttagtcacagaccacgaaatctaaacaatatttataatattggtaaaagaattactagcgttgtaagccggtagtaattcttttacgaccatctaggtatggcatcatacaatgtgaaggcattcatgcgagtaaatttgttacttttgaatgagtagatatgggaggctgggagtaaatgaaaaactccacgaagtaaattcgttactttttatacgtgcggagatactagaaaagcggaaaacttggaaagaaatactagacagtaaatattttactaaaacgcgaaaacagaaaaactagatagaaggaatgaaaaacagaaaaatttaatattttaccgggcccattgatgaagcattgatgagatagaaaagagaaaaaagaaacacgaaggtagagtggtaaaaaaggaaaaaacgaaccgagaaaaggtgggatgcggaggaaaggtggggtggtaaaaaacggaaaaccaaaagaagaaagcgttgtgcggcgctcgaattaatattatgcgctgtagagcgcggaatagcgctaccgccatttgatatgcattcattcaggaaaacaatttcatcatacaatactattatatttttgttgttttatcgaaagaaaagtaatagcgatagctaatctttagaaaaggctgtagggaaaaagttcttacaaatcttttataaacgctgatttgacacggtgggagtaaatacagattttctacaggtttcctctagtgaaatcaaatggtagcaggactttttttttaggagtacattgtgaggatttttgaagtacgtgcagcaaaactaatcaatcaattgtattataaatatgtccagcataactgatatattaattaattggttgataataatctttgaagtgggaaaaaacatgcaatcattgagggcctctttagttggaaaaaaaattggcccctgcttatcacatcggatatacggacacatatttgaattattaaaagtagtctaataacaaaacaaattacagattccgccagaaaaccgtgagatgaatttattaagcctaattattcattattagcaaatgtttactgtagcaccacattgtcaaatcatagcgcattaggcttaaaaaatccgtctcgcaattttctggcgaactgtgtaattggttttttctacatttaataccccatgcatgtgtccaaatattcgatgtgacagcatgaaaaactttgtttgggaactacggtctcgcaattttctggcgaactgtgtaattggttttttctacatttaataccccatgcatgtgtccaaatattcgatgtgacaggatgaaaaactttgtttgggaactacggccttgtttagttggggaaaatttttgggtttgattatcacatcggatatacggacacacatttgaagtattaaacgtagcctaataacaaaaaaaattatagattccgccgggaaactgcgaaaagaatttattaagtctaattaatccgtcattagcaaatgtttactgtagcaccacattatcaaatcattgcacaattaggcttaaaagattcgtctcgcaatttacacgtaatatgtgtaattgtttttttcatatattaatattctatatatttattcaaatattcgatgtgacagtgtgaaaatctttattttgaaaactaaacagagcctaaacaggccctgaataagagatggatgggctagagatggcagcaacagtaaactttgtctttggtctcaaaaggcagcggatgtggacctgaacccgcccagccaggacataggtagtaatgaatgtaggcagctcaggaagtaatatctcgcggactgtggcatcattacgcagcttcaggcctccttcagctgatctattgaagtagctgagtattgttacgagcttacggtgcacggagcacctgcgttttgatccatccgcctccgtcaccggccccttcctcgcctctggctgactgtgactgactgactgcctttcaattcctccgtatatggagacgtcgcagtgggagctggcttcccaaatcgctaggaggtcagctaatccagcatctttagggcaaaacagaggaatcgcaggttagaaaaaatgaggagtaggaaaaatacaaaattctgacaggatttgaagggtaaaacagaggattgcaaaatatagaaaaaacacagaaatggtcatttgattggagcgcagaaaaaacgtaagaatcggatgagagagatagactcaaaggaaatttttcaagacgttagagcacttgctaaatttcctccaaaatccacatgcaatgtgctattccataggaatttcataggatttggaaagcttcaatcctttaaatcaaagggctaaataggaaaattttctataggatttgaatcctatgaaattcctacgtaaatcatttgattcagagggacccttaagatatctaatatacctatacactgtacaagcacgcggtccgaggggatctgtcctagcaaaatactgtagcgagatctactcccgtactacggcgagatgaatgccttcttgtcgagaagcaaaatttgcacggatcaagtatagcttgagcaatcccgggagctcagatcggttctcctaacggctaacggcaaatatgtgtgagctctgtgagcgatgcgtgctggatttttcatcatttgattctattgaaattttctttttatatatagatcctaaaaaattttattccacaaaaagacatgtccccctcaccactcccccccccctccccccttccccctcaaccgaggaaagttaaagtcgctaatacgaagaatgactataccaatatcgttggtcctaaggacctatttgtaatataaaagaatctaattgtaataaaaaatatttacaaatacatcctcagtgacacaacactatcgtcgatgatgtatttgtaattttttttacaaacagatccttttttattacatataggtcatttttcgaaaagaaaatacaaatatatcatcggtgccaatgacattggtgtagcttccatcgggggctagagggacgacgccaatgtcattggcgccgttatattggaccacgacgccaatgacatttgcgttatagaaatgatttcttctagaataagttttttagggtctacttatagaataagttttttgaaaaatcaaaaggtgaaaaatcaagtcaatgcatgtgtatgacgtcttttaaagccaagaactactgaactggttcattgacttcagaatagtctcttcagaataacatcagaggctagaacaatatactattaaaccaatgtagatgtggataattaatcttttttttgttgtttatgcgctaagagcaggtacgatagtaggctataagccagctgtaaacatattttaaagagataaaggaaaagagagaagagcaccgggctacagatttatagctagctgcagcacggattccaagacgacaagacgtaatgtgtgtatggcaggtgagactaggtattgatagtatagtaagcaactatggtatgaattggctattagattggctatagatgaattggagctagcaatgggctatactattaaacttgctcaaaaggactcactaccgcctatttgtgtttttgataaggaatggctatgtcacatttgataaaaaaaccctctcattttagtcattttttaaacgactcagaacgctttgagatcaatgcagcggccattaccttatcatctcccagccctctcccttcctctctcgcatagatccatgcgcaacaaccataccccccatgcaattgggctttgtccttggcccccagcctcactagcagcgacgaggttccctcgcctta

SEQ ID NO: 47800 - DNA, 10202 bp, Oryza sativa
ggtcggcgcgcacgccggtgggtccgccgcggagggggcgcagctcgaccgggctcgccggcctcctcttccctctctaccgcctggcctcgccgccgccgccgcctcctccgccgcaccccgccgccgctcgcctcttccaccgccgccgcctcgcctcctccgcgagcagtgcgagctcccgccgctgctcgcctcctccgccgccctgccccgccgctcgcctcccggcgctcgctgcctccaccgccgcctcgcctcgccgccgccgctgcctccgtcgtcgtcgtcctcgctgtccccgcaccgtccccacaagccgcgagagagaaaaagcaagagagagagaatagagagagaggaagaagagaatagtatggcatgcgggtcccacaaatttttaattaaaaaaagctgaccggattgccacgtgtgcgccacgttggacaaaaccgctctgaattggttcgaggggggtaattcgtccggtttgcatagttgggggatgaagaatgtccgattttgtggttcaggggggtaattcggacgaccgcgatagttcggggaggtaattcgtactttttcctaacttataaacgggaacggtataaaaaggcaaattttccattatggccgtgtttagtttctcctccaaaatttttttacgtatacgtacgtatatttgaaatattaaacgtagactaataacaaaacaaattacatattccgcttgtaaattgcgagaaaaatttattaagtctaattaattcatcattagtaaatattgactatagcaccatattgtcaaatcatgggtaattaggctcaaaatattcgtcttgtaatttacacgtaaaaactgtgcaattggtttttttcgtccatatttaatgctctatgtatatgcctaaacatttgatgtgacggaatttttaaagtttaaaggaacacagcctatatttgtatcactcctaccactaaaggaagagatagtctgcatagctgaagtctgaagattatggtatatggatgatgaaacgggtcgacggccagtgagaggtctacagcgaaaccataccacctgttatctccatctattttatattctgaattaatattcttaggcccaatttttttgaccagtgaactgagatgctccttgatttttttttacacgtttcaaaatgcgctaaatgttgtgttttcttaaaagaataactttttatatattgaagtttatttgaaaatgaataaatcattttttaagtttataatagttaatccttaattagtcatgtgcaaataacctatcacgttttatgtgccacaatcatcttatcgaccaggctaagtcgaatggagtcttaactttgaccaaatttataaaaaatactttcctcttccccaatcctccctcttcatgggaagctgtcgcctccacctggggacttcaccaactagcacacactagagccgacgccgtggaggaagtcgatggtgcagaggcgttggggagttcatcagccactgccaccgctcgtcatccctgagagcaagttcaatagtatagccaactactagctccaattcatctatagccaatctaatagctcattcatacaatagttacatactacactattaatacctggtcccacctgtcatagacacactgcgtcttgaagtccgtgctacagctggctacaaatctgtagcccgctgctcttctctctcctgatttatctccttaaaatatgtttacagctggcttatagcctgctattgtacctgctctgagagatggggatgtgaggagagaccaggaacacgatgccgctaacatgtgggtctcacgctgactcatcaagttgaacgcagtcaactcatcacatatatgtgagtcccacaagttttttattttcttttcactaactagggtgccacgtcagtgtatgctaccatgaaaccaaatttaagatggttttgtaagttggagggtgtcctgaagaggataggaaaaagtacgaattaccctcccccaactcaaatactagacattttacaccctaaactatttataccggactaatgacctctcctgacactgttctgagcggttttgacttgagctagcatacgtggcgctaacatggcagactagtcaggaaaaaaagtttaaaaacccctggacccacctgtcatccctctcttcaacctaacctctcctagccaccccccccccccccgcgttctctctccatcgcgtgcgttcactcggggggcagtggcggaggtgggtggagcttacttgcgcggtagggggcgaaggcggaggcgagccggttccccaattctggtcgtcggcgccctcttctcccctttggccgcccgcagaggaggcagccggagctcgctcgggagaggcgtgtcaaggtgggcggagagcgattgctccatggctccggcacgctcccctactgcactgcgctcatcgccgtcttcgtcaagggcctcatcttcctcttcatctctctcttaagcgcacatggcgcgcatagcggcgcggggacaggcggtggatggatggtcggctcggatgggcggtgtgcggggacaaggcatgggcaggcagacggtcggagcggacggctagtgtgcgggggcacggggaagacaaggtggcccccgcctgcctctctgtcatggccctgcctcgcccctgccattcgccagccactcgccacctagctcctgcctccacctccgcgtctcgcgtcaccgcccacctcccaccgttgcgccgtcctgtgagagagagtgtgtgtgtgcgcgcgcgcgcgtgtgtgagatcagcaggaggtgctccatcccgcgtggcttcactgcgctcctcgccggcaaagtcgcggcacgcgcgccgctgtctccgggtatggcgttcatgtacgtcgctgcgatgaaggaaggtctaatgcggcttctgctgcaaccattgttcgccgcagtgctccccacttcgagcttgtgccgagccagctcacgcccaattcatgacgcctcctcgccggcttcgccgcactctgccatcgcgtcggcgtcgcgccgctgccgttgaccgtgttccggcacttcttcacgacggtcgggtgctcgcctggggcttggtactccttccgcgccgacccatgagagagagagagtgtgtgtatgtgtgtgtgaagagagagagaaagaggggaaggggagatatgacaggtgggtcccacaactttttaaaaagaaaatactgactggattgccacgcgtatgtcacgtaggacaaaaccgctttggattgggtcgagggggtaatttgttcgttattaaaagttcagggtgagcaatgcctggtttttgagtttagagggtaatttggtcgaccacgatagttaaggggtgaaattcgtactttctccgatgaggatacaatttcaaactcgacagaatgataagagacctaaaatgaacttattgctaaaacaaaactaaacagagttagatttctatcgggcttactaatggttactaggcctatgggctgatttaccggcctcacttcccagcccgactggcaacaattaagcccgttaaccatccgggccgtaatatgtgaattcaccactccggttcggtgatccgggcccaatttaccatttctaagttgcaacactgaaaatattttaggttgcagcgaggagggttggtgaagatcgaagaaataatcccccggtagggagcatatcgctcctccgctgctgtctcgcgcgagcgtccgccgcctcgtctcggtgaagaatcgccgcctcccaccctctgcgagcgccgccgccctccccaactccggcgacgactattcccaaggttggtgtactcaccccccatcccgtaccctcctcttggtcctaggtttattaaagattgttagtaggtctctaaatctgcatattcgccgtcgatttagggctgcgattagcttgtcttctttaaattttactgtccatttctaggctgctaagctacagaattaggggcgatttgtgagctcgtcccttggtagttgatacggtttaatatggtgtaggattctggaatttagttgttcctttgagccggttacatgaattattttggtttcatcgccgtcattggatgaaatacttctcatcttattgacgtttatcgttgatctttcattgtaaagttgtgagaaaatggaatggcccgcctatgataattctttggtgtcgattttcctatgtgattgttttgcagtagatagtttacggtggtgtttggactcatcatttgtcattgtttgccaatgcaaacctgcggaaatagtctgcatcatgtgagttatatataatgttacagatcacaaattgtagcaccagtatttatttgatttataatatagaatacaactaggtgcttccattatctcaaaaaatatagaatactactagttaatgtgccaaggccctgtttagttcacaccaaacttcccccaaactcccaactttccatcacatcacatcacatccaaaactttcctactcacataaactcctaactttttttccaaactaccaactttccccaaacttctccccaatttcaggaactaaacacagctcaagttactcctatgctttacggtattaaaacagggcaccacacaagtaagattttaaaacaagtactacagtaactctgatatctttatgtaccccttgccattgtgaaaagtgatagccacgatgcaaagttgcaaacatatgaaaaaaaaggatgtctgtgatgcgaaatatactcataagctagtggccaaataaaaaaaggagaaatttcatttgatttccatccaatgttttatggccttcctcttctgctgccacatgggatcccctagtccatgagccaagcttatagctatgactgttcaatgaacctggttttcaatttgttgtcaatccatttatgcttcatcgccagcatgttctgctgctgcagtcaggagtgatgctgcctgtagtggcctctgctgtggttttgaacaggttggctagcttgtttttgaataggcctacatataaatggaactctgtgtgatatgaataagtggtggtatctcagacgctgtatttgcatattctggttgaggttcatctatgccctattactcttggtagatgggcttgtctgaaattaatcttgtttcacgtatgccgtttgagatatcatgattttcctttttctgcttgtagggtgcagtggaagtgtaaacagtttctgtggaaggacagaaaaggcattcatttgctaaatggcatcaaagcttcaagccttttggaaccatcctgctggccctaaaactagttagtttccttatctttattatttcctggctgctcctgcttatcttagatttctgtgtatcatttctgatcctggttatcatctctacttttatcatgtaaacatggaaataataaaggaatcaccataaacttgatacaagtctatctataatgtttattatttatttatttgacatcccttgtctgcattcttgggtatttgatactgaataaaccattactatggaaatgtaatcttgcttggtactttaaactgaatttttgtattaatgcaagcgccccatacctttgtatttcactataggaaattgtgatggatatctatcatttattgataccacctataacttatatgaccttaattattgcagttcatttctgggctccaacatttaaatggggtatcagtattgccaatgttgcggactttgctaagcctcctgaaaagatatcctatcctcagcaagtcggtatgtttaggttaccccattagcccatcatattcattcattccagatatcagggccatatcggtttgtttatgtattcttgtgcactgttagcattcttattctgttggatggcatgcagctgtggcttgcactggagtcatttggtctcgctacagtatggttatcacaccggtaagaccttttttacttgtctatatgcacaccatgttgaaactttccactatagtgatcatgggccgctttgtttgcaaactacattttggtttcaaattgaacgtatatactcccattggtcacaaatacatgtcattgcagacaaacatgtgtttcaccttttaaaacattaagcatcaatatgcttgataattatgcttttacatttttctaaaaagaatatactttagtgaaattgtggttttagctagtttattactaaattacaaaataaaagaaaagaaaatgaaccatccagtttacattttgaatattttgcccatgcccaaaatgatgtgtatttctggccaaagagagtattacacattgaaataatttgagttttacctatgtgagcacgagatgttgtcatcacatgttgtttcctgttttaattcttgctcttcgttggcaatgctataatgtcacagaaaaactggaatcttttcagcgttaatgttgcaatggctggtacaggcttgtatcagctttctcgtaaaataaggtttgtatgagagctatgctaatttccgccattcgtatttaatgtctcataagagcaacataacctttatattcacttgcaggaaagattacttttctgatgagaaggatgctgctgcatcactggaaggataatgacgacagattagattaaccgacctacagcctttgagccagtctcagttcactctggagtctggacgtactgcagatatctctggctttacccaagacaagaacctgttgtttctttctgtatttcttctacacccactgctggagcagttgaaaatattgtccccaaaatccaaataatgcttttttgcattttgtgaaaataatatgcatatactcaaaacatccgtttctgttatgctggtggtgcccattaaaatctgtatcggggatacttcgctaacagtagtcaaggatcacttctgttatcatcagaaagaagctatatatactacagtttcccctggattcagagtagcgttgtctttgctggtagaaaagcagttttagccctcgacttacgttacctgccatttcttactgttatatttttgggtacttgttggttttgttgcagtggcttgcgcaatcaagcatgaagtcgttgcatagttgacagcaactgttcgaaacatatataaagttgttgtggttaatcagaaatttgatctttcagagaaagaaatggagattgtttacaggtttgttaagcggcacctttttgaacagacattatccttttagagcaccaatgtgtttggttggtagtaagtggtttatttcgaaacagaaacagcaagttcctcgcagcatgagccttctccagttgagtgagtttggcattttgagagggaaagagggaggactgcaaagttgctgttgaatgttgatccatgggctgtgtttagatccaaagtttggatccaaacttcagtcattttccatcacatcaacctgtcatacacataggggtggacaggaagctcgtggctcgttagctcgctcggctcgtgacaggctcggctcggctcggctcggctcgtttgaattttctaacgagccgagctggcatttcagctcgttagagataacgagccaactcgagctggctcgcgagccgctcgcgagccttaacgagccagagcagatgaggcccaggcgcctagcccagcctaacagcccatcacccagcccatcaccttgtgaaaaccctagagtcaatccccttctggcttgtccccatcctcaatccccacccaagccaccgccggcctcatggctgccgctcgcccgtgcctatcctccccggcgccgacgccgccgcccccgcctctcctccccggcgccgacgccgccggccatggacgccgccgcccgcgccgctccttcccgccgccgccgccaccgcccgcgcctctcctccccggcgccgacgcggccggccgtggacgccgccgctcgcgccgctcctccccggcgttgacgcaaccaaccgtggacgccgccgcccgcgccggtcctccccggcgccgacaccgtcgtggacgccgctggccgcgccgctcctccccggcgcccctcctcggctcctccccttgttcactttctctcttgtccccaaagctcacgagcctaacgagctggctcgagctttcaaacgagccgagccgagctgggtttctagctcgttaggataacgagtcgagaagagctagctcgttatcctaacgagccagaccgagccgagccgagccgagccgagccgagccagctcgacatctacccctacatacacacacaacttttcagtcacatcattttcaatttcaaccaaaatctaaactttgcgctgaactaaacacagccggtctggttcttttgatttttgaattctcgctgtagtcaggtactccgtccatccaaaaaaaactcaacctaatatgggatgtgaagtctgaccaaatttattataattatgtcacatctcatactagtttgggttttatggaacggagtccatactcaggtccagctcccctttcaaactaggcaggcacgtcattgcagacctgcagttgcaggtttgctgtaaaattcctttcaccaattgggcaacagatccttgtcaatcgccatttgattagccatgggccctgtttgatccggagggctaataattagctcttcggaatcttgttatttaggagtattaaatttaaattattgacaaagcccatttcataacccctaggctaatttacgagataaatctaatgagcctagttaatccatgatttgctacagtgatgctacagtaatcatccgctaatcatagattaatatacctcgttagattcgtcttgcgaattagcccaggggtttcgcaagtagttttgcctaggggttaattattagtccttcggatccaaacgagcccatggttagctaaacgtgcccaggtcaaatcttttactccctccgttccaaaatataacaacttttagccttcagtatttgtaccaaaatataacaacttctccaccaatattatcttcccaaccaatcacaactctccaccatttactttttctacctacctcttctactcatctaatcacaactctccaccattcacttctacgtatttttttaataaccgtgtcaatctctaaaacttcttatattctggacggggggagtaacatgttttacttggaacccactccttttgtaatgacggcccttcaacaaagtgcaaatagtgaactaccaaacaaacctagagatggggcacctaaatacattgatctctcttatccgatatataaaaaaatgcaagtcgtttcaggtgcatatgctctccaatcggcacatttgaccattgtacgctactagtaaaaaaattcaaaaaaataacatttcgaaagtaatatttacatacaaatctaccaattattttcatacaacaaatacatatatctattatattaattaagagagagcgaaagaagccatcacttttttgatctagatacacagaattgccactttaatcaaagaaaacgataaagatatgaacctttcgactatgataggttgaggttatacaaaatgggacgacaaattaatttcaaacatgaaaccgtacctgcatttatccaaaccccaacaaattaaaattgatagggccctcgcctatccattgccagcccctgtcactaattagtggggttgttgcgacgtcatgatctgatgatccaatcatagggcctgaatcagacggcccagctcaatcattacacgctctctttcggattgggttgtccttaagcacaatgcttaactaaactaacctaaaatttgttctctctaaccatctggagaacatgccaagcactgacgcatgcacacacttcacacattgtggagttaggtatatcattctcaactaaactactactcttttagtatatcttttaataacaagtcaagagaaaagaaggctcatgaacatttttctggcttgtcaattattttgggaagctgcactttcttcatgcccatgtgtatttccagg

SEQ ID NO: 47801 - DNA, 726 bp, Oryza sativa
cggccacaagattcatggtcggcgacaggggatcaatgtgccattgctggcgtccttctgttgtgttcttgcggggagggtattttggctatagacttatagtataactgtgttgaacaaaattgtgatattttctgtggtattaagggtgtgtttagttcacaccaaaattggaattttagttaaaattggaatgatgtgatggaaaagttagaagtttatgtgtgtaggaaagtttggatgtgatgaaaaaatcgaaagtttgaagaaaaagtttggaactaaactcggcctaaagtgtacactagccctttcacgtgtataacttttaggaaaaagtacgaattaccctcccgccccaaactatgacgacaatatgaattacccccctaaaccacaaaactagacattttataccctgaaaaccggacgaataacccccccctcaaccaaatccaaagcggcatcgtcctacgtggcattcgcgtggcaatccagtcagcaatttttttttaaaaaaggtggggtccgcctgtcatactctcacacatctctcttcccctcttctctcaatctctctctctcactgtctcggatgtcgttgggggcgacgaattagtggccggcgatgggcgcgcggccggcacaaccggcgcggcgggtgcggcggacggcgagcgcggctggtggcgggcgtggcgggggtgcggatggcggctagcgcgg

SEQ ID NO: 47802 - DNA, 1619 bp, Oryza sativa
acgcaacgatgcaacacaaaactcaacaaagcaaaaactgaaagaacaatgaaatggcacaaatatagctaggtacaggatgcaattttttttgtatggcaattttccggttataggtagataaaaactcaccgggcaacgaaagctctgataccacctgatgaaccctgagttccactcgacacttatggctgttgttggcccgatcttttggtgagttgagataactacgatttgggagaaaagttgacgacccgactacaaccatacaagacgttgcgttgcgctttagtgatcgatacacctctccgtgggttgttgatcttgccggtgcaaatcaaccctattcctgcaagcaaatcgaagaaacaagaaagaacaagataaaagcaatctgatattgcaaatagtaattgaatacaaatgataagatgggattctgaagaacaagcagacggacggtgtagccgacatgcacgctacaagcaagtagcaatggttaaactttaatctaacaaaacccgagaaaccctgaaggggtacctagcaatttaaagaggtgggaggacgaccaagaggctcctagggtcgtgctccactagattggggtgcaccccagatgggcatcacttgggccggcgtcctatatgaagttacaagcccataggcccattacaggtgtcgcaccaacttgtttcttcaattgctgccgactgagatggaatttggtaatgaggctggatccattggaaagaggactccgagagctttccatcaagtactcacggggcaaaaacggaggtcgtatacagattcggtggccgtttgaagtcagcagtgtagcagttgtacgaatcggattccagcacttggaggacttgatcttgatattttgttgttcatccatgatgtgagtggtggttgtatccatagtagccatggtcacatcacatatgcataccacttcccgcccaagtctaaaatcatattttatctcattttatttcacaaataatcagagaatcacctctgtccataaagttcaaaagggttttcaaaagtataataagtgatccataaccatgtttttatttattactaagctaggctaagcatttgcattttgtaaaagtatagtatacttatatgagcacaattaaagtactctcataaatcctaaggttcaaaacagcaaggggtgattttcaaaaggggtttcatgcatgtttataatcaaaaatacacgtgcagctttataatcaaagcatttagcccgaaaacataggattcaaggaagggcaaaacttgccttagaatatatatgacctaactgagtttagctataatccatctccttcaccggtaacgatttcgccgtctaaaagaaataaaagtaacgataaataccaaaacatgcaataattcaaaatgctctaaaatgcatgagtttactagtgtgattaggtgctgtgtgggtaagatttgtggtgaaggaatttatattttatcactttgcatttgggagttattaattttcaaagtttaatactagcactagattaattaagctctaatagtacatagatgcattttaggtctaagttttatgaaatgctggg

SEQ ID NO: 47803 - DNA, 837 bp, Oryza sativa
aggaccattagaatgcatgaagttgatctccagaagtctatttaatcaagctgaagacatcctaagtctatttcaccgaataatttagtattagtcccatttaagtttctactggttgctttagttctcatcatgatattatgtcagcatttcgtgagaaattttgagcttcttgttgagtgcaacatttgtttggttgtaagacttctgaataaatatttcaatatcattgttccttaatttggtttaattgagatgttattttttttaatggtgttcgatgcaaaataaaatttatatttcattaatacaattgtcacggtgaaaaatagtagtggtcctgggagtataagttcttgtgatgaaaaattgtcacacatcttacgtggcctcacaaaaaaaagattatttgtgataaaaaattaacacgaactattcatttgtggcgttaaacacatcactattaatcgtcctaatcaacggaaatggtatagaggtgagaagaaatttcaccacataaaacatcaaaagtgacagtaacgctgccacagatctaacggaagtagtggccatataaataatcacatttgtaaattacaatagtgacaattttatagtcataattatatactaaacgtggcaatttttggggccacaataaaaatcttaagtgatgaaactatcaccactattctaaacatatttgtggcggcgtatgtcgtctctgatgtaactattatcagtgataaattttaccatcactaatatttatgaatatttgtggcgaacacaaaatcatcactatgttatttggatgattaccagtggcgactagtg

SEQ ID NO: 47804 - DNA, 12498 bp, Oryza sativa
tccaggaatcagccaaggtacacaaactgacaatttaatatacaaatccatcataataataacgttacatacttacaaaagaaaagaaaacagcagcggaattaacggtctagcgatggcttcagctccactcccacaggcagctcaactggtgtataagccaaatgtcttctccttttggatcatttttcttcaactaaggttgattgattattgcaagaatgagcatatgacatactcaacaagccacacagcaaatatgcaagtgcacaaggataccaaaggatggcataatataggctcatttgcaaaagcagcatttagcaaatatttaagaatagtaaaacagtagagtaatcatcaattttaatcaacactgaacagcacacccatgctgctcaggcccaaccattctgaacaaccaaacccggctgcacagatctaactccaaaccaggagctaaacaaattattaccaattatagcatcaataattattgtgagaggtttgagactaatcacgaaaaacattgctcaacccgcccatgaccgcgggcacggctattcgaatagttttactctggccagaggtgtaccactgtacccacaagacacagccttgacatcatgtctaacatgcgtcgcgatactggaaagtacccgaatagaggctgtgacaataccctctgcacaacacaactcaccagagtgcaccattcctggatcataatcaccccctctataaatataaccagaggcatggactccccagggacccccacggacttctcgccgcttctcagtctggcaccccgcaatgaatcatgctatacaaaaggtaaagccgttgcccacgctggcttgtggttgatacggttaatgtctcacaacagtagctagcgaaccggtccttaattgtcatgagcacgaccttcaaaaccatgtgctcacaacccaccattgtcaagttttaattatcaattaattatcataacacgattaaccatcgtgagctaccattaaatataacttttggtgtaccttgcctcctggtcgtcaccatctgaaaatcccacacagaaccagcaaacagagagagctgacaattaaagctaaccacccacgactaccataattcttgaatttattactgctattaaattggttcattaaggttcaagtttcttaagcaaataaaataaagacaggctccaacacagttataccacacaccggcataaccatgccccatacgactctagcagaaaaacaaacgagaagaacacacgtgcaagcctactaactgctcgtctactgctgcgatgagccagggcggaaggtgagcagcagcgcatcctccgtgctgccaacgccagaggctccctcctcctgaggaaccacgggggcgggctcggcacgaggggtctcgacgaagcaggtccacgctagggactgacgaacaagctcgggcctggaggtactcttgcgggcggtgatcttcaggctgtggcagacgcggcgacgcttggggcgacagacctctccctgggcgatcttgagctgacgcagctgcgcctccactgcgtctaggtccttcttcagctgcagattctcctgacgtagctccaggatcttcatgttgttctcaaccaaccctcgacgcatcatctgatggaagtcgatatgggccgcgtcgtacgcctccaccatgcgcgccaggtgcatgatggtagcgtcatcctccgagctagcatcccggaaggtggcgtagtcgcgggctcctccgcgacgagggtggtagcggtagggcgagtgctgcaactcgtccgggtagcgctggtgcagagtgccgatggcgaggagtgcggcgttctggcaagcggcggagaaggaatctccacccgcggtgactgccaacgaaatcctctcgggtgagccagtgaggatcactgcagtaacctcccaagcagcgtggggctctgcatcgtcaccctcctgctccgggagctgcttgccctggtagtccactccatgcagataccccaggacaacgcacatgccccgcagctccaaaacgaagccagtcaggtgcagaccatgacggttgatgctgccggccatctacaaacaaaaacaaaagagaaaagcaacattttaaaggtcagattttgacgataaatgaagcagcaggacagagagagactagaggattttcacaaataagaaaggatttttattttgaaaatattgctaaggcttgggatctacggctcgtcctagggtcaagggggctctgataccaacttgtcacgatcggaattaacccaacgggcgttccttacgtgcgtgtattattccttgtcccaggaggcaaggtacaccaaaagttgatacatttcagagtttataaagtggaagcgtaaatagttaatttattacatgggcggcgaagacccagcacacacaaaaacaaacggaaaacagcggaagactagggcgacgaccacaggcgcttgacggcaggcttttgtttataaccagactgagccacaaactaagccttacctactagacatgtggaagtacggtagtgctttgcaacagaggctcgaagaccggtccttatatggccgaggtgctactatcaaaaccatgcaccccgagcccagcctaaaaccattttgaggattttgaatagagggggaggtgtgaatccaatttccacaataatcaaaccattccatagtgtccaggtgatatgaatatcccaaagtctagagttgtaaaaccacctaatgttgcctaattaaccagcgaagcatctacctaaaatcatactagtggtaccatgagtagagtgtccactagttggggttttgtttattctagggtgaacaaggaaataataacaataacaataataaggtcataacaaaggtaaataggcatggctagataaaatagtgataacgcgggaatttaaataaagcgataatgcaataatttaaatcaacataattttataaactgggattcaatatgttcaaggatgatgtgacttcaacttccacgaagagcggatcttccgaagctgcagcgtctacacgaccaacggaaaagaaaaggcttttactctaataaactccatataacaagcaggaacaaagcacaaaaaaaggttcttgacttcttaaggaaaaattagagacttgaacggtctaattccgagttcgaatggccaagttatggccatttgaagtttatatgctctttaaatgaatatttgcgaatttcttcatttaaattttaattttaaaagggtttattacgtcagccgaggggagggggcgcgcggaccgggtccacgggagtggggcccacgcggcagcctcacggtccacggtggaccgggtgcactcaggctcacaccggccggcgccgtgggtcccacgcatgagccgcacccgagggcgcgggcggctgacggccgggccccacgcggcagccgctcggtgcgcccgaaggcggccacgtcggcgcggccggcgggaggcggcgcgcccgcgcccctatggtcgccggcggcggccatgggcacatcggagcggcggccgagagaggggagggaaagggggaaacgaggcggcggtccacggctcaccctaggtcgacggcgacgacgaaaaggcagccggagcggaggaaggcggctgcgcggctcgggtcgacggggacggcggcgctccggcggtcgacgagcgaaacggaggggtggacgaggtcggcgaggatgcggcgaagccgaaggaggcggcgctgaggtgggaggtggtctggggcgacgacggtggtggaccggagctcggcggcgacggcggagagaaagcgacgacgcgagctcgattccggcgaggaggaagggcggcgagaggcagaaacggacggaggaggtgcggggagggtttaaatagggttggaagggggggagagagcggccggcggggaaggaataggcccgggaggtccggccgccatcaatggcgccggcgagatttgcgggggcaaatccgcccgtttgaacgcgagagagagagggaaaaatggggggaaagggagaggggatcacggggagtgatttccccctctttattgcacgcggggacggcgggaggcggcgggattcacggcggcggcggcgctagggcgcgggagaggcggcgggaggaaggggatgacaggtgggccccacccgtcagcgagggtggcgggcgggcccgcccgtcagcggcgcgcgcgcggggagaggctggatgggccgcggggagaggagagggagggggagggagatgggccgagccggcccaagagggaaaggggactttttagagtttttgtttttataaaatcattttaactttgtttatttcttaataattattatttgtgctctgaaaattccactaaaattatttacgcattttaggcttttaggaaatatacaaaaatcctccaagccttatttgacttttaaatttgcacattttaattgttggaggctttcacacggattttaattattctaggcataatttagaggatgtattttagagtcgttttgggacgtgacattacttgaccattcaggggcccgaacctgtataaaatttctgtctcgatctgttttacctcaatctcgcatatatcctagtaccaacaatccccatactacgcaaatactggaattacgacatcaaatgtcgacaattgtagcatttcaccaggaaatattctaaggtatcatatttatttaatcccaagggaagatatgataagggagaactatgctaatcatttatatattacttgtatatatcaaggtctatgtaggggttaagtagttcaaagggtaggataaaggtgacacacggaagaaagaactaagatattctcactaaaatataacctaggctaactggggatatgaaaagaaaagaatcaatcctatacttctagtatgcaaacatccttagtttacactcgctggtatacaatcatggaaccaataccccctaacagtgctctcctggtgtttcgagagatcacccttgattgcggagttccatatgacaacctgtcatggccatccaaccggggctaaatacggaggagtaccctccctaggaatgtgccttaggaatatatactaacatggaggaatacccgtaccgagctatcgccatcagcggcccatctctattgtctgcagcatatatgcccagataataatacttaataatccaagcaccatgcttagattactaaatactactctacatccatgaatccgacatagagcaaccgagttctcggacattaaaccctcaccaatgcacctctctgataagttagttacacaactatatcgacagaagtataaaataaagtcggtactcagataatataaagggaataaaataccgaagatgtataaagaaaaatattctattaattaaataagtcttagaaaaaaagagaggaaagttactagagccatacccgaaatctcttgaagactcgaggactaagaaaactattatatttcctactccactagcagtagagctctactaaacttgagtgagctctttgatcttcttcttgagtgtgtgttgtgaagcgagaatgagagcttcttaaataggcaggtatgacggttgtagagcatgcgaattgtcagaaatgtcgcgcaactgccataggacgtcatccggagcgtccacgccaaaccccagcctgaacggctaagacgggggttcaaccgaaccatgggctggcccaatcggccaaaattttgctccttacttcagtgacgtggtgtcttgggatttttgagattgtttcactggatttgtaagcccatttacctataagtctaactctcgacgatgtttgattgattattcaattattttccattgattctcctacattttatgtagaagtgaaatggatattatttgcttgcagagcaatggcaagcagagtgcaagcaaataatatccaagtacaagtggaaatagattattctaaagcgaatatgcattgcaagcatagctagttctcctttattttagttatattgacggtagaaattggcctataacgactgtcaaaagttatacaacatacccattgcatagacccaaccaaaccacctgaactaaactagtttgtcaagtcaaattattatggtgaggcaaatcacggtgaatctggttgacctcccataaccgagggcacggctatttgaatagttttactctgatcagaggtgtacaactgtactcacaagacacaatctcacaacacgttaccgtgttccgacatgccaccacgacataccggattgtgactatgacaggacccttcgcacacccccctaaccaatcgaatcacaccgtaggtttcgcccccactcctcaacaggcagtgggcagcaccctctcgtgcctaggtaaatccgaaagcagcttagaccatcgcagggcccatccatactccatcacgcccacccttgcccgggtacgtcgactaggtcaaaccacactgcaagtccagccgttgcccacgctaacttgtagtaagtatgggtaattcttccagtgtttcccatgaaccggtactttatcgtcatgagcacgagtgcacgaccatcaagaccatgtgctcacaaccgaccattatcaaatttcagttgacaaattatttaattaaccaaacacgattggccatcgtgagctaccattaaatgtccatcattaagtaatagtgaagcattaaatatcccaatagtgtgctaatgtttctaatcatgactaagcaattatatctaatatctagctgaaccaatatataaggcctaagctagtcaaattataacccataggaaaatataggaaaaagactcacaccacccaataacattcgaaaataaatgcacatttgaaataaatagagaatttaaatataggatcaacatgctcaaaggattgtggttgggatatatgtgacttgccttgcaaacaagcatcttcaattcgtctttaggaacttcccacgaacgagcaatccttcaaaacgactacaaactaaacctagaacacaaaatgaggaagaacactaataaaaccaaataaacagtataattaaaagtagagatgaatttagatgaattatgatacttgaacgacctcattccgagttcatatgaattagttatgaattaatgaagttttaatcaattaaaacctataaagaaaacaacctaaatgatttatggcatcatatagaattatttttgtactgataaaggaggaatatgacatcagcgaggagtgagaatggactgatgttgctgacaagcgggacccgcatgtcatagagacaagcggtagaccgggtctaatacgaactcggttcacagagaggtccacgggtccacgggatggatggctaggatttcattgatcagactttgatcatgatccgacggatgagatcgatccgatctagggttttgaggtggacgccacgcgagacaggcgatgaagtggctctgacgtggcatgccacgcgggatggacgccggcggctctagatgttggcgacagctgcgacttcagcgcggcggcagacacagagggcacggcgaggaagaggagaccgaggtaaaccttaccagcacttacgcgacattgaacggagaagtacggcgactggcgacgagcttcgagcggcagtgagatcgagatgatggtggcggcgccaccccagtgaacaccggcagaagagaaggggtggacggccttcccaaggtccttgcgaaaccaacggaggagacagcaaggtccggcgatgacgggtggtgaagcggcaaggcttcgccggagatcaaaacaaggcggcgagctcggccttcatggtgagggtggcttgcggggttcggcgcaggggagcgaatgtcaggggtggagcttggccttgcggagccgagggaggtggcggcgcaggttggtgacggccgaggcgacggcgaacgacggctggagttggtggcggcgacggagagagacggagctcgcttggagaggtggctaaggcatgggaggctcgggtaaaagagggaaaagggagaggaggtccggggctagcaatttatagcctcaggaagaaaagatcggatcgggtttgagaggaatcaatgatggaaaagctatggttcaccggataaacgatgctcgaaatcgtgtagaatccacgcaattttattcgggaatcaaggtggtttcttggggataaggtacagcagatcaagacgattccattctcgcaaccaacttgtgaaaaagagtaatggggaggctggatttgacggaggacgcggcgtcggctagagtacacgggcactgcacgggctctgtccaagctggaaaacgacactgtagcaggagggaatgagtttaaacttttctttctttcttggaccggatgaaagagggaggccaattggactttggccgagagatggagagggctgcaggctcggattgggccggcgggagagagaggaaggagaagaggattttctttactttttaatttataagtaaatgctgaaatgattttttattccgggaaaaatccagaaaatacttggaaactcatagtatttataagaattttatctagcccaatttgatgctcaaatatttcatagattttattcaaacacttactttaattattacataatttgtaaaatttcctttctcacaacaatttataatttagcaatttttagggtgtgacatgcacctcctatgtctattactctttgcctggtgatctccccctctccctgcgatcatctcactcaaccatacttcagtgattgaacctaggattataaactctaactccaactcgaacccaggattctaaactctaactccaactctttgtaggggtcattggagcaggagaagaagatgtcactggagctagagaagaacgaatcgcgaagcaaatcctaaagttctaagggtgtgtttagttcacgctaaaattagaagtttaattgaaattgaaacaatgtgacggaaaagttgaaagttatgtgtgtagaaaagttttgatgtaatagaaaagttggaagtctgaagaaaaagttagaaaataaaccaggcctaaatcctctcgtgtttctcttgtggaaccaagtactacctccgtctcaatttaagtgcattgctaagtttccgcgtccaatgtttgatcgtctgtcttatttgaaaattttataaaaaaattaaaaataattagtcacacataaaatactatttatattttatcatctaacaacaataaaaatactaatcataaaaatttttcaaataaaacggacggtcaaacgttgaacatgaacagtacaaaactacactctctcttttttaggatgggtagcaacatatactccacgtcgcattcaaccgtatttaattcacaaacggatgggcagtagttgttgttgtcatgaatactcggagaaaacaagccatcacaatcacgaattgaagaaagtccttcatttcacatcaacttcttgctaataccttagctcttaagcaacgcggtcctttaaaagactttggccatctatccaggaatcatcaacacaaataatacaagcaatcatcagaagatatctgcataaaaatggtggcactagacttgagaaatcctccctccgccgccacgaccgtcaaggaggaccagcagttcaccatcttcatcgacggcgtggagacagccctccacgagggtgtgatccagtggaacggcggcacggtcactttggtcagcacgggtgtcctcgcggtcgaccgtctccagcacgtcctggtgcgcggcgggggcagtggtgacgtgagcttcacccggtgcggcttcgcggccgcggaggcctgcggggtcgcgtcgttccatcggtgcgacgccgtgcgggcggacggggcgcgggaggtggccgtgcgccgatgcaggtccgcggacgtggagcgcgccggcgtggtggccatccgccggtgcaagggcgccgcgcgcgtgcgcggcgcgggggaacttcacgtcgggcggtgccacgaggccaacgtgggcgggtgcgcggacgtcgcggtaggccggtgtcgcgccgcgcgcgccgactggtgcggcgcgatcggcatcgagcggtgcgggtcggcggacgtgagtcggtgcggcgccgtccgcgtggatcgatgccgcgccgcgtccgtgtcgggctgcggcagcgtagcggtgcgccgtggcaaggtgaacgtgatcgaacagccgccggtttgtcaagagaagccgatgtaccacctcgtccacgctgagccagtctacgcgatccctttggaaatatcgagcgagattaaattgcagtagaccgggcagtgccagcgggctaaaggtctgatatgctgatgatatatatgcgtgtcggtgtgataagtatacgtaatatactattgtaatataatgtgtggtttgtacggagtatatatgcacaaggattatacttttaaataaagggacaacgttgacaaatgtaagggtggattgaaaaatgaacgaatcgaaaagaccaagaccaccgaaactgaaaagacaagatcgataaatttggtcgggcattttgttcgtcaattcggttagtcttctcggttaaccgaaaagatctaattaaaaaaaattcaaatgcaaccaacaatccactaagtttaatagaattaaaacctaatattcacatcctactccttttagccataaaacccaataaaagtctttactaagacgtgcttgcgaattctttttgtgtgatttttgtgttaaaatttttttatgatttctttgcatatactacctccgttttttataatatggcaccgctaactttttgttaaacgtttaactattcgtcttattcaattttttttgcgcaaatataaaaaatttgaagtcatgcttaaaacaacatttgatgataaaataaatataatgaatggttaaatgtattttgaaaagtcaatggcgtcatatagtaaaaaacggatgtagtgtttaactttttgtttaatctcggtttggaccgagaccgaatttaccgatcctgatatttttcaattaaaattcggtcctcactttttaatgactgaactgagaggaagactgaagaccaggaccaaaattttcagtctgaccgaatgcccatccatagacaaatagaatacagataaaaaaaaacaaagtcatctattaactttgagttcttctgtcaatttgcatacgtaacatttgctgcaactcttttacaacaatggtcaaaattaatttcgctcactaaaagaatcgcaaaagaaatgtgatgaggactgaagtcccgatcgtccattatgtactgataagtccattgtggagactgaaccaagatgaccgaaccactcacaatcacaaccccaccccttcgttggttatcaactgtgccaaagcgcggtcgacctcaccgataaagctatctcctacaaatgaatcgagaacaaaagcaagagagaagaagaaataatatagatatattgcatatatacaattaagctcaccaattggggttccacaagccgaactaagcggcgaaactgcaacacagaataatctaagcaaaaccgcactctaaataatgatagttattgaataaatatgattagggttagctgtagggcatccacccctcgtgcttaagatgtgaccatggatgctattgagacaaccgctgctcacatcaagaacaaattaaacaagttctggaatccaattcaactgcctgcaacaatgttgatttcaaacgactgccacatgtgcatacgaccttcgttttgggtccattagtacttagtggaaagctttcggagtccgctttccaacggattcagcctcatctttgaattccgtctcgtttggccggaatcataggaacaaggtgacgcatcacctataataggcctatgggtttgtaactttgtctgggaccccggcccaagtagggcccatgtggggtgcaccccaaccaggtggagcacaaccctagggacaccaaggtcgtccttccaccttcttgaataactaggtacccgttaaggttttcttgggttttgtttagattgaagtttagccattgctacttgcttgtagcgcgcgtactaaactgtctgtctgcatgtctttggaacccaacttatcttgtgtattcaattcctatttgcaatatcggattactttgatcttgttcttacttgtttctcgatttgcttgcaataataaggttgacctacactggtgtcgacgtttgatatcgcgactacgtatttagatggtatgggga

SEQ ID NO: 47805 - DNA, 805 bp, Oryza sativa
cctcctagggggtttgtatttatacccatagataaccccttgtccaagtaagtatagggagataaatatggatatgatctgagtagtccttgtcgttttcatgtagaactcttcttgtccttccttatcccgaactccttctatatacgaggtttgtttccgtataagacatggtatgtggtgggccttgccgagcttagtcgattactattgggtatgtggtatccataaccctgacagtagccccgacttcaatgcaaatgaacgagttcatgttctcaaccgaagactttggaataactgttgtcatgctcgcttgaccgttctcggtgagatcagagatagtgctagattcctcttattggcctttgtaggcactatattggttttgtctaggttaatctctgatgtcgtccgagaagatacggaacatgcgactaagtctcccgtcgtgctgtaatcgagaatttggattgaagtcaagaaattccatctcggcgagtacacctttgcttcattccatattccttgtcgaactccagtagtcgttctcggataatcgagaaggtgcaaagtctgcgacaaagccttgaaatctgacttgactattctgatgtctgacttccctaatcaacattcgtcgtactcgcttaatcgatcccgctgtaagaccgtagagacatggagtcctcaacagcgttgaatggaattatcttgaaatcaattctcaaaacaaaatattaaatagagatagccctcaagcgaacgctcaagggtaacatgttctaatatgtatggaaaaatt

SEQ ID NO: 47806 - DNA, 6980 bp, Oryza sativa
cagcccctgcaacgatttgcatatgtgagcaactgacccggtatcaaatacccaagaatcagtagaggaagtagcaagattaatttctataacattaatacctaaggtggaactcttaccatcctactgcttctgcttgagctgctctaggtatttcttacagtttctctaccaatgatctgtctccttgtaaaagaagcactctgtatccttagcgggccctgtcttttcaaccttggtcttagagttgctagtactcatgatctcatcagagtttagctttctcttttgaccactcttcttgttgttgggcttgcacttatgcataaccatcacatggttggagtttttcttgatgctttcctcggcagtctttagcatcccatgcaattctgccaaggaactgttcaagttgttcatgttgaaattcattatgaacggctcaaagctgggagggagcgactggagaatcaaatcagtagccaactctcggctaagaggacaaccaagcttatccagactctcggtgtaaccaatcattttgatcacatgtaggctcactggattaccttctgcaagcctacacgcaaacaaggactttaaagtattaaacctttcagctcttgcttggtcctcaaacatgttacgtagtcccgtgattatcgtatgagcatccaatgcctcatattgcctttgaaactcaggggacatagtagcaagcatgagacagcttatatcaagataatcattgcatcgcttttcatgctcgctacgttgtgcaacaggagcattgttgggcaagtcagctggaaaaggctgtgtaagcacaaactctttgtgctcttgtctgagaacaattcccaggttgcaataccaatccatgaagtttgttccagtcaactcctctttctcaagaatagaccgcaagttaaaactggatagtgcaggagctgccatgatctacaatagaaatatatgtatgcaaaatcagcaccatgtctacatttaacctttcattaaacaatttaacaaaagatactcccattatgtattgtgaaacgaaattccctctagtaacatagtgagtcaagatcatcattttattagtgtctagtgagctttggcatcacagctagacaactatcaaaataggtaagcaacaccttgctaatcacatcatatgtgactcttatgctgttggggtgacatctccatcttcaacccaacctatgccccaaggtccaaaaccgtttcgataaccttgtcaagtaaaccaataatctccgcatatagatgtcagacatctatcctattttatcatgataaaaagtgatactttgctatggcaaacccatcacttatgatcacaaccgtaataggtgtaattattggaagagcataaattacacttaatttttctgagggaatcaatcctaccatgtcatatcaaatatacaacaacaataaagtaagatagatataaaaccccaagcaaaatctaaggggcaacgcacacggcggtcccgctatgattcgccatgtgaaaaccttaacggcgtaatcaaattatgccgaaaccgagtcaatctcattggctcgtttttctcattggcgtgcggttccagtggacatcttactacccgatgaacacaatcacgctcggccttggtgagtactagacattccagtgaagtcaccaacacacataccgattgatctcatcaacccatgcggctattggttcatctcatgttccgatcacctaagaactcatatacaacataatagatctcaactactacacccgcatatcaattatatgcagtgatctagatcataaactatacaaggaggctctgataccactgttgggatacgcgtaggctacgatagcataaatcaaaattttctatcgcgtaaaccaggaaccatgcaagtattagatcatagatcgttaccactcgacgcgctgcgcagaggaaaaaggcgttaagaagtcgaaggaattctcgcgaagtagcgcgcgtcgatgtagaggaagtagtcgatcgcactagctcgaccttctcctccttgtgtgttctcctcgccgtactcccacgccgatcagcaccgcaaaccagcggcgcctctactagtatccacacgtacagggacggaacgccacgcgcagatgtgctagcacccgcgtgcggctagggttttgctcagggagggaagtgacggctagggtttctcacgtgatgaaatatctccaccggtcacacccctcacgaatatatataggatccatcactcgggcctccaaggcacgtaggactcctattcggatcccaatccaaattaagctcatattgggtctccatccaatccccttatttcggcccattaagcgtgcgaccctgtaggttcatgtatactcggctgtaacttggaaactccttctcggtccacgcgccaatagcggcccctagcagaacgtattgacccaccgggcatacataaagatcatatcgactgaacctctagtgtatacttgtataaacccctttgtctcacgatatcgattaagctcaaggctagatatgtgccatcctctaatagctcaatcattcactcgaacctctcgatagattatataacttgtgattgactccttaatcacctttggcatggccatgcgcttccataatctacaacatcgaggggcccagagatatctttccataggaggggcaaatcccatcttgattattcatatcccaatacatgtttcatagcatactcgaaaactacttttataactatccaattacgaagtagcgtttagcagtccctaagtaagctactacacatgttgggaaccatgataatctcagtgtctcatgtttggtctatcaaacaacatgttcactaacatgtctccacattgttaatttggtatctatataccatgatccatgagacatgatcatcaattaatacatgtgctgatcatctaatcatatttgttccacatttgatatttgatcaggaatcctttaaaaatagtaacaaacaacataaagagtctcatgaaagaatcacatatttattaaccaataatgagtttatctatttcaaggaacaatgtcggataaatatgtaaacatagtataggatacaatcatctctatgattgcctctagggcatatcactaacaccaccatccttacctccaccaaccgccagcctccccatccacgctgctgcgcctggcagccgccgtcgcgccaagccaccgcgcgccgcgccctgccgcgccaccgaggtcggccgctggccccgccgtgcacacgccgccctcacctctctctctgttgcacatggagaagaacgagagagagagcagaccaggaagagatgagaaagatataagagagaggagaaagattaagaagaggaaataaaggagaatgagacttacatgtaggacccacagtggaacccagtcggttgacccctcactcctcttgacccacaaaccctagtgaaagtctatattggcccccttttactttagtatccttcatttaacaatcagacaaagcccaccgtagccacctcatactaaagcccacataccacatcccctatacaactcaaagcctctcagaaagtctaaaccacctcccttcccgagaatgctccctcctcggtttataaaaccttccaatttcgaaaattcatatctctccaaccgtaactccgattgactccgttcaacttccataacctctctaaaatcgagatctatttaatggcaccattagttgtattgaatgttgttttattttatttcttttaggattgtgcgtggatattctttggttatttattggacgtgtcggatatttatcgatcgcgggtattctagttgtccaactgtcacagacatctcgaagacattaggaacctatagcaaggcaagtccctacgctccattccttgaacatattgatcctacatttacaaatgtgttgttttacaaataaattgcatgctatttataaattgcgtacctacatttgattatagcctgccttgatattgttacccttgtacatattaatgtatgcctttgaatacccaattcatttatttatatacggtcaattattgacaatgcttagcaatgctattgtagacatacgtatactccatatttaagctagatgattacggatgtgagatcactcgatgtgagtgattgatgatttgcgggtggagacatgagcgccacccgccacacacaaaccttttgtgaaaaccaaaatttaatacaacaaaactattttgactggggcagcatgaatagaatatgggtgggtctggaaacggttagtcgccgaccctggtcagttaaggaccgagtcaggaagctatacaggaaacgaacagagtacgaccgcatttctcaagtgggtatagaccggcggattaggaagctctcgtggagcggcacctaaatcgggtaggttctatatcagtgtggtgatgagtacagtgtcggaaaggtaaaggcctagatatgaacttaaaatgaaccctataaatatatatagtaaatatcccctattccgtggagcgccaggactcccttcaccatccagcagtaggggtttggagtgctggggtgcaatgggggttcatagtccttggagcaggtgccgaaatgcgagagcaactgaaaagtcgggccgtggcaagtctcatgtgttgggactaggctcatatgttgggcaagccgcggggtgcgggattaaaagcgtacatccgctgcagtgtgagtaaaccaatctattcgaatagttgtgctcgcggttaatgagcgccgagacctgtagattttaatactgcttagagtagatatgggagagatgtgaaccttgcccaaatagtgggaaggttagtatagtagagttggtataagatgaaatgtgagggtaaatcgaaccaagcgaggcttggagaggtggatgaaccctggataattacaacttcaacaatagtgttgtttttcagttaaaactgctaggtcaatagatttgtgaaatgaattgtgaaaactagctttatgcaaatgaactaagccatccttgaaccactgtgtgcattagattcattttgtagtggtggcttactgtgtactcactcttacttaattaaatcttttagaaggagttggcgtcgattagatttatgccatgctgctgtcaagtacgtgttgaagatgatggattagggaccataggttcaccagtcgttgcttgtggagttcgatggaccgccgctgcttcgctttcccgttgttttatctattactttggtattttgtattgtaagtgaccatgcttggtctttttcgggacccaatgaggttacccttatattattactgtagaaacaccggtaaacgaagtcagttgtgatattatactgtgctatgtgtgtaccacctactgatccagggagtggtactgtataacacatgggattaccggtgtataaaaccgggggtcccacagatatagggtattatttacttaggtaatgttataaaatgtttttgctatgtgatttttattagatttgacttcacataggtgtagagatgtgttttctaggacttgcacattttggtttcataatttttagagttattatgaattccttatgtattttacaagttatagcgtgttacaggtgaatagttttttgtattcatatagttttgggacaatatgtccagaatgttttgcttcctgttttagttgcataatgtgaatgatttgttgaccaactaatttttattttacaccattgaggcttttagtattttgcttcgcattttataatttaggggtgctctaagtttgtaactcaatatatcaacctaggaatattgtatgtgctgagtaccataaattttggtaagagaggatggtgttgtagcttttctggttcatctaggatttatttgttttatttggagctagggtgcattctatataatttgcttaactagtaatatgtgattagcactcagtttattaatttaaaatttagagatatatttgtacagaaggtgccacatttcattttactgggttgaagctcactacttgctggttagatagaaatttagttcaatccatttgaatctaaaatgatttttttttacaaaatttccaagtttaagtgtgcttatgttgattgttccttatatataagtttaggggcttttcatgtactgtaagcggatatttctattttataaatctgaaatgcacaattttttgattctacagaacttgagttcatttaaaaaaggagtcaaaatggattttatacgactttccaaagttcagcttatctaaaaccaattattttgtagataatatttttagaggcatttggtgcaaagtaagtatatatttttatttctccttaccaaagagtgtatgttagtgaatctgtagaatttgagtttgtcccaaaatgggttaaattaaattttctatgtattttataagttcttacatgttttatgtttactttttcttagataagttttagatgtagattttgtacagtaaataccactttttaagttgtaacattaaagctcatcattttgtgaatccatagcaactggaatcatctcaaaatgatgtttttttattttatatggattttacaagtttaggtgttttcttgttaaaaagtacatgtttttttattttattttatattttcagattttaaattcccaataagcaaaaaggtcccgcaggtttcagggaatagatcccttggtccaaacacgtgtggaaagccaagtttattaagagtccttgagttttaatgtatttataattagatccatggtcccacatataagtctaacacattttacacttcaaaccttgcatggggc

SEQ ID NO: 47807 - DNA, 735 bp, Oryza sativa
agaagattcactgtgtttattactataacagaaatccttaaataatttattgcgcaatattttccagggctgacgtcagcacaggggaagcggcgccgacatgcggggcccaccggtcagcggctcgggagagggaggaaagggcgccggcacgcgggcccactggtcagcggctcgggaggaaaggggcggcggcacccggctcggcttggctcaaggccggccgaccggccgcggcgacggcgacggcgcgcgcgcgaacgcattgccggcgacggcaaccggcggcgaaggcgacggcgcaaaaggcgacgcgaaggcggctgcgctaagtggcggctaggaaggggaggatacggcaaccggcggacgagcttccgggtgccctaaggaaggagaagagagggattagatagagggagatgaaccacggcgaccggtattcacggccgaaagcggcggtagcggttgaactcaccggagcgcgaggggaggcgaatttcggcgacgaaactcgacggggaaggggcggccggggtggagcttagccttgcgaacccgacggcgaagacggcgtggtgcggcggcgaccctagcggcggctaatggcggccggagtagcggaaacagcggcggcaagaggttgcacggcgcgggagcgatgggaggctcgggagaggtcggcgaaatggggaaaaagcgagagggggcgacggagaagattaaattgggaga

SEQ ID NO: 47808 - DNA, 10324 bp, Oryza sativa
  unsure (1)..(10324): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngctttcgctcagggtccttggtaaggattgaatccctgaaagcggaaatatgcttgaaggtcatcgtgttgttgctgcatcatgttgttgatgttggcaaattgagcattagtagtctgttgtcattcttgtgtctgagctatgtgttccgtgaggttgtattggatctcccccgtctgcacatcaagggtgtccattctcctagtgatttcacccaagtcccaacgagaggaactcgagcgccattcacttggacatggaggtactccacttgatctgggaggttggttgtccccccactatatgtcatgaggcgcatgccaccggtcctcactggcacttgcccagcttgagacaccgatgttgtggcgtggagcttgggtccatccgagtgcatccccagttggttcccaacctgcctcatataatctgcacgggtgttgaggatgatgaactttctcgttcgttccttgccatgttgtgtgtgtccctgtatactccacctgcatgagattcttctatggtctgcaggggaatggttagctcacggcagttgtacaaatgataccccgcatttggtaacgggatttcattttgtcacgaccggaattaacccagcgggcattccatacgtgtgtgtattactccttgtcccaggaggcaaggtacaccaaaagttgatacaattcagagtttaacaagcggaagcgtaaatagttaatttattacatgagcgatgaaggcccagcacacacgaagataaacgagaaacagcggaagactagggcgacgaccacaggcacttgacggcaggcacgagctagacaccaaagccttcatcctccaggaactcctcttctgggctggggaaaaattaagcaagattgagtacaaccacctactcagcaagacacacccacgaatgcagaataaatgcaaaggagtacaagggagttataataaaggggttagggtttgcagtaaacagcatttaaaagtcacttagttgcccaaagctattttgtaaagacgattctagagctacacaatgttataatcaaggccgtgtacccacacgaacctgccttaacccaaggccttcgatgattcagaccgaactgacaacccgacctgggtcctagctcgtcccaagccaacccagaccaaccataccacattttagttgttaagcatgttttaagaattaaaccactaacttgggtacattgctaggcttgcccataaccgagggcgcggctattcgaatagattatactttgatcagaggtgtacatctttacccacaagacacatctttctcatgtgtaaccatgtgccacataccaccacggcataccgacgaaagacgtgacatagttctcaatccatcctagccataaacaagagtaccgacccaaccctggctacggccaggattcccgagacaggtaaccaaggttgagcccctagcagcaggacaccggccatgtgccatgacatctcgactaccgggccgcagctcgtgtagccttaatttgccctagagatgtccatcgagccccgacttcgtccatccctatccgtgtatttttgcccatgaccagactgagccacgaactaagccttacccactagacatgtggaagtacggtagtgctttgcaacagaggcccgaagaccggtccttatagtggccgagatgctactatcaaaaccatgcacctcgagcccagcctaaaaccattttaggggtattgaatagagggggaggtgtgtgtccaattccaacataagccaaccattccataatgtccaaatgatatgagaattcctaaagtctaaagttataaaatcacctaatgttgtctaattaatcagcgaggcatctacctaaattcatgctcgtggaaccatgaatagggtacccactagttgggggttttgtttatcctagggtaaacaaggtaataaataacaatagcaataacaataaggtcataacaaaggtaaataggcatggctaaataaaacagtgataacacgggaatttaaataaaacgatattgcaataatttaaaccaaaatagttttataaactgggattcaatatgctcaaggatgatgtgacttgccttgctcgctttcccaaacgttggcttcaacctccacgtagagcggatcttctgaagctgcagcgtctacacggccaatagaaagaaaaaggcttttactctaataaactccatataacaagcagaaacaaagcacaaaaataggttcttgacttcttaaggaaaaattagagacttgaacggtccaattctgagttcaaaaggccaagatatggccatttgaagtttatatgctcttaatgtgaatatttgcaaatttcttcatttaaattttaattaaaaaatagggtttattgtgtcagttgaggggagggagcgcgcgggccgggtccatgggagtggtgggcccctgcggcagcccctcggtccacggtggaccgggtgcacccgcggctcaccagccggctccgggggccccacacgtcagccgcacccgatggcacggggggctgacggccaggccccacgcggtggccacacggtgcgcccagaggcggctacatcggcgcggccggcgggaggaggcgcccgcgcccctatggccgccggcggcggccataggcgcggcggagcggcggccaagagaggggaagggaaaggggaaagaggcggcggtccacggctcaccccggagcgacgacagcgacgaggaggcggccgaagtggagggaggcggtggtgcggctcgagtcgacggggtcggcggcgttccggcggtcggcgaccgaaacggaggggtggacgaggtcggcgacggtgcggcgaagccggaggagacgacgccgaggtgggggacggtcccggcgagcagctaggcccagccagaggtcgatggcaacggcggagagagaggacgacggcgcgagctcgattccgacggggaaaaagggcggcgagtggcggaaacggacgagggaagtgcggggagggtttatatagggttgggagtgagagagtgcggccggcgggtgtcacgcccggaaattcactagtaatttccgaacttatttgtgcataaaaccctcgtctaggaatcagccgaggtacacaaactgacaattcaatatacaaatccatgataataataacgttacatactcacaaaagaaaagaaaacagcagcggaataacggtctagcgatggcttcagctccactctcacaggcagctcaactggggtataagccaaacgtcttctccttctggatcctttttcttcaactgaggttgattgattattgcaagaatgagcatatgacatactcaacaagccacacagcaaatatgcaagtgcacaaggataccaaaggatggcataatataggctcatttgcaaaagcagcatttagcaaacatttaagagaagtaaaacagtagagtaattaatcatcaattttaatcaacactgaacagcaccccaatgctgcacaaactccaaaccaggagctaaacaaattattaccagttattgcatcaataactatttgtgagaggtgtgagactaatcacgaaaaatattgctcaaccagcccataaccgcgggcacggctattcgaatagttttactctggccagaggtgtaccactgtacccacaagacacgattccacacatgttgccatgccccgaagtaccaccacggcactgcaaagggggaaatcgtgacaatacccttcgcacaacacaactcaccatagtgcaccattcctggattataatcaccccctcaaaaaccaaaggcatggactccccagcgacccccacggacttctcgccgcttctcagtctggcaccccgtaatgaaccatgctatacaaaagataaagccgttgcccacgctggcttgtggttggtacggttaatgtttcacaacagtagctcgcgaaccgatccttaattgtcatgagcacgaacttcaaaaccatgtgctcacaacccaccattgacaagttttaattatcaattaattatcataacacgattaaccatcgtaagctacatttaaatctaaccataagtaataatgtaatatgattcaccccattaatgagctaatgtttctaagcatggctaagcaattatatctatatagcatttagctgaaccaaaccaatatataaggttctagctaatcgaattctaacccataggaaaataaagtcatcttcggccaataattaattgggaaaggctcaccacccgatgacattcgaaaataatgcataagttgaaataaaacattagctttaaatgggttcaacatgctcaaagggtcgtttgggatctgtgtgacttgccttgagcttcatcaagcgcttctgaaccttcctcaacgaaaacgctctccttcagaacgtcggaaactaaagcgaaagaacaaaatcaacaaaacagtacaaaaacaagcataaacaatacatgtggatatttttaacatgtagatctcgattttagaaaaatttagcaacttgaaccactcaaatcggagttacgatgaattagttatgaatttctgaagttttaatctatttgcatctagaaaaaaaactggaaaaagaaaatatgacgtcatgctgacgtcatcatcgcgcaatttcacgggcaacgaccttgccggcgatagagaggtcggcagggctatctaaagtcatctacacgtagaggacgatgacgcgaactcaccggtactagcaaacgcgatggacgacgacgaatggtggccggcggcgagctctagcggcgacacggctcgggtcgtcggcggcggcggctctccggtgaccggcaacggcggcgagggggcagccgaggttccccgcctccgtgcgcacctaacggcgacgacgggaagcggcggcgactgctaacgcgatggcgtggcgcggctgaacgtcggccggcggcggcggcggcttggacggcgtggcggcggcgctacgggggacgagaaggctcgggagttggtgcaaacgaaagaggacgccaaggggatgctatttataggcttggattagagagatcggactccaaacgagaggatttgagccggaaaatccgagggttagttggagagataaactcgaaaacgaattcgattccacgttgatttcttcgggataaagtgcgacgacgggaagcggcggcgactgcgaacgcgacggcgcggcgcggctggacgtcggccagcggcggcggtggcttggacggcgtggcggcggcgctacgggggacgagaaggctcgggagttggtgcaaacgaaagaggacgccaaggggatgctatttataggcttggattagagagatcggactccaaacgagaggatttgagccgaaaaatccgagggttagttggagagataaactcgaaaacgaattcgattccgcgttgatttcttcgggataaagtgcgattcttggggggaaggatagaggaggataagaggaatatttcccctcaactaattttgcaaacggagcacgggatgcggcggatttggtggaggaagcggcggctgcacaggtacaggacggcagctcgggcttctgtccaagcttgaagatgagcagtacaggggacgcaaattagactttcggctgggcttctacttccaaggactgattaaaggagggacaaaaagcagacgtcgggaaagagagcgaaaggactgcaggctgagaggagactgggccgagagtgagaggacttttcctaattcggcccgaaaaggaaaaggtgaattttaattacttttccaattaaattaatcactgaaatgatctttgaattgttaaaaatacttctattgctcaaataatttcaagaaaaatcttgaaaatacttggaccctcaaagtatttaacaaaattataatcagaccatttaatgattaatttaatatgtggataattactgaaatgttctttgtatgattaaaattaagaattcagctccgaaaaatccgagaaaattccagagagtataattaaccatggaggatttaataaaaattaaatccatccatgctttatatttaggaaattttatttcccacatttaacttcacttgtaaattaatgaacatttaatataaattctaataataatttattaaataatttataaatcctgaaacgaaaatcaggacgtgacagcgggggaggaaaccggcgcgggagacccggccgccattaatggcgccggcgggattagtggggggcttccatccgaaataaagagagagagaggggaaaatggggggaaagggagagggaatcaggggaaatatttcccccattcaattttgaacgggatcggcggagcacggcggagcacagcggagcgcggtggatttggcggcggcgggggcgctaggcgcgagcggagggagcggcgcatgcggcgggaggaaggggatgattggtgggccccacccgtcagcgagggtggcgggcgggcccgtccgtcagcggctgcacgtgcagggagaagccgagtggtccacggggaagaagagagaggaggagatgggccggattcggcccaagagagggaaggaggatttttagaggttttctttttataaaaccttttcaactttgtttatttcttgataattattatttgtgctctgaaaattccactaaaatttatttacacattttaggcttttaggaaatatacaaaaatcctccaagccttttttgacttttaactttgcacattttaatttttggaggcttttcactaggattttaattattctaggcataatttaaaggatgtattttagggtcgttttggggcgtgacacatttgtacaaccggggtaaaagtatatcaaagatccgtctactccatgtttaagaatatgcccatgcactagatagttctcatcaatacagggacgagctgctgagatgaaagcgatttggtcactaacgacccctagcactttcgctatcctagtaatcagagaaatgcactcaataggagcagaaaatcttatactttctaaccattcccttatcatacatttcacaggagcaattttgatttttctaaccatagcaaacatgataattaattcatcccccctaatgggtctaagatcacctctaggaaacaaactcagagcaatccacttgtgcatgagcctaactataggattatggatatcatttgtcctaggtttcttgcaaattggagcaccagaaataccttcccaaaacctatttttctcgaacccagaaattcctttctagagatcgattttacaagaatcgtgaaagccaaaaagtgtactcaatcctttccatgtaagtgtatactctttatggaaaaagcgaaaagaaattccatcttctatttctttcaaagtgcacagaaattgcaaagtaaccaaacgagaaccaggctcatctaccacaagaaatctctgccaaccaacagctttccaaatagcacgaaaatcaacatccattcctatctttttcagcagctccggagagtattctcgcgtgtgagcatgctcccggtcgcttagcatgtagtaggcttgtctttcctgattgtcgacaaggtcaaggtcggcgtcgttcaggagacatcgcggagcttcggcatcttccatcgtgacatcagctgatgaacaagcgctagactcatcatgattgacttgacgaagagccggaccacttgaatagacgaggcagccgcctcctcattctgcacaatggagcaagaatggtctaactcggcgggggttagaatagcaagagtgtcacacgccggttagtttcaccaaagcaacatgtatatatgcagctaagtatttgaatttgagggaaacaatcaaagcttgaatgaacttgagagaaaactttggagagggaatgaaaatgtgctgaaatggggtggattcccctctcccggccggttggcttaagtagtgcacccacaacggtcaaaactgacatgtggggcccactagccattgcctcaaaaaagggaggcagccgatcgaacccctggtgggcccaaccggccccactttcggccgttgggttccaacggtcagtgtggtcgtggcacagtgaattttcgttgaaaattttattttggtttgtttttaaaaattcatttgaagaatttcctcaaaattctgaaaatcctaaatgcaattatgaaattcaaacatgtgatgatgcaaaaatttaaattattgaaaacaaatatgcggatacataccaatttatgtgttggtgaaggtcgcatcattttaagtccgacgtgcaagaccgtaccacgtgcaagaccgtatctcctttcagttcagtgcactgattttccacctgtctccggaggtaatggagtaggcgtctttgacttttctttccacaccttctttggttttggtgtggaagacggcttcgactgctctagcttcttggccagtgtacttaattttaccagtatcttccaataacggttcgtgggcatcgttgtttccttttccaggaaattctgcatgaactttaccaggctatccatcttgggtggctccacttcgaccacttgaatattctgcggatttggcccgtactttattctgaccatggagcattgttcagtccttggctgaaactgaaacttttccttcttcccgttgatatggaaacggatacttctcgtttccacgtcaatgttggctcctgcggtgctaaggaacggacgccccaggatgagcggcgtctcttttccattgtccatatccagcaccacgaagtcaaccgggatgaagaaatcccatatcttgactagcatatcctccgcaatccccgtcgggtaacggactaacgagtcagccagttgtaggcgcatcggtgttggtgccaacaccgtgaagttgagcttgtcaaagacgttctttggcatgacgctgacactagctccgagatcacacaggacttggtcaaactgctgtgccccgatcgagcaggtgatcgtaggacaccccggatccttcttcttttctaggagcttgtggagtatgacgttgctgcactgctccgtcagcttaaccacctacattgttggatgcggtctcttgttgttgaggatatccttaagataacgggcatatgttagcacttgcatagcatccaacggcacgttgatgtgaatcttctggattacttcaacaaagcgagcgaactgctcgtccactgacggtttcctactccgttgatgaaacggcagcaatcgtgtgtcgcagtattcctgcggcacggccttttctggctgaacctctttgtcagccgagttactcgatggcgcttctctggcaacccgattagttcctgcagggttaggatatggcggatcacgagtggacttacctcctctcgtcgtgatcgccatgacattttcaatggaggagtcggtctgctccggaatcctcccagtttcagttgcagggactaaagaagccaattaagctagctgggtttttatcattttaatgaagctcagctggttttgaaaagtagaagcgaagccatctagcttaacattgatgttctctaggatcttgtcattggcagctagctttttgcttaaagcatcagtggttttagcttgcgcaaaaatgagatcctttaaggagggttggttagagaagttaccgttgttgtttcctccttaatagtatgggtgtgtctagttccacccttaacctcctcgtggacgattcccgttgttgttgttgcccatgtacatcgcatcctcacgagtttctaggcagtcgttcccagagtgacccgtgccgccacagacctcacacgtgacgtgtgagtccaaggccttgatggtgccttgtggccgtttgtcgtggtcgtccagtcgtttcatgaggaggtccagcttggcagcgagtagttccgtttcct

SEQ ID NO: 47809 - DNA, 3498 bp, Oryza sativa
cattggttttgcccatcggaaagaacttcgagaggaatgccgtagagcatttgtcccagatgttgacaacagcacggttggcataaaaccattgcttcgttttcccgagaaggaagaacaggaacagccgcagcctgacggcgtctggactgacaccctttataccctttatagtgtacgtgatacagatctctaggaactgctgtagatgagcattggcatcctcgttaggctcgccacagaatgggcaagcttgcgccatcatgatgaggctagacttcaagtcgaaatcaacgtctcccatgttgatctgcggcccaatggccacattgccagtagagggagcagcgaattcgcggagggtcttgtcagccatagtcttgaaagtctgtggcgctggtacggctggattttttgtcagtagagttttctgcggagcaatgaatcgcggcctgatgctccggaagaaagcttctggattttctttgaagttttccgccaagttgaaaccagtcatgcactaccctgttttcacaacaaaagtgaaaacaaccaaggttagcctgcaaagggcagtgattatacagaggtaaatataaagtattagttcatgtaatctctattatgaatcttccccagcaacggcgccagaaatacttgttggtatttctaaacgacagtactagaaatataattcccagcaatggcgcagaaatactcctggtatattatggttacagagttcatccgcaagcgcacagatataccattgtagcatttcacccgagagtattccaagggtattgtatttattttatcccgtgggaagatcatgtagagagaacttgactaataatttatatattacttgtgataatcatattctaagcaggggttaagataatcctagggtagagtgacacacaagcattatctacccattctcatgatatattatctaagctaagtggaaagaaaagagaaagaaaatctattcctatacttctagtatacatagtatacatacattctagttaaccgacatactagctaataccctctatccgatgccctcctagtactttgagaagccacccttgactgccgagttccttacgacagcccgtcatgaccatacaaccggggctaaatacggaggaataccctccctagggaatgaacttaggactatatacatgcgtggggaatacccgtactaagctgtcaccatcagcggcccacctctcatccgcagcatataaccccaaataatgatatccgtaatctagacaccacgtctaaactaccagatactactctaatatcatcgtcatgacatagagtaattgcataagcaaacattatacccgcaccaaagcatctcccagataagctagcagtatattcaatataacatgaacataatataaagtaggtattcatatactcggaaagtatttcaataccataaatgtatatagaagagtattctaaataaagtacaaagcttacaaaagagaggagaagagctcctagagccatacctgaactcttccgaaggcttccggactcctgatttctactctgttcctattccactagcttaagaatactaaactaacttgagagaatatgagagagctcttgcttgaggtgtgtgagtgaagtgagaagaggaagtccttttataggcaggtaatgacggttgtgatggttggaatggtcggtaataccctccaaccgtcattggggatcaatcccaaccgtccagaagaagccctgcatccaacggcgacgagggaggttcagccgaacccccttgttcggccgaaccaggggccggcccaaccagcccaagttttggctggcggcctcctccgttgcttcacttcatagactggtgaattttggcccaattcatcgtgtcaattctgagttcttggtccattcatgcataagtctgattcttgacatcgtccgattgatttatcatctgagttgatgtcgattctcctccactttatggttattctcttcaaaaggttagtaaacctaatactagtggaatattattattctaacttgtatatgcattgcaagcataactagttctcctttattttggtaatattgacggacgaaattgatcgataacgaccgtcaacacacctacagctagacaactcaactaccgagcgacgggacaaaacaacggctaggcaaagacgcacggcagaggcacgcagcgcaacggtgcggcagttggcagcgacggtggctcagcgcggcagcggctaggcggcggcagcggccacgacgacgattcggccaactacgacacaggaacaaaaccctaaaaacaggagggaggttctcagcagggagcaaaaccggcagggaacacgacgacgacggcggcgctagagaggacacaacgtgctaggttagacgtggaaacaattgacattgggttaaccaattcaattgagaggggaaaatagattaccggcgacgcgagggcgacgatggcggagacggcgacggcggcagaacaacgctagggcggtggcggcggctagcttgggcggcggtggcgcgacagctagggtagctagggcagaaaagaaagaaaaactgggggagggaacacttaaataggggaggactagattaggaaagggggagtcatagatggagtaggactaggacggaggggaggagactgactcgggcaaggggagggggagggcgcgcgcgccggaaggagagggggagggcgcggccggctggggagaggggaaggaaaaaggaaagtaggggattaggacttacccaaaaaggaaaaacaatgcggtgctgttttaggaaagaaaaggaaacggtcccgcgaactgacacgtatacggttcgtcatgcaaaacgaaaccgcggactgagaggcgagtgaattgggcacaattcacgaccaaaggcaaaggaagaaaaattaacttgacacttttaacttagcaacattgcctctggtaatctgatatttactctttaaatcctgttagtgattttcagagcaaagagaattagaaaaaaattctccctgacaattccaattattaaaagtactgttaactggggttttctcctggttaaccaaagcaaattcttgagatcatttattagtgatttggaacctaagggaagggaaaactccgggtgtgacagggtcgttcgacatcatcgacacctcgtcacacaaagctatcacacttcgtgacgacttagataatttgttcaaggtaaacggccaacatttaaaaattttccttgagtggaatgaagttttcgatgaagaagtagacgttattgaactaatcgatttcgagcctcaatgaactcatctaaaatttgcttaaattctgtaaaattgtatcatgtcttgcttgaattaatttagtgtagacgtgtgaaaaatttagaggccgactgagcccaccagggttc

SEQ ID NO: 47810 - DNA, 6335 bp, Oryza sativa
aaccctagccaaccccgatcgttatcacgtaagtgagctttttaaatcagcatttaagcttaggctaaatgttttgagttaatatgttgtataaaaagcagtcggcatatcctataaatcatattattttggggatttaagctgcatatgcttggtatttggtttagtcgttttgatgactataatcattagaaaccactcggttggttattttttccttgactatatatgtttagtttgttcaacaaatcacatagtcgggggctacaactaattaggtgcatctagtcgatgcaccttaatttttcttttttagcccttcacagcttgagatgattgaggtactcaggagttgtggcgaaaatgactaaagcactcggatctttttattaaaccactcgggagaagattaccttatcatctgtgaaggtctcggcctctcaggggctactgtggagattatgggtaccatatacccacagggctgcgttacccgactagttatcgggggtaactcatagtaatagaatatgtaaagataggactcgggtattacgttaacttgtatatcaaggaagtatcacgtaatcttagtcggttacaattgtaaaatatatatagagcttaaaccgtaagggataaggtccgtatcttgtaatcccgactcgttcatctataggagtagggtattacttctcatcgagaaggcctgaacctgtataaatccattgtctcataatccaaccactttcatagcttgttccctatccctttttagtactgccgaaatctagtttcgacaccatgttacaataattttatttcgtaccactgctggagaaaccatctttggtcggtcggccaaattccacaatagtcccggttccaatgaaaaccgggattaaaaagcatctttagtcctggttgatgttaccaaccgggactaaagatcatttttagtcccggttgaagaagttgttgggtcgtgtcaggccccaattatttttagtcccggttggtataaataaccgggactaaaaatagatctttagtcccggtactaaaattcaccccaagctacgcgatcattatctcttcacgcatatgtctgtccctcctcccttggtcttatcccttagcctcttctcctctactcgttctcctcatcactcgttctcctcttcctccttctcctcctcccctttccctcaaccctgtcttcccggcggcggccgccgcgaaggaaggtcgtggaggcgcggaggcctggcggcagcggctgcccacgcggagggcccatggcggtaggcggcggaggcgcggagggccgcccaacggtggcatgggaaattctttctttttttcttcttttttccttcttaatgtgatgtgaatgactatgatttgtgcgatatgtgatttgtgaatggtattgggagatatgttatatgtgaactatgtgtgatttgtgtatctatgattcgtgctttctgttatttgtgatttgtggtgcgattgtgatttgttatttgttattataatgatttggagatattgaacatgagaaaagaaaaaaagctttagtcctggttggtgttacgaaccggattaaagatgttgaaaaactgagactatagggggggttatgggactaaagatgttgaaaaaccgaaactacaggggttttcaatcgggagtacaacccctctctccaccagtgtactttacccctcttttgatcaacggttcacattgatcaaccatttaatacatttaagtatctcgctaactccctaaaagatctcgtttgtgaattgggagtactcggtacgtgcatggggcaaaataattgaagtacggagtagaaagatttgggacaagctataaaaaggaaaatggaagaaactaggcaagactcttgagcacgacaagaagaagtaacttgcatatggcccattcgagtggagcagggaatgaaaaatgggcaagactgcaagaggcggcagagcagaagtgcagaacacccaaagatgacgattcagatcaggttgctattgggagcagaaatagcatccaaaattgagtctctgtaatttgagcttgtcgacaacacaaatcaacttgtaaccttcagtgatatttcaaccttgcaactgaaattgcctaaataatattttatttgaaagagaatgcagaaaactatcatttaaaaatgaaaatcctatctccattcgtattactcgagttcagattaagatgcagcttgtcaagactatttatatattacaccttttacccgtagtcgacaaatcaaattcagtttaattaaaaacaaatccaccgtgaatgaaactaagaagaaaaaacctacggagcaaattcagtatgagattgcaatttcgaatatactaaacaccagattcaccgagtcttactggtgctaaccttcattcactgtcactggatcgactggagtgtgatggagagacgggatgttgtgctgcttgtggctgttcttcttcaagaatgttcaccacggcatgggccacctcgacgctgccgcagccgacggcgctcaccaccctgcaccgtccgccggtcacagccccgcaccggctgacatccaccgccctgcacatctcgacctccacgctgccgcaccagtcgacgcgcgcgcccttgcaccgtgccaggtgcacctcgccgaagctctccacgtcggcgcgcctgcacctggctgctcgcagcgcgccgccgccccggacccgtgcctccctgcaccgctcgagggacaccctgccggcctgctccaagtccgcggcgcggcaccgcgtgaccgacaccgcccgcgcgccctccgcccgcgctgcgccgcaccggacgaacgacgcggagtcgacgccgtcggcgaccgcgtctccgcacagggtgaagctgacgctgcccccgcccccgccgcgcacgacgacgctgcggacgccgctggcggagaggttccccgcgctggtgatggtgaccgtgccgccgagactggcctggaggctgccctcgtggatggacgtctccacgccgtcgatcacaacgacgaacaggtggtgagctgtgacggtggaggaggaggactccccggccttgggatcgacaagcgccatttccaccgagtgcgacaggctcgcaatttgctttcctccggtagtttgggttggtaagctctagactagtctggaggaggaaaggtcttaatttgctttaaaagccaaaggacaggggcagtttgcaagcgaaataaagtgggtgaagtgctggtgaactaacaaatgcagatcactttctttttttaattgctggactttccacagcagtcgaattttggatgtcggatctacactggtcatcactcatataaataaaaataaggctttgtttagataaaaattttttttggcaaaaacgtcacattaaaagtttgcatacatgtatggggcattaaatatgaaaaaaaaactaattatatagtttgcatgtaaattgcgagacgaatattttgagcctaattacgatatgatttgataatgtgatgttacagtaaatatttgataatgatggattaattaaacttaataaattcgtctcgtagtttataggcggaatctgtaatttgttttgttattactctacgtttaatacttcaaatgtgcgtccgtatacttcaaaaactttacacccaaagaactaaacacaccttaaactttaactatagcaatcctcacaaatacaagatagcatgagaagaaaagagaaaagtagagataaataatattgtttatttcatataggtagtctatatgcatatgggtaccttttattattttttttatatggactagttgcacaatagtactatgatcccgttcgattctccaacaagcatgaagattaagtgcgtacaccaaacgagacaagttattagcacatgattaattaaattttaattattaaaaacttgaaaatggatttatttgatttttatagcaacttatatgtaaaaagctttcatacgaaacacaccgtttagtagtttgaaaagcatgctattaaaaagtgaggaaaagttggtttttttagaacggggcctaggtggctgaatgaaatattatattacttgtggactacatttgcatcacattatggatgccataagaatgagttcttttggtcactttcctaactcatctctctcattttttgcgcgctcgcttttcaaactgccaaacagtgtgttttttttcaaatattttgtatatgaaaattgctttaaagaccatattaatctatttttaaatttattttagctaatacttaattaatcatacgttaatgcatacatcttttgtgtgccagaaagaaggggttgccaacacctcctgctgaacatagcctaacaaattcctgcctgtgtcctcacttaccaatggcgagtcacgagctcacgacagctccagctgttagaatatgtgtcagaatatataatcctactaagagttaaaattagagttggaatatgtgtaaaactgagttagagtcaaactctgtcataggctgtcttaaatagagaggagacatcacaatgtaatcatggcattgacactaggggtagaaaagaagctcgggctcatgggctcagttcgggcttggcttggctcgtaagccaaacgagccaagcccaagcctcctttttagctcgttgctggaaatgagccgagccgagccgagctagctttcaagccgcttgttttggctcacgagcctaggccatcatgtgtttatattgattattttactttttatagcgttattatttgttaacttgaaatttatcattaagattttgaagaattgaatatataaacttatttaaattttacatgttgataatttgttcttgcttttttaaataattacaaatatatatgaagaggtgtttcaacgggaaggcttgcaagccatctcgagctggctcgagccaggaaacaagccgagccgagctcaagttttagcttgtttccctaactaagccaagccaagccaagcctagtttgttacgagccactgcaagccgagccgagctggcccatttccacccctagttgacacacgggaagataatggcggtgttggtatttcttacgaccacagataaatccgcaagcgcacggaataccgctgtagcacttcaccttcgggtgaccccaaaaggatatcgaacttagggaacgtgtgaaatctacctaaggctaaaactattcaaggacaacaattaatggtaggctagttaggctagagaggacattctatgtgttttaattgtctaagctaagcaaaggtaatttcctatttgttgcttcaggcaccgacccctgctggtctgccagcgtggttctggctatagctctatgatgtatccgaatgtggaggattactaggacaggatttagggctgtcaccacctgccgtctacctctaacaaatccgtgggatatacaacaaacaaaggtaatatctaacctagataccatacctaagttatcaattactactctaatacttgcgcaggaacttccttttttatccatagttctaatactaaagcacttagtacaaatactaaacaatgaacctgcaaagatgaaaaatctatcttacttatactaagtaattaaataacataagaatggatcctgaatgcttacttaatagaagaagtttctccgaacccagagcagagtgtatcacagctccggtactcctccagaattcctcctagaaagctacatttgtcgaggtagaagtcggagggagcgctaaacttccgggcactcctttagagcttcccctcactttctacctattttctaatgtacaaaaaatacaatagagcctcttttaattcaggtcaaagttgtatgagtgaagtgagatcagctcctccttttatagcctccatatgacagttacagctatgagaattgtccaaaacgccctcaaccgtcattgggaaagcataagcagcgtacacgtggaagagcgggatgaaaggagccagcgatggttcggtcgaaccctgggccccacctcttggcctcttctttggctaggaggctgacatgtgggccctgatggcggttatggcagttatgatccgttccatggcggttttacctgacttgtgggcccttcaatccgtgtacttgcgcctgattggccggaggtgtgtttccttgcatgacgggtgtgttttctccttaaactacttgcacacacatatttcaccaaca

SEQ ID NO: 47811 - DNA, 8592 bp, Oryza sativa
tgctttgcgacatcaaattttaatccatcgataatcatccatgtgcacacacgatgtgaacctaactcaaaacatataacttgatagaatggttagtccacaatttgcgcttgtcattaattaccaaaactaactacgggggcctagatgctttagaggcccacctcgactgacccgtagcatatatgcccatataatgatacttaataatctagacaccacatatacattattaaatactactctacatcccccgagatgacatagagtaaccgagtaatcgaacattaaactcacaccactgcatctctctggtaggttaactatacgactgtatcgatgtagatataaagtaaagacgttactcagatatactaaagtatcaaaagtatattaagaatagtatttcattaattccaaaagtcttacaaaagaaagaaggaaaactactaaagccataccgaaattcctccgaagactccgaggactacgagagctattctattctaatccacttaacactagaatacaaaactaaagtgtagaagagatatcttgagcttgtttgagtgtgtgaagtagtggaggtggtgagggccttttatagctgaagaatgatggttgtggcagttggaaaggttggtaataccctccaaccgccattgggagtgaattcccaccgtctgatcaaatgcctggatcgaatggcgctgggactggttcggccgaaccctgggctaggccaaccagcccagtactcggcggccgtctcctcttccgcttctagacttagaattgtgaattatgggactttttgatcgtgtcaattttgagtttttggcccatttgtccataagtctgatagacagtgtctaattgattgtttgagtgttttgctgtcggttctcctccatattgtatctctttatctacagacagatagacttcaagtacaagtggaaataagttattctaaaacaaatatgcattgcaagcatagctagttctcctttattttagttatattgacggtcgaaattggtccatcaagagtagtttaatacgatctctttgtacttagtttcttttagaaaatcaacacaataactatggtagtttgccaaattgtcatcaaattttgatcaactacgaattactttgtaccgttcaattgtttctcccttttttaaaatgacagctcatcatggaggttcaaaaggaataggatacaagaaacttaggtaagtttgttgtttcatgtgcaagcaccgaaattgtgtaagtttgtggcagtgggaatgtgtgaatgtctatgaaattcttgtgagaacttggaatgcatgtgtgtgatgttatttttgaatgatgtgctaagattagaaacatgtattattgcgggattctgtgatggttctgttttttcagagggcgtggctagcaaatcctgaggctagccaatattttgaaattaatttattttcaaaattagctcatcactgacgggtcgtaagcaaaggccgtcacagttggcatcagctgtgatggctagctaaatcaatccgtcaaaggtgagtcacttgtgatgggcttcaatgcagatacatacatgtgatcatctgtgacgggccatcaacttcggacccgtcaaagatgtgtcacctgtgacgggttgcaaccatgagtgacttgaggggggccctcgcctgtgacggcccagaaagtgcaggaccatcagaggtgatgctcatttctgacggtctgccacccgtcaaaggtgattggagtcaccagcgatctttattcagtgaccaaggccataaccgtcaaatgtcaccgtcacatgtagggtgatctggtgtagtgagaatcatctctattttttataataggtaaagatttcacgaggatttcatgtatatgaaataacttttaggctgactgtatcttacttaccaggcctgtcataagaaaaaaaaaatctttacaacggggacaattacaatggtgatactggaagttgtaatatgaaactcttccgagaaagaattcggttcaaaagtactctttggagaaagaagagtaaaaaatctaattaaaggcacaataaataagcccaggaattgaaatcttgagccacatacctaattttctactcatcatatatgatactcgtaaccctgctgtactcatcgtcagatttcatctgtcgtcgtggtagtagtagtcatcgtattccatattttttttggcgtaatagtcgtcgtattcgtcattgtcggaatagcccggcttgttgtccattgggctccggtggcagctcatgcagcggaaagatttggagattgccgcgccgcaatactggcattttcccctggtcggtgatggtcgcttcactaccggtggcggcggcagaatcgtcggccgctgttgttttgccggagcaggccgacgcatctggacgacctgaggtcgcttcggtgcgctcggttgcggctttggcggaggacctggtggttgttgcctctgcgtcgtcttcggtggcggttcaggaggcctcttggccgccggtggcgtcgccggcgcggcggctgtaggcttggtacgaaacaggtcttctgcccgcatcggaagcgtacacaccgaggcggcggcggcggtggcccccggcgggggatgcctggtcgacagcacgtcccaggctgtctggacgagcttgaacgcaccgtcggcggcggcggaggtgttcttgtcggggtgcaccaggaggcacagcttccggtactgcttcttgacggcgtcgtggtgggtgaccaggtcggagcgcggctggggcaggccgagcatggcgtaccagtcgggcccgcagccggcgaccccgatggccttgagcgccgcggcggagtgcacgttgtaggcggccgcggcctgcgcgacgccggggaggtccgggtccagcttcagcgcgttctgacaccatcgcttcgctccagctacgtcgccagcgaggaagcacctctcggcgaggtttttggcctgcagggcacgatcttgcttggacgacgacgacgacccagccatgactggcaatcgatgatgtctgtgccgcccacctttcccagtttccaccaatatataagagcaagtttaatagtagagctcactacttactattagtcaatgttaaagctaacatgtatagtaggttggctataagtttatctttattttcttcatcctctctctttctctcaccatgaatttaatgcatatttcttggagtttgtgtgcagttagctcttgcatgagagccaacactccccacttttgtttatctctctcttccacataagcatatagcttgcttatagcccactattatccttgctctaatggcacgggtagagaatcataaaagtatccgacacggaggtgaatcagaggcagaatcgtatccgattccgatacgcgtcgggccagattagagtaggtataggctataagcaagctataaatatattttaaagagataaaagtaaaagagagaaaagcagcggggctacaaatatatagccagctgcagcatggacaataagacgtaatgtgtgtatgactggtgggaccaggtattaatagtatagtaagcaactattgtatgaattagccattacattggttatagatgatttggagcaagtttagtagtataggcaactactagctccaaatcatctatagttaatttaatagccattatttagaaacatatcactactggaaaaaccatctttggtcagtcaaccaaatttcacaatagtaccggttgtattgaaaagctcaagggtacttttcatttttagtcgcggtttaaaagaggacaggcggtgtcagacccctatattttctttagtcccggttggtgttaccaaccggtactaaagatcaatttgtagtgccagttgataacaccaaccggaataaaagatcggcatgcgcggagatcgaggcatgggagcagatcggatcgaggatcttccttccagttctatctcctcctctccttttaagtcctctcctcctctccttactcaccctatctcttcctctcctcctccccctcccccctcctctccacttctcgatctgcacgaggcggcggcgtggccggctagcagagggctggtggagggccgggcgacggcctacttgcggcgtggctgcgttgcaggtggcggccggcgcggcggcgtgccggcggccggcgagggggctaccaatcggaagtaaaaaccacttctccaccagtgtatactacactattaatatatggtcccacctgtcatacgcacattgcgtcttggcgtccgtgctgcagctggcaaatctgtagcccactgctcttctttctcttctcttatctcgtaaaaatatgtttatagctagcttatagtatgctattgtacctgctagagtcacttcaacttctagcgaacacttccaaatatacaaggacagcaggtgaatgactctgaatatggttatttcttagcaattctatgtttcctttgagtggtttcgaatagatttaaattttaaagcttttaactcaaacttttttaaaacataactccctaaaactctacccaaattggaaacatgcatcgatttcaatattctttgaaactttctaactcgattctaatttgtgtagctttcaacttaaaattttaaactttcaactcatatttaaaaacttttaaatcatctctttttattattttatttaaaatataaaactttcaacttaaattatgaaactgttctactcagttttttgaatctttcaacttatattttacaacttttaactcaattatgtatttattattatactagcaattataaccgtgcattgcagtggggagaaaaatcgagaaagttagagagtattgttggcagaaagctgagtaaaataggttgatacagtataagttatcaaaggctagtcctttaaaaaagaagatgcatgtctttagcatgataccgacaatgctaacaatgtagggataatgcaaactagtatttttacttacatttcaatggcttaaaaataccatgtagtggtaagtgattgaaattaccccgagtcttttcacaaactaacggacttgaacgttgggcctcgccatatgagagctcttttacatgctaaggcattaacagaatgattgaaatgtttatttattgggaaaaaaatattgaaatgttactacaggtgaaaagatcacttcactaattaatatggaattaacacaggagaagagggctaaaaagatcattgctggctacatgtgtatgggaaataaaaagagatatatcagtacacattaaatcatacagaagattgtcaaaggcctgggcgtttttggggttgcgcgtccaaacccagccgcttcgcccttgtggccgtgccgccgagccgagaggaacaccgacgagaggacgagcgcgtgaaaacgtcacactcaacacccacgcacacgtcttgtagagattatgggtaatgtttacaccctattttgacacttgggattaaaatagggttagtttgatctacgccattataaatatgtcaaattaaaaaaatactattactattcgcgatatcggctgaatgccactgaaattttctaaaattcgatccatgctactgccgtttacttttccatcatcgccgtcacatcctcctcgtcgcacagctctggatcacgccaccattccgaaattgctctaggccaatcagcacactttgtcttgccctcatagaccaacactagtcttttctgcacagctcgtgtgtactggggaaaaattgctctaggcaaacacgcttaacctcagagttctttggagatcggattccggaaaataagttgcaacttattggtatgagtattctattaatcatattaagcccaaggccggaatgtcacaggtgtggtcgcgctctgcgccgccaacatcgtgactggagagcatgtagtggttggcgctggcggatcggttccagaaggggtggtgagcgacgacgacgcggacataaggatggtcctgggagagtgggcagtacacgaaggaaacactgaacgacaagaagaaggtatgggcgtgtgtagggtcgcacgtgcggacgccactctagcggtgacggcggcgccatgaggtcgagttgttcgtcgatgaagcggccttcgatggtgtacatgtttggacggacactcatgcaggatcggtggctcgacttcgtcgtacatgtacaccttgaaccgcttattcatctccaggtaactcatgcatccatggtgcacgctcgtgatcgataaaaacgacaccggccccaccgccgtggacggatgctaagctaatcataccagtagaacgccgccgggttgcggtagacatgcgaaaggagcgcatagtccggctcgcgtagaacgccagccagttggcggagcggacgtcttcaccctcacctccgcatccgcggcggtgatgttgccatgcagcacgtcgtatcgcggcgcgtgccacgttgagctcctcctccacggtcggctagaagagagaacaacacaaagctatatcttagaacaaaccgctggtccatggacgacatcaaggctatcgggtccgcccgagctcgacatcaccggccgcaagctcttctactccgaccactccatgaatcatagcgtaagcaagcaactcaagattattaacagcactctctagcagcaattagttcttgaatctcgatgagctagttattcagtagtttcctgagacaaaatggatgctttggtgacacgacgcaggtatcatatcctccgagatagaggtgcgtcgagtttcgacgagtgcgatgaagccaatctccgacatcgccgtatttgaggatgttcttttcgtctcggattcaatccagccgaagggattagtcccggcgatttcattgatttaatcttcaaaatcatttggctttgccgtttcagtagttagattgttttataactgcagattaattttctgttactctcttgtttttgtatgccgactgagaacaagatcaatggctgccatctcggtgtgtctgcccaacacctcgtgttcccccatgcaccatgtacagatgccggtgtaatccgacacgggagtaacgtggaaccacaggcagtgctcacagctcacacacgatcgagatcgccagctaccatgagtcatccacatgcatgtattgaccaatcgacatcatccaggacacctcgccggaatcatgcaccaattaattcattaagcatgcttttatgttccaaacatatatacacgagcttatataaataattttgcttatggtactaaacagattgatctgttaattgttctattttgaagtatccggaccggttgattctgctgccgccgactggtatcctcgcctatacggttggttggtcacaccacctttcatgggcatccacatccccaccgaccggcctgcctccgtcgccactgactggtgtctctgcctacacggctggcctattatgccgcctttgttgggcgtctacgacttcaccgccggcttgccttcgctgccgccgactggtgtcctcacctacacggttggttggtcgcaccaccgttcatgggtgtccacgtcttcaccgattggcttgcctttgccgccgccgactagtgtgttcgcctccacggttggtggtcacaccaccattgatgggcatttatttatcaacaccgccggtcgcctcagctgcttacacggttagtgttttcatcatcattgatggactacttcgttcccacatcggctatttctgttgtcaccgagggaatatgaaaaagctaagtcatcattaattttctttatatgatattttctctttcctctgcctcactacatcaactagttcgccgttgactagtgagtcgggggctacagatgctatatcatatttttttaataattttcataatatttatcttgattgcttgcgatataatccgagtacaaaggtgcctatcgagttatggagctctatatccctatgctttccgcttggttgtcgatggatagttgcctttgggccgattcctagcacccgggggctcgttggatggagtgtataacacaaggtgctaagtattactcggaagaaatcaaaagcatagagataagataatttattttctgctcttaacaattacaaaagtataatttattttctgttctcaacaattgcaaaagtacccgagtagtaaactctgatacgtgaaactttgttccattaatgacgaactcatgccactcgtatgcatgtttgggaagtgcctaggccgactcctagtgcttgggggctatgactagtcgggcagagtgtttaaacgtaaggagtcatccgctcggggaaatcaaaattgacaagaggagaaatacatatttataaacattttaaaatagttgaattttcctcgagtattatatttacatcagatactactcatcctatatgtttg

SEQ ID NO: 47812 - DNA, 1760 bp, Oryza sativa
ggacgttttcattttcgtcatcattttacttcttccgtcgccgactggttatgctgtcgttgactggtgtttttatcttcacaactacgcgtcttcgctattggtttgcttctgttgccgctgactcgtgttcacttcatcacgactatgcaactctgtcaccatggtggagtgacttcatctttattatcttcggcaccggcaaactctattgcctctacttcgcaagctttgctgcttcaccgatcaccacgtctacaagaacctcgacatctcggcatgcatcaacaattatttcaccggcaattttggcttctccaaagtttctcaagtatcaagtccaagatttaatctaaatgtctgggagtttggagtcatcaaccaatcaactcagattcaatgagttgaacaacagtattttcctccaagtgaagatcttctacagctacaacaccaagttctaccgtcatcttgataaatcaagaggcgttgcatcaatctacattacgcacacgctagcatcaaggaaactacttgagctttgatatcttctcaacggtttgctggattactgtctctgacatcatcaccagtacctctaattcatcggctttgatgtctccgccgtcgctattgggagactatgtctttgtcttcggttgcttccgtcattgtccacttgttatttcgctttcacagttggcctactacgcatttactgaaggatgaccttgccgttatcatcggctgctacactgctattgactggatcattgacatcgtcatcttcataaacatcctgtcaagcctcttcggctatgcctactctgctgccgttggtgggcaacttcgtcatcataactggctgtctccgttgccaccaattgtcattatcgccgattgcgtttgctgtcggcaattgttttcttcttttgcatgattcatggatttcgccattgccattgataagcgtctacattttcaccatcggcttgactccgccgttgcccatggtgtcttcgctttcacggctgacttattatgccttaactgatgggcgtcttcgtcttcttcaccgggcgcctcgtttgttatcgactgattatttcgctgccatggctgcacaactctgttgttgttgctgggcgccttcgtctataatgctgactgacttgtctgctgccgactggtttcgtcgcctccatgggtatgcgacttcatcacctttaattggtgtcattgtctttaccaccagtaacatcttcgtcagctttgacgggtgatatcatcttcatgttggtcatttcgtctccatgccaactgtgtcagttgccttcaatggacaattttgactacaacagaaggacaagctacatcctcggtggcttattatctcaaacacaaggatcataccttcaatttggacttgtcacggatacatgcaacgtgaattcatgttcctgagactatttcctacgctcaaagactgaatcatttattatttcccgtgagggctatcacctaagtacttgtgccagtcgggattcaattatcacatctactttggtacaacccatgagggagaattactcaaattagaagccactcatatgagttacactcgatctacatcaaccgggaaatttatcactcgggatcatattaattggcgtgctctatttcttcatattttaagggtatcggtagacatatttgaggtctaggcctaatatgtctgcaacctatatttttaggtgtgg

SEQ ID NO: 47813 - DNA, 1906 bp, Oryza sativa
ggacaggtcagaacgcgtcctgagggctgtttagactagcggcatgtggccggtcagaccggcggagtctgagacaggctatgttttggttttcctttggttttgatctcgagttggacatggaggagggcctgtaaagggcaagaccaacccctatataagggataaggccatttgaaaccatgtaacatacaatctacacaatcaatcgaatcgttgttttcaatattacttctacttttcatatagcctagttttagttcatccatctttgtcaatttgtgtcataaatcgtccgccttcgttgcgagagtacgaattcctctgtaggtttgtcctgaaaaccttccatttgcccatgagacgggtagttatccatcgttctatctaaatcggctcagctagccggtttaatctatcaaaacccattttggtctagctttttgctagattggggtggttggagactctatatcaccgcaaggcgtttaggtgtcacgatcgtgcttgtctacttgccaaaaaagttgccaacacaatttttggcgactccgctggggacgtcttcatcatgaccaagccggaggttgatccatctaatgtcctccccatctcattggaggatctagatgaggagcaatgtcgggagattgaacaacacctcaaggagacgcaagaggcgcttttggcaaggtgctttatcaagactcgtcaaggagctattcgtcagaccagtttcacatcgaaaaacaccatcaatgtggtaagtggtgatgaggtatctcttccacttcaaaagctcgtagcaagttccatagattagactattaatactacttttaataataaacttcgcgcatgatatgagttcttattttgataagcgaattgatgcttttatgagttgcaaattcagttctaatatgaccgatttgccgcctaattctgttgcaagtactagtcaaggtcctgttcaccaaatatttagtaaaaccgatggggcgaccatgcaactgactaggggagaaaaccctaacttccccgccggtctgaccggcggttcctacaccggtgttggccggtccaactgcactgcctcacggtctgaccggcagccctatggccggtcagaccgcaccccctatactggtcaggccggtccgactacacctctgtctatcggtaagaccgggctctgggccagtcagacctacacaattcttccagtacaggaagttgatcctattttatatcatatttttttacatgatcctcgtgtagctactattaatcctcaagttcccccacatatacctaatgcttacaatgattctaataggggatatcctgaagatgttaggtatggccaatataacaatattgtgccaccgcaccacttattaggccaccaaacccaccaacgcctgaaaatatggaggaacgtcttaggaacatgattagagaagcctttggaattgagccaaggaatcgcactagggtttatcaaaagccgtatcctgattattttgataatatcccatatcctcgtggttttagggttcctgagtttactaagtttagtggtaaggataatatgactacatgggaatatataggccaattctcagcacaatggggtgaggctagtaacagggatgcttttaaattacgcttgttttctttatctttatctggtactgcttttacatggtttacttctttaccggtaaattctattcatacttgggctcaattagaacaaaaattccatgattacttttacactggtaaaactgagcttagagtatgtcatttgacatcggttagacaaaagtataatgaatctgtaattgattacattaaaaggtttagggatgttagaaaccggtgttttagtttgaatata

SEQ ID NO: 47814 - DNA, 775 bp, Oryza sativa
ccggagcaagccgtatctactaaggggaaggaagtagtagttggagagcctagatcgaagatgattgtgccaacaaaaatcaagaagttggtgtatggaaggagaataaggatgaagcttcaagctctaagactccacggaagccaaggtgtcttttgatatgctcttgaacaagtatgagaagaaaagtgttgaacaaagttgtaacaagggcaaaaaagcaagatcaccttctagggagcgatttggtcattaccaagaccattggagccgccttttactcatcatcctcaagtcatgccatggggaccttgtccaatgccactgccgggttatccttttccttacttcatgccatttggacatcaccaccaatgtatgatcatatgcctcctatgcaatttcatcaaagttggggagaaccaagaaggtcagcacatgagcgtttgtcttcaccaaacaaatgccggtttccatctagaaatcgggttgatgaaggaagcagggaagaaaagcgtgtcaaggtggaggcgaggacttcaaggtgattactattaaagtggagtctcatgatgtgccaataccttctgaagatggagccaaggtgattccaatcgatgaaatcgaagccgagaccagctgtgcgcaggtggccggtttgaccgaagccttaatgccggtttgaccgggcctactggccggtctgaccgacggccgcatgctggtctatctgggccgtctagccggtccgactaggctgcaatgctggtttgat

SEQ ID NO: 47815 - DNA, 1332 bp, Oryza sativa
caattacctagcccccagccgtgaagttggaaaaaccaatttccaattacacggcttggttaatacgcattatggagcactcttacatgaccaggttttacatggtcgtttggctctttaggatctgacaagagcttatctgctctgggtgtccccagccgaaattcccttaggtttctcggaggcttgtcagactggcgtaaagggacaataatttcgatgtcaagagtaggtgttatcgtggttagggatctctggacaaatattgcacatataaacacttacagaagatgacgtagatgatgagataaccaccacactaggcaaagcccaggcgtatagttgtacccaataaatcgcataggtagtgggagaatcgctacatcgttggcagaaaaccagttgtagtcatatctcgaccactacgacctactggttcaagaaccaggagtaggagtctctcaaccgtttgaaattgaggtgcgaggactactacgctactggtcgaggaccagttatagtcgtaactcgacctttggaagtcgtggtacgaggaccgctacactgccgatcgaagaccagtcgtagtcgtacatcgaccatcagaagtcgtggtgcgaggaccgctacgttgccgattaaagactagtcgtagtcgtacctcgaccatttgaagggaatcagagtaatgtatggacgacattcccgtgacttgcgagaacaacctcctgatgaagacgaagacaatgaggaattatcgtagtcggaggttcggctcctgtacctactacctcatcctcggaccctctagaagtctggggatctcgagtttcgtcgtcgtcgtgtgatgtagttaaccgtgtccgttgtcgtcctgatgtcattagtcctcgacattgtcgtcctagtgacaacggcgatctagtcagtcttggttgtcgttatcacgacaatgctgattgtcccgttagatgtcgagagcttgctaaccgattagtcgaggaccaggagtaggcgtatcttgatcacctgaatatgaatttttaggtggtgagagatcgctacgatctactggccaaggaccaggcgaaggcgtatctcgatcacctaaagacgaattttcaggtggtgagaaatcgctacgatctactggtcgagaaccaggtgtatgcatatctcgatcaccttaagacgagattttaggtggtgagagatcgctacgatctactggtcgagaaccaggtgtaagcgtatctcgatcacctatgaagttttaggtggtgagagattgctacgatcgactagtcgagaaccaggtgtaggcatatctcg

SEQ ID NO: 47816 - DNA, 1055 bp, Oryza sativa
gattgattatgacaagaatgagcatatgacatactcaacatgccacacagcaaatatacaagtgcacaaggataccaaagcatggcataatataggctcatttgcaatagcagcatttagcaaagatttaagagtagtgaaacagtagagtaatttaatcattaattttaatcaactctgaacaacacgcccatgctgctcaggcccaaccattctgaacaaccatacccggctatacagatcaaactccaaaccaggagctaaataaattattactagttatagcatccataattattatgagattaatcacgaaaaacattgctcaacttgcccataaccgcgggcacggctattcgaatagttttactctagctagagatgtaccactgtactcacaagacacagctccacgacatgttaccatgcgcctcaataccaccacgatatctcggataggaactgtgacagtaccccttgcacaacacaatccaccacagcgcaccgtccctggatcataatcatcccctcaataaccagaggcatggactccccagcgacccccacggacttctcgccgcttcacagtctggtgccccgcaatgaaccatgctatacaaaaggtaaagccgttgcccacgctggcttgtggttggcacggttaatgtctcacaacagtagctagcgaatcggcccttaattgtcatgagcacaaccttcaaaaccatgtgctcacaacccaccattatcaagttttaattatcaattaattatcataacacgattaatcatcgtgagctagcattaaatataaccacaaataataatgtagtatgattcatcccattaatgaactaatgtttctaggcatggctaaacaattatatatatagcatttagctgaaccaaaccaatatataaggttcaagctagggatggcaattgtgcccgtttgcccatttacccgcgggtaaaaaccctattagggttgggtttgttctccattttatacccatggatatcttattgggtcaaaagctatgcccgatggataa

SEQ ID NO: 47817 - DNA, 9189 bp, Oryza sativa
gttgtggcgggtaaacgggcacgcccgcgggcataaggcgcccgcgggcaatgggcatgggcaaccattcttacccgtcatgtagtaatgggtatacccacgggcacaaataatctcacgggcatgggtatgggtaggcactacccgtgcccgtcgcgcccgattgccatcccgagttcaagctaatcaatttattatccaaggtatcaaggaatagggcattcaatgcaaattggccataacaaaagaataggataacaccacccggtgacattcgaaaataaatgcacagttgaaataaatagagaatttaaatataggatcaacatgctcaaaggaatcgtgtttgggatctgtgtgacttgccttgcaataatcagtcttcaattagtcttcagaaccacttccaacgcactcgcgaaccttcgcaacaacaaaaacgacaagctaacacgcaaaatagagaaaaagactaataaaaaccaaataaacagtacataaaaagtaaacaaacatgtagatcatgattttagatgaatttagagacttgaacggcctcattccgacttcatatgaattagatatgaattttacaagatttaattccaattaaacctattaaagaaaagactattccaaattaattaaaccatttacaaatgatttataactgagagaaaagattaaacaacctccagaaaagattagattatatttggtagatgacatatattaaaaagaaataatatgccattgaaaagagagaacggatagaagtctcaccgaaccaaagcgatcggagaggaagggatgatgacaatgttccgacagcaacacacggagatgacaacgctagaccaatcacgaattagattatattgaattaagaccctagggataaactacaccggtgaacgacataggagcggcggttaccggcgaaccacgacacaacaatgcaaacggagggcaccgggaggtagagaaggcgacggcgattcttaccaacacttacgacgtgatgacagacagcgacggaagacggccgacgacgagatcgagatggcggcgaggtactgtccacttcgcagctgcgaatccaatggaggcggcggcgaagcttggcgatgacgggaggagcagcagagcctcgccggagatcaaaacacgacggcgagcttcgggttgatggcgacgatgggcttcccggggtcttcggcgcaagggaacgggctgccgggcttgctcttgaccttgcggagccgagagaggtggcggcacaggagggcgacggccgaggcggcggcaaacggcggctggagcggctgccggcagcgagagagaagacgaacgcggcgacggcgctacaagcgacgggggagagagggagaggtggtggccgaaagaggagagggaggggactctatttatagccatgggagagagagatcgggcttggaacgcaaggaatcgcgccgggaaaacctagggtttggtggagagataaacacgaatcaagctcaattccgcgttgatttcttcgggataaagtccgattcttggggggaaaggatagaggaggataagaggaatatttcccctcaactaattttgaaataacacgagagaggagaccggatttggaggagaaaacggcgctgcacaatctcgggatggctggctcgggctgtctggagctggaagatgaacaataccggcgaagtaaagtagactttggctgggcttcctttttctccagcccgactgaaggagggacctgaaatggacttgagccaagagaaagaaggagagtgggctactgcggctaaggaaaggagagcgaagagggaatggtctgaaaagggcccaagctgaggaggaggatttttattactttaccaattaaattaatcactgaaatgatctttgaattgttaaaaatatttcctatgctcaaataattccaagaaaaatcttgaacatacttggacactcaaagtatttaaaaatattaaaaccagaccatttaatgattaatttaatatgtggataattactgaaatgttgtttgtatgattaaaattaagagttgagctccgaaaaatccgagaaaattccagagagtataattaaccatggagaatttaataaaaattaaatccatccatgatttatatttaggaaattttatttcccacatttaacttcacttgtatattaatgaacatttaatataaattctaataataatttattagataatttataaatcctaaaacgaaaatcaggatgtgacaccacgagcggtgggtaagtggagggtggtgtagctcgaagggaggggatggagcggtgaatcggcggaggaggcgacgaagatggcggcgagcgaggcacagccggccgtggtgctggcaacggcgtgaggcatggtgctgcggcgcaaggtgcctcggccgaggatggcctttgccgatggtcggcgttggcggctgccgggctcttggtacagcggccagctatccagccggcgcatgtggcggacgatgccatcgtcgagggtggcgtccgggtggcggtggagccggagcaagggaaccgcattggcaactttttggcgaggatagtcgccgcttggcgatgggtgtgggtcaaggtgtggtcctttggaatagtcatttgtactgtgttgacttgggtagtgtatcatatggtttttctatggggtttattgcttgagcttacagacgatggccatgatgatcatctctgggtggcgatccttctcctcattctgttggcacccgtggtctttcttaattatatggatactctgtaagctagatagtcggtgtcttgcttgtcagatcaaggcatgtatccttagttgtatggatcctgtgggtttatttttgagacttttgcttctatgtcagaggcatgataaatccaaaacttgggcgtgtgtcggcataaccttcttactacgaggggttatcgattaattccaaaataatttctaccggcgcaaaagggctttccaaagggagacaatttggtttaggtgtgaataaaaatactcagctccaaaaacatagagatatggcggactaactagcttcattccatattacatcgggcactgaaagatacattccaaaaggggagaacgggactaccaactaacaatgcaacgcccaacaggggctcacactcctaatcctacttagagagatggtggaggtgaaagtggattgatcggtaatggaggcttcctgcgagtccttctaagttgggggcctagatcatgttggtcgtcgcgcgtgcctgcacgagcagagcggaggtgttcttgtggggcagctgctggtaacgggcttctaagttggtgtaccgatcacgaagttcgtccagctcctcaagtgcctgctcgtaggcgttcttggcagagcaggccatcttagagaggagcgtgcaccgacatcctttgggcaatccggccatacggaggtggtaccgattgtcttcatcagtgcggtatgggtgcaagccatagtcatggtctatgcccaacggggcagagagcttgcaaagccggtacagagctttgcggaatacgtcttggaaggcagcctccatggtgatccggggatggcgggtttcgaaagagatcatctcgtgctctttctctctagggaaggaaaggaggagtttcgccttccagcacttctgggatccctgaaaatctgctcgacacgatgcatcagctcggcaaagccaacgagctgtcggagtagctgttccagctaccgggcatacccttcagggagcttttgagagatttcccaagggggttcaacccatgttaccgcggggtcagggatggctggtgcgcttgcttgagagcgctcggggttcctttttataggcaccagacactggggctttagtacgtgcgcgtctcagggtatggtcggtctcaattattggtggtggatagtgcgtggctgtagatcctatcggtcagagttcctatagggcctgtctgtcagggttcctgtcatgctcctaagtgtgttgttagcacacagtggtttccggattttctggagtcctcgcacggtcgggtacgatttggggtaagggtgtaagtgggtcagccgcgaacccacttataggtcaaaataagcgggtccgcggcttattttagcttataagtaggtttcgcgggttagccacttacacccctaatttgggggtcctcgttccttatgatcgaagcttcttattgcagctggttcagagtgtctacgtgtcggtgattattcttcttgatcgacaccagattaaagaggggtatgaatgaaactttggaaggagggggacatcgtctatgggtttcagcccgaagcttggtggaggaggcagtacagacttatagggaggagtaggggggaggcagcatagagttatctagaaagatagagggaggtagtacagacttatctggggaatgcacaatatttgttgggcttggcctgaacgagggaagggagctagtgcagacttatgggaattggtccttcgggttgggctgagaaaatagaggaagtaactacagacttccttgtattggagagggttcttgggcctttgtgtaaggaagtaaagggaagtagagggacgatgataatgggctcggtccaaaggtgaaggatcctaaacggacttctacagaggatcaaaatattgggtctagtgagaaaatagagggaccccatatggacttttactgagaaactaatttctctagcctagaaataaaacgaggtcacatattcttctcgaggtgcagctgcggacggtgatctcggatgcaggctagcacatgtcctctagcgtagcggctcgctcgacgacactcctgcttcaggacatcgtcgatgcgctggcaatcccttcgagctgtgcgcaggccccattcaaccacgagatataaccagccgccgactcctcgggatctccgcggggaactcggagctccttgcaaaccctcgccatcgccatgcagcagctcttgaggtacgagttgaaccacacctcgcgaccccggagagcttccacggcctggtccttcttcacctccaccatggttttttcgagtttggccacctcgagtttcgtcttccaatatcgcattcgacgatcttagtcagccaacatgttctcaaaatctacccgacacggaaaagactaagtcaagctattcttctcttccgagaacatagctaattaagtcaaacggaacacaaggagtgaaggagagcaagatacaaacctagtgacgtcatcgccacgctcgcctccgcagacaggctttgactagtttcctcccgcagcacgaacggctcgagtgtgagcgccggaacgatcaccggcatatcgggctgcccgcgctgctggacgtcctcgacatcaacatatctacaacaacaacaaagtactcagaatcacatgctaaggaaactagggagacagctattcagataagagcaattcagatccacagaaaagttttacagcatgaaggctaaggggtgcaagggaaaacaaatatcctactgttcaaaaagggggaggacggactcccccaagtcaccgacttcttccatcatagccttgcgcgcgtcatcggtggccccctgatccaaagccttcttaaggtccagatcgggatatgccagcctcatgcacgcaaggacatggcactccccggtgtagatgccattggacgtctcctcgccgatcctggccgcgtgcttggaggggatctcctccatcgccgtagccaattccgcaagcgacgacgtcagcgagaactcatcggggtgcgccgggatggtagtcgtgacaccacactccccggcgagttggtgcaggctggtgaacgatgttcacagcgaaccacagatgttgatcatgtgaccctcgagctccgacatccggtgcttgagtccgcgccgttgcatctcgttgccggccaccagctccctcatctttaggaggtcctcgcgggcctccgctaggtcgcgcgccagctggtcggcacactggtttgccgacaacgctgccgccctggcctcttcgatctcgcgacctacgccatgagcaccggcctggagaatgcgctccatctccgcttggacctccccccaggtgagggcatcggtggacgggccccgggtaggcacggggctaacggcagggccactcggtgctgcctcctggtccttagcagtgactaagactcccgacgaggtcgctgcaggggacgcgctggatgcggcatcagccccaccttgcgccaccttttcccacgccaccctgcaaagattttcctcttccccatgaggcgaggtgatcagaactttgaaaatgaaaagacatcaagaacgtttacttacttctcgccgatcgtcaccaacctttgccttcgctgaggcggaggagacgtgttcgagtcctgagtaggatgaaatggtgtgaggagaagttcttccgactacgcgctaaaaaacgagagagaagcttaccgcggaggtcggcgctttccgacgggtcccgagtacggaggagaatttcctttccctctttgggatgttgctaccactcgtggtggcagcaacaacgttagatggctccttggcaacgctctctttcaacgacgctgccgcctggtggtccatgagcggcccgatgacgtccgtcagagggagggcctgcataacgtgaagtcacggcgcaatctagacaaggaagatataaaggtattatcgactacacttacattaatcacggcggcgcgctcagtcacatccttatcacagagtgcgatggggatatcgcccgccttcgtgggcacgctgatcattatctgaccaacgcggcgtcccacggtgtcactgtccagacctgtaaatcgagaatacgaactcgatacgtcaggagaaacagatgcgctcagaacaaaaatagaaatgcgagaaaaaataccccgaggagagaccctggtcgtgtcctctggcccagagtaatcaaaggccggatgggcgtggcttttttttctcttcactcgaaccaatccacccagccgacttcttgtgttttttgtgagttgtgtatccactccaataatactattgtcaagtacctttagggatgaggatctcggcaagatatgcagttcttggagaatgaaaaaaaaccgatctacttctttttggtattttagactaaattcttttgttcctcgatgcttaatcaaaacccccttttttaagacggaatcttcctccgggttcccatattcgttctctgagtcttcctctaaagtcccatgttcgtcctttgagtcttcctctaaagtgccatatttatcctctcggtgcctatatttgttctctggactcccatattcgtcctcggattcctcctctcgagtcctatattcgtcctctaggattccatattcatcttctagggtttcatattcgttctctgggatcccatattcatcttctagggtttactcctcctctcgagtcctatattcgtcttctagggttttacattcttcctctctggtcctatattcgttttctgggctcccgtattcgttctctgagtctttctctcgagtctatattcgtcctctagggtcctatatctaaatttaacaattcctgaaccatttttatcttttttgtatcgtgggtcgtcaaaataagcaactatagtatttctacgtaaaacacccataaagggtatttcaatcgaaatcccaaaacaggatattggttctttctcttgttcttgatgatactataatggaatggcgaacctatttcttcgcttttttgctaacaaatccaaattattttgaagaatagaaggatagacaaaattccaatgaccattggacatgattcgatccggcattgaataatcaagaatttccctatcttttttaccaaaagtatccaacagtctatgtcttacctcatcatcagccatcgagaggccaaagatataccttccgtcaacagaaaaggaataagtattcatttgatcttgatccttgtggagtgaaaaagaagctattactaaacaacgacaaaattttttatttgagctatatcctgccataagaagaccaataggagcaatacttgaaatggcaatccataaaaaaacaccaatactaagatccgctaaaacaaagcgatatcccaaaggaataactaaaaaacttaataaaattgatatgactgctatagacggtccaatgctaaataagggaatatcccctcgggatggcaagatatcctctttaaaaagtagcttagttccatctgctatagcttgaagcagtcccagggggccagcatattcaggaccaatacattgttgtatcgatgcggatatttctctttctaaccacacaattacgagtacttctattgtgattcccagtaagagggtcaaaatgggtagaatccatatcagtccatagacttcttttaataattccaagttcgaaaaagaattgatagcttctacctgtaccctgtctattatcatttcaacgatcaacttctcccataaaaggaacgtccgctctcacaattccctcttcatctaccaaaacaaccggaaatgtttcaaaaaaaagtaggcatacggcgtacaaaaagttcgcgcccttctttatctctaaagataggatgtcctaaccatccaacagctattccatccccattgtccattgagcctgctctgaataatcccccctttgtgggcctacagcggttgaatccacctacctatgaagtcggcagcgacttcgtaccccgacaacccccgttctcggagatgatggatgagggcgataaaggacgggagttagggcgggtttggcggcctactccgggattttttctggctgaccttcagggacaacaaggacgggatccgagttctctatttgaaggtagaaccatctcgtccaccacttgctgcgagaagaggggcactggaaggggatgtaacgcgacttcaagctatcccgaagtcagaatccaacacatccagataccctgctagattccatcaagcagctcatagtaaaaa

SEQ ID NO: 47818 - DNA, 11421 bp, Oryza sativa
  unsure (1)..(11421): unsure at all n locations
cgaattatggatagattgcacacagaaattaaaagaagataggctcgatggaaactgtttgaattttcaggagacataaacagagaagataaattctggaaaaattatatatattcataataaatggcctagtatttgaataaattgtttcccctatacactcccatgaagttaaatgcacttttaaacaaagtatggttttagccaattaggaattttaattagtctattatttaactgggttgacttatttatttgatgtaccaaatttagttattaaatcttaccaaaattacaatgagttgtatatgttaaatagagccttcatgaattttcccatggttttatcttgcacgaattattttagataattagcaagacttatctcttatatgtgtttccctttcctaaatgcatctaaatgtttataaaagttatatttggactcttcttaacctgaggtgatgttgatatgttagaattgcagtttaccttacatatgtcacaaactccttaccaatttatgtataagtttactttagtattaaattaagagaatgcttatcgagatgattaagatagaatataccctatatgagttaatttatttgttcacttccatgtacatgacttgtcttcagatggatgaccaaattagttttgtggggcttgacattggccttgttgatatattttacgtgtatggcttctattttaacttcctctacctaccactaggccttaatggtttggttgtttatctagatcttactctatcattcatgagatctattatgaaatgcactacacacctccaaatgccctccaccgacttacgctcccctctcatccccgcccccccccttcctntcacttgtttttgcatctatggtataggttaaagatgaaaatgttttaatttgttctcaaattttacttcagtataagttagatcaacttcacctaggttttaaaatggaaatttttggttcacaaaattgaagaactttcctttcaactagttttgaagaaaattccttaatcctagaatttgggtatgttacagttggcttgtggctttgtggctttgtggctttgtgcccttgtggcctctcccctatcctcctagggtggcttgtatttatacccatagataaccccttgtccaagtaagaatacggagataaatatggatatgatctgagtagtccttgtcgtttccatgtagaactcttcttgtccttccttattcggaactccttctatatacgaggtttgtttccgtataagacatggtatgtggtgagccttgccgagcttagtcgattactattggtatgtggtatccataaccctgacaaccgtcaatatcaacaacccacgaagaggtgtatcgatctctaaggcgcaacaaaacaacgtcttgtacggttttagtcggatcatcaacatttacccaaatcgtagttatcaccaactcactgaatgatcaggccaatcatagccatgagtgtcttgagtggaactcatggtttatcaagtggtatttgcttggtgagttttttttatccacctataaccagaatatagccataaaaaatattggatccattacctagccatctttgtgcccgctgcattgttttttttagtttttgctttgttgagttttgtgttgcatcgtcgtgtcatgtttgttggtatttcttaacgctcacggataaaatctacaagcgcatggagatactgatgtagcacttcacccgggagtattccaaggtatcgatttctaaagctaatgtgtgtgcttaactcttctctagtttcatccaaggacacaaggcagatataggaaaagggtagagaggatttcctattgaggaacatggtctatacttcaggcactggcttactcactactgttggctgctgttaaatgccaattctatgccgccaatacctagataaaacatagttaataagacatccaacatagtggtagggtttaattctaacatattccatgagtgttgatacatatttggatgaaatccaaagttgggatgaaatcaagacttaagtgaaggaagaattgtcacgaccggaattaaccaaacgggcgttccttacgtgcgtgtattattccttgtcccaggaggcaaggtacaccaaaagttgatacatttcagagtttatcaagtggaagcgtaaatagttaatttattacatgggcggcgaaggcccagcacacacaaagacaaacgggaaacagcggaagactagggcgacgaccacaggcgcttgacggcaggcacgagctagacaccaaagccttcatcttccaggggctcctcttctgagtttgggaaaaattgagcaagactgagtacaaccaccgtactcaacaagacacacccacaagtgcaggataaatgcaagggagtacaaggggattataatataaagggttagagtttgtagtaaacagcattaaaagacacttagttgctcaaagctattttgtaaacacgattccagagctatacaatattattagtcaaggccgtgaacccacacgaacctaccttaacccaaggcctacgatgattcagaccgaactggcaacccgaccctgggtcccagctcgtcccaagccaacccaggccaaccattccacattttagttgttaagcatgttttaagaattaaaacactaacttgggtacattgctcggcttgcccataaccgagggcgcggctattcgaatagattatactctgatcagaggtgtacatctttacccacaagacacatcttcctcacgtgtaaccacgtgccacataccaccacggtatacggacggaagacatgacatagtttccaacccatcctagccatagacaagagtaccgacccaaccccacctatggccggaacccccgggacaggtaggcaggactgagcccctagcagcaggacaccggccctgtgccatgacatctcgactaccgggccgcagctcgtgtagccttcatttgtcctagagatgtccatcgaccaccgacttcgtccatctccatccgtgtacttttgtttataaccagactgagccacaaactaagccttacccactatacatgtggaagtacggtagtgctttgcaacagaggcccgaagaccggtccttatatggccgaggtgctactatcaaaaccatgcaccccgagcccagcctaaaactattttgaggattttgaatagagggggaggtgtgaatccaatttccacaataatcaaaccattccatagtgtccaggtgatatgaatatcccaaagtctagagttgtaaaaccacccaatgttgcctaattaaccagcgaagcatctacctaaaatcatactagtggtaccatgagtagagtgtccactagttggggttttgtttattctagggtgaacaaggaaataataacaataacaataataaggtcataacaaaggtaaataggcatggctagataaaacagtgataacgcgggaatttaaataaagcgataatgcaataatttaaatcaacataattttataaactgggattcaatatgtttaaggatgatgtgacttgccttgctcgctttcccaaacgtcggcttcaacttcaacgaagagcggatcttctgaagctgcagcgtctacacgaccaacgaaaaagaaaaggcttttactctaataaactccatataacaagcaggaacaaagcacaaaaatgggttcttgacttcttaaggaaaaattagagacttgaacggtccaattccgagttcaaatggccaagttatggccatttgaagtttatatgctctttaaatgaatatttgcgaatttcttcatttaaattttaattttaaaagggtttattgcgtcagccgaggggagggggcgcgcggaccgggtccacgggagtggggcccacgcggcagcctcacggtccacggtggaccgggtgcactcaggctcacaccggccggcgccgtgggtcccacgcgtcagccgcacccgagggcgcgggcggttgacggccgggccccacgcggcagccgctcggtgcgcccgaaggcggccacgtcggcgcggccggcgggaggcggcgcgcccgcgcccctatggtcgccggcggcggccatgggcacatcggagcggcggccgagagaggggagggaaagggggaaacgaggcggcggtccacggctcaccctaggtcgacggcgaggacgaaaaggcagccggagcggaggaaggcggctgcgcggctcgggtcgacggggacggcggcgctccggcggtcgacgagcgaaacggaggggtggacgaggtcggcgaggatgcggcgaagccgaaggaggcggcgctgaggtgggaggtggtctggggcgacgacggcggcggaccggagctcggcggcgacggcggagagaaagcgacggcgcgagctcgattccggcgaggaggaaggtcggcgagaggcggaaatggacggaggaggtgcggggagggtttaaatagggttggaagggggagagagcggccggtggggaaggaataggcgcgggaggtccggccgccatcaatggcgccggcgagatttgcgggggcaaatccgcccgtttgaacgcgagagagagagggaaaaatggggagaaagggagaggggatcacggggagtgatttcccccctctttattgcacgcggggacggcgggaggcggcgggattcgcggcggcggcggcgctagggcgcgggcgaggtggcgggagcggcgggaggaaggggatgacgggtgggccccacccgtcagcgagggtggcgggcgggcccgcccgtcagcggcgcgcgcgcggggagaggccggatgggccgcggggaaaggagagggagagggagggaaaggggactttttagagtttttctttttataaaatcattttaactttgtttatttcttaataattattatttgtgctctgaaaattccactaaaatttatttacgcattttaggcttttaggaaatatacaaaaatcctccaagccttatttgacttttaactttgcacattttaattgttggaggctttcacatggattttaattattctaggcataatttagaggatgtattttagagtcgttttgggacgtgacaaacctaccccccttaaacggaatctcgaccccgagattcggaagaactggcgaagagatcgggatgggctgctttcatctcgtcttcacgctcccaagtagcttcttcctcagcgtggttgctccattggaccttgcaaaaacggattacctggttcctggtcctgcgctccatggtgtccaggattttcactggcctctccacgtaggtcaagtcttcgcgaacttcaatttgctctgaatcggcctgctcggatggcactcgaagacatttcttgagttgcgacacatggaacacatcatgcacgttgcccaaggaggcgggcagctccaactggtaagcgacttccccgcgtcgagcaatgatacggaaaggacccacaaaccaaggtgcgagcttccctttcgtctgaaacctgtgtacacctcgcaatggcgtgacccgaaggtacacaaaatcgtccactgcgaattccagattacggcgtcggttatctgcataactcttctgccgggactgtgccacctttagattatcctgaatggttctgactttagcttcagcttctgtcaggatatcagtcccgaacacttggctttccccaacttggtcccacaatagcggtgtccggcatttgcgtccatacaacgcttcatagggtgccatttgtatgctggcttggtagctgttattgtaggagaactcggcataggggagactcttatcccaggtcttcccgaaatctaggacacatgcgcgaagcacatcttctaggatctgatttagacgctcggtctgtccatctgtctgcgggtgatacgcggtgctgaaatttaatcgggtacccagctcttcttggagcttcttccaaaagtgagaagtgaattggcttcccctatcagatacaattttcttaggaacgccatggagactcacgatcctagcgaagtagagctcggctagtttgttccctccataggtggtcttcacaggaataaaccgagctaccttggttagtcggtccacaattacccatatagaatcatatccgccttgggtttttggaagtccggtgatgaaatccatcccaatttcatcccatttccattctggtacttggagaggttggagaagaccggccggtcgttggtgctctgccttgacacgctggcacacatcacaaagggccacgaactctgcaatttcccgcttcatactaacccaccagtatttctctttcaagtctaagtacatcttcgtactgccagggtggatggaataagggctttcgtgagcttcctgaagtatcaactgtttaagttctctgtcgtctagaaggcatacccgatttccgttccatagggttccgtgttcatcctctgtgaaaccagcggctttaccctgtttcatattcttgaggagtccacgcatatccggatcattcttctgagcctcgcagatttgatcgagcaaggtaggcttggcttccagcgtagccaagaatccacgactaactatgcttaggttcagggcttccatctgttgattaagttcgggtggaatgccacggacgtcaagagtgttgcaatggctctttcgacttagagcgtcggcgaccacgttggccttaccaggatgatagtgaattcccacatcataatccttgatgagttctaaccatctcctctgccgaagattcagatccgactgagtgaagatgtatttaaaactcttatgatcagtatatatttcgcagcgattcccaatgagataatgccgccagatttttagagcatgaaccacagcggctaactccaaatcatgggtagggtagttgccttcatgaggccgaagctgccgggaggcataggctaccacatgaccttcctgcatgagcacacaccccaatccttggcgcgaagcgtcacagtacaccaggaagtccttgcgagtattcggtaagattaacactggcgaggaaaccagcttttctttgagagtttggaacgctttctcacattgcgggctccacacaaatttttcttccttcttcagcaactgcgtcatgggtctggcaattttggagaaattctcgatgaatcttcggtagtacccggccaaacccaaaaagctgcgaatttgagtgactgtcttgggttgcttccaatcagtgacggcggtcactgtttcggggtccacagcgactcctttagcagatatcacgtgccctaagaatttgacttcggaaaaccagaactcacacttgctaagcttggcatacaattgatgttcccgcaactttcccaacaccagacggagatggtgctgatggtcttcctctgattgtgagtacaccagaatgtcgtcaatgaaaaccacaacaaacttatccaagtattccatgaacactttgttcattaagttcatgaagaaggcaggagcattggttaaaccgaacgacatcaccgtgaattcatacagtccgtatcgcgtggtgaatgcggtcttagggatatcttcttcacgaatacgtaattggtgatatccggaacgaagatcaatattggagaatacagtggcacctttaagctgatcgaacagatcatcgatccagggaagagggtacttgtttttgatggtaacttcattgagagctctgtagtcaatgcacatcctctttgtcttgtctttcttctccacaaaaatcacaggagcaccctagggggaagtactcggccgtatataccccttttctttcaactcttccaactgtttcttgacttcggccagttcatttgatgccatacggtagggtcgcttgtacaggggagtggttcctggagcaagatctatccggaactcaatctctcgcttcggcgtcataccgggtagttcttccggaaacacgtctccgaactctctgacgatggggatttctgacagtcctatctgatgaagttctgaactaccgacagaggttgggggagcaaagaaaacaaccggttgttccggccctcggtaccgagtgacagtgcgtcttgcacaatccactactccttggaattgagccaaccaattcatcccaaggatcacatccaagttcttggtgtctagaagaatcagatccgagggaaaaggaattccctgaatttctataggaacggcagggctataatactttgctgtcataacccctccaggggtggtgatgagcagagggttcctaagcctttctacccccaactgatttctccccacgaatggcacagatataaacgagtgggaagctccagagtcgaacaaaatggtagcagggatggaatgaatgaggaacgtgccaacgatgacgtctggagttgtcagcacatcctcggccgtcacgtggttcacccgaccccgaatgacatccttaccaccgttgttggggcggggaggcgcttggccttgctggcgcctcggctttgggcatttatccgcaaagtgcccatgctcgaagaagttgaagcacagacgctgctgaccttgaacgtccttgcggccttgaccaggctgcacggctggcgtaggaggatggggcgcacgagtcccttgctgactctgctgttgctgcggctgtgggacgcgcaccacgaattgaggtcggggcgcggagcgaggttgctgctgctgttgctgctgcgaggacgatccccctggatagggattggtgtagcggaccctttggttaggcccctgttgattgcggaaattcgccaagcgacgcttgtgcgactccagttccttgtgcttggcttccaagcggatgctcttgtcaaccaaacgctggaaatccggatagtccccggagaccagacgcacggacagctcagggtccattcctgccaagaacttctcttgcttctcctcatcttcacgaacatcctccggggcgtatcgggccaggttgttaaactcatgcaaatactccatcacagagcggttgccttgtttcaactctcggaattcccttttcttaagggccatgactccggcgggcacatgggttctccggaaagcggcggtgaagcgggcccaagtaataggctgcccttctggctgcgtagcctggaaatggtcccaccatagagatacgggcccctgcagttggtgagcggcaaagatgactttctcctcatcgttgcactgcacggtgtctaactttttccccacagcatgcaaccaatccaaagcatccacggggttattggagctagagaaggtaggcggacggatgcggaggaactcggcgagtttagagagttgtgggggcggtggtggagcattatattgtggcggattttggatgtggaggaaagcagccatcatgttggcctgctgggcgaggatttgggtggggatggcgttggtgtctcgtggtggtggtggaggcggaggaggaggtggaggtgggctgccatggttgttgtggttgctaccttcgggttggttgccatcaccggtattagcacttctcctggtcgtcaccatctgaaaatcccacacagaaccagcaaacagagagagctgacaattaaagctaaccacccacgactaccataattcttgaatttattactgctattaaattggttcattaaggttcaagttgcttaagcaaataaaataaagacaggctccgacacagttataccacacaccggcataaccatgccccatacgactctagcagaaaaacaaacgagaagaacacacgcgcaagcctactaactgctcgatcacccatcccaaattgctccaggccaagcacgcttaaccctagagttctttggagattggcttccggaaaagaaattgcagcttgttgatatgagtattctattaatcctattaagccctaggccaggatgttacaccctcacccccttaagagagatcgacgcccccgtcgatcaaccctaggccaggaacgtcctctcttggccacgtccatgtgtccagtgctagcgcatgtgccatgctgtgtaaccactcccggtctacaccagccatgcgcaccatgcctgcgcaactgcgacacacgtgcccgtgaaaccgcgagaaatacatcctctaaattatgcctagaataattaaaatccgtgtgaaagcctccaacaattaaaatgtgcaaagttaaaagtcaaataaggcttgtgcaaagttaaaagtcaaataaggcttggaggatttttgtatatttcctaaaagcctaaaatgcgtaaataaattttagtggaattttcagagcacaaataataattattaagaaataaacaaagttaaaatgattttataaaaagaaaaactctaaaaagtcccctttccctccctctccctcttgggccggctcggcccatctccctctcctctccccgcggcccatccggcctctccccgcgcgcgcgccgctgacgggcgggcccgcccgccaccctcgctgacgggtggggcccacccgtcatccccttcctcccgccacttccgccgcctatcctgcgccctagcgccgccgccgccgccgcgaatcccgccacctcccgccgtccccgcgtgcaataaagtggggggaattactccccgtgatcccctctccctttccccccatttttccctctctctctcgcgttcaaacgggcggatttgcccccacaaatctagccggcgccattgatggcggtcggacctcccgcgcctattccttccccgcgggctgctctctcctccttccaaccctatttaaaccctccccgcacctcctccgtccatttccgcctctcgccgcccttcctcctcgccggaatcgagctcgcgccgtcgctctctctccgccgtcgccgccgagctccggtccaccgccgtcgtcgccccagaccacctcccacctcggcgccgcctccttcggcttcgccgcatcctcgctgacctcgtccacccctccgttttgctcgtcgaccaccggagcgccgccgtccccatcgacccgagccgcgccgccgccttcctccgctccggctgccttttcgtcgtcgccgtcgacctagggtgagccgtggaccgccgcctcgtttccccctttccctcccctctctcggccgccgctccgatgtgcccatggccaccgccggcgaccataggggcgcgggcgcgccgcctcccgccggccgcgccgacgtggccg

SEQ ID NO: 47819 - DNA, 3986 bp, Oryza sativa
agttcggtctgaatcatcgtaggccttgggttaacccaggttcgtgtgggttcacggccttgactaataatattggatagctctggaatcgtgttgccaaaatagctgtaagcaacaaagtgtgttttaatgctgtttactacaaacccgtaccctttatattataatccccttgtactcccttgcatttatcctgcacgtgtgggtgtgtcttgttgagtacggtggttgtactcagtcttgctcaatttttcccaaacccagaagaggagcccctagaagatgaaggctttggtgtctagctcgtgcctaccgtcaagcgcctgtggtcgtcgccctagtattccgctgtttcccgtttgtctttgtgtgtgctgggccttcgccgcccatgtaataaattaactatttacgcttccacttgataaactctgaaatgtatcaacttttggtgtaccttgcctcctgggacaaggaataatacacgcacgtaaggaacgcccgttgggttaattccggtcatgacaagaattctatccatacaagagtgggccttaaacttcatcgaaacatcagaaaataggcccaactacctgagaaatggataaggcaagctgagagagagaacaggccaagttctggtcctgttgggcccagccagggttcggccggactccaatctcgaccgttcagtctagggttttcatggacgctccagatgctctccggatggtggttgcgggacattttcaataattcgcatagcagtaaccgccatacttgcctataaaaggagttaatcacttcacttctcagacacactccaagcttgagctgagttataagaggttctattgtactatattgtatactagaattagggagagagtaaagtagaagaagttggcggaattccggagttgtcggtaatcctctcttatttcttatactttgttaattactctgttttaatagaattatcattctgagtaattaagatttactcggtgagaattaattcttggttagtttctaattagcgtgcgggatcattgttcactatagtcctttaaaatatagtgattgctttagtgtttagctagcgctaaagtaattaattgtgtagacgtggtgccagggtaattaatttccggtggttgcttcgtatcccacagtaggtttgaggtgggtgtagaggtggtgacatccctcaattacactaaagtcctccttgtccgggtacgcagtagagtgacatctaggagcagcgagctggccagtgcctgaagtactaggattaaactgagctttctgtagacactatttctcactagtaaatcctctctatcctttgcttacctttgcttcgtgtccttggatgaacctgacaaggagctgagcacacacgttccctagggaaatcgataccttggaatacttccaggtgaagtgctacatcggtatcttccgtgtgcttgcggattttatctatgacgttaaaaaataccaacaaacatttctggcgccgttgccggggaatggttgatgttcatctccgaaccttgttcatcttcgtatcatttttacttttcattcttcaaccttcacccctgctatccccaataagtattcttgtaaaactcttctcacccatggagccacaatctatctttcaactatctgctccacggggcaaatcttttgagccacctccttcatcggggccaatttttacaactggctatgaaagtcgccccgaattaataaggagtctgcattctatctaggcatcactaccggaggatcattcatgcaataaactccatctgaaggaaaagtaagtctagatcggattctagaaaatacttccttcatggatcaatgtaatgaactcctcccggaagcatcagtgtctaggattgaggaacctccgacacccgaatcttagtctgaaccatctacctcaaccgattcggccgaggaaccttccgccgagccattgcctgttgagaacgaagaaattcaaactccgggatgtgctccaacgttcagggatgatctttatgaagattatggaaacaccttgaactattttagtaaaaagaaaccacctattcccttgccacctcctgatccgatagaatatcaatatctgaaagaaacggttcgggagctgacatccatcatgagtgacgaatggttaaaggaggaaaatgttgatgcaaaaaacacacactagcctaggagatctgcttagctccagtgcaggtcctaagaattgctttagggttttgagcatgccagctggtttgatcatgcaaccaacaagaaataaaagaagaacaattaagtccgcaaatgatagccgatcggctgtgttgccgatgatgtttcatttgatatcaggccgatgtgatgtgaaccagatcggcaataaaatactaaacaagatagaattaaatctacttgattggctgcagatatcaatgatatataatctttttctaaaaatatgtctaaactaagcgattgggatagatcggacagtgagccgagacagtataaatcacttatgtttaaaagtactttaagacaaagattatatatatttatagcttagccaatgaggtaaatctaagatatatcggctaatactctgataccatctatactaagatattaaaacagacaaaatataccaaacaacaagcttaatatatttctaagcaataagatcttaatataaagggcaagtttagcatgtcaaacaaataaaacaactaaaccaggtaagatcggctgaaaccccgatactatctctatcaataatcatagaacaagttagatattataattctagatattacttaatagatcgaacctaaccgatgcagcattaagtacaaaaagaagcataagatctagacaaaccgatgaaaatctctttgagatggtagatatactatataaactagatcaacgttgatatctaaccctatcggccgccttcttattaatagatattaaccgatctagggttagatagcaatattgattgagattttatagcgtatatgataactcgacgattcacataaacaagattagagtatcatgaagatgtaagcactaatcccgagaacgcaagccgccatgacaagttttacctctcatcggagatcgaaaccgatgcagcccaactcgaaagcaagaactcgtcgaaatagtgaaagtagaaaagggtggcaatgcgccgaaagtgttattgaattgtttttgtcattatacatggtcttgggttatatttacaccaaaatacataatgtatccttgccggacacgactctaaatctgttacaaccgtaagatacggacaagtcttttaggcagactcttgccggtaaatatctctaaggaaactacccacaatatcctaattaatagatacaattgcctatccgtgagctcatctcaatcatggcaatacttgtgcagcacgtcgatcaatcccaaagatgattgtagagccaccttagcgagatcggctccatcggctatcctctatctgattgtcacgcccagaaattcccgaatagaattccaagcaaaatgtacattaaaatccccgtccaggaccagccggggtacacaaacgacaatgttgacattcagatccacgtcttacaaacatcataaaagtcttacataaatgcagcggaaagaaagaaagacaacaggagctaagccttgacttgaactgcagcgggaacaccactccacaggcatcctcgacggcacggacaaagcctactcctcggagaaaccttcatctgacccgaactcgaaatctggggttgggaaaagtagagcaagactgagtactacccactgtactcagcaagtcataccggaataggggtatgatgcagggaatcatcaaagaagagctgaagtggttcatttgcataaagcgagcatttataaac

SEQ ID NO: 47820 - DNA, 8486 bp, Oryza sativa
gctcaggaactaagctttattacaaaggaattaaaactgcaattgttctgatctgaattaaaacacttaaagagcaagcaaaaatccttattaagacagccatatcataggcacatgatatcgactgtcgactaaccccaaacaagcaacctaaacacacaaattaacaagcagaagctagacagtcgataaactaatggaaaacgagcctaatgctcggaacggctcctgcggtcggtggagtcgaagacgtcctcctgctcgtcaccaagtccctctgagcgactcccggagcctggcagataagtctcgccactgcctgactctgagccactgggagtagcagacaaccaacctccattgccactggctggacccctggcggctgatgcgggagcgaaggagagagcggacgcaggagctggagctgcaggaactgccggagctgcgggcggaactggaggtgctgcgggagctgcggatggaggtgggttcctgggcgcaagctggatgcgcacgggtgccgtcgtcgtcttgcggggcgtagtgcggatccggactcctcctggcgctggaagaccctttagctgagcgttctccctcttcaggcgcgctatcttgtccttcagagcgacgatcctcatgagcttcccatcgttcaaggccttggtcgccttgtgcaggtctgagtgcatcctgtccaatcccctcatcacagcacacatgtgaccaaaggtggtgtcgttctcgccagctgtcggatggaaggagctgacgtcatcaccgttggctcgacgggggtggaagcggtacgccgtgtcgtggaagatgtagttgtggcactcccgtagtctggccatcatcaagtaggctgcctcctgacaggcgtgatctgctgtgcctccagatgcctcgaccaccatgttagctaggcaggtacccacgtagccgtggacctccaagcgaacacggtgaggaagctcgccactgagcggtggaatcgtcgtatactctggcgcgttggggtagcccaccaccaatgtcatgcgtgccaactctgccacaaagtcgatcatgccttctccgcggtggttgggtgggtggccggccatctagagaagacagaggagtaggatcaatgcatgctcaaatccaagtttaaataaagcaataaaagactcaaataagagaatcgaatgaaagcgaaatttttatgcatagatcattttgcatgagagcgaataaataagacagactcacataacgataaaataatgagaaattagatacatactaataataacaaataaagcataaataccttgcaacccatgttcctgagctaggacctaatgcatttcacccatcaaatcccaactgactgacgaataaatctcaacagttttactaaaaccctggactgacttgttttgacaaatctcactttaaacgagcgaccaagatttttcccttgaaccacaaaaactgatcccaattttcccggaataaaatccaattgcaaggaacatatgcaatgaaaaggattcagagggctcttaggtttttccatttggcttgtcctacggtcaatgtcggatctgataccaacttgtcacgcccagaaattcccgaatagaattccaagcaaaatgtgcattaaaatccccgtccaggaccagccggggtacacaaacgacaatgttgacattcagatccacgtcttacaaacatcataaaagtcttacataaatgcagcggaaagaaagaaagacaacaggagctaagccttgacttgaactgcagcgggaacaccactccacaggcatcctcgacggcacggacaaagcctactcctcggagaaaccttcatctgacccgaactcgaaatctggggttgggaaaagtagagcaagactgagtactacccactgtactcagcaagtcataccggaataggggtatgatgcagggaatcatcaaagaagagctgaagtggttcatttgcataaagcgagcatttataaacagaaagtgaaagatttaaacagttgtaataattaattaacatcaactatccactgtccaacgctaacccatgttgcgacaggcccaaccatccacctaaactatccaaattaaaagattacactaaggtgagactaatcacggtgaatctggttgaccgcccataaccgcgggcacggctattcgaatagttttactctgatcagaggtgtacaactgtacccacaagacacagccccacaacacgtttccgtgcgccgacatgccaccacgacatatcggaaagaggccgtgacaggaccctttgcataaccccctctagccaagcacaccacacctcaggtttcacccccgtccccagcgggcaacgggcagtcccctctcgtgcctaggtgaatccggaagcgacagaggccgtcgcagggcccgccccgctccatcacgcccacccttgcctggatgcgtcgactagaggaaagatacactacaagtccagccgttgcccacgctggcttgtggtaagtacgataagttcttccagggcatcccgcgaaccggtccttaactgccatgggtgcgaccagcaaaaccatgcacccacagcccaccatgtggtttattttaattaaccaacaccaaaacggtgtcactaatccaacaacaccattggaaccaatagtctaaacattaatatgattttccccgttgtgaactagttgaactaagcatggctaagcaattcctagtccaaactctaatcatgttataaccccaagctaacaaaggagcatggtatccgaaaagcatggctgtaacaataggtaaccatcccatagtaatattataaaacaatgcaatatttgaaagaaaacaatagagcatttgcaatatatgatcaatatgttcaagtgacaagcatgacttgccttgctctgctgctggaggaacctcggcgactatctcgaagtaccccggagcgtcggaggaatcggaatctagcgacatacaaagcaaacattgcaaacaggctataagactactgaaacagggaacaaaaccatttttaatggattctgcacagttttcttgatttactgagacttgaatgggcttaaacggagctcggatgaattagttatggattttagaagattcactgtgtttattactataacagaaatccttaaataatttattgcgcaatattttccagggctgacgtcagcacaggggaagcggcgccgacatgcggggcccaccggtcagcggctcgggagagggaggaaagggcaccggcacgcgggcccactggtcagcggctcgggaggaaaggggcggcggcacccggctcggcttggctcaaggccggccgaccggccgcggcgacggcgacggcgcgcgcgcgaacgcgttgccggcgacggcaaccggcggcgaaggcgacggcgcaaaaggcgacgcgaaggcggctgcgctaagtggcggctaggaaggggagggaacgggcggcgataaaggcggccgccggctcggctcggcatcaaagccgacctgccggccaggtctagcggcgacggcatgcggccgacgacggcggcgaccggcggcacgggaggcggcggtggcggccgaaggcgacggtgcgcaacttgaagcggcggcgcggcactaggaggagaggaaggggaaaagaggggagggatgcctcaccgagggtggccggcgcggaggaagacgatggcgaacggcgacggcaagccacgggaggatacggcaaccggcggacgagcttccgggtgccctaaggaaggagaagagagggattagatagagggagatgaaccacggcgaccggtattcacggccgaaagcggcggtagcggttgaactcaccgcagcgcgaggggaggcgaatttcggcgacgaaactcgacggggaaggggcggccggggtggagcttagccttgcgaacccgacggcgaagacggcgtggtgcggcggcgaccctagcggcggctaatggcggccggagtagcggaaacagcggcggcaagaggttgcacggcgcgggagcgatgggaggctcgggagaggtcggcgaaatggggaaaaagcgagagggggcgacggagaagattaaatagggagagagaaccggacgtggccgggagaggtgggaatcgccggccgacgtggggagtgggggaggagagagaggcgggattcgaaaatcgaatcccggccatctcggacgcgggcgcgggcgggagagagaggggagtgggcgcgggagacgcggcgcaagcgcggacgtggtcgacgtggcccgaaggaggcggagacgtgggcgcggcggcggttgcgggcgcggtggcgcgccgggagcggcgggaggtgggggaaggacccgacaggtgggccccacctgtcggcgaccccgagagaggagggcggcggggcggcctggctgggcctcggcctgcggccggcccagcagggaggggggagaaaggagagaatgggccggcggcccattcgggaaaaaaaagaggaaaagagaggaaaaagaaaagaaaaaaaaagaaaaaggaaaaaggattttccctggaattaaaatattgcttgctaaattttaattggtgaaaattatttctagagctctgaaaattccactaaaaatcctgttaatgaatttcgacatgtagaactcaagaaaaattccacatgtcaaatccgattattatttgcattactttcttagggttttctcttgatttcacctgcattttcttggggtcgttttaaaaattaaattttaggcttgggaggagaacttcggggtgtgacactgatccatcattagccgatgcagtcacttagctgatgcctttcgtagctgatgcgtactctgtttctgagaaacgatcctccgccaaatccgattcgattttgatgcatgtcctaccaaatttggtcatcaacagcagagctttcttccagagtaattcggatcattaccactcctcgaaccattccatgttgccacgtcgggtcttttaactgaaatgcatcaatccacaatactagtacctgctctacaatctcagtggttaatgatgcatgtcagtatgatgttactaagctatgcgactcttttgtgcggatccttattatccgccgctcttctaatgattagatttcgaaagaatttagatttcttttcgaaaaagaagaaaaatgttttgcttaaaacatttttctttaatgagattgaatatttctatgcaaaaagaagtgctttaaaaagcaccttttttcctttatttccaaattattacaaatatcaattaattgagcgtttggattcttggagttatcgtgtcattagtctagggtttacccttttaaccataggtattctttgtggagcagtatgggctaatgaggcgtggggatcctactggaattgggatcctaaagaaacttgggcatttattacttggaccatatacatatacatatacatatacatacatatatatgtataatgtatataaattccagaaccctttgcgatcacttacctgagcgacaagacaattacaccgactaacaaattcttcaagcatcccaacgggaatcttattgaaggatttgagattgtccaggatgtgcccatcattcatgacgacaaagaggcaatcttgaaatcatgtctttgaaatccatgaaattgatgttctaatcaggcatcccatcgagaaacttcttatcaacaccctcgattaggcagcctcaaattctctttaggagggaatgagttttcaatcccattcaagcaatcaaggttcgccttgactgactccattcctgaagatgaatatgcggaggaagtaacggttgttctaccatctgagtcccctgaaccatgtcttgagaatgatgtcccagacttctgttgatgcgaaaaacacacactggcctgagaaatttgctttactctagtgcaggttcaaagatttgctttcgggtttaggtcgtgccagttggtttgatcctgcaaccaacaagaaacaaagaatccaaagttaaatctataaacgatagccgatcggctggattgccgatgacgtatcgtttaacactggaccaatgtaacatggatcagatcagcagtgaaatatataataatgaaagaattagatctactcgatcggctgtagatatcaataatatataatcaatgcttcgaaaatatatttaaactaagtgattgggatagatcggacagcatgccgagacagtataaatcacttatgtctaaaactacttcagagcaaagattatatatattcatagcatagccgataggataaatctaatatgtatcggctagtactctgataccactttgtactaagatatcaatatagattcaatataccaaacagaaatcaatctaacatcgggataacttaaaaggttgataacaagtttaatatattttatccaagtgagatcttaatataaatggtagatttagtatagcaagttaacatatatgaaacaaaataactaaatcaggtaagatcggctgaaaccctgatactatctctattgaaaatcataaaacaagtgtaacataccaggaatttcacctagggaaaattttttgtggaaaatttaaaactttctgaattctaaagttttcggtgaacatagaagcatactagagcatataactcccttaaataaaataaacacatagtctagttgggaaaaatcaaaccaaagaccaaaataaaagtttacaaatcttgtggtaataaatttcaaaataaaatattttgctttgaccttaaactggaaacctaatcttcttggttttgaattgctaacctaactaaaaataattaagtcatatataaaacaaatggaaaggtaggtttcaaaataagcacatctgaattgagataaaatgaacttgcttggttgtgcatattattgttttaagattgtttttggatcttcttggtgcatctcataatagattgcatatgcatgtcatgtctaaagaaaattcttaaaaatagatgaatcaacaattaatcccacaaaaattctcataaatactacacaacaccctaatctcccagtaattttagtttgaatttatcacatcaactagtaccacaaataaattcttcaactcagcaataaatctgaaaccagcataccaattagcctactttgcataatcatcaaattttaaccataacttatttatcaaagccccttgtcagaatgttaattatacattactctacaacctgatgcaatggcttcgtctaattcgaaatataaccaaaggaattgagagccaaaagttaggtaaacagtattctaaaatgcaatcaacaatccacttagtcaactttactaaattactatggtaaaagcaaaagtaattaaatcttggaacttggcacatttgatacatcacatacttgtctagctttctgtctccttgtcccccccttaattaaaaattgaatggatgggaggatgagagtaatctagtaaaatgaaatagtgccaacacttgggaaaatttagagcttctagttctctctttctacatctctcccttacatgtgggaccaagtccttgcggggcccactcatcatacaatcacagccaacacatcatctactcttcactcttttaaatcttcttttttttctcaaaaggtgagagaagggtttaaagcaattttcacttaaagtaccaccttacgtctcgtacatttctaggaaatcacttcatagggcccaattgtcatttacatcacagccacaacatctcttcacctctctttgtttatgtgattaaataccatgaagggggagaaaagtagtccgaaggagtagttgctaatttctatttgatggtagtttaccctagttttctagggtttcttttttcctcaggcggcgcccccgtctgagttctatcgttcaaaacaatctggtgtaaggtgttttctccttctcgcgaagtgagagatcgttaaacccttcgctgagaaagttttctcggggatcaaggtagtatggcagatactcgatcatctgccgaggatgaaaccaagcgccctacggaggaggagactgggcgtgatggagagatgggatccgaaccaaatctggaagagagattgaagaggttgaatatgcatggggaggaggaaactgacctagatttctcggaggaattggaagggctgatcaaggacgtacgctggctcgctctttttagggtttatactacaaaaccctttagccactcagcgctgttgaatgctatgagaaacgcctggtcttcggcacaggatatctcgtttaaggtaatggattcaaatctctttatggtacaatttcaatgccttggtgattggaa

SEQ ID NO: 47821 - DNA, 4149 bp, Oryza sativa
agggggggagaaaggagagaatgggccggcggcccattcgggaaaaaaaagaggaaaagagaggaaaaagaaaagaaaaaaaaagaaaaaggaaaaaggattttccctagaattaaaatattgcttgctcaattttaattggttaaaattatttctagagctctgaaaattccactaaaaatcctgttaatgaatttcgacatgtataactcaagaaaaattccacatgtcaaatccgattattatttgcattactttcttagggttttctcttgatttctcctgcattttcttggggtcgttttaaaaattaaattttaggcttgggaggagaacttcggggtgtgacaaacctaccccccctttaaacggaatctcggccccgagattcggaggagctgctgaagaggtgcggatgggcggctttcaactcatcttccctttcccaggttgcttcctcttctgaatgatgactccactgaactcggcaaaacctggtgaccttatttctggttcttctttcgctggtatcaagtatacgaaccggcttctccacatatgttaggtcctcctggatatcaatgtgctccgaatcagcctgttcttcaggtacccttaagcacttctttaattgggacacatggaacacgtcatgggtgccgatcatattggatggaagttctaactgataagcaacttctccccttcgttccaagattttgtatagtcccacgaagcgtggtgccaacttgcctttcgtctgaaaccagtgtactccccggagcggagtgacacgaagatacacgtaatctcctgcctcaaaagtgagctcccttcgacggttatccgcgtagctcttctgtcgagactgagcaatcctcaatctttccctgatgattctgactttctcttctgcttccgctaatacttctgttccgaacagttgacgttcgcctgtctgatcccagaagagaggtgtgcgacacttccggccgtataaagcttcaaacggtgccatctgtagactggcctggtagctgttgttgtacgagaattccgcatatggcaagcttttgtcccaagctccaccaaaatcaagagcacaagctctcaacatatcttccaagatttgattgactcgctcggtctgaccatcagtttgcgggtgataggccgtgctgaaatttaaacgggtccccagttcttcctgtagcttctgccagaattttgaggtgaactgactccctcggtcagatacaatctttttgggtactccatgtaggcacatgattctcgaaaggtaaagctccgccaaccttttgcccgtatatgtggtatgtactggtatgaagtgagcaaccttagtgagtcgatccacaactacccagatcgattcgtgacccgatgatgtccggggcagtcctgttataaagtccattccaatctcctcccatttccattccgggatttgaagaggttgaagtaaacctgctggtctttggtgctctgccttcactcgttggcaaacatcgcagagtgcgacgaattcagctatttctctcctcatgctgacccaccaaaacttttctttgaggtcttgatacattttagtgctgcctgggtgaatggagtactgggtctgatgagcctcggtgagtatcagatccttcagttccttgtcgtcaggtacacacaatctttctcccaaccagattgtgccatgctcatcttcgtggaaatcccgggcttttccgacactcatgttctttttcagctctgctatttcagaatcatttgcttgagcgtaggccgtgcctccagagcggctacgaacccgagttcaacaattcccacgttgagatgctcaaactcctgccgcaattcctcacacatgccctcgatgcatagggcagtgcagtaacttttccggcttaaagcgtctgccaccacattggctttacccgggtggtagtgaatactcatgtcatagtctttgattagttccaaccatcttcgttgtcggagatttaggtccggttgggtgaagatgtatttcagactcttatggtccgtatatacttcgcagcggttgccaatcagatagtgcctccagatcttcaaagcatgaaccactgctgccaattccaagtcatgagttggataattcccttcgtgtggacgcaactgccgtgaggcatacgcaaccactctgccctcttgcattaggacacatccaagtccgtgacgggatgcatcacaatagacttggaagtctttcatcgggtcgggcagaatcaaaacgggtgcggatactaatttcttcttgagctcctcgaagctcttatcgcactcggctgtccatttaaacttctcatccttcttaagcaactgagtcatgggtcgggcgattctggagaaattttcgatgaatcgacggtaataaccttcaagtccaagaaaacttcgaatctacgacacggtcttcggtggggtccatttggtaactgactccacgttcgatgggtcgactgccacaccctgagctgtaatgacatggcccaaaaatttgacttccgtcaaccagaagtcacacttgctgaacttggcatatagctggtgctccctcaacttctcgagtaccagacggaaatgttgttcatgtttttcttcggactttgaatagataagaatgtcgtcgatgaacaccacaacaaacttgtccagaaattccatgaacactttgttcatcagattcatgaagaatgcgggtgcgttggtgagtccgaaagacataaccgtgcactcatatagcccgtaccgagtggtgaaggccgtcttcggaatatcctcttcccgaattctcaactggtggtagcctgatcgcaggtctatcttagaaaacactttagctcctttcagttgatcaaacaaatcatcgattcgcggcaaaggatatttgttcttgattgtgacctcgttgagtgcgtggtaatcaacgcacatcctcttcgtcttatcctttttctccacaaaaatgaccggagcacccaaaggtgaagtacttggtcgaatgtaccctttctgcagctgctcatcaacctgtttcttgacctctgctagttcgttggccgccatcctgtatggtctcttatagattggagcagttcccggtgccaagtcaatccggaattcaatctctctcttgggtggcatggtagtgaggtcttcggggaacacttctggatactcgcagactatgggtatatcttccaattttctcgagttcttctctacggtgtccactgggatttccgcttcaatctgattcaaagagacccctttctttggcgagactagagatttgtacaccacggtttctcccttctcgttgatcaaggtgactgtgcgattcgcacaatcgatgacccccttaaacttggtcagccaatccatcccaagaatgacatctaggtctttggattcgagaagaatgaggttggctagaaatggtgatctttgaatttctattgttatagaagggctgaattgaaccgaagtggagctattccctggggtatgaacccgcattggtgtgctaagttcctctcttattaacagatgcatcccgacaaatttctttgaaatgaaagaatgcgtcgcaccaaaatcaaaaagtactgttgcagggattgagttaacagggaacgtacccagtacgacctctggtgctgcttgtgcctcctccgcagatgcgtggttgacacgagcctggataaaccttggcccggcacgcctaggcttcgggcatttgtcagcgaagtggccaagctcgccacagttgaagcaggaccctggttttgctccagtctccttcttggcttgcgcgggcgggcctgactgtgccggtgccattggtgggcgtgaagctgcaccgcggttggactgacctccatggtggttctgactgccactggcgccctggggaaagttgctagggttgaacgggcggtgctgacgaacgatcatggtggtaggtccaccctgctgcccaggagcgaagcgcggcctctggtgacttccctgaggtgccctgaactgtgcggccttcctcttcctgtccatcttgttgcgttgatcctcctggcggat

SEQ ID NO: 47822 - DNA, 1305 bp, Oryza sativa
gtacctcggaaaggagctgtgacattacctctcgcacaacacaatccactacagtgcaccgttcctggatcataatctccccctcaaaaccagaggtaatggactccccagcgacccccgtgggcttatctccgccacttctcaacctggtgctctgcaatgaaccatgctatacaaaagataaagccgttgcccacgctagcttgtggttggcacggttaatgtttcacaaccgaaactcgtgaaccggtccttaattgtcatgagcacgaccaacaaaaccatgtgctcacaacccaccattatcaggttttagttagcacattaattaattaactaatcacgattaaccatcgtgaactatcattaagccatcattaaattatagtgagtcattagttaacccaaaagtgaactagtgtttctaagcagggctaagcaattacatctaatatctagctgaaccaatccaatatgtaaggtccatgctagtcaaattataataacccaaggtatcaaggaataaggtaaacaagaacaaaagggccataacaaagaataggttaaatccacccaatgacattcgaaaataaatgcaatagttgaatagaaacaatagctttaaataggatcaacatgctcaaagggttgtttgggatctgtgtgacttgccttgctggccttggaactcttcaaactcttctccggcgaaaacgaactctccggaaacgacggaatctaagaagaaaagagaaaaatcaccaaaacagcacataaacaagcatgaacagtacatgtggatatttttaacatgtagatctcaattttagaaaaatttagagacttgaaccaactaaatcggagctaatatgaattagttatgaatttttaaagattaaatcggattaaaacacttaaaccggttttaattgaattatgacgcaataaagaattatttttgaaaggaaaaggggatttattgcgtcagcggctagggtttgcggtggaccgagcgcactggcggcggttcacgcgaacggacggccgagatcgatccaaccaaaacggacggccgagatcgatcgggtccacgacggctcacggcggacggccccgataacgtcagcgatgacgtcatcatcggcggcggcggctcggcggctcgaacggctcgggcggcgcacactcgccggcgaacggtggcacgaggacgcaaacggagggcaccaacgggtagcggacggcacggcgaactcaccggcgaccaaaacgacggcggaaacccaacggacggcggcggcgacg

SEQ ID NO: 47823 - DNA, 2626 bp, Oryza sativa
aggccgacgcgaggaagacgacgacctgacaggtgggacccacctgtcagcgaccgaacgcgcgcgcgcggctgcggactgggccggctgggccgaggagagagaaaagagaggtttttgagccgactttcggcccaaagccaaaagaagatttttaaaacctttttcaatttaaattatttcttaaatgcaattccatttattaaaaatacttccttagctcaaataaatcccagaaaaatctaggaattatagaattaagcaaagtatttaatgaaattttatctggccccattttatattggaatttattattaaaattagatcttattttcaagacttttaaaaataaattctaaaaattccttttaaacaacaatttataaattttgaattttcagggtgtgacaaacctaccccccttaaacagaatctcgtcctcgagattcggaagaactggcgaacagatacggatgagctgacttcaattcatcttctcgttcccaagttgattcttcttccgagtgattactccattggactttgcaaaaacggataactcgattcctggttcttctctcatcagtttccaaaatacggattggtttctcaacataggtcagatcctcttggacttctatctgttcaagattagcttcttcggtaggtacccttaaacactttttcaattgcgacacatgaaacacattatggactcctgccaaagattgaggtaactccaactgataagcaacctctcctcttctgctgactatcttataaggtcccacaaaacgcggtgccaattttcctttggtgtgaaaacgatgaacccctcgaagaggcgtgacacgaagatacacataatctccttcttcaaaactcaaatctctgcggcgattgtcagcataactcttatgtagagactgagccacacgcaatctttcttgaatgattttcaccttttcttctgcttcccttaagatatccgtcccgaaaacctgacgttctcccgtttgatcccacaaaagcggagtgcggcactttcgaccatacagtgcttcgtaaggagccatctgaatactagcttgataactgttgttgtacgaaaattctacatagggtagattcttatcccaacttccaccgaaatctaaagcacaagctctcaacatgtcttccagaatctgattcaccctttcggtctgtccgtctgtctgcggatgataagcagtactaaagttcaacttagaacccatctcttcctgaagtttcttccaaaaatttgaagtaaactgactgcctcgatcagacactattttcttagggacgccatgcaaacacacaatccttgccatgtacaattccgccaaccgacttccagaataggttgtctttaccgggatgaaatgagctactttggtaagtctgtcgactatcacccaaatagagtcatggcctgatgacgttctgggtaaaccagtgataaaatccataccgatttcttcccatttccattcaggaatcttcaaaggttgcagcaaaccggcaggtttctgatgttctgccttgattcgctgacaaacatcacatactgctacgtattctgcgatttcacgcttcatacttgcccaccaaaatctttccttgagatcctggtacattttggtactaccagggtgaatggaatataaagtatcatgagcttctttcagaattgcatcctttaaatctttgttgtcggggacacaaattctctcacccaaccatacagttccttgctcatcctccaagaaaccgatagcttttcctcttctcatattcttcttgatctcttgaatatcaggatcattaatttgggcttctctaacttgatcaattagagtgggcttcgcttctaaggctgcaacgaaacctctactgacaattcccaaatttaatctttcaaattccttgcataattccaatggcaaccgttgtccttccgtagcattgcaatagcctttcctactaagagcgtctgctacaacattagcctttcccgggtgataatgaattcccatgtcgtagtccttaattaattccaaccatctcctttgtctcatgttcagatccggctgggtaaagatatactttaaactcttgtgatcggtatatacctccgttcgagtaccgaaaaggtaatgatgccaaattttcaacgcatgaactactgcagctaactcaagatcatgagtagggtagttcttctcatgcggacgtaactgacgagatgcataggcaaccaccttcccatcttgcatcagaacacaacctaacccaagtttggatgcatcacaatacacttggaaacccttctttggatcaggcaaaatcaagataggagccgatactaaacgattcttcaactcttgaaaactctgctcacattcttccgaccacttgtacttcacatctttctgaagcagtcgtgtcataggcttagcaatcttggaaaaattctctataaaccttcgataatatcctgcgaggcctaggaaactgcgaatctctgaaactgtctttggttgcttccaattggttacgcattccacattactaggatcgacggcaactcctcctgctg

SEQ ID NO: 47824 - DNA, 7949 bp, Oryza sativa
tgcaaatgagaccttctcctgatcagtgcattgaagcaaatccaacttcttctctatggcatgcaaccaatcacctgcttccactgggttggtagtgctagaaaaggtaggtggcctcacacgaagaaaatcagttaacctgttctgcggaggtgcatggttatttccttggttctgctgattctgaagttgctgcatcatcatgttcataagttgcacctgttgagccaggacttgggcaagagttgggttcccttcattgttattattattgggattgttggggccattcccattgctgcgagtattcaccatcttgctggacagggcacaagaagagaaaccggggggggaaactacttaggacagagaattactttaacttttattgatcttaactgagttttattacaaaactgaaaactctcacaccactaaactcaccaacttcctaacactcaaaagcaaacaaacacatgcacttacatcccatcactgatgtaaattacatgcgaagcacacacaagcaacttaaagcaagcaaactaacacaacgatctaagacaacgacttaacaagtcactctagttcttccgagcatcggaggtcgattgaaggctctttcggctcatcttcatcatcttgagttgctacccactcaatcttggaatggttgcgcttggattcttcttcctcatcatcacttatgatgttgaccggaggatctgctagagttggggcaacttctttctccaccacacgaacctttggcgccaattgatagcgagggacaaatagagctctcttccttgcggtaagacgaatcctggccttctgcggtggtgcttctcccttcaatgcggctagttccttctccaaacgatccaccttgtcttctagcttgcaaatcttaccacgattccgatcttcacgatcttgagccgctaacacagtctccgcacgactttcatccatagcccacagcatctcaaccaaatgccttgtggtagcatcattctcaattccttcagtctcaaggtagctgccacggtcacttccctggggttgacgaggatgatagcgatactcagtatcggccaactgatcactgtaacgatcgcggagctctcctatggcgatccttgccacctcctgacttgcatggatgtagtttcttcctccagcttcgaacatcactgaggggatatcttcactattactgttcaaggtgactttgactcggcacttctcttcatgacgatcatgaggaatctgggcataaaaaggggcagtcccaaatccaatgacaaaggacattgtacgcaactcctggacaaaaccctcaacaccaaacaagtactcaggcttgtagcgcggcatctaaagacaagtgaaaagagggagttaagacatttatccaattaatagcacaagttttgggattaatttgaataaagtttagaagatcaaagtaaaaggtaattaaataaagtaaaccaagcttgcaagataagttgaaacagttggaaatgaattttgtacttttgaacatcaggttccaaaagaaataaaagaaagttataaaatcaacatgttaaatttattttattgcagcaagattaaataaaacaatattgtaaaacttttgctggtaaaatgagccattagtacagtaatagatgtacagtactaataacactggaataaatttttgaacgagaaccattaaaacagattatgaagtgcatgtgctattagtttggtttaattaaaagagaaagggaggagaacagttctatttttccaacatttttagagggcttctatgggtaaccatttggcataacctagggtcaaggaagctctgataccaacttgtcacgcccggaatttctatccaaaattccaaacgcttacatgtgtgtgaaccctcgtccaggaatcagccgaggcacacaataacaaattgataatagagtacaattaatactctaatttaaacgaataaaatattattacagaggtagatagttcctctcaatcaataaagatctaagcagcggaaaataaaataaacggcgcggacggctccactccacaggcagcttgaccaaggctacacctaatcctccacaccatcagcctcattgtagaactcttcctctgatgaatgattgcaaggtgagtatatgacatactcagcaagtcacgcagcaaatatgcaagtgcacaaggataccaaaagatggcataatagggttttattttgcaaaagcagcatttagtaaacatttgagaatttaataaaacagtgaagtattaaacaatattaaaccaacgctatacaacataccctgttgtataggcccaaccattctgaacaaccattcccggctgaacagatctaatctccaaaccaggaattaaccattccaaaccaggagctaaacaaattataaccaaataaagcatcatttactatggtgagaaatgtgagactaatcacgaaaaacattgttagacccgcccataaccgcgggcacggctattcgaatagttttactctgatcagaggtgtaccactgtacccacaagacacagccccacatcatgtcaccatgtgccttagtaccaccacggtacctcggaaaggagctgtgacattaccttgctggccttggaactcttcaaactcttctccggcgaaaacgaactctccgaaaacgacggaatctaagcagaaaagagcaaaatcaccaaaacagcacataaacaagcatgaacagtacatgtggatatttttaacatgtagatctcaattttagaaaaatttagagacttgaaccaactaaatcggagctaagatgaattagttatgaatttttaaagattaaatcggattaaaacacttaaaccggttttaattgaattatgacgcaataaagaattatttttgaaaaggaaaaggggatttattgcgtcagcggctagggtttgcggtggaccgagcgcacaggcggcggttcatgcgaacggacggccgagatcgatccaaccaaaacggacggccgagatcgatcgggtccacgacggctcacggcggacggccccgataacgtcagcgatgacgtcatcatcggcggcggcggctcggcggctcgaacggctcgggcggcgcacactcgccggcgaacggtggcacgaggacgcaaacggagggcaccaacgggtagcggacggcacggcgaactcaccggcgaccaaaacgacggcggaaacccaacggacggcggcggcgacgaagaagaagcggcggagctcttcggttcgacgacggcgatggtgctccagcggtctccgacggcggcgaagcaacggacgaggacggcggcgacttggcgatcccgacggtggccttcccgagcgacggtgacggctggaacggcggcggcgcacggctggagcgacggcggcgacggctgagctagggcgcacggcgctagggcttctccgacgacgagaggcgaaggcgaagggggcgacgggtagaggagagctcggggggtccttttaaaggggctcggaggcggcggcgaaggcccacggcgaccggcgacgagaaggaaagatcgggctcaaagccgatccgaatcgacctcgaacccatcggtttccaaaccgatttagccgaagattccaaaggagaaaaggtggaggagatcccggagatcatttcccctctattgattcggccggaaacggaaaggggcggccggatttggaaaggaacggcggcggcgcggcggctagggtttcgggcggaggccgacgccaggaagacgacgacctgacaggtgggacccacctgtcagcgaccgaacgcgcgcgcgcggctgcggactgggtcggctgggccgaggagagagaaaagagaggtttttgagccgactttcggcccaaagccaaaagaagatttttaaaacctttttcaatttaaattattttttaaatgcaattccatttattaaaaatacttccttagctcaaataaatctcagaaaaatctaggaattatagaattaagcaaagtatttaatgaaattttatctggccccattttatattggaatttatttttaaaattagatcttcttttcaagacttttaaaaataaattctaaaaattccttttaaacaacaatttataaattttgaattttcaaggtgtgacacttgcccgatggtactccgaacgtgcacttctctggattgagcataaggcgatatcgtcggaggttgtcgaacgtttcccgcagatcgtcaatcaatgagtcgcttgtcttggtcttgacaacaatgtcatcgacgtaagcctcgacattgtttccgagctggtcactaagtgcaccttggaccgtgcgctggaaagtgtttcctgtggttattagtccgaatggcatcttaacgtagcagaataccccgaacggcgtgatgaatgctgtcttatcctcgtcctcttttgccatgcttatttggtggtaaccggagtaagcgtcgaggaagctcaacaactcgcaaccggctgttgagtccaccagttggtctattcgaggaagaggaaagtgatccttgggacacgccttgttgaggtggtgaaatcgacacacattctccacttcccgttggccttccgtaccatgactgggttggctagccactctggatggagtacctctctgatgaaaccggctttgagaagcttgtcgagctcttctcgtatggcttgttttcgatatggtgcaaatctccgcagtttttgctttattggcttggcatcgggtcgcaccatgagtttgtgctcaatcacctccctgggtacccccggcatgtcggacggctgccaagcgaacacgttagcattgtcgcggaggaaggtgatgagcgcgagttcctatttctcgcctagtgatgccccgatcttgacggtcttgtcggggttggcactggagagtggaacgatcttgattgcgccgtccggcttcggcgtcttgtttgttttgctcactttcttgggtggctcagctgtggcgggtaggctgggcgtgtgctcgaccatgtcgaggctccacttgtcgcattgtactgccagcttagcgttcccttgaatagtgattgttcccttcggtcctggcatcttgagcacttgatacgcgtagtgagatgcggccatgaacttcgcgagtgaagttctcccaatgatggcattgtatgctgtatcaaattcagcgacatcaaaggtgatctgttccgttcggaagtagtttgcttggccgaaagtcacaggcaacgtaattttgcccaatggtttggacgatgactgaggagtaattccatggaagggttgatcggtgggtgtcaactcgtttcgtgggatccccatcgcgtccaaggcgctggcgaagagaaggttgattgagctaccgccgtcgatcaggactcgtgcgaccttgatattatgaatagtgggttcgactacgatcagatattgccctgggatgacagcaatcttggggtggtcctcttctgagaattctatcttctgctcggaccacttcatcttgggcgcagccccctgccacgtcgaacagacttcacgttccactttcttgtattctcgctttgaggagtatgccgtggaacctccaaagatgtgtgagacatgaagatcggaatctgggtatgctgagtccgattcctgagtaggcgcctcagcatccttctcaaccacgtgtactcgcttgcctttttccgatgtcatgtgttttgcgagcgactttttgaagacgaggcaatcttctagagagtgtctgtccgacttgtgtatagggcaccatgctttcttcgtatcgctgccttgtgggtctgggcgcttgggagggtccgcgtattctgttgcgagaacttccgattgagctttccttttcctactcttgcgaattttcttcttgcttgactcaggtgcatccttggctggtttcttctctcctccagtcttcggtttgtcgttcttgcgtctcagtgcgtcatccgcatgagcgcatcgatcgacaatttcgaataatctccgagtagtcgtgacgcgcctcgttgccaactcttgagtagtatagcgatctctgacactggatttgaaagcgcgaattacagaagcgtcggtgatctcggggattgtgtttctgcactcgttaaagcgccgaacataatccctcaaggattcacccgggttctgtgtcaacgcatgtaggtcgtcttcgatcgcgtggcgcttgtaagttccttggaagttggctacgaactgctgccacaagtctgcccacgaagagatcgagtaggggggagatgcatcagccatgaacgtgcagagcctttcaatgtggttggcaagtaattcaccaacgcattgtcgtccgctccggcagcgtagagtaccgtggagtaaaccagaaggaactcttctgggttggtgctcccatcgtatttctctattgctccaggtcggaatctttcaggctatcggacatcccgaagtgaacgatcgaaagctctacacccagcgctgggggcggtgggttgtcggcgatcatacgcccttcgtggatgtctatctgatgatgaagatgaggaagatgatgacgatgacgatgggtcgctcggttccggcgtgcggttacgaggacgtcggccgggttctcgagaaccttgttgtcgtcgcccgttgttgtctcggcgccgatctccatcatcgtcgtcattatggcgacgtcctcgaccagtatcgcccagcacccgccgttcgtgatcgtcatgatcgcagcggttgtggcggttatcatggcctcggtcttcgcttgaacggcctcctcgatcttcgttatcgtgacgtcgtgaagagatgcgatgttgagaacggttctcgttgtcacttgtgcgtcgcgcctctcggcggccattcaggtgatcgcggagatcgccggtgccgcgaggtgaaggggtggctcgatgaggcaattcccggtgttcaggatcttcaccattagcatcgccagttggtggctgttctgggtgcactgcagcagcggcttctttgaacgcgttgctgaggttggtcactgattcccgtagtcgttctgtccatcgtgcgagatcgtcgttcagaatgggatcgtagggggtttccctcagtattgcgttgacggctctgatgtgctgggccagtgtagtcgcttgattttccgcttccgcattggtgcgcgctgatgtgccgacatcgtcgatagccaatacctcacgcggcgtactcgttgtcgatgatccatagtcttcgagcaggtgcaagactgatggttcgtggggatctatgtcgattaccccaacgaatcgatctgaaatcagcgtcgctccttgttccttgtgttcatccctgatggggatgcgtgactgctggaccttagaaggtggcgtcttcatggcgctgagaaagaccttgcagctcgagaggttgtgattctttgtcttgtgaattggacaatagacatcacgagttggagaggtacgctgaattccacgctctttgcaggcacgaatttcagcatggacgttgagaaagacccagcaggcttgcagggtgtgtttcctggttttgtggataggacaccaggaccttgtcacctcggaagtaatcctcgtcggctcgtgattcctgtcggaaagacaaggcttggccgcactaggatccttctcgggctcggatgttgtcgacgttcctatctccgcttcggcgggaggatccttcgacatggagtcgccctgggttgtagccactgcattctcgtttccggccattggcggaccagctgagatcggcactgtggtgtaaaccggaaagacga

SEQ ID NO: 47825 - DNA, 4386 bp, Oryza sativa
accctgacacagcccactgcctaatttgctctttagccccacaaattttcaagagttggacattggcagtcacataattagttccagagaacacttctgtgatatcattgaacaacttgagcctattaactacctctacagcaaaagcacattcatctttactaggggcacaatcaaagagcttctcaacatgttttgcacgatcaaaagcatgtgcataaggtaaagcaatgctaagcatcttgtaggtggaactccacctagttttgcaatcaaggcctaacttgtgatccattttaactttaacatgcttagcaatttcatcaaatttctctactctcttaggcgtggctgtccaaaaagcaacactttcacggatttttgcaattgaatattttatcacctctataccatccttcacaattaagttaagaatatgggcagcacaacgcatatgtgttgatgtgaaaaacacgaggcctgggagatctgcttaactccagtgcaggtccaaaaatcttgcctttaggttcgtgagcgtgccagttgatttgatcatgcaatcaacaagaaataaagacaggaaaatagcggttaaatccataaacgatagccgatcgaccagccgccgatgacgtatcatttgtctttgagccgatgtcatatttgaatcgatcggcaatcatgaataagtaagaaagaactaaatctacttgatcggctgtagatattaaccatatataattcttatgttgatatatacttaaatcaagtgattgggatagatcggtcaccatgccgagacagtataaatcacttagatcgaaatatataataacaatgagattatagatgttcatagcatagccgattagatagatctagcatgtatcggcaacaagatcttaacataaagggcggatttaacatgtcaatcaagcatataagacatagagtagttaaatcaggtaagatcggctgaaaccccgacactaccctaatcggcaaccaaaagcaggctagaaattgagattttaataacgacttataaggtcaaactcaactgatgcagctataaatatgaaaagaaggacaatatctagacaatcaagctgttggctgtttcatagagtggtagataccctgtataatctaagtcaacatagatatttaacctgattggttgccttccaataatagatgttagccgattgaaggttagataacgatattgttgaagattatacataatatatgataattcgacgaattacataaacaagattagagtatcataaagatggaagcactaatcccgataacgcaacccgccataacaagttttacatctagttgaagatcgaaactgatgcagctcaacccgaaagcaagaacttgtcgaaaaaaaacaaaagtaaagggtggcgatgcgccgagattgtattgaacgtgtgttgttgtattacatggggctcggggtctatttatacccgagattacaaaatatgtccatgtcggacacgactctcatctctaacaaactctaagataccataagtctttgcggcagacttttgcccaaacttatctctaaggaaattacatgaaataccctaattaatagatacaattaccttttcaggactcaatccatgcatggcaatcctcatgaagcacattaactcaacccgacaacgtgtaccgaatcacattgtcggaatcggcttaatcggcaaccttgtccgactcgaactctaccgatcctgatcgtagccgattcggacttcagccgattcttgctccgcttctggaacgatctccatcttggattccgcttcgattttatcttcatctccgatacctaaataaccaaatttggtcgttaacaatatgcaacaattttccctccaacatcaacttagacttgccaatcttcttcccaagttcagtgattaccttgtcattcgtggtacaattatcaagagtcaaggttgagatcttctcatcaagattccattccaccaatgcttcataaagttgttcacatataacttcagttgtgtgtggagcaggcacatatatgaacctatacaatcaaagttaaacctagattaaattcagattgatgcaaaaatgaaatctaatgtcatgctgaattaaatatgtagcagtaggaaatgaaattaattgttcatcaagtacctcatgataatgcttctaagtgtccaagaatcatcaatgaaatgggctgtgacagccatgtaccctcttttttggttatcagatgtccacaagtctgtagtaatagccactcttgacttagttccagccatgtaggctagggctttcttattttcttccatgtaatagtccataatgtccttcctaaaaatgcataaatgttaattttttcttcttaattgcagatatttttaatagacaactgaaactaatagatatcattattacctaatagtgtttcgagtcaccatcttaaataatggctgaagtgcagtcacaaacctttgaaatccaatatgatcaacaatagataaaggatactcatgtagtacaatcatggcagcaagctctctcctagctatttgtggatcaaatgtgtacttctccacagatatttttcctccctcctgggaattgaaccttaaagaagactgtgcaagtgtcttgttttgtcccgccatcttgatctttttcaatgtgcaaattttcaaatggtcatggagatgtcttgttccattactgcttttccctccaagccgcttgtggcaatgaaggcattgagccttgactttaccacagatttttactttcttgaaatccttccaaacgatagaagtaagcttcctcttggtgccaaagtccacatcctcctcctcagcctcatcttcatcatcatcaccttgtattggctgagaatcattaacactctcatcgtgaggtggaagtgattgcgagtcttgctggcttctattcgcactacccgcagttgacttcgatgtgaatctgagaagagagaaataaattcagttcaaaatttattcaatggcctagtaacatactgaaatccctttacaaagctgtgaaagcaaatttaaagttcagaccatgttgacgcatacctgcatagcactataaatcaccaaacaataatgcatgtacataagtataaatatagaaaatatataacagtaacgtgcaaagaaatatcccttcaatttgcaaagaaaatatatgacagtaacatcaacaaatccatcatttagtacctaagagctgaaacattcagtacctaagtgcaatgcaatctcataagtcataaactccaacttacatattccaaattgttaaataaaagagctgaaacatataagaggggtagcgtgcttgaaatcgaaccccatggattttaatagacgaaggccgccggcaaaagatgacgtgtttagagtagtcggtgcagaaggagctccaacagctgcaagatggcttttcggcttggatgtggtccttttcaaaggaggaggcctgcgaagggcatttgcattggacttgcgagaggagccagcacccaacccgacgaccgcaggggctgcacccaatgcgacgaccgcaggggcagcacccagcacggcggcggatacggcagtatgcccaacattgggtgtggctgcggcagcgactactgctttacttgtatcacgtggtagcaggtccaaatccatggcagcatcccttcgcgtggaccgccggtcgtgggttagtgagtcaacaatgcagctatggaagacgaataactcgatggagaagaactagaggtaggcgtctatcgagcacagagaagggatgagggattgtagtatgctcaccttgcatcgtcgctgtcatagcttacggggggaggctgaagccatggtcaacggatggcggcggcgatggcggctcccggcggcgcggcgacggcggctcccggcagcacggcgacgacgactcccggtgaagacggctgcaggctggcggcgtgtcgacagaggcagccggtggctctcggtgaagacggctgcaagcgccgcgccggccggtgacgacggcttcaatctcccgacgagagaaggcagcgagtggcagcgaacagtggcgtgcacggctcctaggctcccggcggactggcgaacggcggcggcgcggcgcgcgtgacttgggtggtggttgctgtggatctggatgggtggaggtcctggaggatttggctttgacctgttgacttagggttagattatatatatgcatgttaaatgggcttcaatattatgggccaatacatctaaaaagtctagaattccgccctataagtatagtcgggtcact

SEQ ID NO: 47826 - DNA, 22853 bp, Oryza sativa
  unsure (1)..(22853): unsure at all n locations
cccccgtcatccccgatggtgagaggtttttaaccattttattcctcatggtgagtagatattaaccatccccgtcacctaatagatgaattcatcacggggaaacggtaaacgggcccccattgccatctctaggcgtcaatgagggtttgagctaaatgccttgtttagtttcaatttttttaaaaaaaaacatcacatctaatctttgacatatgcatggagctttaaatatagataaaaaaactaattacacagtttgcatggaaatcgcgagacgaatcttttgagcctaattagtccataactagcctaatctttttaaatatagatttttttaaaaaaaagaagtacagttctcgttgaaatattagaaaaaaaaaatctcgcttctatatgaactttaaaaaagaacacaataccatcaagacttagaatgagaaaagcatgggtaaggaagtggtgggtccggcgggtgtaaggaagtggtaggtccggcgggttggctcgcttgcatccactcagtggagcagtctagaaaggaccggtcaatcaatatagacttgtcacactgggttcaggagaaatcagacttgatcagggtggagtacatagtagaaaggaccagtcaatgtatatagtactaatcagaagatgatgctgtaacagtaatgtttcacaataaacaaaacaattattggtgcagaacatgttgctgtcgtagaagcataacaatacgagataacactacaactttttttttccggaataagacactactacctttttttttcgaataagacactgctacctgtataattgggtctgtttggcattgcagatagtagaatttatgggttaaaatcattttcgaattttcatatatccagctagagttgaagctgtgttcaaacagagccatcatttttgaatttaaaagtttttacagggaaatggtatttgattttagagaggtcatattcgaaagtttgtgctatgatagtgcagaaagtctttttccctcaaattttgtggatccaaattctttgcattcatgccatggacccatgcaagtgtcatgcatattctgatataatagcagtaatactggagttgcaaaggaacagagtacccattgctagcgaatggattaatatagtgagcataaagcaaaggagaagtctggtaacacgtaaccataaagcagtgataatcaagacaccatcatatcagaaggctaaagtaacaacacctaaccataaacatactctaagataagataactaatgtctactcagttggcaaatggcaatggcatagattttgtggccggcttcgcttggaaggaggtcgtcagacgcccccaagtccgagcatgccgtcgtcatcgtcgtcgacgaagtggtcggggcgccatttgcggtggctggcctcctccgcccgaatcttggactcctcctcctgtttcccctcatctgcaatgagcctcatcctgaaaacatccagaagatgcttctcgtgtttacccacgacgaggcgggtaccctgggaagcatacatcgcgactgtgaccaaatcctgcatgcacgcgacaaatcgaacaggtcggtcaggtataccaagggtgtgtttagctccgcatcaaaattaaaagattgattgaagttaaaacgatatgatgaaaaaattaaaaatttatatgtaataaaaatttgatgtgacattttttttttcgaaactaaactcggcccaagccaacacaaggaggtctagggtcggagaaaagtcatcgggttctgttctgttctgaccttggcccacgcctccttggggagcttgtcggccttgatgccgaaaatgttgaggtagtatggcagcgcgtagccatcggggccgcaagcgaaactgatgcagctgtgcaggaaactgaggagcccgtccgggaatccccttgtgactgggtcgccgtggtagcactgccaaaggtaccaatggtacctcagcagcgtgcacgtcgccgccaggggctccatcggcacctcatcggaatcagcaagctccttgaggttcttgaacgtgccgattatttcctgcacgtcctggcttgcggcgctcccggccgatggcggcggagtctgctccaggaggtccagcgcctctgcagctgaccatgcgatggccttgtacggcgtcacctgacagcaaccacatatccaacaaaacagataaagattcagatatatatatatatcttcttcttttcatctcaaaaaacaaacttcagttgaggcacgcatgtatgtatatggaattgttttacgaaactaagttccagcccatatagcccaaacatcatcagccccaaacccctcccagcccaaagaatttgccccataaccaatttcctctcagcccaaactgcatgctcgtacttcaattaaattgcatcagcctggcctggcccagaacaactcattggcccggcacgctcccctaggaacccatctcacaactgtatccacgcccacagtatgcccagggaccaacgggctgatcagttcggcccattctcgaaccctttccgatcaggccatcctctcgtcaaacagattccatcccccaaatccccaacgtctgtcctcctagcccaacaacgatcatcaacacggctaacttatacttactaataacaacaagtactttaagcataactttttgttttttatatttgcacaaaaaatttttttgaataagacgagtggtcaaacatttacaagaaaatatgaacatcccttgtattagtggacagacatagtaaatatttttccttcgagaaaacaaatggcccaacaaccaccaaagatctaccgtttcttcctccgtagttgctactgcgtacgctttgtttattgatcagaagagaaccttttttgcgaacaagcctgcacgatttttttaaaaaaaagaaaactttcttttcagaatgaagaacctacgtacgcgagaaacagatagaccatgtatcaacacaaccaacaagaacggtaaagaagagctagcgtgtgaactcctcgggagaaaaaagccgaaaagaaaagcacaacgtaaactccatagaagatacaaacaaacacagatctagaccgagagaaagaacgttgtaagagggccttactacctgcaggccaacgtcacacatgcatcaagtacaacatatatgttctcccaagcaacaagctcgcgcgatctcatgtttttaccgcaagagcagattttctcacggcatcccagacccataatcctagatctaccgtttgttacagcacgcaagcatcaacaagaaaacgaccagtttttttttccctccacgtacagatcaatacgcgcgaccgaaaagaacatttttcttcttctttttttttttgaaacacatcgaatcaaatgcgaggaaggcagaagtcagtcgagacgcacaccgcaaacatcgatccggttccgtacgtactacacatgcatgcagatgcaggtagttggaaagaagagtgcgtgcgttttctcaccttggtggagtcgtcgtcccaggccagccatggacctgggttagcagccgcctgtgccaccgtcagcctgaggggacggccggcgccggcgaagcgcgcgaccggcggcggcaggagacggccacggccagcaccaccaccatggccggcgcctccaggcaggcacaggacggggcacccgaggatgaacaacgacgacatctcgatctctcgttctcgctgatgaggagatatggccgggggtggaggtgaagtgcactactgcagtgcagccttgcgatatttataatcaggagccaatgctagggttttttggcaactatgggttatgcattttgcgagagtgttagaaaaagcagtcaaactttagagagatcacctttggctttggagtttggaccaacgtaccgtgaaatgcatacggtgtatgtatgtaaattggagatcgatgtagacggtgtatatatgcatcaacaagaaaacgactttgttagtatactactactattccatattaccatttcattaactgcatgtatatgcatgtgtatttcgacatgcagtctgtctttgtccccccgcgcgcgtacagggaaaaagggaagaccagagctgcaggcgtagacgccgtcgtcgtggtggtagcagtagcagtacgcgctgcatgcatccacggcgccgcgagcgcgtggactgagttcatgaaccgcgggtagagtagacgcacagaccgtgctagcctgctaggtgtatggatctttcaagctccggtgtatgtatctttccggtagcacaggtgcacccatccacacgttctgccatgcatgaagccaaccaaccaagcacacaaattccgtgggtccccctctctccctcccctggacaattccgtggattgtttgcgtgcgaccgaacagcagcctagaagaagcagagatcgcaaacagatcgataattacatgcatttctcggctacatgcatttcctcgcttaattactgcaacgctgcaataagtgagcgtatatatgtattttttaagttcaatttagtgatgaaataagtgagcgtacgtgtatataactaacctagcctccaccggcaaaaaaaaaaaaaaaaaccgggtcacatcatatacagacacacatttgaagtaataacaaaacaaattacataatcagcatagaaaccgtgagacgaatttattaagcctaattaatccatcatcaacaaatgtttactgtagcaccacattgtcaaatcatggcacaattaggtctaaaagattcgtctcgcaatttacacgcaaactatgtaattgttttttttcaatatttaatatttcgtacatgtgttcaaacgttcgatgtgatggagaaaaaatttgccggcggaactatttattgctccttccgtcctaaaatataagtatttctagtacagtgacaagttaaacatttttagctttaactattagtagcaaaagaaaaaaaatcaatcatatgtataaaattgatgttactagatttatcattaaacaaattatcataatatgcaattctttatatttaaaacattttatttttattgatattgttggtcaaagtagaatctcggagactgtgtcagaatttaaaaatgcttatattttaagacggagggagtagtacatatctacatccgatcgatatttgttgtttggcaagatacaaattgccttgttaagttcgcgaaaagaaaatttttgggtgtcacatcggatgtttgatcggatatcggaagtggttttcagacacgaatgaaaaaactaatttcataactcgcctggaaaccgcgagacgaatctttcaagcctaattaatccttcattagcacatgtgggttactgtagcactaatcatggactaattaggctcaaaagattcgtctcgcgatttccccctaactgtgcaattattttttttatctatatttaatgttccatgtatgtgtcaaagattcgatgcgacgtttttaggaaaaaaaatttggcaaactaaacaaggcctaactataaaatccatttagttcagcaataaataaattaataaagctacattaatttctttttcacaggagtattacaccagtagcacgaaaagcatgtagccaccatgacccatctactcgtgctgcttaatttgcaatctgcttcaggctattgcattgggtcggaaagaaaaggggaccacggaatatgtatgtcgtcgaggtcgatcggctttagcttgcgtggcacgctcgcaagcttgctttacaccggagattgcgcgacgggcaccggagattgcgcgacgggcataggctgtgtgtccgtctagcctggtgcatgaactcggtccaccggcgccgtcgatacatgctagcaatacgtactcctacgtcaccttcgtttctgtttttttttctgtacccacgcgggtgacgaaaaaacaagagagaaacggatcggatcagtgcatatcacacacattaaatacggcgcgcgaagggttgcccaagcaatgggatactttttcttttcaaaaattcgaacagccagcgtactttgtgcatcgtgtggaggaagaataaagcgatgcaaaaatcttctatgcgcgcatatatatggtgccaaaagtgcctaaaaatgcaatcaacattttaatttgaaccgcgatcatacagccattaagtgcttacaatattacttccttggtctagggcgtgtagcaattaagggatagaaaaagtctacaagtctaatagtagttactaatgaccacattgccctaacaaacgattgcgaaacttttgaagacgatgttgtttttccagcaatatgcatgtcgaaagcaggatgatcacagggaaaaccgagagatgtgtagctcgttatctggtgagaactcccaaggctggagctgccaccgatcagaaagggtttttcagatgggcggagaggattttcacatgcggttggctggcccgacgaggaaatgagttcaccactaatcagaaaactaataaacatcacagcaaacataaatttcataagcctgctagtgttaaaacaagtaccttgaacaatttattatttataacaagaatggacttgctttgcttgtgaggaaatatgtgcaaagcttattgcatcataaaggcctcttggaggagaaattagaactttatgctgattgaaacaaatatacattcagcaaacttgatgcacaaatcaagcatatatttcatcacattctcgatgctggaaaacagatagtaagatctagcatcctgatttttcattttttaaaaaaaaactttcacaagttagcaggaaatcatattgttagagtatatggtagttatagttatattagaataggatttatttgtgtggactccttccatatctgtaatccttctttatctcaccctatgtactcctatatataccggtccctaaggctcaatgcaattgatccacgttacgcaatatacctctctccctatactatccaatatggtatcagagcgagcgacctagaaccgctgctcacgcttccgtcaccgtcgccccgggagggctccgatctcccgggggcggccaactttttttttctctcttcgcgtcgtcaagtcatcatcctaagagatccatctctcaggcgtttgtgttgtcatcaatcaagcagcagcagcagcgtctccgatcgtcgtcgatctcaccgaccacctggcgcactgcccccgcccgtggccatccacgagcaaccgttgacgtgtggatctccgtcggccatgctaggcctgcctcgccgctgccgctgggggggggggaggggaggggggacggccacctcttcacctcggccggcgtcatcgggccccgtccgccgctgaggacgcccgcctgctggtggtgctcggcgctgccccgcagccatctaccctagcgtgacggggcttgcctcttcgccgcgctgaggaagccacctccatcaaccacgccgccgtccccgcactcctctacgccgctggccaccgttgacgccacctccgccagccttgccatcgatctcttgctgcccatctctctctcttatctgtatacacatgcgttcatggataggatttgggaaggtagtaattgacacacaagagggcgttgtggaataggattgatttgtgtggattccttccatatctgtaatccttccttatctcctctccatatactcctatatataccggccccctgaggttcaatacaatagatccatgttacgcaatatacctctctccatatactatccaacacatatgatggagcttgataacaatgtaattatccaaaattaacactgcatacctcaacttcacaacgatatgctgaacacattttatcaatatttatacagtccatcacagcgaaaaaaaaatcctttgctctttccgtgacatttggagcaaacttttattagaaggtgtcatatcactactacagaaaacatttttccgaacgaggacatctttaggttacgggtgaaccgtaactagtcgtgcctgcaaacatcggtctacattttcgcatacggctacttaaaagatctgcatgcaaaaatcaatttcattccagttcagcgaaaacccaccgcatgttctagttcaccacccatcacattcccattcggcgattggtctagttcgatgatgccagctgccactcagctcttgtcttgccggttaattatcgcccttctccctattgctgaccgctcgctaccacctggagggaagcctggaaaagatggggacgagagagtaagaggagggaggagtaggaaaaccgacccgttcacatgtagcgtccatgtggtcaccttgactcaatgacacgtcagctaaaaccggacataatattatcatgtgaatttagtagtatttcagtattgtaagttaaagacgtgttatatctcgtatcatgatttatggatgtgatttaaactcgaagcaaatacgagggattaaagtgaacttattccgaatgaaacaaaacacatggagcaatctgaactgcgtttggaaagtgaactgtgacaccaacggtcggcgtttggaaacatgggatcgtgcgtccagataaaagcaacaaagaatcacaaatcgattcttccaatctccacccctcgccatcgatcatcgtcaccgtcgccgtcgccgtgatccgcagcatggcggcgccaccgccaccgcctccgcgtccgcgtcaccccgtggcagacaacgacgacctggtcggcgagatcctcctccgcatcccgccggacgaccccacgcgcctcgtccgcgcctccgccgtctgcaagcgctggcgccgcgtcctcgccgacccgagcttcgccgcgcgccaccgcgcgttccacccgagggcggcggcggcggcggcggcccccgtgctcggcgtcctccacaacccggccgaccgcgagctggaccgcttcgtcccggccgccgcctcctccttccgcgccgccgccggcgaccgccgcaagcaccacatcctcgactgccgccacggccgcgtcgtcctctacgactacgactcccactaccccaccgacggccacgtcgtctgggacccgatcaccggcgagcagcacaggatccccaacgtgatggatgccttgacccacccggccgtcatctccggcgccgccgcgggtgggggtggtggctcggcctccttcatcgtcgccttcgtcggcgtgcagaattgggagaggcacttctgggacgcgcacgcctgcttctactcgtcggagaccggcgagtggagcgtccacatcaacatccacctcgacctcgatgggtaccacctcgaggaccgccccgccgccctcgtcggcggcgacacgctctacttcgtcggcaagtcggggatcctcctccggtacaggtatggcctcccgctgcgctgcggcagggacatcctgggccacggcatcacctcggccgacgtgctctcggtggtcgacccgccgccgggcgccaagcgccgcctccgcctcggctacaccgtcgtcatggcggcgccggagagcgacggcggcgggctgcggctgggagtcctgcaccgccacaagctcgccctgtgggacagggaggaggacggctccgccgccgccgccgccgcccggtgggtgtggcgcgtggccatcgatctcgagcaggtgctgccatggccggtcgggaataccaagggcaaggagcgggcgtgcttggccgcagttgccgaggaccccaacgtcatcttcgtcggcacggaagaagacggcgtcttcgccgtcgagctcgattcgctgcgcatcaagaaagtgtgcgaattgggcaaatcacaaggccgtttcttccccttcgtcagctactgcgccgagtcatttctggtatccatctcatatttctcatctgttcatgcaagtttggttgctgatttaaaatgacatggtttggtggtttttattttattctatttttatttttacagctgagcctagcaaccagcaaattgccagcaccagcggcaaattaatccaccatcttgcagtctgatcgatgttcttcggtgatttgtttcttctgcggaaagttcagggagacaagcagtttagttcgatcacttgggtcagttagcatagttcctgacgatttttttgttgtggtgttcttcttatcaaattgtgaccatggatcatcacttaagtttcaatcgatcagtttcagcatacgcgagtcattttgtttcagtcattgcctgacaccaaccatcaagtgtcctgaaaaaatgaaccgttgttgttcagtctcagtcggattcagacaaaattaccaaagcatcaagtaattgggggataattcggctcattgaattcactgtgatcatgatttgagacattcttcattttacacatttttcttttttgacatagttgagttcagagtctgtttgccccatcctgtttgaagttttcggtgttttctgaagaatggtctgtgtttcagcttaaacataaaactctaggttatctcattatcttctgaagatttgttccgaaatgctcccatgaccgtggaattgtcgcattgacacttttaatcattcagtttcagcatatacgggtcatttttttcctcatggatcgaacactaagtttcaattctgtttcagcatgtccactaaaaattcagtttcaattcagttttgcacctgagcatgaattgtcctgaaaaatgaatcgttgtgattcagtctcagtctgattcagacacaattgccaaagcatcaagtgattgtggacaattcggggatctgattgaatgcatcgtaatcatgattttagtcttccattttttatatacatttcgacatagttgggatattgttcaggtctgtttgcccccatcaatttggagccttcggtatttttcagaagaactagtctgtttcagcttaaacataaaacaagaagcagtggtctcagctcttcgagtacatccatagaaggcagctggaacttaaaaatgtacccgtttcccatattttcgttgtatgctatcgtatcctacctgtaactttacggtatgcttttgcatggacttatttttcttaatcctttctctagttcaattccaatcccaccacatttgctcaagataaattaagacgcagaacagcggggagtattcagcaaattctgctgactggaccacaatggttgctatcccgagttccacgacaatagccatgtcaaagaatgcaagcttgcatcagttacaactgtcctaacattgaagtattggcctttttctctttttttttcttaaacaaaatacaaacgcagacgctcacagtacaaatgatcatacatgcagtgagggaggcagctctcgggtaggttgggtgacggtccgggctctaccgttgccgcctccattacctactagcgtcaatgtgtataaaaattgattcatcggctgtgtttagattccaaaaaattttggctaaaaatatcacatcaattatttggacatatgcatggagctttaaatgtgaacggaaaaaaaccaattacacagtttgcatgtaaattgcgagacgaattttttgagcctaattgcgccatgatttgataatataatactacagtaaacatttgctaatgacagattaattaggcttaataaattcgtctcgcaatttacaggtggattatgtaatttgttttgttattagtctatatttaatacttcaaatatgtgtccgtatacgttaaaaaaaattggccaacgaactaaacacagccatcatcatggaatgttattaatcgcccaagactcacacgatgatgtcgactccgccactgcatacataactctacgcgagcaataatcatactccatccgtttctaaatactttgacaccattgactttttaagcacatgtttgaccgttcgtctttttttattaaatacttttgtgaaatatgtaaaactatatgtatacatataaatatatttaacaataaatcaaatgatagaaaaagaattaataattacttaattttttttaataagatgaacagttaaacatatttaaaaaagtcatggtgaaatatttaggaacggagggagtaatttattggtgtgggaaattattgcttagactgtcttgtaatattgccttttgctttccttactttgtttttaataaaagaaaaggaaaaaggacttgttaaggtggagcagatggttagctgtgaataataaaattaaccggaaataacgctacataacggtcaggatggccgagtggtctaaggcgccagactcaagttctggtcctctaacgagggcgtgggttcaaatcccacttctgacattttgttttttgttatccgtatttattttatttagtcgagagtttcatacaaaccaaaattctccgaaacgaattcatatcgacagctcaaaaattttcaggagatttgtgcgacatttcttcatttcttttttgccctaatgggccgtaatccgaccaaacgaagcccaatcgaggcccatctttcacctgtgttgctgttgacgctctgtgagactgacctctccaatataggctgctgcttttccctccctaaaaataattcacgttgatatttttacttcctttttttcctggtatttcccttttttaaaaatcgatgaaatttgatgtgaaatcattatgacaccacaagttgacaacactagctcaaccaaaaatctgtatagttggacatgaaaattgatgataacacctatgccgcgcctcccatccatgcaacatttgccattttaaattatagagtccaatttctgatggaatctataaacgtgtcgggcctgttcactttaatgctattttcaaccttactaagttgtgataaagttgccaaaaaagtggttacatttagtttgctaccaaattttggtaactatatactaaaatttggtaaggttttttttatctaagtgaacacgtccgtcattttcaaagttcaaaaaatgccctatgaatttgcatgcacctctcaagaacaccaccaagataatgagaaggtactgtagaattctatggcgtgagctgagttggcaaaattgacgagtgacgacattgggtgggggagaaagttggagttgatcattcaagatccagaaagtccgtagaaataatcacgcaatataatacataaaagcatgctaattgctttcgtagaagtgctgcttttctctagctgaagatcttgcaaacaggtcacactaaccaaacgattgttacagaggacggatgggtacgtcactaatatttttttaaaaaatacgttgagaacactcccttaaccgcacgcttcaagagcctaagatgtgtttacgttagaataggctaatgtgttgtcaaaattcactgaacattataaatgtttggtaattaactaaatccatctgtatatttattattttttaaaatatagtatgatttaaaataacattaatctgaacaagcccatgagtaaattcagactttcagcacgaaaggcataacattttaagcatggcctcatagacaactagtataaaaaattacagtcattcgggattgtctcgtctctaagatctttctatgaagtttaggtgagaggtcataattattttatagctaataagtcatgggaaaataaatgaagttaccaaaataatgatttaaaagaaaatgcaaaaaacaaaattatgattaagaaactgaaaattcaaattttagctatgaaataagccaaccagtaaaagatggagctgaaagagctagctaggcggcttgcgtgtccatacctctacggtcctagaaaaaaaagagaggagggttttagaaaattttagaagagctctaagcttcgccgtctcctcgtgctaattaatcaaacccacacaacactaatcaacgcgatcccccacatccgctaatcacaacagaacacctgtaacatattaattaactaactaatctccccgcaaaaaaaaaaactaactaatctacatccatctcgttgctcgtgcctaatccacatgactaattattggctaccatcacggccggtcgatgtcagagcagcgagatgaattgtttgtactcgtacttgaccagattaataacaaagataatttagctacaatcatggatagagaatcttgtttaacaaaatatgataggcgaccagtagatgtacactgcagcccatagcaattcaaaaatctccgtttaattgacgagcgtgcgagcgtgggaggggaccggtggtctccaggccgttggttggttggttggttatggttgatgagcgatcgggccaaccccaacatggagacgctggactgcacgagcgtcgcagtggacggtgtggtgccgcaacgaggggatcgaacgaatcaacgaatgatcgaaatcctctcggaatcggtagcatctctttaaaagcgacgctctatcggttagtaattaaacatatttatcatttaaactactaggtattgatattaatatgatgcagaaagaattaaaaaaacagattttaaaaatagtctaaaacggtacaccttatacgaaaacgacgctcggtcaatcaggaatttcatcttaaacgaaccatatgtaagccaactcactgggcaccggtagtaaccaacgggaggggagagcaccctgagtttactaggatttttcactggtattggactataaagtgacgcatttgcacgactataacaattttgttatgtgtcattaaacaattatatcatttgacgtaaaatttgagaacaaagtaaggttattttgagaaatatctttactgtatggtggagcataaatctacacatgtattagaaaataagcaaggaatttgaattagtttctcggaccatcatcgtcgatgggtctggattgggtcttaggagattttatggtggaatgatctacctctctcattggtggagcccgccgtttcagcagtgaactcgacctgtggctgcttcaggacacagtagtgtagggattgaattcggttcgctgcagtctgtagcgtgaacactatatccgtttgatcttatttcaaagggcagagtcatccaaaaagcttcatgcagaaaatagatgtaggagtacttatgccgtgtttagttccaaaataattaattcttcaaacttctaacttttccatcacatcaaaactttcctacacacacaaactttcaacttttccgtcgcatcatttcaatttcaaccaaacttccaattttagtgtgaactaaacaaagcaatgtgcagcatgtaatgtaggagtagttatgttctttttccccttctttttcctaggtctcaagaaatatgagtcgccgaaaggatcttttctacttatatttgacggctcagatatcttctctctttttgtccttttagatccgatggttattatttgttacatgatatggcatattctagttctattttaatattaacttttcactagttaagattggaggcaaaaaaaaaatgctctgaagtgaagcgaaacgaaggatctcctatagtgtgctccctctattttaaaatatagtaatttaaaattaaatttaacatcaattagtattatgaaaagctagtatcaaatttaggttgatagtagtatactattatatattttaaataagagaggtaagagttccttaacgattgtaaacttcttcattgcgtacgtttgtgccaaactgccaagcctgtcatcaactttactaaaaaccgcctttttcattgttgaccttagaccttgctaaggtatgtgcaatcaagggtgtgttttttaagtacatttacatttactctctttttttcgtgtacggctttccaaactaccaaataatatacaattttaaaaacaattataacaaagtattattttaaaggtttttatcctagttcttaatagattctaaactaatccgtcgctctatctttcgtgttgaggtagggttcccaaaacacacacaacacaacacaccaaacccaacccgagtacccgaccgcgcgcgtgccccctttcccctgaaaacccacaccaccaccgcgacacgacacgtacgacacgacgacgccgcgagtcacgggagattagccgaagaccgcagcggcgccccccgcgcgcgcgcgcatgtgatccgccccgcctccgcgcgcccgccgatcgattccgacctgtgtcgccgccgcacgccaccaccaccacggattcctcttcttttctctcgcagccatgaataatcccccgaaccccagtatctatctatccatctatctatctgctccatcctctcacgagacaagataccaataatcctgtggcttccgtgatttctcccaaagcaacaacccgagccgtgcttcccttcccctcttccgtccgtttgttttgtccgtctctgcttgtgtttttggttggatcaggacagcaacggccgaccacaactgctgatatgatgatatatcactgctaacacccgaaaaaaaaaattgggcaacgagaggaggaaaaagaaatccggcaatcacctggcgggaaaaaagaatgaaaaaaaaaatgaatattgagagagagaaatttgatggacacagaggaagtgcaagatcggaagcttcaatggattaataattcactaatcacccagaataacaataataatgtacacgtacaacaagtacagctacaatcacctgcactgctgctgatcgctcgctcgctcgtgcatcgggatgcacgctaattacaaaacttcccgatgattagcggcggcgattagcgatcagcaagggagcaaacagaagcaacaagttccggattaagggactaatggcagattaattagctggagctagtaggagcaggcgaccctgagcatggagcggccgcggagcatgccgcggtacagcgcctcccggttcgccggcatcgccgtcgccgccgtcgccgccgcgttcctgcacgacggctcggccgccgccgggcgggacgacgcattgctgtcgttgtcgacgacgtcggcggcgaacctcacccgcttcttgctcccgcgccgcgccttctccctcttccgcttctctgcaagaaacacacgtcaggtgagaggagagtcctaaagaggagccaagaagaacagcacgcacgacggcgcgctatggccatccatggcggcgcttttgctccgctcgctcaccggaggaggagaggcaggggcggaggcgagcaggggcgtcgtcgtggtgaggcggcttgttggcgcggcagagggagaagaggacgagggtgccggagagcgccatggcggtggcggcgagggcgaggccggcgtgggagccgccggccgacgaggacgaggacgacatgggagcagctcaggtagctcgagctcggcgcgcggcggcggcgactgtttggggaggtagttggttgggtggttaaggcgagagggacccctgcactgcactgcaatggcagagaagcccgtaggcacgctgctactataatatactacccgctactgctggttgctttgctggagctggactgaggttggtcaagctagtttattagggtagttcagtacacttatccaactggtaaattattactactactgtaatttttaatttttttctatttttattttgggagaggtttgttttgggttggaatcattggtgcagggtacaatggtcattttgtagttgatgtttcaatttgtattcagttttccatggaagagtgggggctatatatgcatcttcggcagtggctgtatgcacgttgttggtgtagaggctgagttttaatccattattaaaaatatatttgtcatttggtaattccgtcgataaaaaaatgcataggactagtttcttatcggtggatctacatcgagacttataataaagtgcgcgagcggtccctaaacttgtgcgggtatgtcatttaggtctctaaactttcaaaatgcattttcggttctttgaacttgttttgggtgtcatataggtccaaacaagctccaacctcttccatgcgctgatgtggtatgccacggtagcgcctacgtgttagtcggatccacatgccagttacatagaaaaaatataattagaaaaaaaacatattttctcgtctctaccttcgaatttttatctttttttctgtctacctaagaggagaaaatatggtttttaattttatttttttatatatgcttgacatgtgaatttcactaacacgtaggcgttnccgtggcattgccacatcagcgctatggagcgggttagaacccgtttggacctacatgacacaaacaagtttagagacctaaaaaatatattttagtagtttggagatctagatgacacactggcacaagtttcgggatcgcccatgtgcttcactctattctatatggataacaaatgtcttgattgattgtgcgtttgtgcgtcaagtgttatagcggctgcgataaccagcccagccgagcaggtccaaattggatgctattagaaaaaaaaagtgtaaaacgcttttgggtaaatcctacaatgaaatttatattcatgaaattcatatttgtttgaaaattcggtcggtctcaaattattgatacttttatgtgcatatatgaattcatcaccaagccagtccatctgaaatacataaattgcagcatagaagatacaaagggtcatacaagaaaccactctcactagaaaagaatagaaacatgggaggtagtagtagtaaataaaaccaaataaaactagaatttcgtatttaatttaaatctgtgttcccagcattcagaacctgatgagacagagtggaattctgtggaaagctggaaataatacccctgtggaccaggtcatcagtcatcaccaggacagtttttgttttccttctttcattccccttgttttcacttgcaacacctgtaaatcctactgctggtgttatccggcacggcacgatgaattattggggggatgtctccctcttcttgctacctttgacatgaggtcagataagacggtcacccaatgttatgtctgcaaaagatttatgcttttcccccctcttttacaagtgaatggaggccaaggttatgatgaaaatactttttttaaaaaaaaatcttggatcaaattccaaattaattgaggccaagaagtaagattcagtgactgcttggcagcagggcaggtaggacaacatatgcaggctctcctgatgcttttactttgctaccagttgctttaaatgatctagtttgcctctcatttctgcagccagtatggtttttgctccaactagtaaataaaagaaaaaaaaaggcaaggtcctcgaatttgtttatgattttattacaacctctatactttcagaaaaaaaaaacaggttagagctcttactcttgctaggtgtatcatataaagcagttcaaaaaagggaggaaaaaacaataaaaaccgtttaaaaaaactaagagaaaaaaccattccaaaaaacacagaaaaatacgggggagaaaagattgaactatgtccatcagatctggttctgttgaaatgtacagtcctgtgactagtgtactggtctaaactattaactattgtaagtattattgagcggatcagcaccttacaaggtactccctccgtttcacaatgtaaatcattctcgcatttcccatattcatattgttgttaatgtatggaaaatgctaaaatgacttacattatgaaacgcaggaagtattagactttcacaagcttctcccatcaatcagaccaaatctccctagaaaaacctaaattatgtcacgttttggatcccattaattccatcgtcgtcatcacgtcggatccaatgatcgttaattgcatcagctagcttaaccaaatgaatattatttgtccagccaaatggcccttgtacctgccggaaactgctgtcctatgtagcggtttcgcgtgcaatttgcaacgaaaaaggacgcccatttggcgatgtaagctgacatcgatgcccccaaaagagcccaataggaagctaatggaggattaattaatgaaaaaaaatccttgaattcatgtttgcctctctttttttaattcaaattatacatgtatgacgtatagagcagcatgcatgatgtaggtgtactgttagctgcaactggaattatccaattccagttaaagtggaaccctaacccaattatttgagatctaggacaagcaaaccgcacttttgccactctttttctttttttcatgccgctgctagctaatggagaacacatccataatcagtatctaaaatgggtgaggtacatctatatatcctttaggataataagattttttttctaattatttctataaaactttaaaagcaaagtcgatctccttccatcccctcctcacaccacgtgtgtataaccactggattaaatgatttgtcctcaatcaccattctaactcatctctatttatatgggcatgttataacgtacgagcgtgttattagaattatccaattccattttcttggtttccttctcgcataggtatatcatcatgacttcaagaatatacaaagtacatatgacaacttaattaaaccgttaatatgccaccttcctatctcctgaagttgaactatatatgctgtgaagaaatatatggatgttgaagtagaatctaattcaatattgtcacatcgtatccaatgatcactgcaaccaatcaggatgaatattcacctatagttcccgataaaaaccgatgttttatgccgtgttctcttgtgatagcttagttagaccgcaacttacaaaagggacactatcgaccaaacgctgacgtctcttgaaagagatgttgaaagagctcaacaattgaagctaatggaagatttgttatgaataaactctagcaaatgggaatatcctagattccatggatgacgtacatacagagttctttttcccttttggaagttatgggatataggtagctatagtactagtattgcatcggaaatgcttgcttgcaacgacctagagtatccaattagagtggaactataacccaactatttgcgctcttgtacaaacaattgctcttttgaagctcttttcttttccttttatgtgtaatggaaggaacaaccttttgcactacttttgttgtctagcattgtgctgaattcactagttaaaatggttagggtactcaatgtaccaagaaaacaaggtcgacacaaattgaagacaatttattgtcttatacttttgagtttacatagatttatccccaattgggaaattttggacacctagtagccaacaatgccatttataaatccttggtaggaaagatcgtccatttctcatgtgacaataatttcatttaaaccatgaaaagataatcaccttcagttgtattcgaattagtggcgaagctttttttttttttttttgaggatcttgtcctccacatacttattatatagtactccctccgtacttataaagtaagtaatttaggacaatgtttaagtcaaaccttaggaatataaatcatgaataactctcaagttgttgagtttgaaaatgtaaaaattatatgaatagatttgtcttgaaaaatactttcataaaagtacacatatatcacttttcaataaatatttatagaaacaagaagtcaaagttgtgttttggagaccgtgtcgctgtccaaacgacttactttacgagtacggagggagtacctttgtttcattttgaccttttttagtcaaaacaaataaactatcaaaatacattcaatattagatgtaatgaaattaaattaatgctacaaatgttattatatttttctataaacttgattaaagtttagagaagtttgatgagaaaataaaaatgacttataatatgaaacgaattataaacggagggagtaatttttaaagtaatataataattaatatgatctaaaatagctaaaaatacacaagctatccgtgcccggtgacacatcaatgattggaattgggttaactaatgatctaaaaccttagaaagaaaatttagagaaaaaataccactaaaatacaagaaattggaaaatatagaattggcatgaactcatgggaaatgtttgcacgaggtatgtcgattcagctgctgtcctggtgttcttgtgttagataatcctacaacctgcttttttttttccctggccctctctctctctctctttttttaaacacctgggccctctctctctatctctctctctctcactctgatgattacttttcccaggcgtccttgttcttatcccctatccgcccggggatttgcagtacaaaacccaacacgctgtggctccccttttgtactgcgtccctgctgcctatgatctcattggtggccgaccgcggcatcgacggcttcgtcacggaaagaggagaggagaggctctccccgtcgcctgccaagtgcgaaagcggaggagaaagcgaagcatagcaaagagagagatcgctgccgtgccgtgacgcaaatcgaagggagggtcccg

SEQ ID NO: 47827 - DNA, 3287 bp, Oryza sativa
  unsure (1)..(3287): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatgcaaaacaacaaatttactttttgtgtgacatcctcatctttagaatgtgttcacattcgaaaagtcgactccccaaattagtgtgtgttaacctggcccaatatagccatataggtctgtgacaccatcaacttgcatcttgcaaaggaaaaacagaaaaaagcaagatgctgatacaaagagtggtcacaggtcactggttcacagtacgtccaccgaaaccattgtccacaagcacataataacacagtaaccaaggtactcattagcctcaagttcattgcagctagcaaaaaactgactttaaaaagtagtccactaaagaagcactaggatgacgaatagcatgcaaagttaggaccatcaatcacatctcagctaagcataaaagagtcaactaatgaagatcatgaaattagctacacaaatttctgttgagcaataccatatctttagatgatatgcaaaactaatttcttttattttcaatagctggaacgcaaatcacaaacgtaacatgaattgcactttcttgtttcgttaggcatgacttttaatcagaagactcgtcaactgatgaaaaatatttggcaatgaagcatgtgcccccgtttaccaaatatgtattttgcgccgtactaaaaataaaaactataaatgtctttgaaatagtttataacatattgcaaaaattagcctgcaaacttgtctactacagtatttcaggcgtgaatgcttcctgggaatttagaacaagttaatttatttatctaactgcagatgactgtacacccaactttttgcaaattgtgcatatagtattattaatgcatctacggaatttcaggcaatctttgaaatgatgcatagtgaatttaattttggatttggtgaggggaggcatacgctgccctgcttactaaatcaatatttctaaaacaactatggagcttatgatagaaatgatgctctaacatcatattcaagtgagtaattttcgtcccaactgccaacagaaaccgacctagatttaattgagttgtatgattaacctgtaacccccaggctaggaatgaaaatttccagatattagaagccactcacaatctcacattgataaagaggaaaatcaaccactcagcattaaggcataacaaaggccaaccgaaaaatagcaaagcagtacagttgtacatcattactttgcatatgcactgcatatgctgccagtggacaggtaaggaagcagataatctaccagactaccatggaacactgcagtagagggcaaggtcactatactatactacacactactgcatcatcatgtgaaccctgaatcagactgtatttttagtgaaaaatattgccaagataatatctgataccaagtcaattattagtcaaatatttcttgtagaaacttctatgcaccatttggttggtgacgaactgtattacagcctgttgaaaaggataaattttttgacctatttgtttacaattgttatatactacctccgacccaaaatatagcaacttttggctatgaatctggacacagttgtccaaattcatagctagaaatacttatatcttgggatggagggagtaccttcttatagcgagtcaaaggaaaatctgttcacgatagaaggatgcatgacacactgttaccatttcaaattgcagcagaaaggaacagagtgctccaccataaacaatgttagcactcatgtggccatactataaattgcttgtctcgcacgagaaaacaaactgtttatatacagtgcccccaacattagctgctgagcccaacctcaagtatccattcatcaatagagagcaaaaacgtgtgcgcactgaattgccatacaaggatccattctccttgacagcgacacgagtgctgcgtagcggacatgcgaaaccatagctgcccacaaccacaataagtcgcctatttcttgacctatgttcaggaaacttccattactcctgcctgctctatgatgcgtgctaaattacctttctgagaacactaataaactactatattaaccaatttttttctacctctcttactacctccccaatcaaaaaaaattctaataaggatactaaactactatgttaaccagtttttccaacctctcttattactacctccccaattcacagaacattccaagaagagttaacaaacaacataagcaacagctaacgaaccctttgcaataatataattagtgaaagacatgtgaaaactgaaaactacgggtgttgcgatgcggcgggtggggaagtgcgtggactgggacactcaccggtgtagttgagggcgctgtagttctcgagcagcaccatctcgccatggaagtcgacgatctccttgcgcacccgcatcagctcctccttcgactccctccccgccgccctcgccaccctgtcctgcagctcctgacacacacagcgtcgatttcccaaatcagaaccaagaaactcgagaagaagaagaagattcgaaccgaagcacaaatggcgatcgatcaccggcgcaccttctggcggatgatgtattcctcctccttctcgacgaagaaggagttgaacttgtcgagctcggcctccaggagccgcatgaagcccgcctcctcgggcgtcatcgccgcggcggcggcctcctcctcgccgccatccgctgcaacgcgtgcccgcttcgcctgcctctcctccccacccccacccccaccaatcagcttgagccgcttcttgagatccttgtacgacaagaacttgtcccgccactccgggagcgtctccacgatctggctactcaggctcttcccaaacttcatcctcaacaacaagagagaagaaaactgcacaaaactgcactacggctgccaagaaccgatcgaattctcgccgcggcagcggtggaggtggtggtgaaatagggttgaggaggagaggggggaaagggaggcggaggggctgcagga

SEQ ID NO: 47828 - DNA, 4818 bp, Oryza sativa
agcaaaaactgaaaatcccttatattgtgggacggagggagtacttaccaaactacgttataatcgtttatatatacacattacggtgctacctagttcaccttttaataatcaacaatttttttaaaaaaaataatcaaaaatttcaggccctgtttgaccatgttcgaagggaaatatgtaaacatgcaagtacaaatagctttaagaaaatactaatatgggttagcacttggagcttggaagtcgtatgttcttgaggagagctaaccgacttgtgattttctttttgttgacagtattatttaagtagcactctactgtccatgcaaagatatccaacagaatattcctataattaattgtcatgcgtcttgcaatttgacaaggtatagacagggagctgaaacagccatagtgtataaataccagatccactaaagagttagaattattagttgaattactacactgtgctagcgtcaaagtgcctttttttttcaccgacttgcctttaactaattagaataataatccttacccaaatatgttattcactttttcctcaatatataaacatcaataaaacattttcaccacataacaaaaacacagtctattttgaaagaaccgatacatattctatatcactttcattttgtcatatcacttatgtagcccatcttaaagtttctgtcaagcaactcaataatatacgactcttcttttttaatagccattcatatgacatagtataaaacttgtgaagcgcggacgcgacgacgctacatgagtatactactggccatgagtaaatactcgtagctatctgggagtagacaactaacccaacccaccgcatatatcaagaacttattttaaaaaaaaaacaaccaacatgggaaacacaacctgaacggcgcagaagatccgcaagaaatccctcagccaagtacaatgtactccgtacacgccatgagccaaaatgacctgcagccatggaagattcggggcataatcctttgctcgcgaggggaatatccatccggatatgtcacagatcctctgcacgtcactgtcgcccttaaaagcccatgtcctctctctctctctctctctctcactgccacctggaaatgaaaaaaaaaagcctatgagacttgaaattatcttctggatagagagagagattatcgtggtcgtgtacacgaactttgcactcgagcaagtgattattcgatgtctttttagtgtaatgattccattttaaagtaactaatcctaagctaagctgagttctctctgagtctgtgcgctctacagtatgagccactcttgcatgctggaacagtgatgtgtccaagaagtatacttttggattcgttggaggaaaagttgagtgtttctcatgagttcttgtgtgtagtggcccacgtggcaccaagtgactgtcttattatttaaagaaaggttgggtggctgtccgaatatttaaggaagagattaaagttagaaaagatctgaagcgaccaataaatattggattagttgaagacagtgaagtgttagtggtcggccaaaaaagtgcatgttagtcattggtcggaggtgcggtccatccgacatgatcatgagatattattttttatctcctggtatagggaaaagtacacatgaccattggtcaaacttttggtccatgtggaaagacaaccacatacggtcatagttttattgcttttgaattgttatttgacaagtggttgtatgatatgttatttgtgcttttattacggcacactcattttaaagtatatttgcataattatatggttatgtcgggagtaaaatatttaattgatatggacacatactatttactagtattatggcatagaccaatccttttttggtagcacaaattaccaccctttcacttatgtcagtattgtagatgataacttattgcattgcattgtagtattatgaaggatttgatcgttctctatgcaaaacgtcatacatcgcatgagttttatcatacaatatagcactccgttcatgtttaaagataggtggaactaatcatttattaaacttgacctctcatattttctttcttccaaaacagatctacaaatacttaaaagagaccgatgctctataatcaaagtgcattgtgtcgtaaacataaaactatgtattctaaccactactacatgaaagatttttccgtgcgggtggaatcaattttcgcgtgcgtagcttccacccgtctggaacgtggagtctgtgaaaatcccgattttttcgtgcgggtgatgcacccgcacgtgcggacgcttaagccacccgcacgagaaaataaaaaactgaaaccgaaaaaaaaatcaaaatccacccgcaaaccctaatctagccgccgtcaacaccatcgccgccgccattgtcgccgccaccaccgccgtcgtcgctgccttgcccgaggcctgtcgtcgtcgttgtcgccgccaccaccgtcatcatcgccgccttgcccgaggcccgccgatgtcgtccctgtggtcgccggcgatggatccggcctccccgcggtggcagaccatggatccggcctccccgcggcggccggcgacagatccggcctcccagcggtggcaagccacggatccggcctctccgcggcggccagcgacggatccggcctccacgcggcggccggagacggatccgctccaccgccaccaccgtagccaatgccgctgccgccgtactcgcagatgtcgccgccgcgcccgccaatgccgccgcctccgccgccctaaccgagagcgccgccatcgccgaggaggagagggacagggagagggagatgggaggaaggggaggagggagatgggaggatgggcaggatggggaggaggataaatggcagcgctcgcatgatgggaggatggggaggaggataagagggagatgggaggatgggcagcgcgtggggtaggctattttcgtgtacgggtcacttaacaggcccgcacgtgaaaataggcttattttcgtgtgtgggcctgttaagtgatccgcacacgaaaattgatttttctatgtgggcaacggcccagcacctgtccccattttcctgtgcggttgcacttatgatccacctgaaaacaaaaagggtctagtgtacgggaaaatctttcatgtgaaccatttaagattaattggtggtcaagataaaattgtagctagagctaacatttatttacaaatttttttttcttaatatacatatatttataattggtaaaagtccaaatatccccctaaactttggatgaaagtacatcaacctgaactttaaaaccatacatctaacctctaaactttataatcatcccctaaggtgattttggatggtggtttttcatattttggaagcttaaataaacaactttggataactaatgtaacatatttgcatatcatcaattgtaagtcatcaatttatacttatacaatgataccatactattattacgttggtacttgtttgtaagtgagagctaacaagcgattaaaaagaaagattgaagtgaaaattttaatacatatgtctaatgtgtatgtcatatgatcaaactcatccaagttatatacaaattagatataaacaactatacaaagccaccttaggagataatatgaacgattttgctaaatctagggggttggatgtctggttttaaaattcaaggtactatacggacttctatctaaagtttatggtgatatttggacttttgattttgtctcccaaaaacgaacatgtaaacaattgtaaaacttcaatatcactttcttttaatctatatcttttattgaaagagaacacttctaattaaaaaaacaccagcatacatagataggatacgagaaatgtgttaacttaattagaagtatttcactacatgatcatgtcttcgttgggtcatattctctccattacataaaaaaaaataacatatactggatgtgataaatcctagtattataaatctaggtatacatatgtctaaattcgtagtactaaaatatatcacatcggattctaaatttgttttttatgttttttatgggcggagggagtattacagagtctgtatacgaacgattttagccagagagaaaacctgccgttgttgcaaaaatatccagccggcccgtttgccgcccatcccaatcgcatcccgttggagagcgataaaccccccggcaaaccaaaaccatcagtcgagatccgctccacaaaggatcactctcgaaaaaggacgaccctttttagtacaattcgacgcgacgtgaagaaacaggaggccgtcctcccccatcatctgaatttctgaaactctgaaactctgaactgtccaagaagcaacagctgcctcagcctactggccggtgcggactccgcctgaaaaatacgaaaatgacccgaatccacgcgagcacctctcctcgcatattcttctcatcgcctgacgcaatcacggagatgggagtggccgtgctcacctgtacagttgtagcaatacttcgagcaggagcatttctgatggaaaataatactccaggttttaaaaaggtaaaattggttatatagcatcgaaagttcacgtttttggttttatagcaccgaaagttaccggttctctttaatagcacctaaagttcaccatgtttctatttttaacacttccatcaattcttgatcgttttccgtccgtctgatcgttattgatccagccggggtgc

SEQ ID NO: 47829 - DNA, 6705 bp, Oryza sativa
acacagcctaaggtgaaaccgatcgtttgggtttactggcttctaatttaactcaggtgctcgtatttacggctaagtagatttaggtgcactagcgttcacgtaaattattattttagtggttcgcaagataccaatcgataacgagatacttgagatttcgttaatcccaaaataaaatataccagccatgtctttaggaggtgatcatgtcctaacagaggtaaggtgtgcgcgcgcatttagaaagatacgtgagttagggtttttaggatttttctttttggaatttttatttatttattcaaaaattctttatttttcagtcgggtaaacgtgtcgtgtgtaaaaatcctattttcacgtgtggttgtgttacctgtctgggaaatccctatttctatatacacctgagggcatgcagttgctacatccatctgcagaaatgcattttagccgtttaggaatattgtttatattgtagtgtcttttgcaacgcatagacatattactagtaaagataaagtataagaattggacgagtcaagcattggatgatcgtagataagacgatgaagtcatgggtgcatatctccaatcaacagggtgtttaaatcaataatcacacatgtgtatgcacttttaatagaattttagcggaacgaatttgtgctaattttcgtttcttccaatgtgtggacttctcttatgtgctctctccgtctcaaaatataaacatttttaacaaagtgacaagtcaaatattttaaactttgactattaatagtaaaaaaaattaaaagatcaatcatgtaaaattgatattactagatttatcattaaacaaattatcataatatgcaaatctttttatttaaaacatcttacttttatagatattgttagtcaaagtaacatatcgaaaaccatgtcagagtcaaaaaaaaaaaaaaaagcttgtattctgggatagatggagtaattaattaacaaaaaaatatgttttgattgataaattggtatgcataaagatgcttgcactagaattttaacactttggcccttcttacatttactttacaaatgtaaatccatgctgaaacttattttgaaaatgacatatgccaagacttgtttcacaaatgctagctaagcgtgtactcctaggacttttagcctgcaggccgatcggccgctctcgatgccggcgacgtacgagacagccaggttcatggaacgaaaatgagaggtgcccgggcggtatgacttttcagtcagactattattgtagtagtacgagccagtttcaatttctctacagtacgtaatttgtgcagactattattgtagtggtgctttttctgtagcagtaaaattgtgcagtactccctcacagccggaatgagttcatttttgggccgttttggtttgctataaaaactgggccataccaatattttagttatcagaacaataccactgtgagtttggattgtgaccaaatcactggtagtgcctaggtttaatttggtagcaaggcataggctggaattggcagccatccgtcgcccgccggaagtgcccagaagcaggccacacaacttggctaagcacaaactagttcacgcacttccgttaaaaaaaagaagctagggcttcatcttttctctacttcaataaatacccagccactactcccagccactactcgtctcctcggctggccgcctcaccgctctgtttatttgtgcttattctgcagcaaatagtaccaaaactattacaccaaaaaaaaatggtaatccttcattggtaccaatccaaatggaaattgacccataaaaatttggcacaacattggcactaatccaaacactcgtatttactgtgctaccataccaaaattttggtagtgccaaaacttaccaggttttggcactgccaaaattttggtagggtaccaaaccaaataagccctttatttcttcctatatgttctaagataaatttatttttaagtaaacattatatctcaaagtttatgaaagtagtgtggataatacattaggagtagataaaaagaaaaataattgtattgggatttgataaaatgggaatattttagtctatttggttttgtattggtttgtgtgaaatgggtgaaaaaaacttattttgagacggagagattaattgttactattcgttgggtgataaaatatggtataacaatttctagagttaattatgggttattaagaaagcatgtgaaattaaataagagaaaacaataattaaatgaaaaaaaatcattgcaattaggataagttgagagaggaagtggtggataaatttgattgattattattggttgtgataaaaaaagtagatgtaagctgatatattctataataaatttttaaatcttataggtttatttgtctctgaataagtccatttctatgcactcatctacttctattcgagtttcatttcattaataccctttactaatcattatacctatatgaaccacccaaaaatactattatttctattaattgaagacattttgatatgattggcagtacaagtttcccagtccaaattttcccctattgccaaaaaaaagaaaagaaaaaagaaacgcaaacacacacatgcacacccttactcctatacacatctctctggtcccttctactactactactagctaggtccgattcgatcatatcgacgcgatgcaagccgttcactgaacctgcagctaagtatacgtaatacgttggcttggtgggtgcagtgcatgcactgatgactgatcgatccatcgatcgagctatatctctcgacgagacgagatccagtacgtactctttcgtcggatgggtacagtttaattatcgattggtctaggtgcaggcgcattcacgtactacgcgagcaggtgcatcgctgtcgacgatgccggcgacgtacgggacagcgaggtttcagggaagcgatggacacacgatgccgatgcctggcagtgcatgatcacgacttctcagtcaagaccatcaattatcgtccgactagctagaggccgggtccttgtggtgtttttgctggagccgtaaatagtagtgcactccctccgtacttgttgactgaataactttgaataccaagtctgtttagctttaactggttgggttctcttaggccatgtttagttcacatcaaacttttcttcaactcttaactttccatcacatcacatcacatccaaaactttcctacacacataaactcccaactttttttccaaactaccaactttccctaaacttctccccaatttaatgaactaaacacagcctaaggtgaaaccgatcgtttgggtttactggcttctaatttaactcaggtgctcgtatttacggctaagtagatttaggtgcactagcgttcacgtaaattattattttagtggttcgcaagataccaatcgataacgagatacttgagatttcgttaatcccaaaataaaatataccagccatgtctttaggaggtgatcatgtccttacagaggtaaggtgtgcgcgcgcatttagaaagatacgtgagtatgcacacgttgtgagcgcatatatgtactgtgttttaagaaaaatataattactacctctctagaaaagttttacttttatataaatctagacaagtattattattattaattatgtattgtttcgtgaaagaaaaacaaacttcttcctaatttattattaatgatagttgtatgattatatttacagtatgacacaatcacattattacggtggctacacagttttttaagaaaatacttatatcaaagttaaaaagagaatagtataaccattgacaggtatttcaaacaaaaaaaatatggagtaataaatgcgtgtagttttactttttagctgcacgtacgtgtcggatgtccggagaattgggccaagctggtcgtcgctggatgctggcatgcaacgcacccaaccaaagctgcaccggcccgtctctattcgagaaacaaaaactgccaactggtgactgagaagtgagaaagccatacgggcacaagacaacgtgcaaaaccagctggatactcgggatttgtacactgtcaatacaagctccaaatgaatttcttacttcaaaatttgtatccttttcaaggcaacttcacaacttgttgagtgctcttattacacctttttttttctttctgacaaattgatcattttcagaaatttattgtgaaactaagaccgtgccaaaaaaaacttcaataaaaaattaagccatgttctcagcaccagagacattggcgctgaggttaaacataccaacgttagctatgttgacgttgagccccctatccacatggttccgaggacgatccccctcacttacgtgacagggactcatcagcaccaagacggttggcgctgacccaatggcatatttttttgttaaagtttttttttctgcacggttagtttcgaaataagtttggaaatgactaatttgtaaaataaccaaattattactagtatagtaaattaccacgttgatcataagaaataatatatactggactgtcttcataacagtgtggattatttatatattgtgttgtgaactaaccaacgttatacttttcgagacggagggaatatatagttgtattagaaaatacaacagaaaacctagacaacggtatcctgatagaacgaaatatgtctatcatgttgcaacgagattccgttttatagcagccctcaaaatacaaatatattcttgataatcccatacaatttggtggaaaattcgaccagtttatccgaaacagaaggcgtgaacacaagtcatcagcatcagcaaggcataaagcggacaacttgaaacactttattgaatcagctaaacttgcggctcgcttcttcttttcttttcttttttcttcccttcactttcttggacctgtgacttttagttggccgtccaggggatctgaatccatctactgtagaccatttgtacaatcaattgttacaaaatggaccacttaatctacccctaaatgctaaagcaatgactaattatgagctactcctagctgctatattcagctcagctcttgcaagttgccaggcaaaagggctactaaaaaccaatattaatttctagcaaattgctctagcaggctcttcatcttcttggaccatggcttggcgtttgtgtcccggtgagctgaaccatggataagaatgcgtttagtgcaacaacctgcaggggaacaatttgatgacattatcctaataaaatatatttttagtccatgctaataccttttaggacctggtgtctcttacctagccacacacatgtacaccgtttcaccgatttaattatgtttttaccgagtcatttgttccgtatgagaataatctatgggttggaatgatcatcaattacatacttcttcgtcattgcttcttacagaattaatcaaagggggaatatgctaacgagtataatatagtttgaggttgttgtgtttgaagtttccgatcgataaggtgttaatggtttattttcgaaactattggtgctggtaaaaaaaatgttctgctattcctctatcaaagcatgtcaatgtcaaacatttgctaaagttgtactccctctgtttctgaataaaagtttagctttgattttttttcttagtcaaactaataagattatataaaaattagtagcattttcaacccaaaacaaacatattatagatttaatgaatctaaaatttggtattttagatgttgataattttttctataaatttagtagtaaaatatcaaaatgacttctaatataaaacggagagggagtatatacatatgccaaacaattttaccaaaatttgggtaatacccatatatacacatatattaattccacattggctcaattttccaaatggcacattaattcacacaattattttttgcacgatatcagaacaacttctcccatttatatctctactattataaaaactgaagatgtttttgccagaactttggtacgtcatccgtatatgagtcggtttttaagttcgttcgattttagaaataccaaaggagtcgcatagaaatctcttaaaaaaaactcgcatgctaacttgagacgattggactcctaataacaactcatgattttctaaaataatatatccaagcgaattctaacggtgagttttacctgaactaaaccttataataattataagattagaatagccttcacccgttgcgtcgcacatgcattttctctagtcttataaaaaaattggcaataccaaatagaggtaaggtagagaagtttatataatctaacatttatcatctcaaaaattgcctcagcctacgaggctacatgccaatatatcctgatcctacacagtggcggagccaggataaaattatagtggggtttctcagcctttgggccttataacattattagataaaatctattttagcccccttacaatagatatatggatttaaattttaaggggtcttaataggggctctaatgatttattagggggtaggggagacccccccagcccccacgctgcctccgccactgatcctacat

SEQ ID NO: 47830 - DNA, 7084 bp, Oryza sativa
ccgctagctgctgcgcgccgcgcgcggcttcgtcgttgatcgatcgcgttcgctttccggacggatcgagctaggtggccggcaggagtcgctgaggttgatcgatcgatcggtcggtcgtctccgccgcgcacgcgtggttttttaactaactaatcggacgctctcaaaatgtatcgttctttttagggattcagggattgcgtaattacattgttaatccggtatatccacgcaaaatcatagaagaaaaataatactactatatttttaaccttttttttccagctagtcaacggccggcgcacgtgcacgcgcgtgcgcaccgggcggtatctgcgacaagcgtacgcgcccccgtgttgcctccctccatgtgtggctgtgggctgcaagcctgcaggtggcacgaacctggcccgaccgaaacaacgcgcatgcgcaagtcgtcgatactctacgtactacgcgcgcgcccgcgcgactacggacgtcgcccttgcggagagggacacgacggacgagatcttggctactacttcctccgtcctaaaaaaaatacaaaccctgatttccgtgcccaacgtttgaccgtccgtcttatttgaaaaatttataaaaaaaatttaaaaagacaagttacgcataaaatattaatcatattttatcatctaacaacaataaaaatacgaattataaaaaaagtttatataagacagacagttaaagttggacacggaaatctatggtctaactttttcttggacggagggagtacgccgcatgccgcgcgccgccgcgccgcacggcggtctttgcctctgccgtctccgtctccgatcccgtcgcgcgcgcgtcgtgttgaagttgcagcagccagcaatgcagcctgactcgactgatcgcctcgcgggccggcacgcagggtgcagcgagcgagcggccgacgtgcgtgcatgcgccaacctcaaactacttgaaatttgaaaagcatatgcacgcattatgccttttttatttgccccctttcgctttgggctttcagtaattattcatgtacttacttcttacgtctcataataaatttatttttaatccattttatttgtagaaatgaatactataggaataccactggcagaaaaggatgtgaatcaacaacaagctgtgacattaccgtgatatatccatagacttccataaatgtgcacaccgcttgacaaacagataatctgtttcgaatggcttcacgggaaacaacacaaatgcgaggtttattattgcatcctagattttatgtaagcttcatcggacaaaacaaatgatcgttttcaggaagttcaccactaaatctaagaaacactcaatgcagtcctgtaaaccaaggttacacaggtggatcgtgctcaatccgaatggcaaaccctgtatggtacccactatcgaaatgaaaaacgtcaccccatcgttacaagttaaccaatttttttaaccgataatcagcagtaaaaaaaacttccattcgaaatacctttctaaaattttttgtagcgggccagcagttagttccaccttttcagtgctgatttgaattttttggcccgctccgatataagggtgttacacgtacgtttgcttgtgcacataataatcgttagtaattcattcgtttgcacatggatgtacagctatctagcgagttgcgctgttgcgttccactgtcacgcaaattggcaaccaggcaaaattcggggatcgaatcaaataggacgtgtgtgcttcatgccttcatccaatggtggctgccctgctggttggtggtacagtgaagcgcgctggtgcatgattttaggatgtgagcattatgcagtgcataattaattaagtactccctccatcaacttttgatagtcatatttcatcttggcacaatgaggtgtgttcggcaccctctttttctaacccctctcgatcgttttccgtgcgcacacttttcaaaccgctaaacggtgtattttttgtaaaaaaatttttgtacaaaagttgcttaaaaaattgtaattctcacaaactctccgaaacctgcagccacagccggccacagaaaattcaccgagtcagactcggcttgccttgccacatgcccaggccagccgacgccctgcttgcatcaccaagccgagccgctgcatgctgcacagtacgcatacacacatgcatagcacaacatgcatcaccacgctactgcaattcatagtaggcacacatatatgcatgctacagtaccacgtgtactgtagcaccatatactcttactttccaatttccttcgcgaacaccgacgcttgcacgcacacctcgtgaagcccgttgcaaagatttcacccacacggtatccatccaccgtatgccatctcgtatccaacttcgtcacccggtatccttgaccgtctggacctcaactcctcactgagtctagaacttcaattctccccttttcaagaagtatgcattttgtatatttctccccctttgacaataatttcatcaagatgtaagttataaaaatctaaatacacccatagcatgacccatcaatattaataattaagaatttagcaagaaaatgttgacacatctagctttttcctaactattgaagttaccaaaaattcagtaggacacgtgttggcttcaattcaaaacaaccttaatatgagagaacgtacctaacattaatttcagcacgcggaatatatatcctttgtttcttttaaatactaagatatcttttccacgtttcatccatggaatttaatattaaatacatatatcctttttttaaaacattatcctatctgaatggatatataataattcttccatggataaaataaacaagagggtttgatatttttttcctataaaaaaattacatgataaaccttagtaacgaagcaaaccctagttgggccgcctcgagatggcagcccattccggcccaggacacgagccatcgtcatcgggggtcgtctactacttgcttcctcctccctactccgcctagtctactactctacttcgctctccgccgccgccgccgccgccgccgccgcccacctcgtctcgacgccggtgagcactctcccccgctggagatccacgcgccgctggttggattagttcgggctagggtggagcgagattggatcgttggatatttggtttttggtttttgattttttttttgttgaattgttggggggatttgactggattttcctcgtgcaggatgaggatggagggttcgtcgccgatggaggaggaggaggaggcggcgaggctggcgggctcgcagggggagtcgccggcgatgctgcacccgaacggagacggagacggcgacggcggcgatgatgagggtgacgccagcggcggcgaagaggagcagggcggtgtggctagggcgggggttcgtcgccgcggcggcggcggccgtgtgcgcgtgcgtggcaggattccgctgaagaaggggccgtggacgcccgacgaggacaagcggctgcgggagtacgtggaggcgcacggcgaggggaactggaaccgggtgcagaggaacgcggggctgaaccgctgcggcaagagctgccgcctccgctgggcgaaccacctcaagcccgacctcaagaaggggcccttcagcaaggaagaggaggagatgatcatcaagctccatttatggctggggaacaagtgggctaagatggcaaactctgtaagtgtgctcctcctcctactctttcatggttccttggttttgctagcttgtgcattgatactccgttcattgttagtttagattagtagcatgcttaatatttaggtgcattggtgtattagttggattagagcaaaaatatttaaccacctaaattaaagcctaccaacagtttgcctagtggggagaatgcatgctgtccactccaaatataggggccgcaaatataccacttgctcgtagatagatgtattcagagtacatcaaccagtattttcttctgtattggcgaaagactttattttattcatttaattggctccaacttgatttaaatagagaatggccactgggcatacttttttctgagtgtggcgtagtgccatggtgcagacacatttgacatgctgcactcttgtaaatggccttgttaaaaggagtagacaaatgctttgccattattccttgtttgcagagaataacaaagtaagtcgttcttttacaattgttgttagtcttgtctgaaatagtatttggtcctccaacaaatcgaaagaaaattgattcagaccaattatcctttaaatcttcttgcttgtagtggctttacataagcaggggcagagcctcatggctgcctacctggacactggcctccattggctgcaaaacctttgcaagttacaacttagtcgtatatatactacctatctagaagcatgatatactgcttgattaatataaattgtttagtttataatcagaacaaacggcatattgtcagtcgagtatccgtagaaaaccaaacagcgtatctaaactgttttttaactttgatttgatgcgatacccgtgaacaaaattcagctaagctttggccttctatgaattaagtagacccaatcctccatgttggacgtaagctgtctgttcaattctggattgtcgtggctcgagaattttgtagataatggatagaaattcggcatctgtagactgtagtcactgttctaggttcctattaggatcattgtttgttagtattgttactacatgaaaatcggtgtgatcgaggctatatatctttcatcttctgaatctttagggacagcattactggtgtgatgtgagtgcctgagtgagtgagagtgagagtgtgtcctagttgcggactgaacacataaagaatttgcaaaagttaacaatcgttttctccatattgcatcacgatatcacatcactaattcactatttgttggtggtttgtactacgcatttgcaaacaccacgtagctagctagatcaagctagatataacaccaaatctgagttctatcctgaagactagctagtaatcaatcgacttaattaggatataacgtgaaaatcgatctttggctgccgtttgtgtcaagttaaccattcattagcttaagtgaatggttttacttttcttttcagaaacgatactgtcatcaggtgaaactgcaactaatattgatggtgaagtctgaactctgaaatggatggtgaaatactgaaattaatggaagagtgaatagtttacctgacaaccagatgaggtcggcgaggtcgagacccttgctctggatataatctattaatcaagcagtatataatctattaatcatgtatccgtagaatagctctcgaggtgtggtcccgagaatagcagtcgagtatccgtagaaaaccaaacggcatattgcaatcatgtatctgatatttagatgcattggtgtattggattagaggaaaatattgtctctagattaaagccagctaacagtttgtctagtgcagtcttctccatatatactatttgctagtgtctggatataatcagtggacattaaatagttctttcttatgtatattggtgacagactttattttattcaatttaattgtcttaatatcgttagttgctaaggacttaaatagagaatggttgccgggcatactttttctttagtgcgttgtggtgccatggggcacacgtgcttgcagtgctgcactgcagaaaagaaactagatatatattttactgttattcctcttctgtagagaaggaactcggcttgtttgagcattcagagcttgcactaattagaaaaaaatagaatacctattttcttgaatctatacagtcagttaacacatggaactgtctttttcccttgtgttactgtaagcaggcggatgtactgtgactcgctagctagacacaatctcgaaagatgtgaatttaattttcaattcttagttttctgagccatgttataagtagtgtcaacttttaaactgcaacaggaaaagctgacatctaggccacaggataaggtagggtctgcaattattatgggaggattcattgacatggtcatatatatttttaaacttttattgggttcctttcctgcctcctactaaattcctatgagtttttgttcatcgaataggacttcatcatattttcatttatgtaaagacaatatcattcactgtttcgttaggtatgtttaaatcctctccaactattgcaacaccatgatacatcttgctatatttgccattctaacatctgaggtacaatgcaaatgcttattaggctaatgccttaaggttctttagtctaattgcctagaaaaatcctattagatcatatgttaacttgcatatctgaacttctgttgttgttattgcagttgccaggccgcacagataatgaaatcaagaacttctggaacactagatgtaagagaattcagagaactggtgaacctctatatccgaaggagtttaatcattttaagttgacagatctggaagtgatgaactgtgaaagccctgatgaatcacgtgccaagaaacgaacaaatgaggttttacagggaaatggtcaaagttacaaagaggtttttttcgataatttagactatagtagaccagaaaattatattcggccaaattgtgtgactccaaattctcttccagttgatgccacaagtccatttggtagtgccattgccacacaagatcagtcagtaccttttggtagtgccattgtcagtggacatccaattcttgatggcaacttctctacttctgggaccatacagaggcccatgaatgtagagctcccttcactccaatatcccaactatgactttaacaataataatgcatggtcatatcacgaccccttaggacatcctattgaccaggttgactttggctccctgagatcagaatatctctctccaaacaacaatggtctgctgg

SEQ ID NO: 47831 - DNA, 16771 bp, Oryza sativa
ctcctcgagaacagtaagtgtactcactcttattttaacatgaacaatatcacataaaacttactgttagtcttttcaggttgtcatgcttttgttggcatcaacaataatgcaagcagcctattccttgacagccaacctccacccttggtggaccctactttctggaggcacgatgtatcactagaaccgaatttgccagtttattgccagtttaacgaagaattgccgccctcaaatgagcagtttgccaaagatgcagatgacgctttcggtcatgggggtctttctgatgagaccaatctagctgctgcaggtcaaggcgatgaacatgaccttgaggacccctgggcgagcatgcccggtgcctgtgacatacctgattttccaagtgaatgacttgcatagagtttgtgcgtgttattgattttgatctcaaccagtgagagaaccaagaagatcctttttgcaataaccatgcctttcaagatcgtccaataagtttgtggctgcgtatgctattactatcttaccgtggagttgtgtgctatatgctttgctccccgaggaaatgtggcccttgaactgaatgttgccattgtttgtgtcggctacttattcgattcattaatgttacattgtttgctagaatatgctgaaattgtatattcgattcattggttttgattaatcaaagactattgtcgtcatgtggcaattggtacaacttgaagggaagtgaatgctctaattgcttgggacattggtagctccggttctggtgttggtgttgcacctgacgaggcgatgctccttgttttacctgctaataattgctcctgttccgtgaacataacttattgggtaagatgaggaatgctgctcttgaacgaactatgtgatgcctaaattgagctaaggatttgtcaactgttataaattgtgcgaaggatttgtcgacataaacaatcagttccatctttgaaaatggtttgatgtgtgccttttgggcttccggtttcacatgatcgaagacggattcacatatacgtcttccttctttagtactatcatctcgagtgtgctgatgtgtgcctttttgcccgatttctctgcatcttgtcattcaattaacaggctgttgcatcatctcgcaagttgcaactacatttcggttatagccattatatctaaggcatactctctcatttcggttatagccattatatctaaggcatactctctccgtccccccccccctaaaaaaaagagaatatgtaaccctaggtcgagttttttttggacggatggagtatgatttaatatgctgtgtctactaaattacggaatttttcaccaacaaattcaaaaactagaaatttgttctcatgggcaagtcctttaaacttaagggagtcgtccatggaaattgatttccaagagcggtcgttatttcgcttgcccaaatcatgtgatttttacaaggccttggttgtaggcgggtctaaaacaccattgtaaacaggttcttgaccgccccgcacaaacttttttttaagcagtggtgatctatgaacggtgggagtgattgtatttgcgcaggtggcagtgaagcctaagcccttctctccactaggtgcagttactcattgtgacacatcttcatcactagttactgacttttatatcatcatgtaggtcgaagctatcttgtttcaaattatgatatcatttatgccgacaacactcactctttgtttctttagatctagctctttctctctttggatggaccctacaaattttgaatgcatgtgcctataggcttgctcatcacttacactgataataactcttccactatttagatgcatcacttacactaacaataactctctctctttagatggaccctatgaattttggccatgtgcctattggcgtgcttgttaagagcatgaattttagcagtgtgcctatttgcttgcttgtaagtgtacggggtatggaagaaccgccttggaatggtggggcggcatgcatgtttatttgcttcctagcttgttgaaggtattatatagagttagaagagtttcttcatagtgtaactacaacctatgttatggtatatttactgattggatcatggcaatgtcgatacgtacacacgttgttctttttttagagacgatgttttagaagagctgttttgattgtccgaggatgatgatccctagtggttatagttcggacggtatgatatttgttgtcttgtctttttatttccttttcttagaaagtaattcatatgatgcgtgcacagattgagagtggtcttgcactaattataccgtcttattagttgtctaagataaataaaatttccttcaaaaagggctccaaaaaaacaaattggatgagtttagaacatataagtcacaataacagccaaagatatataatggtttctatcacgagtagccactgaaaacaattgaaaatgcaactactcccttcaatagtatgaagtgcactgtgaagcttggatccttcagtactttgtaaggctaagtgctactttggaaagtagtaatttcatagggatcaaaacaattaattactgtgaaaaacctccaaaattaattccttgaatctaaacaagccaaatatttatttaaaatttataaattcctcatacccctcaagaaccttttgcacctccagcttcctcctcgcctcctcctcctccctcctcatggccgcctccgcctcttcctcccgccgccgctggttgaacctctccaccctcctcagccaccggacccgcctccgcacgcagttcctcatctccagcgcagcgtacaggatgccggccacgaagcgcctctccgtcgggttcgccggcaggctctccggcttgatcccgaacgcggcgagcagcctcggctggccgtcgccggcggcggcggcggcggcgacggcggcgttgcccctgttgatgcactcgatgagaacctcctcgatccctggccccgccatgaacccgaggccgaggagcgcgggccgggtcgcctcgtaggcgccccacgccatgacgtggtactccaccagcctcctgctgccggcgtacatgtcgatggcctgcgactccaggcggcggagcagccgcgcgtacatgcggagtagcttgcccatgtcgtgctgcgccggcggcggcgctgcaagggagggaggaggaggtggctggcccacgtcgtgcgtcgccggaggagagggaggaggaggaggaggaggtggtggaggtggagtctgcttgatgagttccatggcttcttctgcagaccacgcaattacctcgtagatggaaatctgccaaaaacgtaaatattatgctcataattaactactccctccgtcccaaaatatttgacgcagttgactttttaaaatatgtttgaccattcgtcttatttaaaaatttttgtgaaatatgtaataagactatatgtatacataaaagtatatttaacaatgaatcaaatgataggaaaataattaataattacttaaattttttgaataagacaaacggtcaaacatatttaaaaaagtcaacgacgtcaaatatttagggacgtagggagtaattaataaataatattcgatagatatcatacaattgatacgactctatatgagtaaatcagattttttttaataatgaaaatatatcacacaagcaaataaataaattagatctaaagatattctctccatcccaatttgatcatcacctaacgattttgaggtcttcctaaaataattatcatataataataagtgtctctttatttatttattatgcaaagggtaattgggcatcgctgaatggaatgcatgcatgaagccatatgcatgctacgactgttagtgcaattccatgcaacatttaaagtgtgatgcaatatccactggatatatggagcaccttgattggtgataattaatttaaaaacatgaaaattttattgtccttgtctttgcaccttttatttaggggatgatcaaattgggatgaaggatatactattaaactaataataaatagaaatattagttgtttcaacggaacatcgaaaacaaaatgcaacaattttagtttaagttatgaagttagcaagatggatcagcaggtgcctaactaatttaatcgagtaatcgatcggcagcaaaagaaattaaacaacaaattaatttagagaataatcaatatggattttctatattgtatttgtattgcatgatcgaaggaaagaattaagagatcatgatcgaagatgagatcgatcgatcacctcggtgaggtcgtcatcgttgacccatggggacgctacggacatgttggggaggacggacgatgcctccgctgtcagcctgcagtgcggcggccctcctgtggcggtgcacctcgggaggtggacgacgacggacggaagccgcgagggggcgcgcgcagccatggttgccggccgcacgactacggagccgccgctgatgaggaggccggaggggcgcatcatctctcgctgcccgcctggtcgatcggtgtagtttgttgcaggccggggcttagggtgtgtatatatatatatatcgatcgagttggagaaggaaattaaggtaaaaccctaagccctaggagattatatatatatagtatacctattattaattactagcaaaaatacccgaaattgctaattcgccgacgtccgcgcggatgaggagggcggcagaagccgcgccgcgcgtgggatttttttcggttttctttgtatcttttcggtatttcttcggttttttccttccgttttttttttgttttttttacgggatacaaagtttatatacgtgtaaaaaactttttatgtgtatacaaactttgtatacataatatattttctagtttttttattttttaatacatacttatataaaatttatatacgttatatacttatgtatatacgccatatttaaccaagaaccccagcacccaaccttggaaacgaactcactacgagagggcgggctctaatccttaagagtattttaatagtatagccaactactgactctaaattatctataaataatctaatagcccatttatacaatagttaactataaaaatatactacaccattaatacccggtcccacatctcatacacacataacatattagagtccgtgttgcagctagctataaatttgtagcccgcttttttctctcttctctttttttctcgatatatgcagtggttatagctggtttatagtctactactattgtacctgctctaagcgaggagatgacacagggtgccaaaggttggggccatcgtcgcggccggtctttccccggcctccgagcgttgtaaccagtgctaggagaagctggatcgggaacaaagatctgattggcacggagcagggggaccggcgctaggagatgtagtaccaattggatcaggaataaagatcgaattagaaatggtaataaaattggtcgctagcatgcacacattctccgatgttgcattaattgtattccgatgaaatccgcgtccataaagttatatgatgatcaatttgagaaattttagatttcattatataatgatcaatttgggaaggagagagtacagtactctttagctagttggagccactttttaaataaatggttcaaagctaataagaacgtgaattacataatactttaaagaaattggaactgctagagaatttatagtccgggttgcaacccctttagtcctaggttgcaaaccaggaatacgaatctgggtttgtgaagggagctatctatttttgatttcctattttttttcagcgtcattatgtcaggtgagatgataaaaacactacaaatattttaaaagactataaaaagtgcccgtgcgttgcaagggaagaaaaaacgagaaaattgaggaacaattgagaaagatttacattttgtagttaattaaattataaatttcctgagatatctaggtatttttaaataggtagatgtataattaaattaatttataagtaaagtaagtgtgggaaataaaatagcatggctgaatttaattttttattaaattcttcatgattatttacactctttgattttttctcggaattttcaaagattaattgctattttctataatacaaatatcatttcagcatttatttaaaacaaaatctaaataaaaatcctcatttgtgtatgggccttttttagccaattttcttcctcaacccgtagctaagccggcccattttcctcctttctccttccctccgccttcccatatctgtccagattctctcagttgcccaacaccggctgaagccacctcttgtgaaatcaggtcatttccttatagataatctaaaattgatcgagggtttcgattcttatcttttcatttttccgttgtcccaaaaatcagagaaaatccattgtgtatcaaactcggaattaagccctattctaaacaagcaaactctaagtttagtccatttcaattgaaaaaaaatcgccgaaagctttacatattttctttaattaggtatatgatatagaccatttgctataagtatattggtatggatgcatgctttgatacgtccaaaagtgcgacggaaattaaaaggaaaaatataaagcataccatgggacccaccatatgctggatgcaccacaaaaatctcccatcaatggtcatgccctgtcctctatcccattccgtttctcctctctctttctctgcgatacgatcgctccttctcaggcttgtgacgtgcacctgcatcccgcagtcctggcaccttttgcatctttgagtctggtgttaatagagatggcaatggttaattcaccgtcggggtcatgcccgtgtccccgtcaccacggtgaaaatatgtcactgtccccgcccccgtcaactacaacggggctataatttctctagccccgatcaccacgcggtgaatttttctccatggtgaacacgtccccggttaaacaacatattcacaatcacattatatcaaatatatccaaaatactccactcaacaaatcagcaaattatagatcacaatcacagtaaggatcattatcatttgtcattacttcattaggcaaaacacaaataaacatcacctgatgacatgagccacaaaattgcagtctagactctggagctaatattaaacatcacatgatcacatgagccacaaaatgacagtctgaagctaatattagtttcacaaatcacaaatgagcatagtcactaagtcagcaacatatgagtctggggcaccattgtcgcgtcccaaatcgactctaaaatacatcctctaaattatgattagaataattaaaatccatgtgaaagccttcaaaaattaaaatgtgcaaagttaaaagtcaaataaggcttggaggatttttgtatatttcctaaaaagcctaaaatgcgtaaataaattttagtggaattttcagagcacaaatgataattaagaagaaataaacaaagttaaaaaggttttataaaaagaaaaaccctaaaaagttccctttccctccccctccccctcttgggccggctcggcccagctccctcccctccctctcctctccccgcggcccactcggcctcctccccgcgcgcgcgccgctgacgggcgggcccgcccgccaccctcgctgacgggtggggcccacccgtcatccccttcccctccaccgtttccgccactcgccgcctttcctccccgtcggaatcgagcccgcgccgtcgcactctctctccgccgtcgccgccgagctccggtccgccgccgccgtcgccccggaccatctcccgccccggcgccgcctccttcggcttcgccgcatcctcgccgacctcgtccgcccctccgcttcgctcaccgaccgccggaacgccgtcgaccccgtcgacccgagccgcgccgccgccttcctccgctccggccgccgttttcgtcgtcgccttcgactcggggtgagccgtggaccgccgcttcgtttccccctttccctcccctctctcggtcgctgttccgccgtgccggtggtcgccggcggtgaccatcggggcacgggcgccgcctcccgccggccgcgccgcaatggccgcccccccgggcgcaccgagcggctgccacgtggggctcggccgtcagccgcccgcgccctcgggtgcggctgacgcctggggcccacggcgccggtcggcgtgagccgcgtgcacccggtccaccgtgggccgtgaggctgccgcgtgggccccgctcccgtggacccggtccgcgcgccctctcccctcggctgacgcaataaatccgattttaaattaaaatttaaatgaagaaattcgcaaatattcatttaaagagcatataaacttcaaatggctataacttggccatttgaactcagaattggaccgttcaagtctctaatttttccttaagaagtcaagaacccatttttgtgctttgttaatgctttttatatggagtttgttagagtaaaagccttttcttttccgttggtcgtgtagacgctgcagcttcggaggatccgctcttcgtggaagttgaagccggcgtttgggaaagcgagcaaggcaagacacatcatccttgaacatattgaatcccaatttctgaaattattttgatttaaattattgcattatcgctttatttaaattcccgcgttatcactgttttatttagccatgcctattacctttgttacgaccttattatttttattgctattattaccttgttcaccctagaataaacaaaacccccaactagtggacactctatttgtggtatcactagtatgattttaggtagatgcttcgctgattaattaggtaacattaggtggttttaaaaccctagactgtggtaatattcatatcacctggacactggaattgttggattattgtggaattggattcaccccgccccctctattcaaaactctcaaaatggttttaggctgggctcggggtgcatggttttgatagtcgcacctcggccatataaggaccggtcttcgggcctctgttgcaaagcaccaccgtacttccacatgtctaatgggtaaggcttagtttgtggctcagtctggttataaacaaaagtacacggatggagatggacgaagtcgggggattcgatggacatctctaggacaaatgaaggctacacgagctgcggcccggtagtcgagatgtcatggcacagggttggtgccctgctgctaggggctcagtcctgcctacctgtcccgggggttccggccgtaggtgggattgggtcggtactcttgtctatggctaggatgggttgggaactatgtcacgtcttccgtctgtataccgtggtggtatgtggcacgtggttacacgtgaggaagatgtgtcttgtgggtaaagatgtacacctctgatcagagtataacctattcgaatagccgcgccctcggttatgggcaagccgagcaatgtacccaagttagtgttttaattcttaaaacctgcttaacaactaaaatgtggaatggttggcctgggttggcttgggacgagctgggacccagggtcgggttgccagttcggtctgaatcatcgtaggccttgggttaaggcaggttcgtgtgggttcacggccttgattaataatattttatagctctaggatcgtgtttacaacatagctttgagcaactaagtgtcttttaatgctatttactgcaactcctaacccctatattataattccattgtactcctttgcaattatgctgcacttgtgggtgtgtcttgttgagtacggtggttgtactcagtcttgctcaatttttcccaaacccagaagaggagcccctggaagatgaaggctttggtgtctagctcgtgcctgccgtcaagtgcctgtggtcgtcgccctagtcttccgctgttcttcgttgtctttgagtgtgctgggccgtcgctgcccatgtaataattaactatttacgcttccgcttgttaaactctgaattgtatcaacttttggtgtaccttgcctcctgggacaaggaataatacacgcacgtaaggaacgcccgttgggtgatttccggtcgtgacaaccatcatccaatggatcatcacaataaacaaaatacacaaataggcatcatgcacacgttagcttagaaggcactgtcttcgactcttcatgtctcaaactagtgcaagtctctgcatgcaaaagacaagcaaaatacataggcattagtcaattatttgatagcaaggaaatgaagggagtacaatgcaatagtcaattatttttagtttgaaaagaatacctccatcttatcttggatctcttgaagacagctccaaaaatcttgcaggttcttcattatcagcatctacaaaattagttgtaatgattattatgcaaccatgacaatggaaaaatataaatgatcacactatgtttgaatggtacaacacatacacctttgtacttgtttcgtagccaattttgggaacacattaaggcctccaagatatctgaagtgagtcagctgcggtgctcactaagaaccctcccactagtgctgaatgcagcctctgatgcaactgggctaactggaatggcaaatatgtcccatgctacttttctcaatgtaggatattgtgtcccagccaccttacaccaatcaaaaatcttgaagttttccatattaattgagactaactcatcctccaagtacctatctagctcagatttaactcttattgctggtggcctccttcaagcaacacgtgcactaattgaagacaatacacctgaattagcaagtgaatgagctgaagattctgtgttatcttcatcctcttccatttcatactccttcatgaggtcatacaaattgtttttaacctcttcaagtttgtctgtacactcctcacttgattggctagtaatggactcaatgaacccaaggaggtagtctgttttaaacttaggatcaagtatggtggccaatcccattggtccttggatctccttccaatacttatcaaacttcgcaatcatctcagttgacatttcctctataatattattgccacatgcagcctgtcgacgggggatacccgtagacaggatatagagggtactggggtacgctggtacaaggatctacatagtacgacatcaagcaaataggaaacagagattatactggttcaggccccttggtaggtaatagccctaatccagttgatatgggattatatgatggaaaccacagattacaaagggaacagtggaactcgacgataccgacaagatcgtagtcgagttgatccgactagatctcccagcgacttggctccgataagctccggcttcgtaggctgtggtggagttggctctgagattcgatgctttaggtcctcccgggggtcccttttatatcgcaggtcacctgtctcccagttggactcggagaaaccggaccgaacacgacacaatgacgacccagttctgaccgagtaggactccttccatctgtgaaatccatgatgaatttccttaacgtatgccgaaaacatccgtatatgcgtgaacataccatatcgatatgtgacgtatatcgaagggtagagggtataccttactcgtaaccctgacagtagccccccgacttctgcttaaatgaactggtgaaactgatcgcgacttcacatgtcgaaattgtcgttgttctcggtgtgaggacggagagacaaggagtgatcgacaacatcgagtgaagttcaacggtcatgagtgaatttaaattgaagtccgaaaaactgccacgcgtaacggacccagaaattcgcaccggcggaggtgcgtctatttaagggagttttggggatccaatttgaggtctgcccgttgaaaaaactctccagcttccaagcgtccctcgtcttcttcgctcccgcaaaaaccctagccaactcatctcggtcctttctccggcgatctccggtggccatggatcttgacaagtctacctccaccagtgtgtcactgaagaaactgcaggaggatggcgcccttcccagtcgcgggaccgcggagagggaagtaggaggtactgaaccccagcctgtcctgggtcgcatggttgcggttgaggactttattctctgcggttttcttcctccgccttctgaatttctccttttggtcttaaatttctatggtctttccttgctccatttgaaccccaactccatcgccttcctgagtatttttcacctttgtgaggcctacattggggtagagccgtttcttgacctcttccgcttttactatgagttacgctggatggaatccaaaaaggtgtccgggtgtgttggtttccgacttcgggatggcctgaagtcacgatacatcccctttcagtgcccctcatctcgcagcaaatggcgggggaggtggttctatcttcaggtagaggattcggatcctgccttcgttgttcctgaggagcagccagacaaggttccatcttggaccaccaaacctgccttgaccccgtccctccaatctttcatcgatatcgttgacgacctccgagaacgggggttgtcggggtatgaagttgctgccgatttcattggtaggcggatccagccgcttcaggctcgagcccttcctgcctttgattattatgggccagaggacgcgacccgggtttctcctcgaggtatttcctttttagttaaattgactcccttatgcgcatgttcttcccggcttatcggattctgttctcgatctacaggcttgaatagtgcaaccgtggagcgccgcgtcagccaactgatgatcagcggcccgacaacggcgagcaacgtccccgtccccctttgcgagaaaggggcagccgagcgtgacgctgccatcaatgtaagtgtacttagcggtccttttgcatttttcttccgggatcgcattatgacttcatgaaacataggctcttcctctgactgatatcatcgggccgctcgtggaccatcaggtggcagcgtcgctgaaggagaaggtcgccaaggaggcgtctgacactgctgctgccgctgccacgacgagtggcagcgatgttccgaaaaaggggaggaaattctcctctgtagtcggacattgtcggaagacacccaccccctcggtaagttctcctgttatttgatcacgtagtcggaaaacttccacctcacatcatatcgattgtactccaggcctcggacgcgtctcccccgcctccgcgatggcagcggcttgtgacgctcagcgagaagtaagtgaatgaatttgaggtttcgtgatttcgtcgaactctgtctcaatcgcagcctttcgcagggcggcgcgggcgaaggcagcgcaagatgggtctgggggacctccaacgcgtctcctgccgtggcctcaacggatgtcgttgtcgtgcccaggagccatgaggcgacggatgtctgggggatcttgtggctgattgtggttcgccggctgccgtcctcacctgggaggagctccaggttgagatggggcgcctcctcgaggctggtgctcgcggtgttagccacgaaatcgcggaggcgagggcggcggctgcgtcgtcggcgaacaagcacgccgatcggctagcgcgcgacctggcggaggttcgcgaggacctccagaagatgagggaactggtggccggcaacgagcgacaacggcaggggctcgagcatcgcatgtcggagcttgagaacaacttgtcggaaatccatggctcattgcgggtcacctatactggtctgcaccagctcgccggggagtgcggtatcaagtccaccatcccggcgaatcccgatgagttctcgctgacgtcttctcttgcggagctggtgacggtgatggaggagatcccctccaagcatgcggccaggatcggagaggagacgtctaatgggatctacaccggggtgtgccacgtccttgcatgtgtgaggctggcgcaccctgaactcgatctgtggaagatcttggatcagggggcggttagcgacgcgcgcaaggatgtgatggaggaggtcggcgatctgggggagtccgtcctctcgctttttgaagagtagggtcttagctctcttgtactctttagtcatgctttgtaaaacttttattggtctcaaccgccctagtgtgtgcggtcattgccttagctttatttagcattttgatcttgagtactttgttgtcctttgttaccatttcctttgcccttccgtctggatcgacttgatttgttgtgttctcgggagagaagagcagcttgacttagtcgtttccatgctgagcagatctcgagagtgcgcttgctgaccaggatcgtcgcatccagtattggaggacgaagtttgaggtcgcggaactcgagaggactatgctggaggtgagaaaggaccaggccgtagagacactccggggtcgtgaggtgtggttcaactcgtatctgaagagttgctgcacatccatgtcgagagtctgtagagagctccgaataccccgtggggatcccgaggaatcggctgccggatacatctcatggctgaatggggcctatgcccagctcgaaggcatcggtcaacatatcgacgaggccttgaagcaggagtgtcgtcgctcaagccgatatgccggggggcacgtgttggcctgcatacgagatcatcgttcgcagctgcatctcgagttcctccgcgaagggttttctcgttcccagagaactcctacggagatagatggcctggcaaagtcgatggcgccgctggcggagaaggttttccagtcgatggactagcgttgtccttcctggtagtctccgtatcctgtgacaaatgtctttggaaaaagtgtaatatagttttgaattttgatggaattgtaagaaatacttgtggaatagaaaagaaatctatcttactaagctttcttactctggacgtagtgtgtatgagtgtcttctcacttcgcgacttcgatcagtcgtttgagttatacactctccctagcctccagccttgtcatcggagaattcttctcggaagataaggctcttggacctttgacctgcctcggttgaacaagcactgatcctagcccccagccgtgaagttggaaagtttatttccgattacacggcttggttaatacgcacggcgagaactcttacacaaccagatcttacatggtctttcgtctctacaggatccgacaaggccttatcggctctgggtgtccccgccgaagttcccttaggttcctcggaggccttgtcaagacggcgtaaagagacatgaggataggtttcaacgttaggtgtcatctgggtaagggatcatcgaaaaggaacactttgattgtagtctgtacctaaaaaataggctttattgaggctgtaagatgtcttacaagtatggatactattgacttatacatagaatttacgtaattgatcaatgttccaggaatttgccaactcgcgaccatcgccatctgcgattttgaatgcacctggccgcaaaacttgcgtgatcgtgtacggtccttcccatttgggtgagagcttgttgcgccctgcttggctttgaacccgtcggaggacgtagtcgccgatcgaaagcatgcgtgctcggatgcgcttctcgtggtaacggcgaagggcttgttggtagctggctgctcgaacggcaactcgttcgcgatgttcctcgagtagattcacatcgtcgtatcgctgctcttcctgatcctcatcggaatacttctgtactcgtgtactttgatgtcgtagctcggtggggagcatcgcctctgagccgtacacgaggaagaagggtgtctccttgttggacgttgtcggtgtggtacgcacggcccatagtactgatggaagttcctcgacccaattcttgtcgtgtgacatgagcctgtcgtagacgcgggtcttgattccttgtagtattatgccgttgccctctcgacttgtcaattgctctgagggtgagaaaccgaggcgaagcagatcttgactcccagcctgatgcagtaatcctggaaatcggcactgatgaactgggagccgttgtctgttatgatacggtggggcaatccgaatttgcagaatatccctttgatgaatttgatggcgttgtcggccttgatttcccccgtgggtgtcgcttcaatccacttggtgaatttgtcgatcgccacgaataggaacctgtagccgccctgtcctcgtgggaatggcctgagtatatctagcccccagcacgataacggccaagtgaaagggatagtctggagtgcttgcgctggcagctttgtgtgtttactgtggaattgacaggcttcacactgttgaaccatgtcgcaggcgtctttgagggcgtttggccagaaaaacccttgttggaaagcttttccgactaatgtccgaccggcggcatgtgacccacagatctcttcatgtatgtcgaggaggaggtgtctgccgtcgtcggacaagatgca

SEQ ID NO: 47832 - DNA, 1398 bp, Oryza sativa
aggttcgagtggctctcgcctggacgcacgtcgtgctagatcatctggttcgatgttgtcttgcggtatacatgtcggacctcgatcccatcgaaccttttctccagcttcctgacttctgcgagatacttgaataactcggggctagagcacttgtagtctttatgcacctggttcgcgactagttcggaatcccctttcacgatcagtcacctgactacgagcgcagctgcaactcttatccccgcgagtagtccttcatattcggctgtgttattggttgccctgaagttgaggtgaattgcatgcttgaattgatctcccgaaggtgatgtcaagatgaatcctgcccctgctcccttgctgttgagtgcgccgtcgaatgccatggtccacgtttcattgtcgatttggttgtctgacctgttatcgggcatggtccaatcggctacgaaatcggcgagtacctgggacttgatggctgttcgtggcacgaagtggatatcaaattggcttagctcgactacccatttggcaatgcggctgacaacatctttatttctcatgacttcaccgagagggaaggaggagacaactgtgaccctgtgggcttggaagtactggcatagctttcttgatgtcatgattactgcgtagagcagtttttggatctgtggatatcttgtcattacgtcgtggagagcttcgctgacatagtagactggtagttgcaccttctctctctcaacaacaatgatagtgctaacggaatatggcgtggcggcaatatagagaaataattcttcattaggttgaggggcaacaagtacatgtggatttgataggtagcgcttgaatgcaatgaatgcctcttcggcctcctgtgtccatacaaatttgtcttgttttttcagcagagcgaagaaaggttgtcctcgctctcccatcctagcgacgaacctgcttagtgctgccatgcatccggttagcttctgtacttccttgagtcttgtaggcgacctcatgttctcgattaccatgatcttctcgggatttgcttctattcctctgccggagacgaggaagccgagtagcttgctgtcacgcccggaatttctatccaaaattccaaacgcttacatgtgtgtgaaccctcgtccaggaatcagccgaggcacacaataacaaattgataatagagtacaattaatactctaatttaaacgaataaaatattattacagaggtagatagttcctctcaatcaataaagatctaagcagcggaaaataaaataaacggcgcggacggctccactccacaggcagcttgaccaaggctacacctaatcctccacaccatcagcctcattgtagaactcttcctctgatgaatgat

SEQ ID NO: 47833 - DNA, 13422 bp, Oryza sativa
tctcatatacagcaagatcaattccggcataagggacaataccaagcaaagatggaaccagacctctatagaatgctcgaggaccctcgtgcatcaatatatcccttgacaatgcaccaagactaggtactttaccatccacacatgaataagtctgcagtcgtgttttcactaaatctacgggataaattgctgtttgtgctactgcaccagccaaaccaccagctacaagacgttcagaaggaccaacttcgctcttattttctcctttgctcttcataatatattctttcagcatttcataggcataaaatcttattgcgctttctggagcaactttcacaacattcaatccattccctctaaaaaatgctaacatgccaccctggctccatatatccttaattgaatgcatgactgtagttcgtgtagtctgtacttgcatgatcactttaaggcggtcaagaggtgcagttgcagtacgagatgcagcacctgcaatccctcctgcaatcagatatttacttgcattgaccgacttacttatgccttctggtataacagcctgttcacctatatctacaagacatactctttcccagtgatgataaatattctcaatggttacttcattaggatatagcaaaagaaagtccctccactcttcaaaagtaataattccattgttgtccttgtccacatgctcgacaaaccgtgcaagctcctcatcatcaatctctatacctgcaaacaacaagctgacattgcttgtaagatatattatggatgtgcaaacaataaaatctctaaataacccaactatgaatatatttaagacttcaggcaaagcagaaccaaggaagcaaacaatgtgtatgcttttttaaatttgacagaaggtatatttttggtagaagataccataaattaataaggtatagctaaataatgcaaagtcagattgtgctctcctgcaagctcaacatccataggaaagaaaattatttttggtcatacttgagacaaaaatatgatcacatgaagttaagaacttaagatgatagtgttttcaactctgaatgaagaattgtaatctaatatgaattgctccgtgatatggttgaaattaaaccatcttaactaaatgttcaatgcaaaaaaaacttcctgaacaaagaccgccctaccacatttaatctttcttctcagccttttgagaaatattctattacaaaaatcatccacgtcaagctttggcatgagaaggtatagctgatataccagttttatcattattagttctcaagtcaagctagtatgttactccgtaccagttcaaaacaaatcataaatataccgcctacctaaattcaccttaaggaattccacttagataatgcattggccagctacaattacctctaaatcgaattcatataccccgtgctaaaatttgaaaaaggaacatggtactcaccatggccatctttcactaattatgcaaggccaaaagtttgggcccaattgattggaagctgcttcagccaccttcttgaagtgattttatcatgtgagaatgcttcgacttcacctgaggcactcaaattcggttgcctatactacgaaagtcttagtatgggaacatagtcttggatctatatgctgtatcaataagggattcagtcttctgaaactaatagagttcgccttgaacagggaataaggaaaataactaaaacgtttgcactcttaaactgcctccagtttttggactctgtgacaatctaatatctaacaagaaactgataagtctttgaggctatatatttgctctcataactatatatcacaagattaacgaagcataaaatccaacattaatcagtcaaaaaatgaggaaccaattcaacttattcagtggaagcaggttattgtaatgaatctaataaaatatggaactcaatatgtggaactgcttaacaagagaggatttaggacaaatgcaacgcatcaataggattggattctatgagcttcaacacttatatatggtagatgaacacctaatatgaaaacctgtgagcggtggcaaatacaaggcttatcctgtttgatgtgatggcaaatacaatgtcttatgttgatcagccctagttccagtgaatctaactacagaataattacattcagcaggcaataatatgcaatactgataggaaaatgatttcagagatccaagttcacattgcactagtgaaacgtgatcccgtaggatcatagtcatgccactactaagtggttaggctcaatccttcctcaaatattgtgggaaaatggacaaaatctagtagcatgttaactgaaaattttcagatgctcccaaggttccactactcaatgtcagtagatgacactgttctaaaactcagccctaggctaggtaccagtgtaccacctaggtgactattgggcgctaggtgcccggtggccgcaccaattaggcattatatggtgctttagtcaccgaactatccttgagggctcttgtgctcatattttagtgttctattgtcttaacttttatgtgatatgctcactaattgcttggtttcactagtcgcgttggacctaggtactggacatgccgaccatctagtgcctaccgccttattgaatgttccctacaagtaccattaagctccattggtatcagtacattgttcgccgcataaggacttcttcccgtcttcaaacattacaacacacatctacccatcgagtaaaccaaaaccaaaaaaaaggaacaattccaatgtatggctacaaattcaccacgagcatccagcaacaatcaagtaaagtaataatgcgtttgaaaccacatttcgccgaacacgtcagaatacggacagcggagcgacgtgtgacagcacgggaaggaggcgatcaatggctgcggaaggtgagggtgaaggtgaggcgagcgcatacataccagccttgacgagcgcgtcccagagctcctcggggaggatgcagccgttgtgctcgacgtcgatggcctggaagatgcggtagagctcgagctccttgtcgtccatgtaccgcctgaagtcgtcgtacccgacgcggccgtcgcggtcgcggtcgcaggcgcggagcagctcccgcgcgtacttgcactcggcggggatctgcagcgcggcgagcccggcctcgatctgcgcgtagtccagctgcccgcgcccgtccacgtcgaagaaggcgaacatctcccggatccgcgcctccctctccgcctccgtctcgtgcagcgccagcagcacgtgctccatggtcaccgcccccgccttccgcgccggctcgcaccctcccgccgccgccgctgcagccgtcgccgcctccgccttggcgacggggggcggggaggcgccgccccgtgggtccaccgcgtggaccgccgcgccgggcatggcgccggcggcgaggaaggaatgggggtgagggggaggcggcggcggcggcggcgccggtggtggtggtggtgggttgggttggtttggggaatggaatgggaatggaaagaggaggaaaggttggagaaggggaagggaatatacgtggatgtgagaggctgcatacggtatgtatgtatgtatgtatgtatgtatgtatgtatgtatacgtattggaataccgtattttttggggctcatggaatacgggaaaaatccgtatgtgtgggaggggcgcgcggctggatcggtatgggcagccgggtgccgtgcgatgggggacggatggttagatatccacgtggtcacgtggagatcttttctcgaataataaacaatactatttgaaatgaatgaattcttccgcagttccattccaagaagcctggaggtagttttggaaatataaagaaaaaaagacaataaaaacaataatattgcattgacactacaatatttatatcttatatgtttactattttctatataccattattaatcctaaacaacattagacggagtagaaaagattttttttaaaatataatactagcactatgacataatcacatgaaacattttcgataagactttattggcatggttctttttctgactgtgagaaaaaatgaggggttgataaaaattatgctcatgttacatctcgtgtctcgttagacctgtcatggcaccgccacctacatcacttgccattgtccataggacttagctacattggtgtcaccgacacgtcgtgtcacattgaactcgctacccttcactggattgtcttctcctcagtcgctctctaagcatgccatctcccaaacacccttcggaccttcacatcacaaaccctacacgtaaaataccaacccgatagaaccgttgaatagcatcgatagtctaaggtgaacgttttgtatccatagaaagcactcgtcgagacagttcaattgagaggtagaaaagaattagatatttgttggtatgttggtatgttggtatgattcggtagagaagaagcaacctgataaaagaaacaattttagggcccatttgaatcacaggaatgaaaaaacggagaaataggaaaaacataggattctgacaggaatgtaagtgtaaaacagaggattgcaaaacacagaaaaaacataggaatgaccgtttgattggaccacaggaaaaacgtaggaatttgaggagagataaagactcaaaggatttcttccataaggttctacctcttgttaaaattcctccaaaacttatatgggaagaggcattccataggaatttcatatgattccatagggttcattcctttgattcaaagggttttgtaggaaaaattcctataggaataaaatcctctaaaattcctataaatttcctttgaatcaaagggggccttagaaaagaaaatctcatatatttatatttttttcccttgagtgctaagaccacctcctgcatataggtcgggtggatggtccaacctcgtgcgagttgtgaatgctagtagtccccttcgtgtatcttgctggtgtctgaatacatttgatcgagccagcgaagtgcaagtgattctgatttcgagactgatggacagtgatgtatgatggtgtgatcacgagatttgtttctactccctccgtctcataataagtgacgtttttgactttttatttgtaacgtttgactattcgttttatttgaaaaattaatgcaaatataaaaaaagataagtcatatgtaaagtacttttgataataaagcaattgacaaacaaaataaataataattcaattttttttaaataagacaaatgattaaacattgacaaacaaaaactcaaaaagacaagtaatatgggacgcatgtaatagctgctgctaatactacttaaaatacctaccgtcctgtacaaccacctcgtgcttattttcagccccatcgttttgtacgcatgtgagaatgagctgtgatagataggtgcctaattcaagaatcatatctaaggtaggtccaggtactccggttctaatattaaacaaattcctagtacaagtatttcaaatagcaattacaattattttgagctagtatgattgaccaatatcatacttggctgagtctcatattgtaggaaaagttttccacgcacaagaaacgacaaactcattagcacataatttattaagtattaactatagtataaacttaaaaaatagatttatttaatttttttaaataacttatatatagaactttttttttaaaaaacatactatttaacaatttgaaaaacatgataacagaaaagagcagggcctggaaaattttcactctccctgcaaagattacaaataaaccccaaaaatgaaaattcatgatctacatgatgtaggctgagtttttgtttagataatggtgtaggcttcagtttattacaaagaaatattttcaccggggaatccatggttaatagtgacctgacgatcctattcatctcgaacgatctttgtagcgtcctcccaatttgcaccttaaatatttcccctggaatctcaatcatgccaacgtttggcttattttgtttggaggatgtatggacactgagaaatggggataaatatggaaagggataggcttaatacagaagaaagggaaatgaccaaagactatggcaaaagcaggaaagctgggaagcatcagctggtccaaagcagagcaggtctggctaccattttctccaaaacttccatgttacaactgaaagaccagatcagcaccaaaatttggtgcaacaagcagcatctgagagggtgacactctgacagggaggttcctctgcaacagagctataacatgagaaaagtgcttcttgatcttcagagaatcacacagcagtgagtaataagcattggcatagtcagaggcaacttcaagccttcaagccaagaatatacttgaattccgacaataggtcagggaaattacaatttacaaggataagcacactggcaaaaggtaatagaagtactaaagcttctgacccaatgtgtcacctattgatttacctaactatccaggagtcaagtcaagtctgaacagctaatgagctagtcactctccatttctccagcaaagcatacctataactttcagtgctccccggatggatcttggttcatgcaaaatgctaggaccggctgaaatcttcagactttcagataagctggctaaccaatttcagactacaagcatagcataggggtgatagggtcagagtaatgcgaggtagctttcactgctgaagctgaatgagcaagtcactcttcaacaaagcatacctacaattttcagtactaccaggatgtatcttggttcaggcaaatgctaggaccagctgaaatcttcagaattccagacaagttggccaaccaaattcagactacaagcagtgcatagaaggtgataggctaactgtaatgtgagatagctttcactgctgaaactatcaatctagaaaaagcaccgacctagtgaaagaaaattcaaggtaaacagttcacttagaaatttcaaattctggtcactggccagtgatatagaaatttcaaattctggtcactggccagtgatattaaaaaggtaaacatgcttctgaaacttactgctcctactaccttttcccagaatgtgacgttgttactgtcaagtatagaaatccttgtccatgtattaaaacttggagaaagcagcatggtttgactcaagattacaagtctgctctgtcttgtccaattcaaagattggaaaggagatatacagttcatgcagaaaaaatttctccagacaggcacattgaccatgtgtagctgacaaccaccactcaaagctgtcttgaatcccacaggtaaaacctactctactaaagtacgtaccaagcttttgacacaatgtgccacaacaccaagttgtccaagacttcagtagtatgtatattcaggtcaaatctccaacaaaacatgcctattatttcagtactcccatgaggaaaatcatgattcgtgcaaaagaatagcatcaactgatcaaccaaattttgactagaaataggcgtgacaccctattattgggctggaaattacatatctagaagcaccacccaacagtgcaaggtttccaattatgcagcacaatctgaatcttgctactctatgtggtgagaaagggaggcaggttccccttcgtgccgatcactggagcctgagtgtcagggaagaatttcgctcctgggagctctgtcaccgtgccttccttcgtaacacgtaccgggtaggtcagcaggtgcccaggaaggtcatcgttaagctcatcgctcgcgtagaggtcccagtacttgtcagccatcttgttcaccctctgaacacactccaggctctctgggttcaggaagttgtcatgcagcatgccaaggtgctcataccacaacgacatccggaaaccgtggatttgtcctcttgcaaccaggcccttggtgttcaggtggcatggctggaatgcacccatggcgatctcggagtctctgcccccatccatggacctctggttgatgttggcagatccaacaatgatgtactcgtcgtcaactgaaacaaaccaaggatattaagttccaacaaatttatctttatcaacatgaagcatgtcatcaaagcacaggtactgaaataagagccagtgacaatatattgtctatcttacaacaaggaatgaagtaattgcgtatgttgcctagtgacaaggaaattgaactgtgatgtaaaagtctttcctaacatgtgggtgtcgaaattggggcaagtagttatgagtgtataaacataaaatgggacattggagatccataagaggtgctgcgattctgatttgtgaattcttaaagatgttaaacaatgcaaaaaagatcatgtgtcagctgcaatctggagtaaatttagagaacttgtgacaataatgtttttaagcatacctatcatcatcttggagtgaacatagatcatgaaccggcgtgccttctgtgccttagcatagtctgtgccatccaaagggcgacctgcaggttcatactcaccattcaactttacttccctgttccctaagcagaagaaggtaaggtaatccctcgggtcagcattgatcctcttcgcctcaagtgcaacggcaatatcatagtacatcatctccattgtcctcctctgccaatccagtattgcctgcactgatccactagcaggaggtccttcaggccacattggcagcacaacatagactgcaaaacgctcaccagcttcaatcttgttcacaatcttcagagaaatctctctgggaatcagatgcaacgcctcaatgtcttctggtctgatgccatcggctttccatgcaaatgagctgccaaggaagtactgattctcgatgtagatgaagttcttggcgcggcgaattgcgtggatgtatgcatcttggatgctcctgtcaatggtgttgttcttgccactgacaaggcctgatcttgcagcagcctctggagtgctagggaagccaaagcaggcgccgccatcgatggaccggaacaactgaacactccaggcctcaccgtcatcggggaacatcaccggagacggcggaataatgaggtcggccatggctttgaggtctaggaggaggtccttgtcaccgccttgcttcctccaccgctgctcgaagttgtagagcacatcccaagccgcggggccttcgatcttggagtggatgtcgtgccatggctccctcggcccgcccttggtgacggccgcgccgtcgaggttgggctggtggaagtcgctgtggtgcgccgtgtcgagcgtccggaagagggagtggaactgcgtgtcgtagcggccgtcgcagaggtcgaggccgccgacgaagctgacgatgcggcggctgccaccgccacgcggcactggcatgtcgtggtcgacgatgacggtcttctggtggtgggtgatcatgtaggcgatctgcgcgcccatgatggcgctccggccggcgtcggggttccgcgggcagaggacgcagcgcacgtcggtgccgcggaagtagtccgccgtctcggcgtcgtgcgtcgacatgaacccccacttcatgccgagcgactcgacggaggtgcggtcgtcccagaccagcaacagcacgcgcacgccctcgctggccttgcgcttgaggagctcgccgagggtggcgtcgccgccggggcgctgccgggtgccgtcacggatgagcgtgatctcggtgtacacggaccagccggtgaggtatatgaggtgcttggcgttgctgatggcgtcgaacacgtcctcccagcaccgcccctgccggtagtacccgccgccggcgagcgggatcctgggcgcgaacgcgtcgggcacgtgcgcgtcctggtacagggtgaccctgcacccggggcgctgcgagaagaaggtgtacggcacgccggggtaccgcgcgccggagacgcccctgccccacccatggcggtcgccggcgacgtcgcggaactgcagccgcacgtgtatcgtcggcccgtgcgagatcctcctcctgccggcgtcgaggatgtcgaggcggcgctcgatggcctcgccggacaggagctccctgacggggaggtaggcgcggccgatgagcgtggcgccgatgggctgcgccgccttgacggagaacaccacgtcggcggcgaagtgggcgcagtagatgtggaacacctcgtaccaccgcgggttcaccggctcgtcgtcgacgacccgcgtccgccccacccgcgcccggccgaggtcgatcgtcgcgtacagccgcgtcgcccccttcccgagccccagcgagtcctcgaacccttccacgaactgcacgaacggattcaaaaatcaaaccaacaccaaaattcgcgcctcctcttggattgctccaaccaaaaatctctcaccactaaattggatcgattttgagctcgaagagagagcgggattcgactgaccttgcggaagatcccgggggcggcgccggtggcgcgggtggggttggagaggtggtcggcctcgaggatggtggcctcgagcgtgccgtgcagcagcaggtgagccatggtcgctcctcctcggctccgccgccgcccgccgccgccgccgccgctgccgctgacgtcacctgctcgcggcgcgtccaatacgagcttccctccgagacgaaggggacagtgcaccaacaaggcgaaaagcgtccaattaggagagggaaatggaaaaggagagattctagccttttattttgatttcctttgctccaaagaaaaagacgtggcgtttgggatagttattaatgtcggatcggaaaatcccgtaaaaaaagttggaacagaaaatatttgggaaattggaaagaagttaaagggagaattttgggaagaagttaagggctgcttcatacagaatattaactaatttatgtggagtttctactatgtaaataagttagtacaataacagactataagccagctataaacatatatggagtaaataaatgagaagagataagagcagcggacaatagatttgtagccacctgtagcacagactataagacgcaatgtgtgtatcataggtgggaccagatattacttgtatagtagtatatgtttataggtaactattgtatgaattaactattttatgatttagagtcagtagttggctatactattaaacttgctctaatatagaggatttggggacggatcaagacaagaaactaataaaacatgggaaggctttggtaaaagaaaaatacaatattggcagggattaaactttgttgtctttgaaccattttgaaccattttaacaaaccaattaacttaagtcctatttggcatgccttcgaatttgatattcggggtagatttaaagtttgtatgctaaattatattgtgtaaaagaaaaaaaaattctaaacttcatataaaataggaatgaaatgatttattcaaatgttatcaatgtaattgaaaatctagatccataaatttgtaaagctagtaatatccaacttaaaacaaaaatgagtccaaagccgtgctaaagatgggtgagggttgtgaacactgaacactcaccttccgacatagaaaactgagcaatgaattagtgcacgattaattaaatattagctaaaaattaaaaattgggttaatatgattttttaaaaacaactttcatataaaatttaatgtaaaaacacacagtttagcagtttggaaagcgtgcgcgtgtggaaaacgaaggagagaagtttggaacacccacagacgaactcagcttttattggggagttaagacctttgatctccttcccgtttgcatggttataatttatgggacagtagaaataccccgtagcaagtcactatagtaacatgcaacgacgatgataacttaaacacactagtcatatccatattcatatctagaagtggttttgttaacgacgagtatctactgatggacccacattccatattattccatagattcgccgctatgtctcatgacctaaagttgtattctataaatacgtcgtttcctattgttgaaattgactaatgagtactccctccgaaaaactatatcctaggtcaagattatcatatcttgatctaggttgatttttttgacggagagagtatccaaattcattgttttaagtggtatcaaatccttatcttgattgtttttttttaacggtggaagtactgagtagtgattactcggagatgagaaaaatcggtggaaatgtgcccactaaccacgcatctaatcatctaggagtatcacactatcacacacacacacaccaccgtgacaccaggtcaccaacaaagtgtcaaccacaagacagacaaagaccaccagaaggcacaattggggggtccaggactgcccaccacgagcataaacgaggcgtacgcatccgcatcgcaatcgcaatcgcaaccacatgccgttcagtcgctgtagatcgtggagctggaggtcaagctcggtgtagtacgagattcgccaccacgcacagctcccggtgcacaagaaagcagaacggagcccatgcatggaaaaacgatcagaattcacaagaacacaggtgtgtgtacctgtgacactgtgagcttttgattcgcatgttgattgatctgctgcacatgttaattaaccgtgtggcatgaacgcatgcatgatgagcaaacgcttcacaggaggaaattaacgatgcattttatagtggatgcagcgtggaggaactggccgatcggagcaatagtttcttattcccaaagacggggagacagacgtaaaggaatccaatgacttgcgctttcggtatctagcttgggtctattcttcagagttattaaaagattgtgagaatttagttgactagtgagaacttagaaaggactactttctcagtttcaagttataaaattttctattacccacatttacatatatgttaatgaatatatgtcagtatttattaacatatatatgaaatggaggtaatagtaaattgttatgcatagtacgtccaatcaataggtccagcacatacgtatatatgtatagcagtactcatttagaaaaagaatgggctacatttaaggtcccacatctttcaacgaaaaagagttaaatttttgttacactctaaattacatgtaattacactgtaagtttgaaagcttatattgtatttataacttagtactcactccgttttaaaatgtaagtcattctagcat

SEQ ID NO: 47834 - DNA, 6363 bp, Oryza sativa
aaactttcaagagtgattttgctatgaggtataagaagtaatacatttttataatgcaagatttagtacaacccagcattggtttcttaggtaacactgtaacaggaggtatagggtgtgtttagttcctgaaaaaaattgaaagtttgggaaaagttgggagtttcgaaaaatagttggaagtttatgtgtgtaggaaagtttttgatgtgatatgatgtaatggaaagttagaaattttgggtagttgaggtgaactaaacacggccataaaacaaattgttacctcccaagaatcgtaaaattcataaactgtcaacttgaaataagccgatgaacataattcatattagaacagaacactacatagagctgtagaattcaaccggagatagattacattgcttgaaacaacaaactctgcccaaacccaaagcagagcaacactctagcagtgtgcaggaatggcaactcgatcacacactcagagcaacactctacgacgtgaggtaggggatcatgtacgccgacgacgccaatgtcccgatcaccttcgcctccgtgtccgggaagaactcggcgcccgggagcgccgtcacggcgccgccgtccttctcgacggcgaccgggtaggtgagcaggtgtccggggaggtcgccgtggagctcctcgccggcgtacagctgccagtgcctgtcggccatcgcgttcactctccggacacactccaggctccccgggtgcacgaagtcgtcgtgcagcatccccaggtgctcgtaccacagcgacatccggaagccatggatctggcctctcgcagcctgcccattgacgttcaggtggtgtggctggaacgctcccatggcgatctccgagtcccgcccgccgtccatcgaccgctggttgatgttggccgacccgacgatgatgtactcatcatcaactgataaaagaaaaacattgaattcggtgtgaaatttagagcgagtttaaccgtagtggttgaaatttgcaactagtagttgttgttacctatcatcatcttggagtggacatagatcatgaagcggcgcgcgttctgcgccttggcgtagtctgtgtcttgatccgggcgatgtgcaggcacgtactcgccatggctcttggcctccctgttccccaagcagaagaaggtgaggtaatccctcgggtcggcgtcgctgtgattggccttgagcgcgacggcgatgtcgtagtacatcatctccatcgtcctcctctgccagtcgaggatggcctgcatggcctcgttgccagggtggccctcgggccacatcggcaccacgacgtagacggcgaaccgctcgccggcggcgatcttgctcacgatcttgagggagagctccctcgggatcaggttcaccgcctcgacgtcctccggcctgacgccgccgccgggcctccacccgtaggagctcccgatgaagtactggttctcgatgtagatgaagtccctggcgcggcggatggcgtggatgtacgcgtcctggatgctccgctcgatcacgttgttcttcccgctcacgaggtcgaggcgcgccgccgcctccgggctgctcgggaagccgtcgcacgcgccgccgtcgatggagcggaagagctgcacgttccatgcgtcgtcgtggtggtcgtcgttgttggtgccggggagcttcaccggggacggcggcgtgatgaggtgctcgagggcggtgaggttgacgaggaggtcggcgtggccgctctgcttccgccaccgctgctcgaagttgtagaggacgtcccaggcgatggggccctcgagcttggagtggatgtcgtgccatggctccctcggcccgcccttggcgagctcggcgtcgtcgatgctcggctggtggaagtccttgtggtgcgcggcgtcgagcgtccggaagagggagtgggactgcgtgtcgtagcggccgtcgcagaggtcgaggccgccgacgaagctgacgatgcagcggatgtcggagccgccgccgccggtgccggccggcatgtcgtggtcgacgatgacggtcttctggtggtgggtggccaagagtgagaccttcgtgcccatgatgaagctgctgccggcggcggcgtcggcttgccgcgggcagaggacgcagtgcacgtcggagtcctcgaagtaggcgagcgtgtcctcgtcgtgcgtctgcgcgacgctgagcttgatgccgatggcgtggagcgcctggatggaggagacgtcgttccagaccagcatgagcacgcggacgccctcgctggccttgcgcttgaggagctcgccgatggtggcgtcgccgccggggcgctgccgggacgggtcgcggatgagcgtgatgtcggtgaacaccgaccagccggtgatgtatatgaggtgcttggcgttgctgatggcgtcgaacacgtcctcccagcaccgcccctgctggtagtgcgcgccgccggcgagcgggatcctcggcgcgaacgtgtccggcgcgtgcgcgtcctggtacagggtgaccctgcacccggcgtgctgcttgaagtaggtgcacggcacgccggggtacgccgcgtcgccgacgccgccgccccaccacttcccgccgccgtcggcggccacgtccttgaactgcagccggacgtggatggtcggaccgtgggggagcttcttcttgtcgtcgccgaggatgtcgagcttgcgctcgacggcctcgccggacaggaggtccctgacggggaggtaggcgcggccgatgagcttggcatcgacggacagcgcgaccttgacggagaagacgacgttctcggcgaagtgggcgcagtagaagtggaagcgctcgtcccaccgcgggctcaccggctcgtcgtcgatcacccgcgtccggccgagccgcgccctgccgaggtccaccgtcgcgtacagcctcgtcccgccggggccaagcccggtcgtcttctccaacccgttctccagcccttcccaccactgcaaacaccaacaccaaccaagcacaaagattcagaaacacagcaagaatcagggaaaaaatgtcggcgaggtggatgatcgctatggatggcatcgacgagtgaccttgcggaagccctcgggggcgttgccggtgaggcgggtggggttggtgaggttggtggcctcgaagatggtggcgtcgagcgtgccgtgcatcagcaggtgagccattgctgctgctccttcagtttcagtgtgtggctgtgtgcacttgacaaggctgggaagaagctcgcaaaacaatggtgtggcatgaggcttgacgggctgccaatttataggcaggcgctgctgcacatcgcggagctgaccgcgtacgtgctagattcagaatttcagaggatcaatcacaacagttactaaaacacacacacacacaaaagatcaacggcaacagcacacaagctcgtgaagcacgttcgatcgtactaggaaaatatagtaaattggtggggtcaatgcccaatgagatgttctgtagtttgttcactacagacttgcaggcttcgaagttcaaagtgtatatgtctctgacatctcagttttctcggtgtatagttttcttctgcctcttgacccgtcttccccctccgatttcggtggttcgccaccggcgagggtcggaggacgggtccaaccgtcatcgtcgggtcccttaatagtatagtgtagttaggttggttctttctcgtcgggtcttttatgtaagttgggttcttctcgagttgggaatctgctggtgagattccatggttgttagagtggatggcagcggcggttggtggcggtggagatgtgggaatatactatctgtggaggaatcaggcggtagaggcatcacctctaggcggcggtggcttctcatggcgccggcttgatgtcttctcggctagtagttcaggcctctgtcctagaagttctggtggtggcggtcaaaggcacctactatgcggccccttagcctgatcgtagtccaggatctcctgacccgtggggttggcaattggggcgtcttcggttacatcgcccgaaggttttggcggtggcggttggcggcgcctgctgtggctaccgttctacttggttagaggttgggatctcctgaccggtgaggttggtggcttagaatgacctcgactgttgcagctacttatggtggccagcgacttactaatggagagtacaatggtgacggtggatgggaacttccactggctaggttctagccgtcgggatatgcaggtttcctcatttccaacctcatgtgtcggcctaagtagacaacagttcattcgccatcattcgagttcttcggtgtttatgggtggctggatttggattcttcctctttgtttcctagcagtagtatccatgtagggtttgttgttcaggttgagctcaagctcctcaaatttaatggcgaactccatggagaattcctgctaagctcggcgaagcccataccaaaatctatggctcagcaacaagcctccaattttatgttgtttctgtggaggcaaccaaacggaatcactggttcgtcaagcggtgtgcacgtcaaaggagacccaagatgcaatcatcgcagcaatgtcgcatctcactgtcaatttgcacctctgctactgcttagattcaataggaagtttgttacattaggctgtgttcttttctcctctttcccaactcacttccctcgtttttcatgcgcacgctttttaaactgttcaacggtgtattttttttgcaaaatttatatatataaaagttactttaaacaatcatataaatccattttcaagttttttaggctaatatttaattaatctcactataatcacgtgttttgttttccgtgctgggaggcaagcttgagaacctaccctcccgaacacagccttagtgcagtttcttgtcatttggaaatagatggttcgatgctttttagctaatcggtttggtgatgtgctagagcttgttcccctgaactttatcgttattaatgaatgtttatgttttaaaaaggaaactgaggaattttagagaatttaatgataataaactaatttctatgaaaatcctgtaaaatttatacgttctaaataagcatagattgcacatagtcgagaccaaaggtgaggtaatgcataccacaaaccaaaactagtttgcttgaaccttgtatctcaatgggaatgggcgagataggtgtgctttgtgctatgactagaggcattatctaccgaaattgacacacgctagactgatttgccggtggaatcagccgaactaaaagaaaacaaacattacaaagcacatatgaccacgatttgttgatagggaattcgacgataggaatactttcatgggagtcaaatcagacaactccatcctctaagaattcatttctattctcaatcattcaaaaatgcataaggattagcaacatattctatgctgagtggtttatagatctcgactcgacctcaagtccttatcgactcaaacatgagccactaccgcaatgacttacatcatccacaagaccacaaagtgtaacctataaatattccatatctcttcattcatcatccatagggaatcatgcgtgctaatatctactatctccgtcttaaaatatactcgctctatttcatattgcaataagttgctttgattttttaaaactatttaaatttgatcaagttcataaacaaatttaataacatctaaaacactaaattagtttcgttaaatctaatattgaataaattttaataatatatttgttttgtgctgaaaatactactatgttttttataaacctatagttaaacttaaaagagtttgacttaatataaaacgaaaaaaataataacctgatactgaaccaactttataacttttttagtcatattgccataagatttctccggatatacttttatatactcttgcataaattgttatggaactttggatgcgcccctaaaacaactgaaagttgcattgcacgggaatgatcacatcacatggacgcggaaactgccgggcagcatagaaatattataacacgttgatctagaattctagatccaagcttgccgctcgtgtaaagcgtggggggtggcctggatcgagtaacagcaacgacctgcatgcagattggaatattggatttggatatgataaaaatgcagatagcagcatttgacgaggtgcccacttggacactcgcaacgctttctctattggcggagaggaatattgtaataagcgctgcattggcattttgtttgtttattggattg

SEQ ID NO: 47835 - DNA, 14345 bp, Oryza sativa
  unsure (1)..(14345): unsure at all n locations
atacaatagcagactataagctagctctaaacacatattgagaagatgaaagaatatagagatgagcgacgggctacacatttgtagccatctgcagcatgaactctaagatgtaatgtctgtatgataggtatgaccagataatatataatagtatatatatttataggtaactattgtatgaattggctattaaattgactatatatgacttagagttagtagttggctacttggctatactattaaacatgctttaaatacctaacggtgactattaaaactttcacatgctaactactgaatttggagtatatattactagatgtcagtcttatttttttccccctttccttttcctagcaataagtcaaatttcatttcctgttatttcaaatagtgcacagctcaaatagacacatcaaacatgtgtagtataggaatggcactttgtacaatgtaatcatggaaaatgatcacgcaacaccacacatatacgcacacccgggattgtattttcgtgttttcttaacacaagctcaaactgacggagacagagagcagagataaaatccattaatttcgcttagaaaatccctaataaaaatatacatacatatatataatctaaacataattaatggtcattcctaatgtaataaaacatatatagctgaccagtaaaataacatatccatatgtctcaaaagataataaaatagacactgatagttgttttgtttcccgtatggcagaatggcacacgttttatgattttaagttaaaaaatggttatgaactacaattatttgtacatgttaattgaccttttatttcaaagtagacgccatgcacctacccacccacgagcaccaccacctctgcctcagcaggaccgtggcgggtagggttgtaagcgggccaacccacaaatttatttataggtcaaatagatgataacgaatggatttttgtgtcgtgattcgatttgcgtatttagagagatgcaagtggatcaatctataaactcatttatatgtcaaattaataggtaacccgcgagtcaaatccgtggattacctactaattttatctataagcgggttcgcagccaagcccgcttactcgctagcggcaggcaaacggcagcaccgttttgatatcgcttgccgccatggagccgcggcaagcagaacactcttgttttggctgcaaattaaacactgcatttaaactgacgttctttgctaacaacatatacttctcaattcttttttgattgctcctctggtctgatctgactatatatgtatttcactttagtgaaaattatctttgaagagtttgtaattgagcaacatgcatgcccaagaacccaagtgctccactgctcatactaccacaacgacatctgaaagcagttggcatgccctcttgcaactgtattcaggtggtacggctgttgttcatccactgtttgttgatgctggcagatggccagatccaacgatgatgtgctcgtcgtcggctgaaataagccgagcagtgaattcgatgaaattcagagggaatttgatagattgaagcattgaaatttgttgtgctggaatattgagcaaacctacgtctgggtcctctgggagtgaacaacatacaccatgagctggcacatcttttgttttttgtttttttgtctgacgaggagttagcaatttcttaccaaagttttgcatgtttaaatttccggttaccttattcagaaatccataaccaccgtttaattagctttgaaagggagtgtcctatgggaaacaaaaatatggctaccaccttaagggtgtgttcggatgcctcttttcccaaccatttctctcgttttacgcgcgcacgctttttaaacggctaaacggtgcgttttttataaaaagtttctatatgaaaattgcttaaaaaatcaaactaatccattttttttaaaaaaaattagctaatacttaattaatcacgtgttaatcgatcgttccattttccgtgctcagtatgctggaggggaatgagaaccagctaacacaccctaacggtggtcaaatacgaaaccctcattttttaataaatggttacagttgactttttaacaaatatttaaccattcgccttattcaatttattttgcaaataaaaaaaatttaaatcatacttagagaacatttgatgatgaatcaagtcacaataaaataaataacatttgatgatgaatcattatatttaccaattgcaaattatctgccaagtttctttttttttttgattgggggggggggggcacaagctcaagttgtgtcacacgaggctctgtccttgacttaattctaatgtataggatctttaatatttttaggttcgtcattgtgtgatagtgtagtgtgtgatacacacacgatagatgtgtctatttgagctgtactatttcaaagacgaggaaatcaaatttgacttgaagctatatcaaaaacaaaaacctaaaaaggaaaagacggacagctcatagtttagtcgcatgtgacagtatttttacccctagtcaccgttagattagaaacctaactctctcaagtcttatccattattaaattagttcaaccacagttggacctcatcttttcgcttatacttatacttattagctaaaatttaaattttcaatcttaaatttaaagttgattttgggtttttcatcgaagtttattttccagtctttacttctagatcgctaagagcaagtttaatagtatagccaactactagctccaaatcatctagggtgtagctatatttatggcgccatatttttcatcaaaaaatagtcggcatgtatttacattggaagttcctaaattacatatgtaattttagtgtatttacaatgtaaatctcaagagtacatatgtaagtcttaaaattacatatgtaaattcaaaaattacatactaattacatatgtaagtggggtataaatgagttgtaactactctctaagtggcttaaaaaaatgactgtagcatatgtcgccacaattatagccaatccgatcatctatagccagtttatatagtatttttctctgtactattaatacatgatcccacatgtcatacacacattacgtcttggagtccgtgctgcagctagctatagatttgtagcctgctactcttctctcttatcttttatctctttaaaatatatttatagctggctaatagtgtgctattgtacctgctaacacgtatataaaagttttattcaaaaattacttttcgtttgcaaatatatcgtttgacttattacacgaataaatgaaacgatgggctaagttcaaaagtgtcgcaattaacaagcatatactccctgtgtactactccctccgtttaaaaaagggcaacctaggaggggttacatgctcctagtatctgtccagattcgttgttactaggaggggatagttgtctttttatgggatggtcacatcgttattttttttatggggagtacgttccaacttccaacttccaaggttagtgtactgtgttttgttttttttttcacgtgccaattggcaattttcctttcgtacgtgtgggctctcgtctccgccaataagaaagcgttgcaaatgtcccaagttggcaattttccttgcgtacgtgtgggctctcgtcttcgtcaatgctgctcaagtgctcatcatttgttggattaggcggtgcttggatctagggacttaactttagtctctatgtttagacactaatttagagtattaaatatagactacttacaaaactaattacatcaatgaaaactaattcgcgagacaaattttttaagcctaattcatcttgcgaattagtccaagattatagatgggttttattaataatctacgtttaatatttataattaatgtcaaacatcagatgtgatagggataaaattgtagtcgtatctaaacagcgtcgtactctactccactctaccccaaggtcccccacgctttacacgggcgccaggctttggatctcgatccacgggctgctgatcaaaagcacgtggtgccggtttctgcgtccgtgtggtcaccgatcagctccatgctggttcctgtataattttggcccctggctaacaagccaatttggagatggtgagagtgatactccctccgtttctgattgatcacctaactaaaaataaaatcagaatttatagattgattgttactccgtacataaccttgtcttcttcgtgtgccgtgcaaaattgtgtatataacctctccggcaaaaagaaaaagaattgtgttggcttattagcgcatgattaattaagtacccgtccgttccaaaatataaatatttttggacttcgacacattcttcgagatactactttgaccaacaatatctataagataaatatgttttaaataaaaaattgcatattatgatagtttgtttaatgataaaaaattgcaggaattcaaccatgcggatacagtcactactacttacgcgccttcgacatgtacttaagaaataaaaacactgaaattaaagtcatccggccccaccctcaccctctctagctgatgattagtcgattactgttttcctatagccatcgttatacacgagtttctgtggtgttagcgttgatcttttgctaatctctgaatctagcacgcggtcggctgcctataaatttggttgctcgtcaagcctctcatgccaccattaattgcgagctgcttcttcttcccgttcttgtcaagactgaaactcactggatcatcgaggagtggcaatggcggagcagcagctgatgcatggcaccctcgacgccaccatcttcgaggccaccaacctcaccaaccccacccgcctcaccggcagcgcccccgagggcatccgcaaggtcagcgaccgattccatggagctagatcgatcgaacctcgccaatgtttttctacttcttggttgccttctcatggtgtttgtgtttatgcgtgcagtggtgggaaggggtggagaagacgaccggggttgggcagggcgggacgcggctgtacgcgacggtggatctcggcaaggcgcggctcggccggacgcgggtcatcgacgacgagccggtgaacccgcggtgggacgagcgcttccacctctactgcgcccacttcgccgacaacgtcgtcttctccgtcaaggtctcgctgcccatcgacgccgcgctcatcggccgcgcctacctccccgtcggggacctcctgtccggcgaggtcgtcgagcgcaagctcgacatcctcgacgagcacaagaataagctcccccacgggccgaccatccacgtccgtctgcagttcaaggacgtcgccgtcgacggcgacgggaagtggtggggcgccggcgtcggcaacgccgggtacgccggcgtgccgtgcacctacttcaagcagcacaccgggtgcggggtcaccctgtaccaggacgcgcacgtgccggacacgttcgcgccgacgatcccgctcgccggcggcgcgcactaccagcaggggcggtgctgggaggacgtgttcgacgccatcagcaacgccaagcacctcatatacatcaccggctggtcggtgttcaccgacatcacgctcatccgcgacccgtcccggcagcgccccggcggcgacgccaccatcggcgagctcctcaagcgcaaggccagcgagggcgtccgcgtgctcatgctggtctggaacgacgtcacgtcgctgcagatcctccagtcgctcggcatcaagtggggcttcagccagacgcacgacgccgagacgttccagtacttcgaggacaccgacgtccactgcgtcgtctgcgcgcgccaccccgacgccggcggcagcatcgtcatgggcgtcaaggtgcccttcgcttccacccaccaccagaagaccgtcatcgtcgaccacgacatgccggccggcgccggctccggcctccgcagcatcgtcagcttcgtcggcggcctcgacctctgcgacggccgctacgacacgcagtcccactccctcttccggacgctcgacgccgcgcaccacaaggacttccaccagccgagcatcgacgacgccgagctcgccaagggcgggccgagggagccatggcacgacatccactccaggctcgagggccccgtcgcctgggacgtcctctacaacttcgagcagcggtggcggaagcagagcggccacggcgacctcctcgtcaacctcaccgccctcgagcacctcattgcgccgcagtccgcgatgaagctccccgtcatcggcaacgacgaccacgaggcgtggaacgtgcaggtcttccgctccatcgacggcggcgcgtgcgacggcttcccgagcagcccggatgcggcggcgcggctcgacctcgtgagcgggaagaacaacgtgatcgagcggagcatccaggacgcgtacatccacgccatccgccgcgccagggacttcatctacatcgagaaccagtacttcatcgggagctcctacgggtggaggcccgacgacggcgtcaggccggaggacgtcgaggcggtgaacctgatcccgaggagctctccctcaagatcatgagcaagatcgccgccggcgnagcggttcaccgtctacgtcgtggtgccgatgtggccggagggccaccctgacagccaggccatcaggccatcctcgattggcagaggaggacgatggagatgatgtacgccgacatcgccggcgcgctcaaggcgaagaggatggacgccgacccgagggattacctcaccttcttctgcttgggaaacagagaggtgaagaggagtggtgagtatgtgcccggacatcacccaagagatggcacgccatatgccaaggcacaaaagacgcgccggttcatgatctatgtccactccaagatgatgataggtatgctcaaatctagccccgcaaatttcaacccttcaatctagtagtaaatcctttccaaattcacatcaaattctagctgatataggataaactaactgggtggtccacgcaattgcgcggctagcacccatataaaattatatatttttaatatgattttacttaaaatttattaaataattatctcattgtcttaaaattttgaaaaagaccaaacattatcatcccttgctacccttacttctgtcatatcattttttttattaccttgctcgatctaccactgtttctattcattcttcttggaacctttaaaaattagatataaaaacttatagttttagagtttattgttctgttggccttcttttttataatttctaaaagtcacatatactcctctacaaccatccactgcatcttctctttattgtcattgctattttaaaattcgaacataattattgtttaggttcgtttttttactttctaaaagttccactaaaagtcagggactttgtcactatactcctctacgactcgcccgctgccgtccttcttttttgtcattgagattttaaaatcaagcatgattaccattgggatttatttttttactttttaaaagcccgaaccttttaaaaattgaatcttataggttttagagttttattgtctcgttgggtttcatgttttttataatttttagaaatcccgtcaaacactgccactatactcctctacaacccgtccgctgcataatctttattgtcattgggattgtaaaaatcgaacataactaccgttggaattcattttttactttctagaagacccaccaaccatcgtcagctctaccattgtactcctatacgacccgctgcctctcatttttattgtaattgagattttaaaaatcaaatatgattattattggggtttattattttactttctagaagtccctcgccaaccgctttgactgattgcttcacaacctgcccgtcgtccttctttttaatcgtcattaggattctatttggtgttttattaatattttttagatgtctcatcaaccgccaccactctacttctctgtaggcttgttacttaattaatcttgtcatggtcttttctttcaatagtctaatttttattaccaattttagctatttataaattgtattcctaattaaattctttttttctttttctaatttcagaatttattttatttattattatgttcttttgatatttttattttttattttcaattttagttgtttcaaatttgtattcatactttaactctctctttaatttgcctaatttcggattttattttattctttattccgaattttaattaatctaccatttagttcttatatgtactcttatttcaatattgcttatatttaattccgaatttaagttaattttaaattgtattcctacttgaacttttattttcttttcttttttctaattttatttttttattctgaattgtaattaatctcgtattggattcttgtatggactcttctttcaatattccttatttttaattcggaattttagttatttataaattgtattcctagtcgaactcttcttttttctttttctaattttgaaatttatttttttattattccgaattttaattaatcacgtattgggttactatatggactcctctttccatattgcatatttttaattccgaattttagctatttttaaattgtatttctaattggactcttcttttctttttcttttgattaatgtgagaatttctaacctccacagcgaacgtggtgtcttctttcaaggctgttttaataatataatagatagatagatagatagatgttctaatgtgcttatcatgtcatttggtacctgtacttttcaaaaagtttttaaaaattgttcgtttgtttcagtcgatgacgagtacatcatcgtgggatcggccaacatcaaccagaggtcgatggacggcggccgagactcggagatcgccatgggagcattccagccacaccacctgaacatcggtggccagcttgcaagaggtcaaatccatggcttccggatgtcactatggtatgagcacctaggaggcgaaccgcacgacgacttcctgcacccggggagcctggagtgtgtccggagagtgaacgagatggctaacaagcactgggagctctacgccagcgaggagctccatgaagacctcccggggcatctgctaacctacccgatcgccgtggctaaggacggcacggtggcggcgctcccgggggcgaagttcttcccggacaccgaggcgccggtgctggggaagaaggcgatcaatccgttgatgacccccgatatcacctcgtagatcaggtgaaagtttgtgctggtggtgcatgcggagcaaaagtttgctagtcctacactggagtgatgctgcttccatcagaatgtgtttgtttttcaacggtgtaagttgtcctagaatgtcaccctctatgtaatgttgaatcttaattccattgtctaaaataaccaaatttgtaatgttactggaacaaattttgtaatgatgagtatgcacctgcaaatcgatcacccagaggaggccaaccaaataaaacatgccctggagactattggagctgaagttgcaaggctggccataaaaatgtttagggattaggactcatttggataatgggtaggaatgggattgggatagggaaatgagtgaagggctaggatgagataggaagaatggagggctaggattaaaagtaacctttgaaaggtacgaacaaaattcccaatccttctgaaacgggccctcataagtacattcttctgctagctttggtggaaaggaacaagtccattttgactccctcaaatattgcttcaatctaatttatatcactgaaccgcaataccggatatcttcacccaaaaaaaactattaaaaccggtgtagtttgactccctcagcggttttagaaggcggtttcgctaacgtggtgctttgacttggtccaacctattgagtcatcgtgtggggcccacctgtcaatgacccttatatctcttatcttcctttcctttcccctccatcggatctacgccacgccgccgcccctcttcccccttccactccactccgccccttagggagtcactgacatgtggttctcacatactgacgcatctggttggaccaagtcaacgtgccacgttagcgaaaaccactctcaaaaccgctaagagagtcaaattgcaccggttttaatagttgataggtcaagatatccggtattgcggttgagggatacaaatcaattgaacctatattgagggagtcaaagtgatcttattccttgttggaaatgcaaggaaaaagaagatagcaacccaggtcaattttagcccaacaggtgcggggtaatttgggccaacaaatgggttattttgatagaacaggcctccagctatacgcaacgaggaacatatcagtttcttttctgaaggaagggggaaaatagctctagctgaagtatatcctcgaataaaatttagaaatatacattatatacatgttttgaaagattcatgaaaatatacgcgtaccgcagttcagaaatacgcgaccggttgttttcctcggcatggagccgcgagaccgacggctgaaacatgcggcatactggccggtgccgcacagccgatctgcgtgaccgtgcggtgccgcgttgctggcgggatcgacgcagtaccgcgcgctcgtgtgtcgcgggattgttccggccatcggtctctataccgcgaaaaaaaatcggtcacgcattttcaaaccgcggtacaagtatagtttcacaaatctttcaaaatcttgtatataatcataaaaacgtaaaaaaataatgtacattttcaaattttattcgtgtatcctccagtaaaaaaaataccaatcgtttcggaaatattttattgggtgtagataaagatagtgtgtgtcgaattagcataataatttttttgtgtttaacacaaaaaatagcgatcaagtcaatagattagggtattcatatgtgaactactacatcatacagttaaccgtaacatgaatgtctacagggcccagctgttcttatctttgatagttcaacagctagcgttactaggcaggcagcccatgcgaagtattgaatcagggcaggacgttgctgttccatctcttcccatcattgaggtcgtatgtgatttcctttttattttaatgtttcataacgcattcatttgcttgcactataaaagcaagaggccatcaaacaagaaactgttcatcgcagcctttgccattgcctaaagcaaacgtgctgtagaataaatgagaactgttcactcgagcagtcgagcttaacttgtggcagaagcccagaaagataccagagacaattgctacaccagtttgcatttagtggtcactgtttcctggctgaagacagaatttttggaacgcatgaattttaatttgatttcgactcataaactacttcaagaaagaaattgtatttcagacgagcctactattggcgtgagcaataaaatgcatatatttttccagcttttttttaagaacatatttttccagctttaaattcgagatgacagacacaggatttcaagggtaagtagtcacgcaacaattgcagataaaattcaccggaagaatacgagataatatcaggagtggatttgttgagggaaaaaatgggttgagaatgaagtattaggccaagtttagaatatgctaggtataatatagctacgtatactattttttttttaagaaattgttgcgtattcacgtgaacaccaagaactccctaggtccatccctgagaaacttgtatagattaaggtcccgttcgaataaactaaaaaaagtggacaaacttttgataaaagtggcacgtttttcaaactgctaaacggtgtgttttgtgcaaaaactttctatatgaaagttgttcaaaaatatcaaattaatccatttttcaagtttgtaataattaaaacacaattaatcacacgctattaacacctcgtcttgcgtaaaacacttaatcttttatcttcatctccaggagattcaaacaccacttaatttgattcatagatatattttttttgccatagttgagtaaacatgagcttttacgcacaagaggtactcgacagtcagcggaacaacagtagatactagtactagattagataaaaaaagagtaaagtgcacacgcggtccctagacttgtgtggtgtgtcaactagctaggtctctgaactctcaaaatgaattttttggatctctcaacttgtctcaagtgtcatataggtctaaatgggttccaacccgctccatgtgctgatgtggcaggccatggtggcgcctacgtgttagtaaaaccgatatgtctgccacatatagaaaaaaaataacatatttttttctcctctcttttttcatttattttttcaaaattaaaaacatcattttctcctctctttttaaattttattttttctacatgattgacatgtggatcccactaacacataagcatcaccgtggcatgccatgtcatctcacggagcgggttgaaacccgtttggatttctatatgacacacatgacaagtttggggacccaaaatgtattttaaaagtttagggacctagataatacatatatatacaagtttaaggactgcccgtgcacttcactctgaaaaaaaaactaagaatctagctccagcttctagcacctatcatccaggaaagaactcgacttgcctgttcaaacagcctactccagctcaaaagtatcagcttaagccaaataaacgacaccaatcaagggttagccaaacatcaaccacatcaggttgaatatttaggttgattttctaaccagaaaagctggagctggagccatgtgaaacactccataacaatagcaggaccagggcgtgcaccgttcatcatgcaaggaatatacaatttttcttaaggagggcttagaggacccagcacagcaatggaggagagaagtccacattgtctccatcttaaatcttggcatgtttctgggggaggaggagatggaacttgacaaaattatcaccactcattcactcacaaaaagtcactataaggatctcaggctgtgtttagatccaaagtttggatccaaacttcagtccttttccatcacatcagcctgtcatacacacacaacttttcagtcacatcatctccaatttcaaccaaaatccaaactttggatccaactaaacacagcctcaagctttcaacacggtagctctatgtaatagtgtgcacgcatgcctgccgtttgtagccgcacatgggcgctatctatgtgcagacgtgcagttaacctgggaccaaaaggaccggacggaacaactcagccggagtagcccggcagcgagagtggacgttgccacacggcagaaaggctttacacggtaccaagattccaagacccctcaatgcatcaaatcatttctatcgatccacacgtctacatagatcaaaacaatgaaaaatacaaagtacatcgagtagtaagaatgagagaagatatatctgattgcggggtgtgcatgttgaggctggtttgttcagagagaacctcagatcctgggagaaagtcaggtcaggatgcagctaaagctaacactaaacaaggcaacaactactggtctactgctgctacaacagtggtgctaccacctggatgcactataatatatgcatcgtcatctgcatgtaatgtaactacccgtcgacagcctcataattatgcccggccaactctcctggcccttctcccctaacgttttcccaagtttccatgccaacgcttccggtgtccccccaagcaatattggtgatcatggccaggcacgtactgacgtacgtattcacacatatagattgttaattaccacgacttgacaaagcaaattaaggctagctacagcacagcacagaactatgacccattcttaaatggatcaaactatggacaacagtggctagctacgctaaagcacaagcaagcaaaacgtgtgcgcctgattggccaatcgatcctcacaatttacccattgaaaggaacgacgttattagaaattacagaaaaatgaagatccagccgtgttcatcgattgtccacgaaacctcgaacatttgcagcccaaa

SEQ ID NO: 47836 - DNA, 8160 bp, Oryza sativa
tataaatgttaataaatatatatatgtatctagattcattaacatatatatcgaatgtgggcaatgctagaaagtcttataacttaaaatggaggaaatacatatacagcgacagctctagtaaggccggtgcaagaacagaaattacatattttctacaactaggtattcatgcacgtatatttatgtagtcatataaagttctgtgaagatttccaacaagacaaagtacagagccaactcaagatcaaatgatcaatcgatcgagccctagctagcttagttttcgtgtgaccaaggtggcatgctggcattgtaccagcagtacagcgtacgttctggtagaagcgagtggcgtttggtgctgacccaacccaaagcacgagaaagccccccatcgtagttaattcgcactgcttaaaaagttcagtaaatttaaccaccactaccaggactaactttattgcgctgctgtcctagctaaacctgcccctcatccctgggatacttcaggtttcagtgaaataacccaagttagagctacccatgcattcataggatttgagtacttagtagttagtagctagtgtggcagtggagatccaattaatctaccacaattcgagcacatgtaatgtactacccgcaaggcagagctagctagctactcttctcctctcaccgaaccggatgcatttgccccgttgagtgcttggcaagggagtgatcactaaccactggccagacagtgccttctagttgcacgggaacaggattagcaaggggattaactcctagatgcaggttttgggcaagtccccaacaactcaaagcagtatgtgtaattgtgtatgcatgatataatgcagcttgttgaagcaaaggatgcggtgtagaacactgtacctcttgtggactttgtttctgacagaggtgtggcaggtctgatcatcgtcatccgtttcctgtaaccaaagccgcccaactcggacttgcccccaccgtttacctgcaaaaatgtgaaacctgcagaaaatgagatttaatcatcatcatcatcaataactgtagtgtcagtataaatgctgagagtatacagatcagaatttatatataggggattattgcacggtgtatatagtttgttatgttgtgtacgggcggtgtaccttgcagtctgccaggctgacaaagagcaagcagccctgaaagaataaatgacaaagaattcataagaagatggggtgcctcttcctttgaaacattaatcaatacatttaaacctaagtcatcaacaaataataataactagcatgatggcccgcgcagattgcgcggctagcatcattatattttctctcatataatagcatatatgttttctcattatattattcaaatatattaaaatgacaacataattttaaattttgcaataactttacaaaactactaatgtgtaatattcatattgcattttatatacgtgttagttattaattatttttaagataaaattttagttatttgtaaattatatatattcatatatggactctagactcgtcttttaatatttcttttttctgtaaattgtatttctatatagactatatgttcttcttctaatattatttatttttatttctgaaattttattatttctaattgtatttctatgtggactctaaactcatctttcaatattatttaatttttaatttcgaattttagttacttctaaattgtattcctatattagcattaaactcttcttcccattttttcttaatttcgaattttaactatttgtaaattgtatttttatacggactctaaactctacttttaattttattatgtttattccaaattttagttagttttaagtttctatatggactctatactctacttctaatattccttatttttaattccgaatttcagttatttcctaattgtatttctacatggactctatactctacttctaatattccttatttttaattccgaatttcagttatttcctaattgtatttctatatggactccggtctcctcttctaatattccttattttttaattccgaatttcagctatttcctaattgtatttctatatggactccggtctcctcttctaatattccttattttttaattccgaatttaagctatttctaaattgtatttctatatggactctgctttttctttttctccgattaatgtgagaatttctaggccatgagagcgaacgtggaggctcctttttctattcctttaattatataatagataataataatttagatctccatcctattcttgaagtgtggcagtagatgatgaggttgttgattataactagtaattatcatacctgtcacataattgtgaaggtttgagctagagggacccttaagattttcttccttgaatcgctagtcctagcatttgtactgacaatgtatatatgatcagtgtggtgtactagcgtttatagtgctcacctgtcaacggtttttactggacgacaggtcctgacagtccttggcaaccaccacaaacctgcctgcacttttccatgtaaaaaaaggagtgcgtgcatgtgtacgacgagcagcagcagaagaagcttccatccctgcaggaactcactgacacacgtatctgtgtggagccgatggaactgtaaaagcacccggacggaagccccattcaattcgatcggccggacaaacaatggcaacgaactcactccgccattaactccgtttcacctttttacggagagaagagcaagttcttctgctgctgcaatgctgtgtgcgccttccttgccgatgcgccatggatggatggatgattggctgcttgattggggcagttattgcaggccaactgctctgtcgaaagagtgtccctcggaaagtggctttagaagttggagtaaaccttgcagtgcatggcatacatacagcatggagtggtattaccttggttacgaacgcccatcaagtccatttctggagtagtacacactgtccaagcttcagtgtttgtacctggaaagaaatgcacattagccatatgcgcaaggcaaggcaaggcattgagcaaagttagattcatcagttactagtttagctagttagcacatacacactactggacaatgactagcgagtgagcttagctagctgatcggcgacaagtgacaaccagctagttagcaataagagctggtgatggttagctcatctcagttcatccttaggttttcctccagtgaaggccataaatgaggtcgccaagggcgtaggtgggggagtttattaccggcgtactggcagagaaggtggttatgccgctcgccacagttcaccgacagcccaccccagcagcccatgagggccccccatcctctttccatctatctctctcttccactaatctcaccaaagagtcttcttcacttccttctctaggcttattaacagcttatttctgatctctcacatgttcagttttatctcatccctcctgctagatattactgttgctggccccaaccaccctgcatggattacaacacaagtttatcagtaccactgtggttcaaagtagtgtatgtactggactcgtggagttatgaccacaaggaaattgaccagaaagttaattacaatgactgaaggtgtgtactcacttggtcctggcagagtagaaggagagtacaccaactagatctgaaccctggtgtgctactgtaccaaaaggctaaggccactgacagaggagatacgtgacagacaagtcccagttgagttactgtccaacccccaaatctaaccctcttctaccaccacccccactcgtgcgccacagcgctctcacacgcgcgccacactcatgccatgtatgtctatatatatgtgcatctatatatcttagccacattgaacgcacgctacactgcaagaaaggcaagtataggggtggcaggtagtttatattcactggaaaccgagaacttcactcctcccagcactccacactaggaggatgctcactgtctgactgactgactggctgctgctgctgctcattccttctcctactctgcctgcctcctctgctgtgtccttgggagaattcttcagggacagtatccctgcagaggtgagatcatgggacagtcgaagaagaagttccgcggagtcaggcagcgccactggggctcctgggtctccgagatcaggcaccctctcctgtaagtctctatctcactagtgatgatcactagctagctatgttgctctgatgtgttatgccactgtcgtgatagatacattttgatggatagctagtggttctggtttgttgttgctttctttctttttttctttctctttcatggtatgttagtagctaactcaaggtgcttgggtgcgtgcatgcatgaatgatggatgatgttttttttgctacgtgcgttgtggcagtaagaggagggtgtggctgggtacctttgagacggcggaggaggcggcgcgggcgtacgacgaggccgccatcctgatgagcggccgcaacgccaagaccaacttcccagtcgcgaggaacgccacgggggagctcacaccggcggctgcggtggcagggcgggatggccgtgtcggcggcggcagcggcagctcgtcctcaatgacggccaacggcggcgggaacagcctgtctcagatcctcagcgccaagctccgcaagtgctgcaagacgccgtcgccgtcgctcacctgcctccgccttgacccggagaagtcccacattggcgtctggcagaagcgcgccggcgcacgcgctgactccagctgggtcatgaccgtcgagctcaacaaggacacggccgtgtcgtcggctgcgacggtggcagcagcaacagcagtgtcgtccagcgaccagccgactccgagtgacagcacagtcacaacgacgtccacgtccaccacgggctcgccgtcgccaccacctccggcaatggacgacgaggagaggatcgcgctgcagatgatcgaggagctgctgggcaggagcggcccgggctcgccgtcacatgggctgctgcacggtggtgaaggtagcctcgtcatctgaattccggaagaacaggaaagaaattgaaaatgcaaggttaaaacagcatgatcaggtcaccatctaagatcaaggatctggtagggtggttggtgcacaggcagttaagattgctacatatgataggtatatctctattactactacatatccagcttaattaggaaacaattataagatcgattactactgtgtgaagtgaagctgtgtatttattaaagacttacttgtatgtacaagacgtccccgtcattatagtcatactggtgaaagctctgctatgtatcaacgtcatcagagatcagactacatatatataagtggtgtcaacttctaataaaagtaaataaaaacattgtaattgtgtacttttgtggctttgctttttctttcagactacttgctggattttcatcaaaagaagatgaggaatatgatgaaggtgatatttgtgaataagacatgtttcctaaatggttttaaaagaaaaaaagacatgctttataggataatactcctacaatcatatctatgaactgttcatcttatccaaagatagtagtactccaagattggaaaattatggatgattgtcatattaaagacaaacaagcaggagaaatatttttcttcctgcatcactccaattctccaaccacatgagtccactcaaagggttaattgatcaaatgattaatgcaatggaaagaatttggtaagatagacatggtgcaaaacatagtttactggaaaaaagccgtaatttccgttactacaattcagtaaaataaatccatactccaatgttctggttctgttctgtcttctcactttcatcaagggaaccacctagtttattaataggaaatacaccaattcctgcaggaaaaaggtgttccaaaggaggccttagcatagtaaaaactataatgttttagagcagtcgttgccaccagaaaaagattcacttgtgtccacttaggggggatttgctgatagttaaaagcaataattatgcaataaacagatggccataactcacaaggcatcaactaaattgcgacagtgcaccagactacatgcattatgtcagtgtgtttattcacacacaaatatatagcagcacaccacacagtacaagcagtggtgtttctaactgtgatgccaaccctccgaaagtaaaaatggtgacaccaatccagcacaaacaacttaaagaacttcaagataacatcatacgtggcatatcaaatgaaaaagaatgaaagcactgaaatggatggcaaagatcatggtccccatattatttccccttcctaatttcacaacatacaaataggagcaatgaagcgcgaatcagctccacagttggttctataggttggtaatgcatgaagtcaatgcgaaagggcccagtcagttagttggtcagtcataaagtacgatcatgtcaaaaaaagaagaaaagaaaattaacaatatgagaggatacactattctaaggtcttggatgttgatgaaagcaacaaaggcactacatttagtagtacacgaaatgacaaaatggcatatgattaagaccttagtgaaattcaacgatggccagaaccaaaagctatgcttacatagtgagccaacatttaagttttgatgcttaaaataaacaaattggttttcctttatcatcatgtcctttcagcagaaaagtgctcaccaatttgtgtctcaatccatcaaaacctaataaatgggtttcttgcataaaaaccatcaaactcaaatatgacaaataattctcctaatatgtgctgcagaacaaattgttaggtgtatgatgttcgcctcataatttagagatttgatactcatgctactgctcctaaattttggaaaagtaacagctcacaactagtttcgccttgataccttgtggtgcccagtagctggttaaggacctcccatgttgcaaaagcatgcattgaatatgtccagtaggatagctgtatcggtccccacaacattaactctgccctttgcttcaatctcattcgaatcaatctggtgatgtcatcttaattaagattgtaaagcatatagcaccaagttacgctgcgctcttgacactgtcatccgccagatctacctaaaatagatcaacacatggtccatgtacatgccaattaatccattaatgtcattgtcaagtggctgtggacgacagaagtgtagcaaattagcaatgagccaaaaagaaaaggaaaactggcttgtttcaacttctgactaatgagaaagacactcaagtacacaaacatgcgctgaaaacaacatatcataacttgtatcagtaataaataagcatttcaatgagcaacattccaattccagggggctttccgttctttaaaatctagtaaagaagttaccatctggtgagcttttgtaattattcttcaaagcatgggtagattagttggttaagatatctatttagtgaagaaactacaattctactaaaaaatatgtaaaagagatacagcatgaaagaattacccactagtctatcaaaatctgggaagatgtcaatgaaatatggattcacaatgtacagaacaggtggcctgcttggcttccatgtgtaaatatactctctagactctagactttatccagtcaatcttgtagcaaaagatttaggaatcaagtctgacacaacaatttctgtaaacaactaccccttttttggcctctgtaaacaactagcagtagaccagccagtgaccctaaatgcaaagcgttggcaagtataactgctactgcatgacaaacccttgcccctctgagggcatagtaccatggcctggtggtcctagttagttgttacattttgatgtacttacgtccattcaaaatgattacatgcttggcatgtcattatcttggttcatttagcaaccaaatctgtaaaaagtctaatttttaacaatcagttacata

SEQ ID NO: 47837 - DNA, 1364 bp, Oryza sativa
cttttgtttataaccagactgagccacaaactaagccttagccactagacatgtggaagtacggtagtgctttgcaacagaggcccgaagactggtccttttatggccgaggtgctactatcaaaaccatgcaccccgagcccagcctaaaaccattttgagggttttgaatagagggggaggtgtgaatccaattcccaataatccatccattccatagtgtccaggtgatgagaatattcccaaagtctagagttgtaaaaccacctaatgttgcctaattaaccagcgaagcatctacctaaattcatactagtggtaccatgagtagagtgtccactagttggggttttgtttattctagggtgaacaaggtaataataacaataacaataataataaggtcataacaaaggtaaataggcatggctaaataaaacagtgataacgcgggaatttaaataaagcgataatgcaataatttaaatcaaaataattttataaactgggattcaatatgttcaaggatgatgtgacttgccttgctcgctttcccaaacgtcggcttcaacctccacgaagagcggatcttccgaagctgcagcgtctatacgaccaacagaaatgaaaagggtttttactctaataaactccatataacaagtaggaacaaagcacaaaaatgggttcttgacttcttaaggaaaaattagagacttgaacggtccaattccgagttcaaatggccaagttatggccatttaaagtttatatgctctttaaatgaatatttgcgaatttcttcatttaaaatttaatttaaaaaggggtttattgcgtcagccgaggggaaggggcacgcggaccgggtccacaggagtggggcccatgcggcagcctcacggtccacggtggaccaggtgcacccgggctcacaccggccggcgtcgtgggtaacacgcatcagccgcacccgagggcgcgggcggctgatgaccgggccccacgcggcagccactcggcccgcccgaaggcggccactcggcgcggccggcgggaggcggtgcccgcgcccctattgtcaccgacggcggccataggcacggcggagcggcggccgagagaggggaagggaagggggaaaagaggcggcggtccacggctcaccctaggtcgacggcgacgacgaaaaaggcggccggagcggaggaaggcggcggcgcggctcgggtcgacggggtcgacgacgttccggcggtcggcgaactcggcaagggggtggacggggtcgacggcggtgcggcgaagccggaggaggcgacgccggggcgggagacggtcccggcgagcggagaaggccggcc

SEQ ID NO: 47838 - DNA, 9306 bp, Oryza sativa
aaacattggtatattaatgactttcatatctgcatattaatttcaattgaaagccatcttgttgcccatccttcctgacaagatgtagtgtacaaggcactctttagttgaggctcgctcactttgtattacagaagtataacctagacgtaactaattcagtataaaagcaaaaagtgcatcagcaacgatgagggtggaaactagaaagaaggatttatgatgttccttagtttattcagtcacgaaagaatgactttaaaaaaatgtacacttctttcaaagtgaaaatgatgagatgtcttacttatgtaatgctcctacacgctgaggttgttcttgctgacaccctcgtttctatgagaagtttattctaacatagtaagttgatatttacagcaaacaaaatggataataatcctgatgtttcaacaaaactagaggaactcactgttaacgaccaaatttggtaaagccatgggctgggttcaaagctagagtcgaagccggatttggaggaattctttttaagaaagccagagtgtgtatcggctacgggcggcatcagctgccgtacgtatcggctacaagcggaatcggctgtcgtatgtatcggctaacgccaaatccaatgaagacaagccgatgtagccagtcttgaaaagacaggtccacaactatcatcgggatcaatcgaagtgcttcatagccattgccacacaagaatcggtccagcaaagggcaattgtatctattaattaggtttagtttccttaagagatattttggtaagagtccgcctaagggacttgttcgtattttacattgtaataaagatagagtcatgtccaacaaggagatgttatgtactttgggtataaatatgacccgagaccttataatcaggggacgacagctcaataatacttcggcgcatcgccaccctttttctctttcattgtttcgacgagtttttgctttcgagttgggctgcatcaggttcgatctccgacgaagaggtaaagcttgttatagcggattgcgttctcaggattagtgcttacatctttatgacactctaatcctatctatgtgaatcaccgagttatcatatatgctgcataatctagattgatctcgtcatctaatctcatcggctagcctctatcatcgaaaacggccgacagatttagatatcaacattaagctagattatgcggtatatctaccatatcaaatgagtcttcatcgttcttgcttagatcttatgtttcttttcacacttaatgctgcattggttaggttcgatctactaagtactgtcttgaaacattttatctagctctttctatgaatgctaatagagttagtatcggagtttcagccgatcttacctgatttagccatcgtgtttccactacttgggtcttgatcgtctaaatttgccctttatattaaaatatcatctatttgaagtgtattaagctctctatcaatctactagttcaccttatgtcacgaccggaactaacccaacgggcgttccttacgtgcgtgtattattccttgtcccaggaggcaaggtacaccaaaagttgatacatttcagagtttatcaagaggaagcgtaaataattaatttattacatgggcggcgaaggcccagcacacacaaagacaaacgggaaacagcggaagactagggcgactaccacaggtgcttgacggcaggcacgagctagacaccaaaaccttcatcttctaggaactcctcttctgggtttgggaaaaattgagcaagactgagtacaaccaccgtactcagcaagacatacccacaagtgcagaataaatgcaagggagtacaagggagccataatatagggggttagggattgcagtaaacagcattaaaagtcacttagttgctccaacctactttgtaaacacagtcctagagctatacaatattattaatcaaggccgtgaacccacacgaacctgccttaacccaaggcctacgatgattcagaccgaactggcaacccgaccctgggtcccagctcgtcccaagccaacccaggccaaccattccacattttagttgttaagcaggttttaagaattaaaacaataacttgggtacattgctaggcttgcccataaccgagggcgcggctattcgaataggttatactctgatcagaggtgtacatctttacccacaagacacatctttctcacgtgtaaccacgtgccacataccaccacggtatacggacggaagacgtgacatagtttccaacccaacctagccatagacgagagtaccgacccaacccctcctacggccggaacctccgggacaggtaggcaggactgagcccctagcagcaggacactggccctgtgccatgacatcttgactaccgggccgcagctcgtgtagccttcatttgccctagagatgtccatcgacccccgacttcgtccatctccatccgtgtacttttgtttataaccagactgagccacaaactaagccttacccactagatatgtggaagtacggtagtgctttgcaacagaggcccgaagaccggtccttatatggccgaggtgctactatcaaaaccatgcaccccgagtccagcctaaaaccattttgagggttttgaatagagggggaggtgtgaatccaattccgaataatccatccattccatagtgtccaggtgatgagaatattcccgaaatctagagttgtaaaaccacctaatgttacctaattaaccagcgaagcatctacctaaattcatactagtggtaccatgagtagagtgtcaactagctggggttttctttaatctagggtgaacaaggtaataatatcaataacaatagtaataaggtcataacaaaggtaaataggcatggctaaataaaacagtgataacgcgggaatttaaataaagcgataatgcaataatttaaatcaaaataattttataaactgggatttaatatgttcaaggatcatgtgacttgccttactcactttcccaaacatcggcttcaacctccacgaagagcggatcttccgaagctgcagcgtctacacgaccaacggaaaagaaaaggcttttactctaataaactccatataacaagcaggaacaaagcacaaaaatggattcttgacttcttaaggaaaaattagagacttgaacggtccaattccgagttcaaatggccaagttatggccatttgaagtttatatgctctttaaatgaatatttgcgaatttcttcatttaaattttaatttaaaaagggtttattgcgtcagccgagggaagggggcgcggaccgggtccatgggagtggggcccacgaggcagcctcacggtccacggtggatcgggtgcacccgggctcacaccggccggcgccgtgggtcccacgcgtcacccgcacccgtgggcgcgggcggctgacgaccgggccccacgcggcagccactcggcccgcccgaaggcggccacttggcgcggccggcgggaggcggcgcccgcgcccctatggacgccggcggcggccataatcacggtggagcggcggccgagagaggggaagggaagggggaaaagaggcagcggtccacggctcaccctaggtcgacggcgacgacgaaaaaggcggccggagcggaggaaggcggcggcgcggctcgggtcgacggggtcgacggcgttccggcggtcggcgaactcggcgagggggtggacggggtcgacggcggcgacggaggaaggagagagcgacggcgcgagctcgattccggcgaggaggaagggcggcgagtggcggaaacggacagaggaggtgcggggagggtttaaatagggttggaagggggagagagcggccggaggggaagcaaaccggcgcgggaggtcggccgccatcaatggcgctgccgagatttgcgggggcaaatccgcccgtttgaacacaagagagagagggaaaaatggggggaaagggagaggggatcacggggagtgatttcccccactttattgcacgcggggacggcgggatgcggcggatttggcggcggcggcggcgcttggcgcaggcggagcggcgggaggatggggatgacgggtgggccccacccgtcagcgagggtggcgggcgggcccgcccgtcagcggcgcgcgcgcggggagaggctgagtgggccgcggggagaggagagagagagagggggggaggagagatgggccggcccggcccaagggagggaagggggacttttaaggtttttctttttataaaactttttcaactttgtttatttcttagtaattattatttgtgctctgaaaattccactaaaatttatttacaccttttaggcttttaggaaaaatacaaaaatcccctaagccttatttgacttttaactttgcacattttaattgttggaggctttcacacggattttaattattctaggcataatttaaaggatatattttagagtcgttttgggacatgacaccttgcttgttagattggtctacgtttcgtatatttcatctgtgctaatattgtagtataaagtggtatcggagtaatagtcgatacacgttaggtttgctcaatcggctatgctgtgagcatacataatccctactttgaagcacatttagatattaagtgatttatactgtctcggcatatcgcccgatctatcccaatcacttgatccaaatgtgctttcattggatagattgcgtactgctgacgtctacagccgattgggtagatctaataatttctatgccttatattcccttgctgatctgatgcaagtaacatcggcttggctccgaacaatacgttatcggcaatccagccgatcggctatcgttgatggatttaactttgttcctttttctttcttgctggttgcaggatcaaaccaactagcgcgctcggaacccgaaagcaattttggacctgcgctagagttaagcagatctctcaggccagtacgtgtgttttccgcatcaacacactttttggcatgcccggtgggaccgactttcgtaaaattttcttcatggcaagcctcaagtagagagaagttgatccagaaaatgtcatcccaataacaatggacaagctgaccctggagcagaaggcagaatttgaaaagatgagagatgacttgcaaaacgattcctgcattcattcgcacagactcgttccgacaccatggtccagaaatataaggtagttctgtcgaacaacgatgacgcggaaacaagttctggcaaagacgacaaagccaagggcaacaatcaggaggaagatctcgaggcgctcagatgtatgcaagaccaggttgattatgccgttcatcatgctttggtcaaccaatcaggagtacttgtcaacatgttgaccaacatgatcaaatatgtggttgacggcacgatagctgagcatcaagccaaaggtccagtttttctgcctggagggtttttccaaactacaaaactgtcagcatggacaggcatcaacccatctcgagtgccgccccagaacagccgatggcttcagttgtgccccctgggggcaaggtccatcaacatcggcacaagggcagccaggattcaatccttacgttctgatcaggccacaaccgcaacatgcagggcataacatccctcggatctctccagaacaagtcgcatctatgttcagaccaagacagccgatagttgagacgattccgcaaataaccatgggacaactttcgcctatcccacaacaacagccaactatcggcacctagtttaaccctgatcaacacatcgtacaccaaactcctcaacctcacctaaggggcaaccttaattttcagtaccagccccactcacctcagatacagtatcggctaggaggagcgcctcagccccagtacctgcctcaatacaaccaactggatcaggtgccgcagtagatccagggagcacctcagcagaagccttgggcagatatgatagccaatgtgatgagggaacaattcgggcacaagcctaaggatagtgagaacttgtatcggcatccatacccagaatattttgagagagtaccattatcgaacaggtataaggtcccagatttctcgaagttctcaggacaggacaatgtgacaacatatgaacatgtcagctgattcttagtccagtgcagggagtcatcagctaccgatgctttaagggtcagattgtttcctctgtctctgtcaagattggccttcacgtggttttcatcattgccatataattttgtacaaagttgggccgatctggagaaacagttccataagtacttttatagcagttccataagtacttttatagcgggattcattagatgaagttgtccgatttaacgtcaatcaaacagaagcatgacaaatcggttcaagattatatccagagattcagagatatgaggaacaggtgctttagtttggctttaacagattcccagcttgccgatctcgctttccaaggcctactggtgccaatcaaggagaagttctcagcccaggaattcgagagtctagctcacctagctcagaaggtgacggcacacgagcaaaggtttcttgaggctagaaaggcatataaaaaggtgaacaatgttagcacatatgtctctgaaaccgaagaggatgaggaccctgaggtagcaatagctgaatgggcaaggaacaaatgagtggtcacgtgccaatgggtcaaggactctggaaaggaggaaaaaattgatttcgacatcaccaaagacgataggatcttcgatttattgcttcgggagaaacaaatccaccttcctgctggtcatgtaattccatctgctacagagctagggaagagaaaatactgcaagtggcataacacaaggtctcacaacaccaatgagtgcacagtcttcaggcagcagatccaatccgccattgagcagggaagaatcaagttcgacgacccaaagaaatccatggagatcgacggcaatccttttcctgtcacaatggtccacacaagcgaggggatagccaatagaagaagctatcggcccaatgccgctatgatcatcagcaaatatcaagggaagcttgagaggcagaaagaggagtgttacaaagacaacaacaatttcgatcctcattgggactacaaattctttagattctactaaaacgaagggatgaggttaccctcgaaggaaggttgcccgtgatgcagtgatgccgacgaaaaccacgtcggtagttcaagccaatttcgtcccggaaaggaaaatcggtcggtgcagaagaagctgcctgttgatcagagattgggacttgctagccgattggtttctattggattatattgctatactatattatcatcagctgattgccttcatatcattatatacattggacatatagccgattgctcaaaaccctatcgccatcggctggtatcggcatcggctggaattactccatgggcttgtcaactgatcggctcattgatctgctatttgcatatcttgtcagttgcaggatcaaactgactggcacgcccacatctcaccaaactttggacctgcactggagctaagcagatctcccaggccagtgtgtgtttttcgcgtcaacaggttgttaacgattatagagtgttttattgagtagttcagctactagcttggtggtatcagtgattagtagcttttttttgagagttttattaagtttgtttctaaaccatgtagatgaaataacagaattggaacttgtttggtcaagtatatcagttattaattctatgacaccagaaaattacattgtttcatcgcatttaaaggctacaggtatttttcttttttacggagtgatcaaaccggatcaagggataaactactgcaaattatatcttctcgccctagtggacttctttatggagtgaactatatcaaatgttttgcttttgatgctgatctaattagtctgctgatcgttacggagatgttggtcatttccaactcttaatcttgctaatttttttccttcttttgctccttgataggctcgcttggcaaggaatctcccccacaaaattcagaaaagaggagggactgcataatcaggtactgcatactccccctcacagcttcagtaatgcttgcatgaaaaagttattaaaacaggctctctcaaaacaaaattcatttctttgccagttactaagcttaccgtctttaacaactgagaattgctttattaaagaaaaatcaaagtaaatatgagtgatcttgagtgttgtaaatttgatggtataacagcatagaagcacatggattttatgctgctatgttgctgtaacacaagtttgccaaacatttatgcagcatctccatgttctatctagtagtggtttattttgtgtacaacagtgagatattactcccaatgaaatttctacagatttttataaacatattgaaatatgatccattctctaaaaatatgaatgatttgcactatatcatgtaataatctagctcataatgtattacttactttgttgtattttaatcatgaatgatttgcactacgatatttccacatttggttgattaagtatctgccaatcaattgccattcatcctttttattttctgggagcaattttaccatcattttttgcattgcacctttgactgatatttctaagcattgctatttccttttgagtacctcgacaaacagagttgagcccattgtatatcctataactgattaatgcttgtaggtatggatctatttgagcttcaacaaagccctatcagaattttgacatttcctgtgcatgtcaaaggttctgaatagatacacttcaccatttccttttattgcaggataacatttttagctattgttttcggttaattttcaacatatatagattcatctaggttgacattgacgatcagcgattgtgccaactttattcagttaaaacctgatctagccatttgcagttgtgcaactgccgttgataattttttttccttcttggtatagtcacatcattagtttgttgtatatgcatgtaggcacttattatttatcatgtgcagattttatccattggcataagttatactaatatctgttgttttatcctttgtgttcacaaaattctgtattgttgaagatca

SEQ ID NO: 47839 - DNA, 2564 bp, Oryza sativa
ccgaccccatgtggaaagggagagggtatcacgggaaatatttccccccgctttattgcacgcggggacgacgggaggcggcgggattcgcggcggcggcggcgctagggcgcgggcgaggcggcgggagcggcgggaggtcggggaagacgggtgggccccacccgtcagcgagggtggcgggcgggcccgcccgtcagcggcgcgcgcgcgggaagaggccgagtgggccgcggggagaggagagagagagagggggggaggagagattggccgggccggcccaagggagggaagggggacttttacggtttttctttttataaaactttttcaactttgtttatttattagtaattattatttgtgctctaaaaattccactaaaatttatttacaccttttaggcttttaggaaatatacaaaaatcccctaagccttatttgacttttaactttgcacattttaattgttggaggctttcacacggattttaattattctaggcataatttaaaggatatattttagagttattttgggacgtgacagctgtggttcatgctcttaaaatctggcggcattatctcattggaaatcgctgcgaaatatattccgatcataagagtttgaaatacatcttcactcagtcggatctgaatcttcggcagagaagatggttagagctcatcaaggattatgatgtgggaatccactatcaccctagtaaggccaacgtggtcacagacgcgctgagtcgaaaaagccgttgcaacactcttggcatccgtggcattccaccggagcttaatcaacagttggaagccctgaacctaagcatcgttagccatggattcttggctacgctagaagccaagcctaccttgctcgatcaaatccgtgaggctcagaagaatgatccagatatgcatgggatcctcaagaatatgaaacagggtaaagccgctggtttcacagaagatgaacaaggaaccctctggaacggaaatcgtgtatgcgttccggacgacaaggaacttaaacagttgatacttcaggaagctcacgaaagtccttattccatccaccctagcagcacgaagatgtacttggacttgaaagagaaatactggtgggttagtatgaagcgggaaattgcagagctcgtggctttgtgatgtgtgccagcgtgtcaaagcagagcaccaacgatcggccggacttcttcaacctctccaagtaccagaatggaaatgggatgaaattgggatggatttcatcaccggacttccaaaaacccaaggcggatatgattctatatgggtagtcgtggaccgactaaccaaggtagctcggtttattcctgtgaagaccacctatggagggaacaaactagctgaactctacttcgctaggatcgtcagtctccatgacgttcctaagaaaattgtatctgataggggaagccaattcacctctcacttctggaagaagatccaagaagagttgggtacccgattaaatttcagcaccgcgtatcacccgcaaaccgatggacagaccaagcgtctaaatcagatcctagaagatatgctccgtgcctgtgttctagattttgggaagacctgggataagagtctcccctatgccgagttctcctacaataacagctaccaagccagcatacaaatggcaccttatgaagcgttgtatggccgcaaatgccgaacaccactattgtgggaccaagtcggggaaagccaagtgttcgggactgatatcctgagagaagctgaagctaaagtcagatccattcgggataatctaaaggtggcacagtcccagcagaagagttatgcagataaccgacgccgtaacctggaattcgcagtggacgattttgtgtaccttcgggtcacgccattgcggggtgtacacaggttccagacgaaagggaagctcgcacctaggtttgtgggtcctttccgcatcattgctcgacgcggagaagtagcttaccagttggagctgcccacctcattgggcaacgtgcatgatgtgttccatgtgtcgcaactcaagaaatgtcttcgaatgccatccgagcaggccgattcagagcaaattgaagttcgcgaagacttgacctatgtagagaagccggtgaagattctggacaccatggagctgggaattggaccgttcaagtctctaatttttccttaagaagtcaagaacccatttttgtgctttgttcctgcttgttatatggagtttattagagtaaaagctttttcttttccgttggtcgtgtagaagctgcagcttcggaagatccactctacgtggaggctgaagccgacgtttcgaaaagcgagcaaggcaagtcacatcatccttgaacatattgaatcccagtttataaaattattttgatttaaattattgcattatcgctttatttatattcccgcgttatcactgttttatttagccatgcctattcacctttgttatgaccttattattattgttattgttattattaacttgttcaccctag

SEQ ID NO: 47840 - DNA, 1802 bp, Oryza sativa
ctgcaccccccgctctgggcgtccccagccgaagttcccttaggttcctcagagactttgtcaagacggcgtaaagggacattaggttaggtttcaacgctaggtgtctttcgtggtaagggatctctgggtaaaacacttggcgatattgtgcacctgatatcaacattgttgaagtagaggtaatgggagaatcgctacacctctggtcaagaaccaggtagtagtcgtaactcaaccactagaagtgaatgtacgagagatcggtacgattgactggttgagaaccagtgagtaggtgtctctcgatcatttgaagttgtggtgcatggactgctgcgttattgctgtagccgtacctcgaccatctgaggttgcggtgcgagagattgctacgcactggttcgaggaccagcggacaagtagaattatctcttggacaccaatagaggttgcggtttgagagattgctacgcactagttcgaggaccagcgaacgtgtagaattatctctcaaacaccaatgaaggttgaggtgtgggagattgctacgtactggttcgagaaccagcgagcgagtagaatcatctctcgaacaccaatggaagtggcgggagattgctacgtactggttcgagaaccagcgagcaagtagaatcatctctcgaacaccaatggaagtttgcggtgcgggagattgctacgtactggttcgaggaccagtgagcgagtagaatcatctctcgaacaccaatggaagttgcggtgcgggagattgctacgtactggttcgagaaccagcgagcgagtagaatcatctctcgaacaccaatggaggttgcggtgcgggagattgctacgtactggttcgagaaccagcgagcgagtagaatcatctctcgaacaccaatggaagcactagagttggtttattacatgtgtatctcatgtggccagcatgactcacacacccaacttgtagcatatccggatgtccgttcgcaatcatgtcgggtgatcaagccgacaacgttcacgaggaattatccgttaacaacatttttctcaaatagtccagccacggccggcgctatgagataggtcgtcggtctttgttggtaggttgggcgcgacgactctgcatttgtcgagattgttctcaataatgcggtgtacttgatcacaacctacttgagtgctcaattattcctgaaaaatattttctagaagacaagatatatagcagataatatcaagtgtgtactcaaaaaactacatggattttctagcattatcaggatataacgagcatatataaatatcaggcattatgtaaaccgtaaacaagcatgatttatatggaagaaaatagagtgaaccctgtcacgtcccaaaacgactctaaaatatatccttaaaattatgcctagaataattaaaatctgtgtgcaagccttcaacaattaaaatgtgcaaagttaaaagtcaaataaggcttggaggatttttgtatatttcctaaaagcctaaaatgcataaataaattttagtggaattttcagagcacaaataataattgttaagaaataaacaaagttaaaatgattttataaaaagaaaaactctagaaagtcccctatccctccctctccctcttgggccggctcggcccatctctctccccctctctcctctcccccgcggcccatccggcctctccccgcgcgcgccgctgacgggcgggaccgcccgccaccctcgctgacgggtggggcccacccgtcatccccttcctcccgccg

SEQ ID NO: 47841 - DNA, 1272 bp, Oryza sativa
actcagtcttgctgaatttttcccaaacccagaagaggagcccctggaagatgaaggctttggtgtctagctcatgcctgccgtcaagcgcctgtggtcgtcgccctagtcttccgctgtttcccgtttgtctttgtgtgtgctgggccttcgccgccctgtaataaattaactatttacgcttccgcttgttgaactctgaactgtatcaacttttggtgtaccttgcctcctaggacaaggaataatgcacgcacgtaaggaacgcccgttagattatttccggtcgtgacaagcccccagcgttagatcgtagtcgatttaacatcggggacactcgcgcaatatatattgtataaaaacatgctctaggtaaacataataaattatagatccgacaatgctgtatgatcttgaaaagtaggtacagtaaattgtatataaaatattgcgtacctttgtagatatatgccggatatatctacagaattagtagatcaatttaaaaaatcaatctactaaatacctgatcatgggtggctggacacgtactgactccatacatatgcatgtgtactgtgtacgtgtaaggagcaggcatatttgttgaattcgcgtcatcaggacgagtagtcagatttgtcaactagaaatttgattctagcgcaaactacagaactcctcgaatccgattaggatattagccactgaacagatcaatgtggtgcttgtatttcagctcctcgacgtgcttgttttgttgatggagatcgatgccgagtctggcttggacccggccagctgatgccgcccaccggttggcgtcctgcacgtcgatgggttagtgtcggatcagttttggattccgccaacactatggtcctctgccgctgcgacatcttgaagcttgattggtctcgccggatcgaatagttgatggcgatgattccaatctcgttgggagacgtactttggccaggttggatctccctgatccgaagtcgtcgagtagcttattgttggagaatccatctcttaaacccatctcgtctaaatcctgaagcaccaaaaaatccccctacctggcgcgccactgtcgacgtttgatgtcgcgattccggtatttgcatagtatggggatcgtcggtactaggacatacgcgagactgaggtaaaagagacagaggcgacgatttttatacaggttcgggcccctgaattgtcaggtaataaccctatatcctgttggccgaagccggtattgctcttatt

SEQ ID NO: 47842 - DNA, 2079 bp, Oryza sativa
ttcaattgaaagcgatttttgttgtccatccttcctgacaagatgtagtgtacaagtcattctttagttcagcctcgctcacttggtatcacagaagcataacctagacgtaactaattcagtatagaagcaaaaagtgcaacagcaacaacgagggtggaaactagaaagaaggatttattatgttccttagtttattcagtcacgaaagagtgactttaaaaaaatgtacacttcttccaaagtgaaaattatgagatgtcttacttatggaatgctcctacatgctgaggttgttcttgctgacaccctcgtttctatgagaagattaatctaacatagcaagtagatagtttactgcaaacaaaatggataataaacctgatgtttcaaaaaaactagaggaactcatgcatgatgtacccaaaggaaaccggttcttgacacactacaaatctgtggtagttcttttccatctcgaaaacgaatcaaggctgtgtttggaatcagctgttcccaacatgcaaagtgcgcacggaaaacagggcggtccattagagcgtgattagttaagcattagctttttttcaaaaaatggattaatatgatttttaagcaacttttgtatagaaactttttacaaaaaaacacaccgtttagcagtttgaaaagcgtgcgcgcggaatacgatggagatgggttgggaaccctggattccgaacacagcccaagtctatccaaaaagtttagacaagaaaacacgtaacaagttggtttgcaagaatacgaattacgtcaatcctgcactataggtagagcaaaatggtgatttctcgtaaatctctcgaatggtgatttaagaatttagtgcaaacctaactcttgctataaaatcaaatgttcggtaccgcatcaacggaacaataaaaagcacttggcataccataattttgtcattcttgttgaaattttgtaacataaaatgcatgaggccacacgaccttaatgttcaacgtgtcatgcattagtgaaataatagctcacaaaacataacaaatatagctagataacggttgcaatccttaccaaactaacgtataaagcgagcgatgagtcatatcattatctttctagcctgctaaccatcacgtacactttccgatcccaaaaaatgacaacttctatggatgaacctggacaatgtttagggtttagggatgaatctggacaaatgattgtctaggttcatccctagaagtgggtttctccttatgggacggagggagtatatttgatggacacaaaagttactttcgtgatgaaatcaaaggggatttgttgaggcacctaatagaacatatgtccaaatgacatgactcacttggatcctaataggacatgaaagcaaaactagcactccaaagcaaccaatgaggaattgaaagaaaataagtgccatcgcatctataaatagacaatgaaaaccctccccatcgttcacacagttcaagcattatacagtaaaaaagaaagatctagtgtcctgtcgcaatgaagatcattttcatctttgctcttcttgctattgctgcatgcagcgcctctgcgcagtttgatgttttaggtcaaagttataggcaatattagctgcagtcgcctctcctgctacagcaacaggtgcttagcccatataatgagttcgtaaggcagcagtatggcatagcggcaagccccttattgcaatcagctgcgtttcaactgagaaacaaccaagtctggcaacagctcagggtggtggcgcagcagtctcactatcaaggtattaacattgttcaggccatagcgcagcagctacaactccagcagtttgatgatctctactttgatcggaatctggctcaagctcaagctcaagctctgttggctttgaacttgccatctagatatggtatctaccctaggtactatagtgcacctagtagcattaccacccttggcggtgtattgtactgagttttaacaatatagtggttcggaagttaaaaataagctcatatatcatcatatatttcacctgag

SEQ ID NO: 47843 - DNA, 961 bp, Oryza sativa
tgttataatccccttgtactccccttgcatttattctgcacttgtgggtgtgtcttgttgagtacggtggttgtactcagtcttgcacaatttttcccaaacccagaagaggagttcctggaagatgaaggctttggtgtctagctcgtgcctgccgtcaagcgcctgtggtcgtcgccctagtcttccgctatttttcgtttgtcttcatgtgtgctgggccttcgccgcccatgtaataaattaactatttacgcttccgcttgttaaactctgaattgtatcaacttttggtgtaccttgcctcctgggacaaggaataatgcacgcacgtaaggaatgcccgttgggttaattccggtcgtgacaatatgttatctaccctaggtactatggtgcacccagtaccattaccacccttggttgtgtcttgtaatgagttttaacagtatagtggttcggaagttaaaaataagctcagatatcatcatatgtgacatgtgaaactttgggtgatataaatggaaaaaagttgtctttcatatttaaatactatgcctctataaggatatatcctagtacgttgtcgtgactaattaccatcatcggtactctacaattttattgtgtgcttacattcgatccgaagctactttgtttttaagatataaatggagcgtataaaggatgtccgtccttttattccaataagaacaaacacaaagcacatatggcaaatactaaatccactacaacaaaatcatagaccatacaaagcaggtaaagatgtagcaatccacattgattcttcatccactactacaacaagcgcatatgaaaggcggcatatgcatgatcattgtgaatatgacatgcccttgtcgagcaacgtgtcacttcatgcaaatatgttgtttcaagcgacatcaatatatggttacaaaattttaaacattggtat

SEQ ID NO: 47844 - DNA, 1870 bp, Oryza sativa
tgataattcaaactccagtaagtccaaatcatattttggacaaaagcaagcaaacagcacatgtgcacatgtgcacctaaagacaaaggaaatgcatccatataaacatttggcaaaattttccaaacaaactctgccaaagagaaaatcagaatatatctcatttgttggcttaaaaccttatagtatgtagacaccgcatggccaaaaaatgatgatgtaaatatcttgataaaaataaaaatatagcaatcagtactttagatatatactttaattgactagaaatcaggtataattttattattaaggcccactgcagtaatggattccattactgttgtccttatcagcagattattaaagtttggtaggaaaggtatgtagaacaaagtagatcacctaaacctttaaaggaattttttttacaataaaaagcagagacactgagaaagcacaaggtaaaaccagtgataaatcaacccagtggattatctgaaattttcttcctatggcaataagtgatgtggaattgtggatagtctgagaattcactaaaacagcatgacttattctgtagatttaattacagctttccaatttactgaagtaggtccctaaccagttaaacaaaaatatctagagaaacgttttatggaaaggagttgaactatttggctggatacattaattagcagcaagaatatgtgcaatcaattactagtaaataagaatgctaagcatccttgacagcttgacctgtatcactcaacataagtatggtcaatgaacactcaataaaaatgaattgaagcccatgtggaagtgaacatgcatgatggttttcgaacacgtattagatggaggttacctaggggttcaggtgatataatgtagatattggaccacacagtattttttttattccaagtggaaattttgtttgtccctatgtgattaacatataattgagtgagagatgcactttctgtaaaagtacaccatatttttaccataggcatagttttaggcccatgaaattgtagcgggcccagtggctaaattggttgtgcagagaaaggaaatctagatctgaacagcaaattctatttaacagatcgattcattcagtttcaccagaagacacactgacacacaggtaataccagctgggttaattaagaacgtcaatactagaaatggtttcacagttgatagtctctctacctctcttaatcctgctacagcctatgaccacacaagaattcctgttctgttgtttatgctacttaaaaaaggtaaaactctttacgaaagagagctcagttgcataattagcgcaaacaaactaccctatatcatcggcaacaccgacaatccaaaggggaaacctgtcgattatcgatctagcattctagccaccgctgaaggctagatggaaactcatcagtagctgttggccacggaagacaattttctcgttggccttctcccccgtgtttgtcagattcacggccaaaatgttatatgatatttcctatcagctctgtcaggtcttgacaacacatcgaggggcttcatccggcaccccaatttcaatcgaaccccaaatcctccgacggctaaatggcagactcgtgctcaacccaagaaacagcctaaaatcaactgggtagaaagcaaagaagcgcacatacacgacacaattcgcagcgcaaaaagaagacggatacctttgaaggcaccacggatgattgcagccggctgccaagaaacccgaatccgactcccacgacccaagaatgacccgggggcagcaatgcaggtttgcagggtgggacggggggctgctccgatcgcttcgttcgtt

SEQ ID NO: 47845 - DNA, 5758 bp, Oryza sativa
ggatccccctttttaacatgtaaaatcgaatatacggatacatatttaaatattaaatatagattaataacaaaaaaattatagatttcgcctaaaaactgcgaggccaatttattaagcctaattaatccgtcattagtaaatatttactgtagcattacattgtcaaatcatggcaatctacacacaatttatgtaattaatattttttatatttaatactctatgcatatgtctaaacattcgatatgacatggtgaaaaatttttatttaaaaactaatcaagacctgaattgcctttgcaaagtgtcagatggtatgtctgggaaaatctaagattctaagaatcaactgctccttccattttatataatataagacataactacatttatttaagttgtttcataatagaaggtgtgtataaatgcatgttattaactagcacatctttttcattaaaatattattatttaaatcatctaccatcaagatctctaattttattaggcgcatgtaatatatttattaaggtaatccaaactatgatggtttgggtggtcgtgtggaattgagggagtacttgataattaagatataataatacggaggagctgtgaaacccagcttcttagagtttagctcgttcatgtttcagattatgtatgtagagcgtctcagaatctcaatgaaagtacatattattttggagaagcctttttatttcgagagaagctgcagttgtcaaaaatttttctaaacaggcccagtgactctgactcgtagttaagggtgcattgtccactttttaaaattgtactccttcatatttcacgtgcacgctttcaaaattgttaaatgatgtgtttttgtaaatgttttctatagaagaattgcttgaaacaaatcatattaatttttttttcaagttttattgttgacataaaaattatgggtacttccactttaatatttgtttaatttgcctctaattattggtaaaattacttattttaaatacatatttttgttaatcacataaattttcttccatcgcctcttgcacgaaagcgaccgaggcattcacttgttgctcccatgatacgatcattacactaacacgatcattacactaacgcgtcaggtacatcattcatatcatacatgtgcatagtggaataattatccaaaaaaaaacatttgtgattattattggtcatactaggttgcttaaaaaaaatttcagttaaactttatccactgggtatattaccggtacaacgcacgggtattttactagttttttttcatataaaacagaaaagtctgaaaacgcgtggaccaattttggtaactggccgaactcccattagactttacgggcaaccggcccatcacgcttttttgcgtggccgtaatcgaaaagaattcgtccccctagttgtgtccccggggagaataaatttcctaatctaaattattccgccaaaaatccgccgcgattggccaccgctggctccatggcaagcggaagcggcgagggcaagggccgccgccaccaggacaatatcccaagcgtcgtcctgctcgagctctggggccacgtcgccgacgatgaccaccggcctgacgccaccaccgccacttccacgacgagcaccggcctgccaatctcggtgaccttgtgcgccgccaccccgccaagcctctcgcacctctccgtcgactgccctggtctggtggatctggatcccaatcccttagataagtttgtggcgcccacggtgatcagcacggatgccgacctcgtcctccttcgtgtccctgtcgatcgctttgccagatttgatcactgtttcagcgactacttcgtctacaaggtgcactctcactctgaaagcgcaaagctgcaccgtctcccgagcccacgtggccgtggctttgcagacgacaacattgccatactgagctgcggcaacgacgacgacgactcctacgctgtggccgctcttcaacccttgcatcatgtccacttcaggcttcacctgtgtcgctctacccccgatggaaagccagggagttggacctcccatcagttgacagtggaggagccgctgaggggaacggtgtgccccgtccctgactcagcactgaggaggatcttccatgccaccaccaaggtgattacgcttggaggtgctaaaggtacagttggctgggttgatctctggcgaggcatccttctctgtgatgtgctcgacgagattgagagccccaagctccgcgatttgccgctgcccttgccctctacgggcaactggcctttgttcctcaatcgctgcccctactattgtcgtgacatcgtcgtcaaccagagcagagacactatcaagtacgtcgagatggaattcaccatcttgaactcatctcaagatccacgctcctcgtatcacgaatgggtggccagccaagaatttcgaagttcgcatctagacatcttggtcgatgatggtagcttgaagatcaacacatggaacatgcctatcccggtcactcatgggatgactggaagcctggatgctccgtcacttccaaccacttggacactgccctgcatagttacatgaggaaaatagactacaagaggaaaaatgccgccatatccgtggagagtcttcacacggcttaccctaccctgagcatcgctgatgatgatgatgttgtttacttgctatccaagcgcaccacaagtggaaactattctaatccctcgaggagatgtttcctcgtttgctcaaaaaccatctaaatggttatgaaaaattctggaaaaatttgacaacattcatacaacacatatatacaacttcacaaaatcttaagtccaaactcaactcacacgtcgagatataaaaaagacaaattcagcgtatgaatagtagagtactgtttatatctaaatttgtcttttttgtttctcgatgtgtagatcgaatttgaacatgaattttggtggactagtaggtatcattatactctacattgtcaatttttttttcagattttttcacaactatttgcatcgaatttggaagaaaaaggtataccactccccaccacaaggggagcagccaagatggtattcactcttaacatgagggcacgtgttctcgaagaactggagaaacttcatagcatgagtcaccttggttttatgcgttgcttcctttccactgggatctccaaacatcttaagcctacaggtaatttgctgtgatatctggggaaatttatatataccttatttgtgctgtatgagttgaaaacaaaactcaggctgcaggccgtgcatggttggaaaacaaagctcaggtgaattttgttgcaccgcactgttacatttggagtagatgttggtttaccgaagcttgcttttgccaatatattggcagcaaatccacatccaataaatggtgagctcattcctagcaaaatgtagcacaatatgggtgtgaaaacacaatataaggatctaaggtcggatcataataatattccttggtttaggaattaggatggtctgtgtgaccaaactactgagattatattacaacttaccaaggtagtgtacttaatttaggagaatatgattgataatgaggatacaatgcaatggtagagtagtactcaaggatcactatgcactgttgtgagttagttgatgacaagccttggggcttcttgctgtagttgggaagcaaaatggagttgggagctgtcacgcccagaaattcccgaatagaattccaagcagaatgtgcattaaaatccccgtccaggaccagccggggtacacaaacgacaatgttgacatacagatccacgtcttacaaacatcgtaaagtcttacataaatgcagcggaaaacagaagaaactggagctaatccttgactaaactgcagcgggaacaccactccacaggcatcctcgacggcacggacgaagcctactcctcagagaaaccttcatctgacccgaactcgaactctggggttgggaaaaatagagcaagactgagtactacccactgtactcagcaagtcataccggaatagaggtatgatgcagggaatcatcaaagaagagctaaagtggttcatttgcataaagcgagcatttataaacagagattgaaaaactccccagttgtagattaagcagtattatcatcaagaccacgacaccagtgcacaggcccaccaccacgaaccatccaaattcattagactaaactaatgtgattctaatcacggtgaatctggttgaccgcccataaccgcgggcgcggctattcgaatagttttactctgatcagaggtgtacaactgtacccacaagacacagccccacgacacgtttccgtgcgccggcatgccaccacgacataccggaaagaggccgtgacaggacccttcgcataaccccctctagccaagcacaccacacctcaggtttcacccccgtccccagcgggcaacgggcagtcccctctcgtgcctaggtgaatccggaagcgacagaggccgtcgcagggcccgccccgctccatcacgcccacccttgcctggatgcgtcgactagaggaaagctacactacaagcccagccgttgcccacgctggcttgtggtaagtacgataaattcttccagggcatcccgcgaaccggtccttaactgccatgggtgcgaccagcaaaaccatgcacccacagcccaccatgtggttcattttatttaaccaacaccagagcggtggtattaaaccaacattaccattagaactaacagtctaaacattaatatgattttccccattgtgatctagttgaactaagcaaggctaagcaattcctagtccaaactctaatcatgttataacccaagctaacaaaggagcatggtatccaaaaagcatggctgtaacaataggtaaccatcccatagtaatattataaaacaatgcaatatttgaaaggaaacaattgagcatttgcaatataggatcaacatgttcaagtgacaagcatgacttgccttgctctgctgctgggggaacctcggcgactatctcgaagtacaccggagcgtcggagggatcggaatctagcggcatacaaagcaaacattgcaaacaggctataagactactgaaacagagaacaaaaccatttttaatggattctacacatttttcttgatttactgagacttgagtgcttgcctccttattggtaaaggatgcaacggtacgagcctatagaacagctcccgcagcacctccagttccgcccgcagttcctgcagctccagttccagctcccgcgttcactctctccttcgctccagcatcagccgccaggggtccagccagtggcaccggaggttggttgtctgctactcccagtggcagcggcgagactgatctgtcaggctccaggagtcgctcagagggaccgggtgacgagcaggaggacgccttcgactccaccgaccgcaggagccgttccgagcattagtctcgttttccaattagtttatcgatggtctagcttctggttgttagtttgcgtgtttaggttgcttgtttggggtcagttgacggtcgatatcatgtgcctatgatatggctgtcttaataaggatttttgcttgctttttaagtgttttaatggagatcagaacaaaagcagtttta

SEQ ID NO: 47846 - DNA, 8387 bp, Oryza sativa
ttctttttccccgtctgcttttccctccagatggtctacaccaggactggtagccgcgcaacaggcgagggcagcaacggcgaagaacgcgctgatggtgtgcaccccaacagtgattctggcaatggtccgccaccacttcccgagaatccgacgcttgcccaagttatggcacatcagactcagatgatggcagccatgatgcagcagatgcagcagcagcaccagcagatgcaccagaggatgatgcagcacgccgaacagcagcatcaacagtttggtccccctccccctcagtccaagttgccagagtttctacgcgtcaggccacccaccttctccagcaccaccaaccctatggaggcgaacgactggctccatgcaatagagaagaagctgaatctcctgcagtgtaatgatcaggagaaggtcgcttttgccacacaccagcttcagggtcccgcgtcagcttggactgtgacagagtacctccatgagttcaatcgcctcgcgcgatatgcaccagaggatgtccgcaccgacgccgagaagcaggagaagttcatggcgggtctggatgacgagctgaccaaccaactgatatctggggactacgccgactttgagaggctggttgacaaggcaatccgtcaggaggaccaacgcaacaagatggacaggaagaggaaggccgctcagttcagggcacatcagggaagtcaccagaggccgcgcttcactcccggacagcagggtggacctaccaccatgatcgtccgccagcaccgcccgttcaaccctagcaacttccaccagggcaccagtggcagtcagaaccaccatggaggtcagcccaaccgcggtgcagctccacgcccatcagtggcaccggcacagtcaggccagcccgcgcaagccaagaaggagacgggagcaaaaccagggtcctgcttcaactgtgacgagcttggccacttcgctgacaaatgcccgaagcccaggcgtgccgggccaaggtttatccaggctcgtgtcaaccacgcatctgcagaggaggcacaagcagcaccggaggtcgtactgggtacgttccctgttaactcaatccctgcaacagtactttttgattctagtgcaacgcattctttcatctcaaagaaatttgtcgggatgcatgggttaataagagaggaacttagcacaccgatgcgggttcataccccagggaatagctccacttcggttcaattcagcccttctataacaatagaaattcaaaggtcaccatttctagccaacctcattcttctcgaatccaaagacctaaatgtcattcttgggatggattggctgaccaagtttaagggagtcatcgattgtgcgagtcgcacagtcaccttgaccaacgagaagggagaaaccgtggtgtacaaatctctagtctcgccaaagaaaggggtctcgttgaattagattgagacggaaatcccagtggacaccgtagagaagaacttgagaaaattggaagatatacccatagtctgcgagtatccagaagtgttccccgaagacctcactaccatgccacccaagagagagattgaattccggattgacttggcaccgggaactgctccaatctataagagaccgtacagaatggcggccaacgaattagcagaggtcaagaagcaagttgatgagcagctgcagaaagggtacatacgaccaagcacttcaccttggggcgctccggtcatttttgtggagaaaaaggataagacgaagaggatgtgcgtcgattatcgcgcacttaacgaggtcacaatcaagaataaatatcctttaccgcgaatcgacgatttatttgatcaactgaatggagctaaagtgttttctaagatagacctgcgatcaggctaccaccagttgagaatccgggaagaggatattccgaagacggccttcaccactcggtacgggctatatgagtgcacggttatgtccttcggacttaccaacgcacccgcattcttcatgaatctgatgaacaaagtgttcatggaatttctggacaagtttgttgtggtgttcatcgacgacatacttatctactcaaaatccgaggaagaacatgagcaacatctccgtctggtacttgaaaagttgaaggagcaccagctatacgccaagttcagcaagtgtgacttctggttgacggaagtcaaatttctgggcgtgacaggagccccagtggccagtttagttttctgtaaagtcaacgtacaaccatcttcacacatgtcacgcccggaaattcactagtaatttccgaacttatttgtgcataaaatcctcgtccaggaatcagccgaggtacacaaactgacaatttaatatataaatccatcataataataacgttacacacttacaaaagaaaagaaaacagcagcggaataacggtctagcgatggcttcagctccactcccacaggcagctcaactggggtataagccaaacgtcttatccttctggatcctttttcttcaactgaggttgattgattattgcaagaatgagcatatgacatactcaacaagccacacagcaaatatgcaagtgcacaaagataccaaaggatggcataatataggctcatttgcaaaagcagcatttagcaaaacatttaagagaagtaaaacagtggagtaattaatcagaaattttaatcaacactgaacaacacacccatgctgcacaggcccaaccattctgaacaaccatacccggccgtacagatctaactccaaaccaggagctaaacaaattattaccagttatagcatccataattattgtgagaggtgtgagactaatcacgaaaaacattgctcaactcgcccataaccgcgggcacggctattcgaatagttttactctggccagaggtgtaccactgtacccacaagacacagcctcaacatcatgtctaccatgcgtcgcgatactggaaagtacccgaatagaggctgtgacaataccctttgtacaacacaactcaccacagtgcaccattcctggatcataatcacccccttataaaacaaggcatggactccccagcgacccccatgggcttatctccgccacttctcagtctggtgctccgcaatgaaccatgttatacaaaaggtaaagccgttgcccacgctggcttgtggttggcacggttaatgtttcacaacagtagctcgcgaaccggtccttaattgccatgagcacgactctcaaaaccatgtgctcacgacccaccattatcaagttttagttggcaagtaattaattaaccaatcacgattgaccatcgtgaactatcattaagccatcattaaataatagtgagtcataagttatcccaatagtgtgctaatgtttctaagcatggctaagcaatcatatctaatatctagctgaaccaatatataaagctcaactagtcaagttataataatccaaggtatcaaggaataaagtaatcaatgcaaacaggacataacaaaggaatagattcacaccacccagtgacattcgaaaataaatgcacagttgaaataaatagagaatttaaatataggatcaacatgctcaaaggattgtgtttaggatctgtgtgacttgccttgcaataatcggtcttcaattagtcttcttgaatacttccggcgcactcgcgaaccttcgcaacgacggaaacgacaagctaacacgcaaaacgaagaaaaagactaataaaaaccaaataaacagtacatataaagtactcaaacatgtagatcataattttagatgaattatgagacttgaacggcctcattctgacttcatatgaatttattatgaattttacaagattaaatctaattaaagcccatttaaaaagaattaaataaatttaattctatttatggataattttaatacgtagatctttattttacacaacttttgcaacttgaaccacattaaactgagttacaaagaattagttatgaattttcaaagattaaatcggattaaaacacttatatagattttaattgaattatgacgcaataatgaattatttttgaaaaggaaaagaggattattgcgtcagcgggctcgggttcacggtggaccgggtgcacggcggcggctcatggaaacgaacggccgagatctaccctatccacaacgaacggccgagatctaaacggtctacgaccggtctatggcgaacggcaacgatgacgtcagcgatgacgtcatcaccggcgacggctcgggcggcgcatgctcaccggcgaacgacggcgcgacgacgcaaacggaggacaccaacgggtagagggcgacgcggcgaactcaccggtgaccaaaacaacggcggaagagcaacagacggcgccggcgacgaggaagaagcggcgacggtcttcgggtcgacggtgatggcggtgctccggcggtcttcggcggcggcgaagcggtggacggggacgacgacgacctcacgatcccgatggtggcgacgacgaccgacgacggcggctgcaacggcgacgcggcgcggctgaaccgacggcaacgacggcgacggctagggctgcgcggaggcggcgctagacgcgacggcgggctaaggcaaaggtggcggcggatagaggagagctcgggggtgcttataaaggggctagcgagcggcgacggaggcccacggcgaccggcggcgagaaggaaagctagggttcggaggagagaagtcgatccgaatcaaactcgaatccacggatttccaaacgaaattagccgacgattccaaaagagaaaaggtagaggagattgagaagatcatttcccctctattgatttcaccggattgggaaaaagacggtcggatttggaaggagacgacggcggcgcggcgctagggttcgagcggcggccggcgcgaggaggaagacaggcctgacaggtggggcccacctgtcagcgggagagagagaggagagcagcggctcggatgcgggccggcttgggccggggaggagagagagagcggttttgggccgactgggccggggagggagagagaaagagagaggttttaggccggctttcggcccaaagccaaaagagacttttaaaaacctttttcaatttaaattattcatgaaatgatattccattgattaaaaatacttccttggctcaaataaatcccagaaaaatctaggaactttagaatcaagtaaagtatttaatgaaattttatctggccctattttatattggaatttattaattaaaattagatcttctcttttaggcttttaagatcatttctaataattccttttaaacaacaatttataatttaaggatttttaaacaagaaaagctcctaacaattataattagatcattaatgatcaaataattactgaactgttctttgtatcatttaggaattgagctctgaaaaatccgagaaaatttcagagagtgtaattaatcatggagaatttaataaaaattaaatccatccatgctttatatttaggaaattttatttcccacatttaacttcacttgtaaattaaagaacatttaatataaattctaataataatttattaaataatttataaatcctgaaaaaaaatcaggatgtgacaacacagctgtatatggccacatcatataaattgcattgaaagctaaactaccattaaagataaaaaaaaatttagttagccgtacacaatgcaatattaataaaagataatctcgtaagacgaaactggaatggtaatgaaacttgtgccttttgcaaggaaaaggagactgtcaacgacctgtttttttttttcactgtgagttggccaaatatatttggagcctcatggctaatggcttatgtgtttggagctcaaatgtcgtcccaactctttcgagcaatttttgatcagggcatagtttatataccaaatggaaaaaaaaaatcacattgcgggattggccgccatgtgttgggccctctaggaagccggcccgtaatatgttttgaaggataaagaagatcaagtctcctgatatggtgtgtttcatctgtttgtttccctcttatattggtcaggtttacaaagccaggaggatcaaatcaaactggaacaatgtgcggaagaactgacgtctacagcactgcactgtcatcagcaagactgagttctgttgggtcaagatggagttgtcctgtgaagctggagttgtatcgcttgggttgaagcctttcactgctgcacaaccgattttgccgccggttggcaaccatctatttgtcccggttatgcaaccgggacggcgaatccgggactttagtcccggttggtgttctaaagatgtggtcccgactatagggtttttttttcattttttttcttttctctttttcttttttactgttcttttgctatttgcccaaatcatctcagatcaaacattcatcactcatagcaatatagttcatcccaaatcattcacacaatagttcatccccaaatcgttcacaacaacaacacagatcgaatcacacattcaacacagattgaatcacacattaagaaaaaaataaaaaaaagaaaaaaaatacagcagcagcgccggcctccaccgcctgccgccgcaccggcctcctcgccggccgcctcccctcccggatccgttgccacccggccgccgcggcgtgaggctgcctccgcctccgcccggccgccgctgcccgtcgctacctgagaaaagggaggaagagaatgaggagaggaggaagaagaggaagagatggggtgaagagataaggtgagggtggaggagatagaacttattaactgatcccgtattctcctcctcgatctcgcgcacgccttggcctctccgccgcacatgccgatcttttttcccagttggttacaccaaccaggactagaaacatatctttagttagaggggtatggcaccgcctgttattcttttagccgggactaaaaatgatctttagtcccgattggtgtttccaactgggactaaagataaaaaagtagctcgaaccttttgaactgggactaaagataatagttagtcccggtttttattgcaaccgggactattgtggtttttgctcgaccgggcaaagatgttttctccagtagtgttttgatatgctggaatgtataaatatgttcagaaacgtctcaagttggagctgtagtacttttgagttttagccagtaaactttttttgctctctgagtctttgaatttcatatgtcatggcccggattagggttgacaacggggcgggttgagctggaatgcccccgcccccgctccccgacttctccccccgaccctgaccccgcagaggtggttgggtggaaaacgtcaccagccccgatccccacagggacctggcgggtgagcagggccccgcactacccggctgggccggtggacggcaagatagacaatggcgacgaggacagcgagttggaagacgatgaggcgagccgccgccgcctgcgcctggccgtcgacgccgccggccacgccctggtcaccgccgccgcctgcgccaggccatcgacgtcgccgcccgcgccctggccgtcgccaccgcccatgcctggcggtcgacgtagccgccgcctgtgtggtgtgagggtgacggggagaggagattgggagaggaaagaggataaggctagggttttatttttatattttagactattgttggattgggctcttttgggtcttccatggactacattttaaggtttaatttacatcccacggggccccgcgggtcacccgcggtgaaatgcctcccccgtcccctccccgcaaaaatgtggggccccgaccccacctcacccgtgggtcaaaaaattgaacccgcccccgccgccgaaagggtggggtccccgcagggagacggggcgcaaaatgcaccaagcccagctggaggagatccaggcgcgcgaggagacgctggactcggtcatgcgtgagacggaggaggagcggcaggcggcgctcatcacctcaagcgccttagacgaggtgctgggcaacatccgcctgcagtatgaggcctacgccgaggtcctggcgaagagggttgaggacgcccgcggggtcctcgacgcggccgcggcccaagtgcggcgggcatcgaaggtcgacgcctcgctgcgggcccggtcggaggcgcttaggccgagcgcaaggcctggacgagcgcacccgcttcgcgcaggagttcgaggccacgattcgcggcgga

SEQ ID NO: 47847 - DNA, 5527 bp, Oryza sativa
tgaggagcgggcgcgcgcgttggaccagcacgagacaaccttggccgtccacgaggcgacagcggccgaggcggaatcctcccttcgcctccgcgaggaggccgcgaccgagcgcaaccagaccaccattgccactgaggctttagtggcccgtcgcacagaggagctgtggctccgagaggaggcgtggcgggaacgagatgccgcgctcgccgagcgtgaggccgaggtgaaccgccgcgaggtggcggcgcgccggctaggcgagcagctcaccaaatgtgaggaggccgttgctgggcatgagacccgccatgtggaaagcgcccgtgttgagcgcacggcgatggtggcgagggcgcttgagctggaggccagggagaaggaactggcagcgcgcgggcagcccggcgacgccgagttggtcagccagctcaccgcggcccaagatactctcgccaacctggggtgtctggtacagaaccaggctggggagatcgcggccctccacctcaccaacgacatcgggcctggccaactctacgatgccatcgaacggctggagtgcgtgggacgccgggtgggcatctccgtgcgccgggacaagaagctcctgcccacaagaccggcgctcgcgcttcggctggacgagatggcggcggatctcgagaggctggaggaggaggtcggcgaggccgtgaagtcgtcatcggcttccttggcacgggctgcggtggagcttgtcctcgcgagtcatcaagctcgcgaccccaacatccttccgtggcacgtgctcgaggatttcccccagggattgagacgagggctcaggagcaagttcgggacgcggccgacgtgatcatctcaagctttgaggggacggccccttggttcaccctcgcgcttccctcagatgaggagagcgggagtgatgacggcggcggcgatgatggcaacgaggattgggacaaggtggtcagcggcgctgtacttggaggcccaggcactccgtgattgcccccgcctctcctcctttattttgttatgtgctcgtggtgaacgcttgaaactctaggccattgtgccatcctggttgtaaataaagcttctcctttgcacttttacatccttgctttctcttctaaatgcctgcggcaaggaaaaaaacaaagcgaacgcatttagttgacttctttacgatcaagttgccatttttactccctttgtcccgcccctcgggctcgttccggtaaaaagggggaatttgcacttggtccgcgacacttaggtggcgaggggcaaggccgtcgctccaggggagccgcccagcgggactaaccagaccgaggccacggtgatcgggggtcggggatggccatgtgtaggcccttccgagcccctagggttcgctgcagcccggggcacggcccgcgttcaggctccccttcggttattttcaggttatccaacgccacttagggtccggagcaagcgcgaatcgtccttaagccaggacgagccataggaaggagtaagaaagggcgcgcaacagcttttgattaagcagaaaaatttattgctgagggagggattggatacaacatatttaacagtggtagccctcggccaagcccgcacaggctgaggagtgtgcgggggttggcccgagccccaagaaagcaaaaaacgcgcgacattatgggtagaaacggtggagatgctcgatattcctggggttaggcaactccgtgccgtcctccatggttagtcgaaccgagcccggccgggggacaccgatcactttgtatggcccttcctacattggtgagagcttgctcagccctaaacacgactgtatgcggcgtaggacgaggtcgctgacttgtagtgatcgggctcggacgtggcgctgatggtagcgccgcaagctttgctggtagcgcgccgcacatagggcggcgcgccttctccgttcttccaaataatcgaggtcatcgctgtgaagatcatcttggttggcctcatcgtacagcgcgacgtgaggcaaacgtagggaaagctccgagcataggaccgcctcagggccgtacaccagggaaaaaggcgtttcccccgtggcgtggctcggggtggtccgattcgcgcacagcaccgcgggttgctcctcgagccaagaatacccgtgcttctttaggatgttgtacgtcttggtcttgaggcctttgaggatttcggcattggcccgctcaacttggccgttgctcttggggtgggcgagcgaggcgaagcacagcttgatgcccatgtcgtcgtagtagtcgctgaatagctcactggtgaactgggtgccgttgtctgtgatgatacggttgggtactccgaatcgggatgtgatgcccctgatgaacttgagggcataatgccagttgatcttgacgaccgggtaagcctcgggccacttggtaaacttgtcgatggcgacgtataggtgctggtacccgcctcggccgctttgaagggccctaggatgtctagaccccagaccgcgaagggccaaaagagcgggttgggccaaaagacctggttcatgaccagttgggaatcgcttagaactaggaggcagcggatgcccattccggctgccgctctcagtcccgctatgagtcctttgtattctgccatattgttcgtggctcggaaatcaagtcgaacgacgtacttgaggacatccccgcttggcgaagtcagcgtgactccggtccctgcaccttgaaggttgagagagccgtcaaagtgcataacccaatgtccggtgcgaatatcggcgttcgggtcttctccatctccggggagggagggaatatgggacggaatagagtcgtccgccggggtccactcagcgttgaagtcagccaaaacctggcttttgatcgtgtgctgtggttcaaagtgcagatcgaactcagcgagctcgatggcccaattcacgatccgaccagtgccctctcggttgtgcaggatctggccgagagggtaagacgttacaacggaaacccgatgcgcttggaagtaatggcgcaatttccttgaggccatcaagactgcgtaaagcatcttctgggcctgagggtatcaggttttcgcatctcggagtgcctagctgatgaaatagacggggcgctgcacctttcggtggggtcgacctttgtcgttagggcaacctagctcggggcgcccgtgctcgggggccccgagggggtctcgagccacgtcagtgcgacaggcctcggggccgtccgccggggcctctctctctcccacggggacctcagggccttcccgggggttgggggcttcgggcatcgggctgttgggggacgaggggccatcactagttaaggggacccctggtcccttcccatagccgggctcgcgacgcaggtcaccttcgtcacgctctactacaagggcggcactcaccgaatggggggtcacagccaagtagagcagcaacggttcctctggtcccggggccactaggataggggggaggtgaggtaagctttcagctggctgagagcttgctccgcttcctccgaccatacaaacggcccagagcgtttgaggagcttgaataggggcaacgccctctttcccagcctcgatattaatcgactcagggcggccatgcatcccgtgacgcactgcacatccctaagtttgctggggggcgcatcctctctatcgcgcgtattttctcgggattagcttctatgcctcatgaggaaactaaaaaaaccgaggagtttgcccgccggcacaccaaacacacacttctcggggttcagtttcatgcacgtggacctgaggctgtcgaaagtctcagctaggtcttgcaacaacgtgtcctggtggcgcgtctttaccaccaagtcatcgacatacacctctacattacgcctatttgatcactcaaagtaatacgagtcatgcgctaaaatgtagggcctgtgttcttgagaccaaaaagcatagttgtataacaaaaggtgcctacaggaataatgaaagcagttttttccttatctttcctagtcatgcggatctagtgatacccggagtaggcatctaaacaacacaaaaggtcgcaccccgcagtggagtcgactatctgatctatgcgtggtaaagggaagggatccttagggcatgccttgttgaggtccgtgtagtcgatgcacatccggagcttgccgttggcctttgagacgaccaccgggtttgccagccactctgggtggatgacttctcggattccaggagccgcatcacctcctctcggatgaaggcttgccgctccggggcttggtgccgtactttctgctggacgggtcacgcatctggccgcactgcgaggcggtgctcgatcacctccctggggaccccgggcatatccgatggctttcacgcgaagacgtcggagttcgcccgcaagaaggagacgagcacactttcctatttggcgtccaaggtactgccaatcttggcggtcttggatggatcatcgccaaggggaatctccttgacgggcaactcgtcggccgaggcgaggcgcctcttggaggcgcggggtgtggagggctccggggcctgcggcttggtggctgccgccaagttatcggcgcgctgctctgcacaagccagggtgactttgacatcgccaaagacggtgatggggccactgtggcctggcatctttatctggaggtaggcgtagtgggtggcggccatgaacttcaccaacgcgggcctcccaaaaccgcactgtagggcatattaagatccgccacatcgaagtcgacccgctcggtgcggaggttggtagagtcacgaaaggttaccgggagctcaacgtgacccagaagctacgtgtgtcccggggtcacgccgatgatcggcaggtacggctgaagcttcatccccggggacttaagggcatcaaaggcagccggggagatgatgctgaggccggcccccccgttgactagaggacacttcatcttgatgttgtggatggttcgggagatcacgagggccaacttccctccccaagcgagcaccgtcggatggtcgctctggtcgaaggtcagtttcacttccgaccagcgcgccttccatgttgcctcgtgagttgggatcgcggccagaagctcatgcctcatggccttgaaactgcggcgggaggtgtgagcgcaaaccccccgtcgcgagtggcgacggttccctgaggtatctggaattccaggtcctcgctgtcatcatcatcatcggcgggggcctttttattggcctccccccgccggtcgctagcgggggtcgcgggggccttgccctcccgttgactctgccgcttctcctcatcggcctttcggtaccgctcggccaagttcctgaccgagctgcagtcggtgaggctgtgccgatctgtgcccataggtgttgtgcatcgagcaccacttaccgcaga

SEQ ID NO: 47848 - DNA, 4597 bp, Oryza sativa
ccgccaccgtgtccgccagctcgaagtgctcggcgatggtcttgggctccttggaggcaatcttctctagcatgcagttgtgtcgcacgccgttctagaacacataaacgaccgcgtgggccggtatgcagggaatagtgttgcggacctggcagaagcgctgtatgtatgagcggagggactcgtcgtccttccgttgtatagcgtgcaggtctgcctcctctcctgggcggggatacgtgccttgaaagttcgtaatgaactgctggcacaggtcctcccaggagtggatggagtcggggggctgagtcataagccagccgcgcacctgacctttaagagccatggggaagtaattcgccatgacctagtcgtcgccccccgcatcatgatgatcgtgctgccatcatatttctccgtgaggttggggcgaaacttcgggggccaccggactctggagactcgccttgaaggccctgcaactggtccctccaggggtaaatgtgaggggcgggccgcctcgcgtggaggagcggggcactccggatgaggaggcgccctccccatgcgggccgcccagtgctcgtccctgtgttgctcaatgttgattcgagcgtccctcctcgtagaggccaccatgacgtccccggcttcccgagatcctcgatgacgttggggccgtcgaccacctcgaagtcagggccgaccgacgggccctccttcttgctgacgaggaaagagcggtgggttacgcgaggtaccagaggcggcgggtcggccacccgcagcctgctaccgctgggcagtggtgaccaggttggtcatgttgtccaaccatcgctggacaggggtctccggctccgaatttatggggggatgccgtagaagggctcccgccgcctaaagtgcgcctcgggatgagccgccgttgccgtatgtcaggcggccccgtgccccgacactgcgcggtttctccccgcgcggcggcggggagaggttcctccctctgtgggggggtcgcggtgggcaggagtgggagagttgttgcgacggtggtgggggccgcggctcccgctagcatcgtcactcccggagggagtaggggtgtgcgccaccacttcttcctctaggacctcgaccatgatcgttgaggatggagggaaacttgtggtggaaggaaacgatttctctttcaaacgcgcgaattccccctacctggcgcgccagctgtcgaggaatgatcctctcttgcgggtgattgagggacccccttttgtgagttcggccgggggaaagggcgcactgatcaagaacgtatatctgcctagagtctttcgagaccgcgtgtgagagctgggattgtacaggttcgggccgctagggagcgtaataccctactcctgtgcgtgggatttagggttgagtgttacaaaggtttctaaactccagggagaactcttactcttcttcctctggggcttaggctaagtgagagtcatccccccttttcagtgggcaaggtcctccttttatagttcaaggggataccacatgcaccgcctctacctactccttcaagggagggggcccacgccgcttggagcggaccaccattcgtgccttcaccggaagctaagcagccgtccgtcctcgagtggggcccagcgccgtcccctgcctgacacgggggacgcccttgtcattcccctttaagtgaatggagacttttggcggttcacctcacgtggagggggctctagacgatgcattgatgggacggggcatacctgcccccactccgccgagcacagggcggaacgtgggggcaccgccgcccgtccgattggatgtgatcggccacagaccggtcacgcccgattgacgcgggtcaatcgggcagcgccgcacgtccgccctcaccgcattaaatgcggtgtgggacggttggggtgctattcattgatggcggctcagattcggccaccgccccactcactccccccgccacgtggcggccgggcgagggcctcggggcgaggcagcctgagggtcaaaggggcgtgacgtggcaccccgaggccccctggctgcctctgcgtcgtccgagatgtggggggagggccaggctgtatggccgcgtggctggacgggattgagacttccccatacttctcatatcctcaggcccatatcaccgacaattattctcacccctagttagctaatgtaactagttagttcaggtggtggtttgggcttgtctcaatgtggtgtagtgttgagcagtgattggttaatattgattaaatactacaactgtttttactgctttcaactactgcttttaaatgcaagcattatgcaaatgaaccgctagcctcctttggttatatcttgcatcatacctcctcttccggtatgacttgttgagtacagtgggaagtacttagtcttgctctctcttccccacaccagagttgaagttcttcttagttggagatgtctcgaagaaattggtttcgtcgctgccgtcaaggatgcatgtggagtcaagtcttcaggcttagctggctttcatcttttccgctgcatttgtaatcttttatatttttgtaaaacgtggatctgtatttcaacaattgtcgtttgtataccctggctggttctggacatgggtttaatgcacattcagcttagaaattctggttcgtgaatttctgggcgtgacagttgtccatcattcttgacaagatgtagtgtacaaggcattctttagttgagcctcgctcactttgcatcacagaagtataacctagacataactaattcagtatagaagcaaaatgtgcagcagcaacaataagggtgaaaactagaaagaaggatttatgatgcttcttagtttattcagtcacgaaagagtgactttaaataaatgtacacttcttccaaagtgaaaattatgagatgtcttacttatggaatgctcctacacactaaggttgtgtaatgccccgagtttcgaattagtatatttcggggaatattagaacaaatgcgcaaaagttcaatttttttaaaccgttgttcgaataggcgatcaggaaccatggatgtatagagctcgtcaagtagtgcaaaatatactaagtcccggggattgaaacaatgtgggacgttggatctcctttttgtctctttatgtaactaaaagaaaaaagaaacaacggttttgctaaaaaactggcgacagttttttctttagaaaactttcgattttctagccattagatgcactccaggattcgtgcaacatatacggccatatgggtagaataaaaaaaatctcgtgtgggctagacaagcattgaacgagctaggatctatccatcaaacttgccacacgttacgctgaggtacgggcactttctgattattaatagcatttgtagttatatatcacttacaccctaggtacataacacttatactctagttacatactctagttagttacatagcacttacaccaactagagtagttacagggtaattacatggtataaaattaggatttgtaatttttttcagggacatatatatgcatattacttttgaattgaaagttattatcaatttgggcactaagactcgtggtttgtactagtgcagactgttttcctgtaatcgttgatgacaaatcctatggttgaaaaatttgacagttctggacctaaaaaactgtcgacagcacactagctagtccctttcttgggactagctattctatgagaagttcattctaacatagcaagtcgatagtttactgcaaacaaaatggataataaacatgatgtttcaacaaaactagaggaactcacgcatgatgtacccaaaggaaaccggttcttgacacactacaaatctgtggtagttcttttctatctcgaaaacgaatcaaggctgtgtttggaatcagctgttcccaacatgcaaagtgcgcatggaaaacggagcggtccattagagcttgattagttaagtattagcttttttttttcaaaaaatggattaatatgattttttaagcaacttttgtatagaaactttttgcaaaaaaacacaccgtttagcagtttgaaaagcgtgcgcgtggaatataatggagatgggttgggtaccctggattccgaacacagtccaagtctatccaaaaagtttagacaagaaaacacgtaacaagttagtttacaagaatacgaattacgtcaatcctgcactacaagtagagcaaaatggtgatttcttgtaaatctctcgaatggtgatttaagaattcagtgcaaacctaattcttgctataaaatcaaatgttcggtaccgtatcaacggaacaataaaaagcacttggcgtaccataattttgtcattcttgttgaaattttgtaacataaaatgcatgaggccacacgaccttaatgttcaacgtgtcatgcattagtgaaataatagcttacaaaacataacaaatatagctagataacggttgcaatccttaccaaactaacgtataaagtgagcgatgagtcatatcatt

SEQ ID NO: 47849 - DNA, 3592 bp, Oryza sativa
tctgatgtttcaacaaaactacaggaactcacgcatgatgtacctaaaggaaactggttctagacacactataaatctgcggtagtccttttccatctcgaagacgaatcaacgatgtgtttagaatcagctgttcccaacatgcgaattgcgcacagaaaacggagcgctccattagagcgtgattaattaagtattagcttttttttttcaaaaatgggtccatatgaatttttgaagcaacttttgtacagaaaccttttgcaaaaaacacaccgtttagcagtttgagaagcttgcgcgcgtaatacgatggagaagggttgggaaccctggattccaaacacagcccaagtctatccaaaatgtttagacaagaaaacacgtaacaagttggtttacagaaatacgaattagatcaatcctgcactacaagtagagtaaagtggtgatttctcttaaatctctcgaatggtgatttaagaattcagtgcaaacctaatccttgctataatcaaatgttcggtaccgcatcaacggaacaataaaaagcacctggcataccataattttttcattcttgttgaaatttgtaatttaagatgcatgagaccacacgaccttaatgttcaacgtgtcatgcattagtgaaataatagctcacaaaacgcaacaaatatagcaagataacggttgcaatccataccaaactaacgtataaagtgagcgatgagtcatatcattatctcctgcctgctaaccatcatgtacaccatccgatcccaaaaatgacaacttctagggatgaacctggacaaggcttagggtttagggatgaatctggacaaatgattgttcacgttcatccttagatgttggtttctccttacgggacggagggagtatatgtgatggacacaaaagttactttcatgatgaaaccaaaggggatttgttagggcacctaatagaacatctgtccaaatggcatgacttacttatatcctaataggatatccaagaaaaactaacactctaaagcaaccgatgaggaattgaaagaaaatacgtgccaacgcatctataaatggacaagcgcaatggaaaccctccttatcgttcacacagttcaagcattatacagcaaaatagaaagatctagtgttccgcagcaatgaagatcattttcgtctttgctctccttgctattgctgcatgcagcgcctctgcgcagtttgatgttttgggtcaaagttataggcaatatcagctgcagtcgcctgtcctactacagcaacatgtgcttagcccatataatgagttcgtaaggcagcagtatggcatagcggcaagccccttcttgcaatcagctgcgtttcaactgaaaaacaaccaagtctggcaacagctcgggctggtggcgcaacagtctcactatcaagatattaacattgttcaggccatagcgcagcagctacaactccagcagtttgatgatctctactttgatcggaatctgggtcaagctcaagctcaagctctgttggctttgaacttgccatctagatatggtatctaccctaggtactatagtgcacctagtagcattaccacccttggcggtgtattgtactgagttttaacattacagtggttcggaagttaaaaataaactcagatatcatcatatttgacatgtgaaactcagggtgatatatcctagtacatcatcgtaactaattaccatcattggtactctacaattttactgtgtgcttacattcgatccgaagctactttgtctttaagatataaatggagtgtataaaagatgtccatcctttaattccaataagaacaaacacgaagcacatatggcaaatactaaatccactacaacaaaatcatagaccataaaacgcacgtaaagatgtagcaatgcacattgattcttcatccactactaaaataagcgcatatgaaaggccgcatatgcatgatcattgtgaatatgacatgcgcttatcgaccaaacgtgtcacttcatgcaaatatgttgtttcaagcgacatcaagatatgatttcaaagttttaaacaatggtatattaatgactttcatatatgcatattagtttcaattgaaagccatcttgttgtccatccttcctgacaagatgtagtgtacaaggcattctttagttgagcctcgctcactttgtatcatagaagcataacctagacgtaactaatttagtatagaagcaaaaagtgtagcagaaacaacgagggtggaaactagaaagaaggatttatgatgtttcttagtttattcagtcatgaaagagtgactttaaaaaaactagtaatcatgcacgtgcaaggcacgtttttcatattacatatggcatcaacgtaatattttgctgtcgcaatatgtatataagacgatttatttcaatgtggtgataaaataaataaaccaagcttcatgttaatccccattcaagctaaaaaatgcaaaaaaaaaaagagagctcattgttgcatacgatcggaatacaatagcgcatgaaatctatgttggtaaaaaaataaatcactgaaacagagaaggaattaaagtttttatatagtcaagtcaaatttgaaagagagtaatgggttttgaaactaataagaatgtattattataaagatgttgttattccatatatttccaaattgaagttggatcatccattaagatttctttgagttgattatatactacgggccttcagatcgaaaaaaaaactcttctcgaagttgaactccatttaacatacatggaacttccttagtattttgcgaacatcaatttcaaatattcattaataagaaacatacgtagtatttttctgatttttcaagtttacgacttattgtttaactgtcattcatttgttttgaaaaaaaaagcaattttcaattgatatagcacagccgcacaccccttctgagatgagttctgattagcatctcctgataacatggcatctcttctttacaagcatacaaaaggacatacatcagaactatttatgttaacaccaaataaatggcagagaaataactaattttgatttaattagattaagacagtcacaatatccagcttgcgcttgttgccggcgttgttgattgactgcttgctcatgctgaagtagcctaggaagatctgcacccaatgtccctacatcaggagcagactttcttgtgttaagttcatgagagcttgccaggcttgtgttaagttcatggcatctcctgaagtttatgcattcatcatctagctttatctcacattagatggagcaagctggggtcttccgatagcatcataggttgttgaccctccgcaccgccgctgctatggaaccatgaagaagtgtctgtgtcacctattcatattggaactaaatttggtaaaggttagtcagatatctgaacctaaaaccagcattgcacatattgaaatttgatgctgaaacttattacctgagcagcagcacattgtagtcatatgcttctttgcaaagttctcctataca

SEQ ID NO: 47850 - DNA, 1022 bp, Oryza sativa
acaaggtttagggtttaggtatgaatctggacaaatgattgttcaggttcatccctagaagtgggtttctccttacgggacggagggagtatatgtgatggacacaaaagttactttcgtgatgaaatcaaaggggatttgttggggcacctaatagaacatgtgtccaaatgacatgactcacttggattctaataggacatcaaagcaaaactaacactccaaagcaaccgatgaggaattgaaagaaaatcagtcccatcgcatctataaatagacaagcgcaatgaaaaccctccccatcgttcacacagttcaagcattatacagcaagaaagaaagatctagtgtcccgtagcaatgaagatcattttcgcctttgctcttcttgctattgctgcatgcagcgcctctgcgcagtttgatgttttaggtcaaagttataggcaatatcagctgcagtcgcctctcctgctacagcaacaggtgcttagcccatataatgagttcgtaaggcagcagtatggcataacggcaagccccttattgcaatcagttgcgtttcaactgagaaacaaccaagtctggcaacagctttggctggtggcgcaacagtctcactatgaggatattaacatttttcaggtcatagcgcagcagctacaactccagcagtttgatgatctctactttgatcggaatctggctcaagctccagcccaagctctgttggctttgaacttgccatctagatatggtatctaccctaggtactatagtgcacctagtagcattaccacccttggcggtttattgtactgagttttaacaatatagtggtttggaagttaaaaataggctcagatatcatcatatttgacatgtgaaactcggggtgatatatcctagtacatcgtcgtaactaattaccatcgttggtactctacaattttactgtgtgcttatattcgatccgaagctactttgtctttaagatataaatggagcgtataaaggatgtc

SEQ ID NO: 47851 - DNA, 1679 bp, Oryza sativa
cttggacattatggaatggttggattattgtggaattggattcacaccttccccctctattcaaaatcctcaaaatggttttaggctgggctcgaggtgcatcgttttgatagtagcacctcggccatataaggaccggtcttcgggcctctgttgcaaagcactaccgtacttccacatgtctagtgggtaaggcttagtttgtggctcagtctggttataaacaaaagtacacggatggagatggacgaagtcgggggtcgatggacatctctagggcaaatgaaagctacacgagctgcggcccggtagtcgagatgtcatggcacagggctggtgtcctgctgctaggggctcagtcctgcctacctgtcccggaggttccggccgtaggtggggtttggtcggtactcttgtctatggctagggtgggttggaaactatgtcatgtcttccgtccgtatgccgtggtggtatgtggcacgtggttacacgtgaggaagacatgtcttgtgggtaaagatgtacacctctgatcagagtataatctattcgaatagccgcgtcctcggttatgggcaagccgagcaatgtactcaagttagtgttttaattcttaaaacctgcttaacaactaaaatgtggaatggttggcctgggttggcttgggacgagctgggacccaaggtcgggttgccagttcggtctgaatcatcataggccttgggttaaggcaggttcgtgtgggttcacggccttgattaataatattgtatagcactaggatcgtgtttacaaagtagctttgagcaactaagtgacttttaatgctgtttactgcaaaccctaacccccttgacggagcgtggggctcctcaccgggagacctcgcaggcccccctttgccggttcggccgggagcgctaagtgaggttcttcgccctcgatctgaggaacgtcagcgagagaggaagtgcacaagacacgggcgacgtagacaggttcgggccgctgagaagcgtaacaccctactcctgtgctctggtggatctgtgtgtgaaggaatacagagagctggagagccagagagagttcaggctctagaacccccttttctctcctccctttcttctaggcctgggcctcctttttatctggtcaggggtcaccacatgggcctctagctgcctaggaaaggaaacatgctttttacaatgagggctagtctacagccggaagcgacctctgacaagcagagcacacgcctcctgccccgctcgccagctttaccggtggacgcccatttcaaccttcattcaatggccagcgacttccttgccatgcttgcgccgaagcctggactggatctgaccgggactgacataccaactccaggagttagcacgccggctccggctagggacgagtgccaggaagctctcatcattccgacgggacgaggcgaggcgtgtgacaggccgcctgttgccacctaacccgtgatctgaccggtctgtgactggtcacacgccgcgaccggtcacggaccggataagcgtgcgctgcgcggcattaaatgctgcgtggcgcgctcgtccaacccgctataaatgcggttaggtgagccccgctgtgctcacctaacccacacacgtggcgccaaaaccatagggggtcgg

SEQ ID NO: 47852 - DNA, 2899 bp, Oryza sativa
  unsure (1)..(2899): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntggttgatatagaagttgaattcaaatggatgaatgggaggatcaagtactggatgaaccgatcgaaactagggatctgaattgtattcctcatgaagttatcatttaatttcttcagaagtttaggacggtttttggaaccttgaggttgagacatcatttttagagacatcatactctaaggctgataatgtatcactttaatatggagataaatctcgtaagggtaaaaattggacatatatgaaatttgtaaaagtaaaaaagttgattatataccaaatctccatgcgtttcccctctttctacacattttgataaagatacctaatctagacttatcacttgctactcttttcccttctcgtcactactgaaaaacgatttttctgtacagcgacccatttagattgtagatggaccataactggtcgcgtctaggaaaataagctcattttcacgtgtggtccatttaagaggaccgcaagaaaaaatcgatttttctgtgcagtcctcttaaatggaccgcacgcgaaaatatgcatttttgcgtgtggacctattaagagtgccgcatgcaaaaatacccactccctcttttccctcttacccactttaaattttcccctctatctctcctctcctctctatctctttttcttctatcagtcaacaatagtggcctcactcatctgtgccctctcctctccttccgatggcagcggcaggcgtaggtgacggcggcggcacggcggcggtggaggcgtgggatccggcgggcggcggccaacccccgcatggatccggcggcaggccgccctcgccccccccctgcgggatccgcctcccctcccctccccttccttccctccccagattcggcgaaggggaggggcgttagtggtggtgcaaccagaagggagcacagatccggcggagcgcagcgcggaggccgctgccaacgagggcatgagcggtgtcctcgagcgacgacggcaatgacaaggaggaggaggaggccgcaccgctgccggaggattatggggttttcatttttttttgaaattttgtttttttcagatttttgtttttccgtgtaggcgacataagcacccgcacgcgaaaatctgattttcgcgtgctggtgcgccacccgcacgccaaaatcgcgattttttgcagaccctgggtgctggtgggctgctcacccgcacgcgaaaaccggttttgaccgcacacgaaaatctttctcgtagtagtgcgttttcgaacagtttttacatagatctagtgcaacaaggaacaatttcacccattaatatccaaaaggaaatgcctttgcagtaacaaatgggaatatttacgttgcctggggtctctataatatatgtgtcgatcaggatattgcctttacaaaggtttcattctgccgcgaaaacacttttattgcaacataaactccattgtgtgaagtcaaacaagaaattaaactataatcccagaaattctctatgaagtaggcaagagaataattgaattgatcttgggtgccttaaagtggacacaagatttgctgtaaatcttttaagtggcttcaataagttaaattactcaatcgtggttacaccactatgtagtggtggcacaaactatatgtacagtgcaagcggtactatctcaaaagtttcagtacaaagtatttggagcttatttaaaggggttaaaaggtaaagtgagaacattttcttgttactaattcctttggattaacctttaactactgtaccgacaaatccaacttttgaactacacgaacctataaaagaggacatggatttttaccgtcgtctgccatttgactattcaaaatattgagacttagagtattgagatcaagacaataaaggagtatccaaatttgattgtgtgcctcttatttctattgaaggataaatgaattgtccgtcttttctcattacctcaaaagcttatatggtcagcctatattgtcaaatatgaaacagtaggttggacttgcaatactccgtattaaggaggcataagcaaggtgatggaaaaggcagcctacctacgaaagaaatgtctcgatcgaaagcaagtcagaagccaaaaactgaagccaatctcttttatcggttcaataattgcttggaccacatgaaattccccggatacttacacaagtcgaactattttccacgaaattcttgcaagcacttacttgagcaagcaaaaaagactagctattagcccatatcggcgatagtgaactccactgctcaaaacaaatgatccaaacaagccctgaaagctccttttccccaaggcaacagctaactgaaccagcaaaatctgtctgcctctgaaagaaacaaaacaaagagaaaaaaaaaaaccctttccctcccttctcacggcactggccaacttgcaagttgcaactgatgtgaagcactcactgagactccaagcacctatatgcaggtagctctcagcacgcttgagttggtgatgccttgattcccactgttttgtccgtcaaatactactgcgacgacgacgacgatgacgatgacgatgacgatgacgatg

SEQ ID NO: 47853 - DNA, 2033 bp, Oryza sativa
tgaatgaatcagggttccagtctaaagcaaactacataacaaagataaggtttttgtaagccaaaataaaaggatgtctttgctatttgttccacaaggatgagtatgataaaagcagcttttctttacctactggcttggctactggttcctccaacaaaaagggagaataaaaagaaaaggactcgtagcatagcactatagcagtgctccctcatttgaagttacttaatttagttcattattagctgttgttcctttgcctttgttgattgatgactttttacagacaagtgacagcaattggaaattgacaaccagcaaagtcacactgatttttttttatatagcagctactaccgacaagcaaccaatttttccattgcttttggagtacaactactagtgtcaggatagaaatgtttttcattagtattttttataactagtgctagtgatctgtcaaggatgaaaaggatgcaatccttcaaaaaaaaaaaagataagtagtgcagtcctgaaaagaaaaggaggtagagttgagcaactaaatgactaatcatttgtccaacaggcaaaatgatgagaattaactgagtgcttcaaatttctgaaatcttgggcttttctaaacacaattaaatttctgaaatcctcggcttttctaaacacaattgcaactttcaaagattcacctgcaactctctgtaagtaccactgttgacactgtatgcctaatatcctgtaatcagcaatcacattacaaaaacatgtgaaagtactcaaatattaagtaggtgctatgttcatccagacgacgatgtgaggtagcttatcctttgatgtatttcaattacgaacactgaactgccaacaacaaaaaataactagtattacactgcattataagttcagattccttagaatccaattacattgttgtgcgaatttcattgagctatggattttgggaagacagaagatagaacgaataataagcaaaaggataagcagtgcctttcctaaggcaacgaaacatttcgacattgaaacaattctatggctggccatgatcttcaggttgctgatcctggcgttcaccttgccaagcccaaacaatgtccttaagagctggtttcatgtcctccttccacaaatgttggtattctagtgtatctccattgttcttcttgatttctaccaaatgaaatgaaggagtcacctcgaagatctctgcatcgattgccaatacacctttccttccttcacttgcaccttccattttcagcacaccaccttctttctttttcactgtcaacttcgaacatgaggcaacatcctctagttttgagataatagctgaagctgattgacttgatgtaaaccttgcttctttctttttatcagtctcctcaaacaagccagaaagatcaaagccttccgaaagagaaataatatcgaaagcgttaaggttggttagctttcctgcatcctgtttctcctcagtctttttgctactactgctacccatggaggagaaaacaacattaacatcagcaagagctgtaactggttcatttgtctccacgttcttaaggattagcttgctatcaagtcctttcttgaaccagtaagtttccattatttttgtaattggcattctacttcttgggtttggatcaagaattctcgaaactaattttcgtacatcagacgaaaaccaagctgggcatttgaactctgctttcccaatctttctgtacatctccatcaaatttgaatcttgaaaaggcagataaccagccatcagaacaaacaggatcacaccacaagaccatgtgtcaaccttgacaccgtcatacccttttcggctgatcacctcaggcgccacatatgcgggagttccacaagttgtgtgtagaaggccatcttgtcgtcttgattcagcaagagcgctcaatccaaaatcggtaattttcaggtttccattttcatcaacaagtaggttctctggcttcagatcgcgatgataa

SEQ ID NO: 47854 - DNA, 755 bp, Oryza sativa
ccgccgttgttgggcgtctacgtcttcaccgaccggcttgccttcgccgccgccgactggtgtttccgcctgcacggctggcctttatgccgccgtagttgggcgtctacgtcttcaccgaccggcttgccttcgtcgccgccgactggtgtcctcgcctgcacggctggcctattatgccgccgttgttgggcgcctacgtcttcaccgaccggctcgccttcgccgccgccgactggtgtcctcgcctgcacggctggcctttatgccgccgttgttgggcgtctacgtcttcaccgaccggcttgccttcgccgctaccgattggtgcttccgcctgcacggcagacttattatgctgccgttgttgggcgtctacgtcttcaccgaccggccgccgcatccgctgactggtgtcaccgcctgcacggctggcctgttataacgccaactgatgctaccttcttcacggctggctacatcgctgtcactactaataggcatcagtatcgtcaacacaagctgcctacgtttgccatggctgccgactgatttcttcacttccatggctgcatgattctgccagtgttgattggcctattatgccgctgttgttgggcatctacatcttcatcgccggtcgtctcgtctgctgctgactagtgcccttacctctacgtctggtttatacagctaccactactgatggacatcatcatcttccgtcgccgactgattatgctgccgccgattgg

SEQ ID NO: 47855 - DNA, 4006 bp, Oryza sativa
tggatgaacttccaagccccagaacagcaagccatgcaaaccatcacagattggtggagtgagctctgtaattccatacctttgttgatgatgtggtggaacatatggctggtacacaatagaattttccaacaattgttgaagaatggattctaagtcgcttttctagtgaaggaaaaaattagcctaatagtcaaggatctgtctgtttcatgatctttcaatcaatcgctctctttttttatgtaaatcaatcctcatatcttccctagatgtttttttccttttaacagacatatgtaaggctctggtttactacttcttttctcgttctaatatatccggcaaatcttctacagtttgaagtataaaaaaagaaatagtttgaatattacacccttcattttattctattcaatcaaataaaagaataaaataataaagataggagccgagactccaataaatataacatcagataggagttcagactccaataaatataacatcaatattgttgtcaagacaaccgaatatgcacaatgtgttgaactttcaaattgacagttcactttcaaattgacagttcaaattattgaaaaacttatgcaattcaactcgcttccttttcttgtctcactattaagttaagataatttcaaggttgcagcaaccgctactaaaattaatgcaaaacaacttagtcagtctacagtggcagatatgatcaaggggaaaagaggattttaatggcgtaccgtcaaaggaattatttgtgcagtggttcaatgaagaaagctcccacctttcttgtttcctgtacaatacagaacaatacagagtattaaaaacctttataaagttgctggacataggaataacaatattatgctaatgctaaaaagatcagctgaaaatgcagcataataagaagtgtaaccaacaatgaaaaaagggtttttaatagcatataaaatgaaaacggcttcaaatattgttcaacaacacagggcactaaacaattatgaaatttatgttatcatatgaaaaaaataagagtaattaaaatattaattcaaatacgtaccagatacaaaaggaaaggataattggaatgtattatgaaagtcaaatagaacctcaagcaaaactgcaaggaagttaattagagcgattagtctatgaagattagtctatgaaaatcagaattggtgagagagagacgaagacatttagcgagcgagcaacaacaccgagcatgtcattatatagcagcaatcaccggcatcggcatgtgcatctttcacatgcacatgaacatgggaagaggaagagtaagaggcaaagtaaataagtgtgtgactgttagcggaaattaaagaggattattcgtgtagttgggctagcgagctcgtcgcttgcgtgaggggaggagaagcggcacagtacggctagagcgcgcgggggaatggggaggcagcgctgtggggcgaggagaagcgaacgcagctgagcttgtgggcccgctgatggcatgcgcggcggatggggaaggagaagcgagcgctttgcctggaggtcccacggctgctgcgtgccagagatgcggaggtgaagcgcgagcagcggcaggaggagaagcgagtggatgtgtgatgcgacagtgatcctttttttttttgacttcaaagagggaattttattgattacggaagagatgattacattcttggtctatcaagtctaagattcctgcgggagcacacaacttctactccacacacgatctagacctcatagccatttgagctaaagcatgagcaatcctatttgcttccctcttgatcttgcaaacctgcacactttagagacactgcatcatccctctcgcttcctttattgtcgctgccaagggtgatctcgacagctcctgttgtgacagagccttgaacacctctacgctgtcagtttccaagattcttggcatatgaatccattccatggctgcccttaatccttctagacatgccaatgcctcagcttggacagcagtagcacaggatttttttgcacagcaaacagcactaaacccctgcagtctctaatgatgattccagcagctgaaactcctgtgtcttctataaaaccagcatccacatttacctttgctgaaccttcgggaagggcgtgccatttatcaacctgattggttgtctgaacctgcagtaatttcaccattggttcattatacattaatccttttcctttgatgtcatcgctttgttgtcggatcggcaacagtaccttctcatagttgacgaggaaatttacagactctgcaattgtggccgtcccctttccatggatcatatcattcctgaggaaccatgctctccacaacaagtacaaaacacgcgccttgtctgaactattcaagctatccaacaggacaaggagccagtcaggcccagtcatagcaaacttcctttccggcggtagcgcccagaactctctgatggcttctcgcaacgatctcgccattgtacattcaacagtcgcatggaaaccattttcctcctttacaccacagatagggcagatgcctactggttgtatccttctttttcgtttattctcccaagtgggcagcctgtcgtgagcaagtttccatgcaaaaatcttaacttttggttgaacgtctgccttccacacattctcccagagcttcctttcaccattggtagcagtacttgatgcggcctgaacttgagcactcttagttaagttccatgctactccctccgtttcacaatgtaagtcattctagcatttcctatattcatattgatgttaatgaatctagacatatatatctatctaaattcattaacatcaatatgaatgtggaaaatgctagaatgacttatattgtgaaacggaggaagtagcttataggcgcttcttactgaaaaaaggcctgttttctcatagtgccatgcaggaaagtgagatgtctcctggtttggcacatggatctttagaatagcatttgcatcttcctccgtcgcaacatgtctgattaatgcctcattccaggcgtttgttccagggatcaaaagctcatgtacatacgtgagcctattccaattcttcttctgtataacctcaactttctcaccatgcgccacccatctattcctccaaatcttggtagtccgcctgtctcctatcctccaaatcagtcctttctttagcaattccagcccatgttcgattcctttccaagttggtgaagtattggacgggaaagctgtatcagtaagggagccattggggtaatactttgctttcagcaaccgagcgcacaagctattcggctccgcgatcaacctccatgcttgacgtgctaataaagcctgattgaaagaccgagtatcccgaaagcccaggccaccatgaagcttagggctcgtgagcttttcccaggatatccaatgtactttcctctcccctttgtcatgtccccaccaaaaattgcgaaccatctattcataatcattacaaaaatgttcaggcatcttaaacactcctatcgtgtaggtggggagagcttgagctacactctttatcagagtatccttccctgcagctgatagaaacctctcacaccaatctgttaatctcttagaaaatcttcccttgattggttggaattgttctgatttcatcctaccttcgggagttggaaggcctaggtatttatcttcaaaacctgctctttgaatctgcagaacagctttgatctcctcctgcctctcctatgagcaaaattcactaaacaacagagaacactttgctgggttaataagctgccctgtgcttttctcgtatagactgagcgcctccagcaaattctcgcttgatcaacctcggcttgaaaaaacaataagctatcgtcagcaaaaagtaagtgggagatccccggggctccccgacacaccttaat

SEQ ID NO: 47856 - DNA, 9667 bp, Oryza sativa
gtggatcccccctgttttcaccctctccctcatcgtcgtcgctgtactcggcccgctctatctagctagttccactagcgggaaggatggggtcgctagatctggaggcctaggcctccccgttggccgatgtgacagcggtactgggcagcagtggaggcgactgcaaccagcggtgttggaggcgacaacaactggcgacggtggagagagaagggaggagggagaagagtgggagagagatagaaagaggagggaatcagagggaccgagggaggagggagagactcgagggagtttggtgggcagtaggtgtggtgggctgtggattttaatagcgtcaaaatttgtttcgcagcggtgccctttacttaccgctaacaaaacccgattttcgcagaggcctgcctcgaaaaatagagttggttttttatagcggacctcctaattgtccatcagcgaaaatccgttttcactggtgatttgtgatccaaaataatctaatatatttttacaagcatttgtttcgttattccgccggcaaaaataaaagggtaacgccatgaaaaattatttttatagtagtggccatctcgatattacattatattgtcgaggaggactgcaagaggcgaaggctggagagcacgagcacctgttggagattggggttgcaaccaggaagttagatggggaggggagggaagatgatcgagggaaggtagaagaaacctgctcagagattcgtgctggacgcgtgtgaaatccttccgaaggagtgaaggacgaaagtcctctgtaattttcttcagctcgagggccagtcaagcaaatcaaggcatcatttctagaggatgctacgtccggaccatagaattttaattgaaacattccttttcttcttttttttttttttgcctacagcaattttcgtgtttggttacttttcttttaggaataacttgggccaaacatttgaagtataagagattatctggttcacagaatcacagccaaacgttaactcactttaccgcgtcacaaatagtcacgtttaataaacttcgctgcctatttggttgaggtcacactggagtataacatgattctttctcttccatctatattgtttgattgcatgctcactcgagattattcttcttaatgaaataaaggacatgaactttaattaaggagctgtgttgtattgtagccctttcatgcaaccatttgggcccacacggccatagtgaacgggcaaagggagggtaaggtggacacacgcagctggtgggaaaaactcaaaaactgttcttcaccgtcacaaatttgtttggcacaagagcataattgtggagattatgggtaccccatacccacacggcatggttatccgactagtcataggggatagcttatatctatggaatatgtaaccgatcatgacttgggtattacgtttccttttatattatgaagcggcctaaagtcctgatttgataatattgtaaaatagatttaggaaaccgataccgtattggttaaggtttctatcttgtaatcctgccccccatcctatataaggtgggcaggaggccctctagggggcatgagacaacctgatcgtcagatcaatacacactcggcggattcaaatccccaaacaggagtagggtattacctctcatcgagagggcctgaacctgtctaaatcctttgtctctgcatccatccacttttaggtctcgtgcgctacccccttttattattgccgaattcatgtttcgacagttggcgcgccaggtaggggttgcgtcgagtttcctatcaacgagcgcgatggaatcaatctcatgagtcgccgacttcgctttcgctttgggagttttcacttcctttccgtcgaccacttcttcaagctcctcttctctgacttgatccaaatcagtcagggggaaactcaatctgatttttatcattatttatcatattgatttttaatctcagattaatttcttgctattttttgttgttgttcgcatataactacgcggcactattgaggcgattgatgctggtcatggactcgaggcgtctcagctttccggtcgatcggccgcgagtccactccaccggcttgtcctcgccaccgccattgctgatagcaacaacgtcttcaccgaccggctggccttcgccgccgccgactggtgtttccgcctgcacggctggtctattatgccgccgctgttgggcgtctacgacttcaccaccggcctgcctccgtcgccgccgactggtgtcctcgcctatacggtcggttggtcacaccaccgttgatgggcatcgtcatctacaccgccggcctgcctccgtcgccgccgactggtgtcctcgcctatacggtcggttggtcacaccaccgttgatgggcatcgtcatctacaccgccggcctgcctccgtcgccgccgactggtgtccccgcctacacagtcggttggtcacaccaccgttgatgggcatcatcatctacaccgccggcctgcctccgtcgccgccgagtggtgcctccgcctacacggctggcctattatgccgccgctgttgggcgtctacgacttcaccgccggcctgcctccgtcgccgccgagtggtgcctccgcctacacggctggcctattatgccgccgctgtggggcgtctacgacttcaccgccggcctgcctccgtcgccgccgattggtgcctccgcctacacggtgtttccgcctgcacggctggcctattatgccgccgttgttggatgtctacatcttcaccgttggctcaccttcgttgccgtcgactggtgtttccgcttacacggctggcctattatgccgccgttagtgggcatcttcgctttcaccgtcgaccgccttcgtcgccgccgactggtgtcttcattgttattgatggacgactttgttcccacattggccacttctgccatcaccaaggggaatattacaaagctaagtcatcatttattttattctttatatgatatttttccttttcctctgcctcactacaccaattggtcttccattgagtagtgagtcgggggctacagatgttatatcatattttttataatatttatcttgattgcttgcgacataatctgagtacaaaagtacctatcgagttatggagttctatcttcctatgctttccgtttggtttgccaatggatggttgcctttgggccgattcctagcacccgggggctcgttggatggaccgagtagcgcaaggtgctaagtattattcggaataaatcaaaagcatagagatgagataaatttattttctgctcttaataattgcaaaagtacccgagtagtaaactccgatccgtgaaactttgttccattaatgacgaactcatgtcactcatatgcatgtttgggaagtgcttaggccgactcccagtgcttggtggctatgactagttgggcagagcgtttaaacgtaatgagtcatctgctcggggaaatcaaaattgacaagaggagaaatacatatttataaatattttaaaatacttgattttttctcgagtattatatttatatcagatactactcatcctatatgtttgttttgcaggatccagatccggatatgcataaaagggattcatggctttcagcttatctcttacgctccaggaatggatcagtcagaacatcaccgaccggcttgccttcgccgccgccgactggtgtttccgcctgcacggctggcctttatgccgccgttgttgggcgtctacgtcttcaccgaccggcttgccttcgccgctgccgactggtgtttccgcctgcacagctggcctattatgccgccgttgttgggcgtctacgtcttcaccgaccggccgccgcatccgctgactggtgtcaccgcctgcacggctggcctgttataacgccaactgatgctaccttcttcacggctggctacatcgctgtcactactaataggcatcagtatcgtcaacacaagctgcctacgtttgccatggctgccgactgatttcttcacttccatggctgcatgattctgccagtgttgattggcctattatgccgctgttgttgggcatctacatcttcatcgccggtcgtctcgtctgctgctgactagtgcccttacctctacgtctggtttatacagctaccactactgatggacatcatcatcttccgtcgccgactgattatgctgccgccgattggtgcttttatcttcacaactacgcgtcttcactaccggatttctacttggacaccttcaacacatatcttcaatcaagcaatgactactcgacgacaagaagctataattctcgactctatgttcagttgtttctcaactaaccaaagagtcgggggctacacaaatataaggctcaaaatcaattaatcagccaatgagtcaactccaggagtcattatcttcatctttgcttcggagcagatgttctacttcagcaacttcaattatttcaccgacaattttggcttctcagcgctgccataatctactccaaaattctcaagtatcaagttcaagatttaatctacatgttcggaagtttggagttatcaaccaatcagctcggtttagacgagttggacaacaacatctactttcctccaagtgaagcatctacaacagctgtaacactaagttctacagtcatcttcgtaaatcaagaagcattgcattagttttctttatgcacacgctcacatcaaggaaacttctcaagcttcgatatcttctcaatggtttgatggattgttgtcactggcattatcaccagcacgtttacttcatcggccctgacgtctccgccgttgctaaggggtgactacgtcctcaccgtcggttacttttgtcatcaccgactttcatcgccgacttgttatttcgtcttcacggttggcctactatgcaactgccgatagaggatctcatcgttatcatggactgctacactactattgactagatcaacgacatggttatcttcatcaaacatcctgtcaagtctcttcaacatagcctactctgctgtcgttgatgggcaacttcgtcatcatagccggctatctctgttgccgctaatcatcattaccgtcggatgcgtttgccattgccgactattttcttcatcttcataattggtggatttcgccatcaccgttgatgcgcgtctacgtcttcatcgttggtttgcttttgtcaccaccgactgttctttcgttgttgttgggcgcctacatcttcactgctagctgacctgactgttgccgactggtttcttcacctccatggttatgcaacttcattacatttgattggtggcatctttactaccactgacatcttccgttacttctgatgagcaatttcgtcttcatgttggtcatttcatctccatgccgactgcgtcagttattgccaatagacaattttgactatgacagaaggacaagctatatgctcaggggctcatcaactcaagcgtgaggattatatctccaatttggacttgttccggatacattccacatggattcatagtcatgagtctattttctatgctcaaagactggaccaattattattccccgtaagggctatcaaccgaatacttgcgccagtcgggattcaattattatatttattttggagtatcccataagggataatcattcagatcagaagctattcatatgagctacacttggtctatattacccggaagatttattactcgggagcatgttacatgcgtcatcctttaaatggtgtcgaaggcatattttttggcctaggcctaatatgtctgcagcccatattttcaggtgtggcctgtcacgttcttttagggacttaggcacttttcgcttaggccaaagtgcgcgtaatcaagtgcccaataccttaaaatccttttataccgcagttactcaactttttaggagttggtacaatgcatcttaaaaggtgtcaaacagtaaagctttatatagctggcccgctgacttttttatatagtcatggtgctgtttgggtttttaagcaattgattggatacaatatcattgctttttgccacgtaagtgtgcatttttattgaccaatattatggcttaggctgattatatattgtggtcatttttcaggcggttggtaaatcctttatgagtttatttactcggattttataccacatatgccatatatttccaggtgtggtgggaccatgtgtcttctagggacttaagcacatctgttaaagcagtgtgcgcatggcgtatgcccaatactttggaaatttctttattcacaacatacaagcttctttatagctattttgctatgtgaattttcaatgatgtagtcagctttaggttgcacgcatcatattttacaaagcagtcggtatatcactcggatcatgttattcagggattcacaccgcatatgctatatattaatattaagtcacttgtttgactacgattatcaaaaccactcagttggtgcatctattaggtacatctactcgatgcacctgactttatttttcagccctccacagtcttcatatttggtaaaagtactcgggagatcatggcgaggatgattgaagcactcggctttggagtaatctagttcgagagaagattatctttccgactgtgaaggtctcaggggctactgtggagattatgggtaccccatacccacacggcatggttatccgactagtcataggggatagcttatatctatggaatatgtaaccgatcatgacttgggtattacgtttccttttatattatgaagcggcctaaagtcctgatttgataatattgtaaaatagatttaggaaaccgataccgtatgggttaaggtttctatcttgtaatcctgccccccatcctatataaggtgggcaggaggccctctagggggcatgagacaacctgatcgtcagatcaatacacactcggcggattcaaatccccaaacaggagtagggtattacctctcatcgagagggcctgaacctgtctaaatcctttgtctctgcatccatccacttttaggtctcgtgcgctaccccttttattattgccgaattcatgtttcgacaataatcattaaaacagcatcaacaaaaagatctaattatcacgagatttcttcagtacgagctttgatcatttggaaaggcaaagcaaggggtccatggccacgaactcctgttcggaaaaggaaaagaccaggatgcatagcatagcagtgagagagtacaattaatgatcgatagcaaaaggacgatgcgacgctacatgaaaaccaaaaaaccacaccagcacacacatgcatcaatcggcattattgacgagtgaggaccccgggcatgtaatcgtcccgtcctctgtggagtgtggatccagcatattgattccagattcagattcagctatgcaccgaatcgaaacgacgttggttgtagcgtgctgcgtgcatcgtcactgtatggtggtggttggtccaggtacgctcgctcgagattggagaaccaaccgggcgggccagacggcggtggggccgcgcgcgcgggggccatctccccgtcgcttttgccgtaaaatccaccgtcccgtccccgtcccgcagagctgggccaccggtcgactactcatacatgtcgctgtgtcgactgctcgtttgctacttacgccgagcggcgcgtgcccccgccatgtgacggttttggagcatgtactgtacaaactagtagcacaagccagcggcagtggagttctcccgtggccagacagcgcgcaccgcagagtattacaagtggcgcgctagatgctgcatgctgtctgctgctcggccgtttcctccttcctgcaacgatcgatccagatccggtccacgggtagcaccgtgcggtgtctcgctgcttgttctggggcttgcacaccaacgttacaccgcacttgtacctttgggttacgtggcaattaattatctgtcattcgttgtctatgatatatgggtccagtggtaaataatttaattattctttgggttaattattctttgagttcggggtatctcacagcttgtagcttctggggcttgcacatgcgcttggtttctttcttttttcgtcgatttgtaatatacgtttgttgagcctatagatgttctgggatattgtttgatttcgtcgattttactgcaccgattggttttccactcaaactggtttgccatctttgttctcacgttttcatcggtttccaaatttctgctcaaacaggttttcattggaaacagatcaaaattctgttgcttttttgctcaaaaccggatgttgggattcttttttctttttttttggacgaggattaggattcaaatttcgatttgggaatatttattggttcaagaatttcattattttgctgatgcacgtatccttcaaatggtactgatgtacgttcactttatcaggaaattggaatggatgagaaaggcggaactaggctctgttctgcttttattatctccatcagcaacaattcaagaagataattaacggtaatcttcctaaacaactaaaggaaggcctccacagggaattgaatctgtggttagcgtcatctcgctagaagagaaggacgaggtaaaaaaaacacataacatcaacatttaaattactaggatactgaactgtattataaagtactgatgtataaatcatttaacctccattgtgtcatagaaatatcaggcaagatcaaaaattggtgacaaaaccttgctacgctacagaaacctgagcttgtgaaaatagccgaacaaatataacgatgctctctctctctaaaaaaaatgatgctgtatgcaaaaatagttgtttccgaaggtatgcaaaaattgtattatccaagtctaatagagcttcagttggcaaaatgcagggcggtgaacaacaccatcctagttcaatttataggctgcttgagtcccttccatagatgaaccgcctgccccaatcagatactaccagcatcctggtgcgccagctgaattgcttactgcattccataagagcaaaacgccattaaaaactctacacgacacgtccatacatgcgagggaagatgaagtgcagaaaggaagacaagcatgttcagtagggtggcattattaatacctggcatagacagaataccatagccattgggtgctgtgaccaacatgtatccaatcacccggcaattgagcggctgtttgctctccacccagtggagcaaactggccaaggtgcctgtacctgtaaatcataaagggcgaccattagggactgctgtattctggatgccatgcaaaagaaatctcgtgtatcagcaatatgtgacaagattggtaggcttttgtttggtttgctccaccaactttggtttggcaatgccaattgtttttagctaccaaccagttagatgactaatttattggtgttgtcgatttcttggcatagttgattggagtcataaacaaaaaaacgggggatc

SEQ ID NO: 47857 - DNA, 2242 bp, Oryza sativa
ttgctgggagcatcttaacttgcgagtccactcgagcaagggctttcttgaattcctctatgttcagctcttttgactccttaatagcattcccgtctgaatctttgagtaggtcatggaagtccttcatttggttagttttaaggtacaactcaacctgtgggtacctttcatagatgtcgccaagaacatttttaattttcttgacagtcaaagagccagaattgtccttgtctgctacccggaaaattgaagcaatatcttcctgaatatacatatcaacacaatccattaagaatgtcagaaattcataaacaaaagtagttgacaatacatgaaatttgtttgctaaacaattactagcatttatgttaagatggcattaacactacaacaggtagatgctagatcatgtcaatcttgcctttctcacaaaaagaatttgaagtaggaactgaaaacatcctccaaaaattttgaagttggttcagaaaggaacaccacggtgtaaatctttataactataatagtgatatgtttgagatggctaaacagcttcacacaaagttgcagtctttaaaccataataatttcagcatttgtaattttttatatttaatcatatgaacttattatcaaaacaaagacttagatataattaactggcaacttaacactgaaaagggctaattgctgtacataggccactatttgaaattcaattatgctagcttagtattctagagagcaggcgatgaaacatgttaaattataattataccataacatatcgagatgttcttgccaatgacaaaatatggtgcattctttacttgaacaaaaaatatggtatctttgcattgagaagtacacacataccataacttttctttgagttattgtcgcgcaatcaccgagagcatatacatcatcacatccatgaaccctgagccattcatcagtagctagcactcgtcggtttgcctataaattaaataagtgttttaaaaacataatttagtgtaatatgttgaaatgtattctcttatgagttctgtacgagatatacctgaccaacttgcttcatgaaatccattatgaggggacgggttccaataccagtggaccaaacagccatgccataaggcacagcaatctctccagttgcagaattagtcatagtgatagccttatcagacaccttcacaaccttaaaattcgtcttcaaatctatgcctgtcctcttgaatttatcttcagcaaattgggtaattctcttgtcaaacctgcatatatagaacattaaaacttttttttgcaaagaatatcataaaactgcatcaagaaacagaattttctgaaatttgaaggcctcctacatatgtaattatcaactaaaatgcttctgatcggtaaaactaaaagggtgaaggttcaaaattactaacataaaactaaaaatgtgaatattttgcaatggttcaacaagtacaacagatctcaaggtcttacattgtaaggatatgatctccagcttcaattactgaaatattcgcatacttcttcacatcaggatacaactttgccaagtcctcattgacaaagtcatgaagctctgcagcaaattctacacctgttgggccaccaccaataacaacaaaatgaagattcttcttcctctcttcctcagttaggtttggaagggacgctctttcgaaacatttcaggacactcttcctaattttttgagcatcttctacttcctgacagaatgcacatgacgattcaattcaccatgcaaaatatgttgcaaaattgaacaacataatggatataacatactaaagaaaaagaagttatgacgaaagatggaacaaggatattctttgtttgacaaagaacaagtatatgtaaagatgtaaaagcaagtttgctgaaggtaattcagacattgaccaagagataagctgaaagagtcgtaactgataagatgataaaataaaaccgagttttgttacaacagttaatttctttcattaacctactgccttattagtactgacctttagaaaatggcagttttcaacaacaccaggggtattgaatgtattaggtctagctccaacactgacgaccaggtaatcataatctacaacaaattcactatttccatctgagtctgatctgcagtggatctttttgttagttggatcaatcttgtagcactctgcttcccaaaatc

SEQ ID NO: 47858 - DNA, 1137 bp, Oryza sativa
aaaagcacttctccaccagtgtacacaacaattaaccaaatgctcctatcttttaacatgtaaagacatgttcagaaagcaatttgggagatgttcagaatgtattctggaagaaaacatatgcatattgttttgcatgtggatgtgtacagaaaactcatcacatagtacaactgaggtgaattgaattacaatttggatcatattatcatactgtcaaaaagtcacagtaattgattcacattcagtttcagcaaaacaatacacataaaaaggcaatattcagatattactgattcagtctcagcagaatgaacaaccagaaaatttgtacaggtaccaaaaatcgattcaatcacaagcaatactgaatagacaacataacaacaaagtttcatcgaatttggttgtgcatttcacaagcagtattgaataggcctgaacgacattgtttaatgaattttctcatgtaattcacaagaaatgttatattattctaaggtcaaaacacaatagcaacaatattaaatcatggttcgttctcggtgggttcattggagacgttgtcattgtagatcttcattgttttctcgatgggagataccagcgaggatcatacccttcgcccaccttccttttctcaccttgtcctttttctaccttcttggacttgtattcttccatggaactttcaacacgctggtagccatcacatatgaactgaaacatcatcatgatggcattcacgtggccatgtaataattccccttgtttgctgtttgccttgatgaaggttgcaccttcacatcatccttagagttcattgactccttagttgtggcttgatgtggtgaaaaatcctcatcatccacatcatccatggatgccatgccttactacaatacagaagaagtaggagatcaataggtgcaaactaaagtataataatttccaacacaaaagagatagattggagaacaataccaagatgacgagttgaagttccagcagtcctatgcagccgacaatcagtggtgagtattttttcttggttcatacttgttcacccactcatatataggctaaggaggataatgttacctttgttgctatcatgatatttatggaaagatatag

SEQ ID NO: 47859 - DNA, 3041 bp, Oryza sativa
caccgccggaatcgagctcgcgccgtcgctccctctctccgccgtcgccgtcgagctccggtccgccgccgtcgtcgccccggaccacctcccacctcggcgccgcctccttcggcttcgccgcatcctcgccgacctcgtccacccctccgtttcgctcgtcgaccgccggagcaccgtcgaccccgtccacccgagccgcgccgccgccttcctccgctccggtcgccgtttccgtcgtcgccgtcgacccggggtgagccgtggaccgccgtttcgtttcccccttttccctcccctctctcggccgccgctccgccgtgcctatggccgccgccggcgaccataggggcgcaggcgcgccgcctcccgccggccgcaccgacgtggccgcctccgggcgcgcctagcggctgccgcgtggggcccggccgtcagccgcccgcgcccttaggtgcggctgacgcgtggggcccacggcgccggccggtgcgagcccgggtacgcccggtccaccgtggaccgtgaggctgccgcgtgggccccactcccgtggacccggtccgcgcgcccctcctctcggctgacgcaataaacctttttttttttaaattaaaatttaaatgaagaaattcgcaaatattcatttaaagagcatataaacttcaaatgaccataacttggccatttgaacacggaattggaccgttcaagtctctaatttttccttaagaagtcaagaacccatttttgtgctttgtttctgcttgttatatggagtttattagagtaaaagccttttctttttcgttggtcgtgtagacgctgcagcttcggaagatccgctcttcgtggaagttgaagtcgacgtttgggaaagcgagcaaggcaagtcacatcatccttgaacacattgaatcccagtttataaaattatattgatttaaattattgcattatcgctttatttaaattcccgcgttatcactgttttgtttagccatgcctatttgcctttgtatgaccttattattgttattgttattatttccttgttcaccctaggttaaagaaaaccccaactagttgacactctactcatggtaccactagtatgaatttaggtagatgcttcgctggttaattaggtaacattaggtggttttacaactctagatttcgggaatattctcatcacctggacactatggaatggatggattattcggaattggattcacacctccccctctattcaaaaccctcaaaatggttttaggctggactcggggtgcatggttttgatagtagcacctcggccatataaggaccggtcttcgggcctctgttgcaaagcactaccgtacttccacatatctagtgggtaaggcttagtttgtggctcagtctggttataaacaaaagtacacggatggagatggacgaagtcgggggtcgatggacatctctagggcaaatgaaggctacacgagctgcggcccggtagtcaagatgtcatggcacagggccagtgtcctgctgctaggggctcagtcctgcctacctgtcccggaggttccggccgtaggaggggttgggtcggtactctcgtctatggctaggttgggttggaaactatgtcacgtcttccgtccgtataccgtggtggtatgtggcacgtggttacacgtaagaaatgtcacatcctgatttttgtttcaggatttataaattatttaataaattattattagaatttatattaaatgtttattaattttcaagtgaagttaaatgtgggaaataaaatttcctaaatataaagcatggatggatttaatttttattaaattctccatggttaattatactctctggaatattctcggatttttcggagctcaattcctaattttaatcttacaaagagcatttcagtaattacccacatattaaattaatcattaaatggtctaattataattttgttaagtactttgagtgtccaagtattttcatgatttttcttgaaattatttgagcattggaagtatttttaacaattcaaagatcatttaagtgattattttaattgggaaagtaataaaatcctcctcctcagcttgggccattttcggcccattccttcctttccttcctctctcttccgccggcccaacctgtgccgcctcctctcctctcagcccagccggaaaagtctactttccctccctgagctactgttcatcttccagctcaggcagagcccgagccagccgtgccgtgcacagtgccgccgcctcctccttccaaatctcgcctccccgttgctcctttttccaatttagttgaggggaaatattcctcttatcctcctctatcttctttacccccaaaaatcggagctaatcgttgagtatcttatccgaatcgaactcgttttcgagtttatctccaaaaccgagtttttgatttcccggatcgatttcttgcgggaggagtccgatctcttcaatccaaggctataaataggaccccctagtcctcctctttcgtttgcccctctcccgtggtctcccgtgccccgtagcctctccgccgccgccgccaagttcgccgccgccgccggccgagctccatccgcgtcgcgccgccgactccgtcgtcgccgccggtcgccgtcaccactgttaggtgcgcgggagggtggagaagcccgaccgcctgacccccgaagtcgccggtcaccggagccccgtcgccgccgtcaaccgaagccgcgccgccgctagacctcgtcgccggccgtcgtcgttcgtcgtttggttcgagggtgagtaccgttgggttcgtctcgtcgtcctctacgtgtacatgtcctccaaagtcgcagccgaccatccaatctccggcgaggtcgccatcttggtccggccattgatgaggtcatcatgacgtcatcatcgtttttctttttcctgtttttctaatagattaaatcttcggaaattcataactaaatcatcgtaactcggtttcga

SEQ ID NO: 47860 - DNA, 1184 bp, Oryza sativa
gattggttaattaattacttgccaactaaaacttgataatggtgggtcgtgagcacatggttttgagagtcgtgctcatggcaattaaggaccggttcgcgagctactgttgtgaaacattaaccgtgccaaccacaagccagcgtgggcaacggctttaccttttgtatagcatggttcattgcagagcaccagactaagaagtggcggagataagcccatgggggtcgctggggagtccatgccttgttttatatgggggtgattatgatccaggaatggtgcactgtggtgagttgtgttgtgcagagggtattgtcacagcctctattcgggtactttccagtatcgcgacgcatggtagacatgatgttgaggctgtgtcttgtgggtacagtggtacacctctggccagagtaaaactattcgaatagccgtgcccgtggttataggcgggttgagcaatgtttttcgtgattagtctcacacctctcacaatatttatggatgctataactggtaataatttgtttagctccttgtttggagttagatctgtacagccgggtatggttgttcaggatggttgggcctgtgcagcatgggtgtcctgttcagtgttgattaaaatttctgattaattactccactgttttacttctcttaaatattttgctaaatgctgcttttgcaaatgagcctatattatgccatcctttggtatccttgtgcacttgcatatttgctgtgtggcttattgagtatgtcatatgctcattcttgcaataatcaatcaacctcagttgaagaaaaaggatccagaaggagaagacgtttggcttataccccagttgagctgcctgtgggagtggagctgaagccatcactagaccgttattccgctgctgtttttcttttcttttgtaagtatgtaacgttattattatgatggatttgtatattaaattgtcagtttgtgtacctcggctgattcctggacgaggattttatgcacaaattagttcggaaattattagtgaatttccgggcgtgacaagaaagatgtgtcttgtgggtaaagatgtacacctctgatcagagtataacctattcgaatagccgcacccttggttatgggcaagcctagcaatgtacccagttagtgttttaattcttaaaacctg

SEQ ID NO: 47861 - DNA, 12627 bp, Oryza sativa
acccctcggggagacagagggaggggtggccacgtctccctcgggcccgaccccccgagggggtcaggccacgtgggtgaccgcggctacccaagcctctagtcacaatacccccgaccccatgtcaccgacagttgcccccggcgttacgccagggcgatcgcctccctcgagggaagcgctcgggcgtgacgccactccttaggcccggtgacaggtggggccggtccctacaggcgggcagaaacccagcggtcgcaaatcgcgcgcatcggcaagggaaaatcgaccgacaataatgagcggcctcttcaagaccgctacattactcgagcagcgcgcgaatcgggacgagccggttcgtttcgcctggagagatgatgatggcgtttttctcggttggcgagcgtagttaatgcgcgcacgatctgccccatctcaaccgccgcggccgcgcatctgccgtgggcaccgcaaacgggcgagtggggttagtggaggcgtgggcgcgagaaacgagggggcaaggtagtgggcgcgggaagcgaggagccgggcatagcgttggcaagggtgtaaagacgccgaggaagggattcgtttccttcctctcgccactcttccccttgccttcgccacttgcgctctaactcttcgtttcctgtgtcctacccttgccgtactcgctcgctctcaagctcctcctctgccggcgtcatggcacggggctccgcaccgctcgatggtagcgtgctgccgccttcccacatcgtgagcgagaggcaggccgggctgccgcgccgattcatgccggaatctgccaccggccgggaggtggtcgcgctgggcgagggacgcccggcgccagactacccggggcggtccgtcttcttcctctctttcgcaatggcggggctggtcccgccattctctatttttttcatggatattctggagttttatgatctccagatggcgcacctcacccccaacgcgataatgacgctggccatcttcgcgcacctgtgcgagatgtttattggggtgcgcccatctctccggctgttccggtggttcttcaccgtacagccggtgtcgccgccgacggtagtcggtggctgctacttccagccgcgggggcaggtgctgaaccgctacattccctgcgtcctccgcaaaaagtgggacgactggaagagcgattggttctacactcccctcgccgacgaagcgcgccttcgacttccgagccagcccctggcgcaggcctccagctggcgggcgacggtagatctgggagacggctacgacgccgttcttgaccgcctggcgggtctgtgatcccaggggctcacgggggccatggtgttcggcgactacctgaggacccaccaggggcgcaaatgggactgggaccctgaggacttcaggatggtggtccaacgggtgctgaatctcagctccgtggaggcatccctcatcccccaaggggtcctccccctctgctgcgatccagagcgcgccaacatcctgaccatcatgcaggaggtcggggcgtcgggggagcgggccccccgaggccacgacggcgcgggcgggagccgcaggggggaacaatctaccccgggagggggtcgtgcttctgggccccgcgacgggggcccggggggcagccgccctgccgacgcccgggggaagaggaagcaggagggtacccctcccccatctcctccccgagggggcggggcggtgcgtgccagcagctggcgcccggagggtgccgtgccgacgccgcagcccgagggggagcgaaagaagaaacggctccgcaagatgggggggaccgagccatgccgggggaacctcatctcgcccccgaggtggtcgtttagccgacctccctgcaggtccgtccccgcgcccaccgcggccgcattcattctcccatctcccaacgcgagttttcactcacccgtttctttttgtcttctggtttttcttctgcctcagcgagatcccgtcgcgcccccccccccccgccattctaagtccggccggtctgaggtcgaggagacggcgaccgcggaggcccggaggcgggaagctgaccggcgagaagccgcggaccgcctccgggaagccgaggaggctgcccaggaggccgtcctaccatcgccgaggaggctgcccaggaggccgccctaccatcgccgagctgcagggcgcactggactcgtccgccggggaggtcgaggccctccgcttggcgagcgaggtagggcccggcatgcttcgggatgccgtctcccgtctagaccgtgccgggcggcaggcgggcctctggggcgggcggtacgggaagtacgccgccaaccaggggggcctcgcccagcgcctctcagagatggccgggaccctcaagcggctccccgagaagctcgaggagacgatcaagtcatcctcgagggacctcgcccggggggcggtggagctcgtactggcaagttaccaggccagggaccctgacttctccccgtgggcagcgctggaagagttccctcctggaaccgaggacggcgcgcgcgcgcaggtccgggacgccgccgaccacatcgtccacagcttcgagggtacggcccctcggctcgcgttcgccctcgactctgacgaggagggcggtgacgacggtgcggacgacagcgacgacgaggccggcgacccgggcgcgtcggagtgagcccccaggcccccgccaatcttaataacttttccttcttcttccgaggccttcgggcccccttcttgtatagactgatttaatctgtaatcaagtaaagaggaaatttctgcgtcagttctgtttgttgtgtgtatgagacgaggatggtctgtgccgcggtccttctgtgttttggcttgaacaagggctcgtgcccaggtcccagcctcaaacggcgcgggtcggggctagtgcctggggagatccacatgtcgagactggccaggccgggagcgcggtgaccgagggttatggatgacccgattgtgggcctttgccgattcccccccggagttcaccacgccccggggcacggctcggttctgggccccgtttggcgattttagccggcccgggccaccgagggcagggtcgagcacgagcgtgctaattcaagccaagattcttcaaaaggaaaatgatggcacatacacagtcctcaggaaatcgaaaatgcttttattgaaatacggaagagaaaaaaggtaagtatatgcatgtggtagcccccggccaaccctgcacgcccgggggggtgcggggttggcccgagcccgagacatgacacccgacccccactaggggtagaagcgacgaaggtgttcgatgttccacgggttaggcagctctgtgccgtcgcccgtggccagccgaacggagcccggccgggggacgccgatcactcgatacggaccctcccacattggtgagagcttgctcagtccagcacgcgtttggacgcggcgtaggacgaggtcgtcgacgcagagtgatcaggcccggacgtggcgctgatggtagcgccgcaggctctgctggtagcgcgcggctcggagggctgcgcgccgtcttcgctcttccaaatagtcgaggtcgtctcggcgaagctgatcttgatcagcctcgcaatacatggtgacccgaggggacctcagggtgagctcagatgggaggaccgcctccgcgccgtagacgaggaagaaaggcgtttccccggttgctcggcttggcgtggttcggttcgcccagagcaccgctggcagctcctcgatccacgagtcgccgtgcttcttgaggatgttgtaggttttggttttgaggcccttgaggatttccgcgttggcgcgctccacttggccatttcttctggggtgggcgggggaggcgaagcagagcttgatgcccatgtcttcgcagtagtcaccgaagagctcactagtgaactgggtgccgttatccgtaatgatacggttaggcaccccaaaccgagcagtgatgcccctgatgaatttaagcgcggagtgcttatcgatcttgatgacctgataagcctcgggctacttagtgaacttgtcgacagcgacataaagatactcgaacccgcccggggcccgcctgaacggatccaggatatcgagcccccagacagcaaacggccacgaaagaggtatggtctgcagggcctgggccgactgatgggtttgcctggcgtggaactggcacgccctgcaccgtcggaccaggtcgaccgcatcgttgagagccgtcggccaatagaaaccctggcgaaaggccttgccaaccaaggtgcgtgaggcggagtgggctccgcactcgccttcatggacatcggcgagaagctcgacgccttgttcccgaggaatgcacttcaggaggactccgttagccgcgcgccgatagagggtcccttccaccagcacgtagcgcttggagatgtgccggacgcgttcactcccttcgcggtcctcgggtaaagtcttatctgcgaggtacgcctggatctcagtgatccaagcaatcaatctaggggagctgggagcgctcccctcgggccccgaggcctggactccgacgggcctcgggggccgttcaggcgcgtccgtctcccctagggggtcgggtcgcgccgacggatgggcaagcctttcttcaaaggcgcccggtggggtctgggctcgcgaggaagcgagccttgacagttcgtcggcggccgcgttatcccgtctgggcacgtgccgaagctctatcccgtcgaaatggcgctccatacgccgcacctggcgcacgtaagcgtccatctgcgggtcagagcaccggtactccttacagacctggttaacgagcaactgcgagtcgcctaacactaggaggcggcggatccccagtccagctgctactctgagtcctgcaaggagtccctcgtactctgccatattgttggtcgcccgaaagtcgaggcggaccaggtatctgaggacgtctccgctcggcgaggtcaacgtgacccccgcaccggcgccctgaagagacatggagccgtcgaactgcatcacccagtaggcggtgtgaggcagctgcgaggggcccgagctggcctcgggggcggagacgggctcgggagctggggtccactccgccacaaagtcggcgagagcctggctcttgatcgcgtggcgtggttcaaagcgcaaatcgaattcagagagttcgattgcccatttcaccacccgtccagtaccctctcggttatgtaagatttggccgagggggtaagacgtaaccaccgtgacccgatgcgcctggaaataatggcgcaacttcctcaaagccatcagaatagcgtaaagcatcttctgggcctgagggtatcgggtcttggcgtcctggagggcctcgctaacgaagtagacgggccgctgcacctttcggtggggccgttactcttcgccaggggtcgcatctctagggcgctcttcgtccgagaggccgcgcggggcgccctcggcttctgtgccgacaacctcggggtcagagggcgacaggcgcggccttcccgcagtggccccgaggccatcctgggggtcgggggcgcctggcaccgtcggacaagcaagcggagggccaactcctgccgtcgggggccttgggccgccgttcggctcgggggcctctcctccctgctctctctcgggtcgagtcgacacagggtgaggatgcgcggagtgagggttgtcctcgtcgcgctctgtcacaccctgaaaattcaaaatatataaattgttgtttaaatggaatttttagaaataattttaaaagtcttgaaaagaaaatctaagtttaattaataaattccaatataaaattgggccagataaaatttcattaaatactttgcttaattctataattcctagatttttctgggatttatttgagctaaggaagtattttttaataaatggaattgcatttaagaaataatttaaattgaaaaagttttaaaaagtcttcttttggctttgggccgaaagtcggcccaaaaccgccttctctctcttctcggcccagtccggcccagtccgcagccgcccgcgcgcgcgcgcgccctcgcagccgctgacaggtgggtcccacctgtcaggcccgtcgtcttcctcgggccgaaaccctagtttcgcgccgccgagctgccgtcgccgccgctttccaatccggccgctcctttccgtttccggctgaattgatagaggggaaatgatcttcgggatctcctctaccttttctcctttggaaacttcggttaaatcggtttggaaatcgatggattcgagttcgaatcggatcggctttccctctctcctagccgcgagtttccttcgccgttgccgtcgccgtgggccttcgccgccgcctccgagcccctttaaaaggatccccgtgctcttctcttctcgccgccaccctcgccttcgcctctcgtcgccggagtagccctagcgccgtgtgccctagctttgccttcgccgccgccgctccagctgagcgccgccgtcgttccagccgtcgccgtcgctcgggaaggtcgccgtcgtcgtcgccaagtcgtcgccgtcctcgtccgctctttcgctgccgtcggagaccgccggagcatcgtcgccgtcgtcaagccgaagaccgccgccgtttcaacctcgtcgccgtcgccgtccgttggtcgtccgccgtcgctttggtcgtcggtgagttcgccgtgccgtccgctacccgttggtgtcctccgttcgtgccgtagcgccgccgttcgccggtgagcgtgcgccgctcgagtcgtctgcctcgccgagccgccgccgccgtcggtgacgtcattgctggcgtcatcaaggccgtccgccgtgaaccgccgtggacccgatcaatctcggccgtccgatttggattggatcaatctcggccgtccgttcgcgtgaaccgccgcccgtgcgccggtccaccaaaccctagcccgctgacgcaataaatccccttttccttttcaaaaataattcattattgcgtcataattcaattttaaaccgatttaagtgttttaatccgatttaatctttaaaaattcataactaattcatcttagctccgatttagttggttcaagtctctaaatttttctaaaattgagatctacacattaaaaatatccacatgtactgttcatgcttgtttatgtgctgttttggtgattttgcttctttttgcttagattccgtcgtttccggagagtccgttttcgcggaagaagagtttgaagagttccaaggctagcaaggcaagtcacacagatcccaaacaaccctttgagcatgttgatcctatttaaagctattgtttctattcaactattgcatctattttcgaatgtcattgggtggaattgacctattctttgttatggccctttcgtacttgattaccttattccttgataccttgggttatattaatttgactagttgagctttatttatattggttcaactagatattagatataattgcttagctctgcttagaaacattagtacacttatgggataactaatgactcactattatttcatgatggcttattgatagttcacgatggtcaatcgtgattagttaattaattaatgtgccaactaaaacctggtaatggtgggttgtgagcacatggttttgatggtcgtgctcatggcaattaaggaccggttcacgagtttcggttgtgaaacatttatcgtgccaaccacaagccagcatgggcaacggctttatcttttgtatagcatggttcattgcggggcaccagactgagaagtggcggagataagcccacgggggtcgctggggagtccatgccttgtttataagggggtgattatgatccaggaaggtgcgctgcagtggattgtgttatgcgaggggtattgtcacaactcctttccgagataccgtggtggtattgaggcacatggtgacatgatgtggggttgtgtcttgtgggtacagtggttcacctctggccagagtaaaactattcgaatagccgtgcccgcggttatgggcgggtctaacaatgtctttcgtgattagtctcacacctctcatcattataaaagatgctataactggtaataatttgattagctcctggtttggaatggtacattcctggtttggagatagaactgtgcagccggggtggttgttcagaatggttgggcctatacaacagggtatgttgtatagcgttggcttaatattgtttaattacttaactgttttatcaaattctcaaatgtttgctaaatgctgcttttgcaaatggaaccctattatgccatcctttgttatcctgtgcacttgcatatttgctgcgtggcttgctgagtatgtcatatactcaccttgcaatcattcatcagaggaagagttctacaatgaggctgatggtgtagaggattaggtgtagccttggtcaagctgcctgtggagtggagccgtctgcgccgtttatttaatttccgctgctagaactttattgattgagaggaactatctacctctgtaatgacattttattcgcttattaattagagtaatatttgtactctattatcaatttgttattgtgtgcctcggctgattcctggacgagggttcacacacatgtaagcgtttggaattttggatagaaattccgagcgtgacacgctccacgaccaacgccgcgctgaccacctgcggggttgccgccaggtagagtaacaacggctcatctggctccggggcgaccaggactgggggagaactgaggtacgccttcaattgagtgaaggcccgctcagcctcctccgtccaggtaaacggcccagagcgtttaaggagcttaaataggggttgtgccttctctcccagcctcgatatgaaccgacttagggcggccatgcagccggtgacgcactgcacatccctaagcttgctgggggggcgcatccgctctatagctcgtatcttctcggggttggcctcgatgcctcgggcagagaccacgaacccgagaagcttgcccgcaggcacgccgaacacgcacttatcggggttcagctttatgcgggcagagcggagactttcgaaagtttccgctagatccgagagtaaggtctcttggttgcgcgtcttcacaaccaagtcaccaacataggcctcaacattgcgtcctatctggctacccaaagaaattcgagtagtacgttgaaaagtaggacctgcattctttaacccaaaaggcattgtcgtataacaataagttcctatgggggtaatgaatgcagttttttcctcatcctccctagccatgcgaatctgatgataaccagagtatgcatctagaaaacacaaaaggtcgcaccccgcggtggagtcgacaatctgatctatgcgtggcagggggtaagggtccttaggacatgccttgttaaggtcggtgtagtcgatgcacatccgaagcttgccgttcgccttgggaacgacgaccgggttcgccagccactccggatggacgaccttacggatgaatccggccttcagaagtcgcgccaccttctcgcggatgaaggcttgacgttccggggcctgccgccgcactttctgccggaccggccttgcgcccagccgcacggcgagacggtgctcaatcacctccctggggacctcgggcatgtccgctggtctccaggcgaagacgtcgcgtttgcccgcaggaaggagacgagcgcgtcttcctatttgtcatccagaagaccaccgattcgtgtggtcttggacgggccgtcgcccagggcaacctccttgaccgggacctcgtcgcacgtgaccatccgctgccttggggcgtccgggacggaggtgctgagcctctcgtcgccacccgcgggcttggacaccgcggcgaggtggtccgcgcgctgctccatacaagcaagcgcgactttgaggtcgccatggacggtgatggggccaccggagcccggcatcttcatctgaagataggcgtagtggaccgccgccatgaacttcaccaacgagggcctccccaggaccgcgttgtagggcagactgaggtccgccacatcgaagtccacccgctccgtgcggaagttggcggaaccaccgaaggtgaccgggaggtcgatatgacccagcggcctggtgtgccccggcgtcacgccgatgatcggctgggacggccggagcaccatccccggggccttgatggcttcaaaggctgcgggggaaaggatgttgagggctgcacccccgtctatgaggacacgccccaacttcacattgcagacggtgggggaaaccaccatcgcgatctgtcctccccgggcaacgcacggcgtgtggtcggtctggtcgaaggtgagggcaacctccgaccaccgcgcccgccgcgtcgcctcatgggtaggggccgcggccagaagctcgcgcttcatggccttgaggctccggcgagaaacgtgagcgcacgctcccccatcgacggtggcgacggtggcctcaggctcctggaaccccaggtcatcgtcgccatcgtcgatgtcctcggcggtggccttctgcttggcctcacctcgccggttgccggcgggagccgccggggccttgccctcacagcgctcctgcctcttctcctcctcccatttcctcgtccgctcagccaaacttttgaccgcacggcagtccgcgaggtcgtggagggaggtgttgtgcacggtacaccacttgccggtcgggcgctccctgctgggagcgccggcctccttctttttgtcgctcgcaggcctcacctttcggggggcccgcgaagcgccctcgacggcgaggacatggccctcgtcgtcggaacgggccgacttcttcttcctcctcctgtcccgccgctctgaccgagcagcggacccgggggcggccggagctgccacaccagaaccggaggagttccaagtccaggcctcctccttgcgagccacacggtccgcgagctcaaaaagctgcgcggtggtctggggctccttggaggcgatcttctcgagcatgcggttgtgccgcacgccccccctgaacgcgtagatcaccacgtgtgcggggatgcacggtatggtgttgcggacttgacagaaccgctgaatgtacgagcgaagaggctcatcgtccctccgctgtaccgcatgcaagtccgcttcttcgcctgggcgcggatatgtgccctggaagttcgtggtgaactgctggcacaaatcctcccaagagtggaccgacgcgggtggcaagttcattagccaaccccacgcctgaccctttagggccatggggaagaaattcgccatgaccctgtcgtcacccccggcggcctcgatcccggtcgtgtagatctggagaaactcggcggggttgacgcttccatcgtatttttcggtgatggtgggccggaaccttgggggccaacggacgttccaaaggctcaccacaaaggctcgacagccggcaccgccaaccggggacacggagggccggcccccgcgcccggaccgaagtggcgctccgagcgaggaagcgccctccgttgcgtgggcggcgcgacgatcgtcgcgccggcgctcgatatcgaggcaggcatccggccccccacgcacatcttcttgggtcggaggcgttgacgagggaacggcggacgaacggtgcgtaacggccgccgctcgccgcgccctccgcctcgacgacctggagccggtggcggcagcgccagaggcctcggtggcggaggaccgcccgccggcgcctaggcgctgctgcgccgtcatgaccaagtcggccacatcatccagccaacgttgggccggagtctctggatcggggacgacgggcgggtgacgcaggagcgcacccgcagcctggagcgcgccctggggcgtgccgccatcgccgtagacgagacggcgacgcgccccgtctcgccgtcctcccccgtcgcccgcaggcggcgaagtcgcggatcctccgacctccccgagtgcctccccccgcccaagattttggcgagagggggacggtggggtgcgagcccgacggcgcgggttcggctcccagtcgtcaccactagcgctcggagagaggctgtgcgcctctgcccgttcggccattgggctgagcgggagaagcttggcgcacacgaaagaggacgagggcttagaaagacacgcgcgccccctacctggcgcgccagatgacggagcgtggggctcctcaccgggagaccgcgcaggcccccctttgccggttcggccgggggcgctaagtgaggttcttcgccctcgatctgaggaacgtcagcgagagaggaagtgcacaagacacgggcgacgtagacaggttcgggccgctgagaagcgtaacaccctactcctgtgttctggtggatctgtgtgtgaaggaat

SEQ ID NO: 47862 - DNA, 2818 bp, Oryza sativa
acggccgggccccacgcggcagccactcggcgcgcccgagggcggccacgccggcgctgtcggcgggaggcggcgcgcccgcgccccgatggtcgccgccggcgaccaccggcgcggcggagcggcggccgagagaggggcgggaagggggaaaggaggcgacggtccacggctcaccccggggcgtcggcggcgacggaggaggcggccggagcggagggaggcggtggcgcggctcgggtcgacggggtcgacggcgttccggcggtcggcggactcggcgagggcgtggatggggtcgacggcgttgcggcgaagccggaggaggcgacgccggcggcggaccggagctcgggggcgacggcggagagagagagcgacggcgcgagctcgattccggcgaggaggaaggggatggcggaaacggacggaggaggagcggggagggtttaaatagagccggggcgagagagggcggccgggggaaggaaggaaaccggcgcgggaggtcggccgccatcaatggcgccggcgagatttgcgggggcaaatccgcccgtttgaacgagagagagagagggaaaaatgggggaaaagggagaggggatcacgcggaatatttccccccactttattgcacgcgagggcgacgggaggcggcgggattcgcggcggcggcggcgctagggcgcgggcgaggcggcgggagcagcgggtggtcggggatgacgggtgggccccacccgtcagcgagggtggcaggcgggcccgcccgtcagcggcgcgcgcacggggagaggccgagtgggccgcggggagaggagagagagaggggggaggagagatgggccgggccggcccaagggagggaagggggacttttacggtttttctttttataaaactttttcaactttgtttatttattagtaattattatttgtgctctaaaaattccactaaaatttatttacaccttttaggcttttaggaaatatacaaaaatcccctaagccttatttgacttttaactttgcacattttaattgttggaggctttcacacggattttaattattctaggcataatttaaaggatatattttagagtcgttttgggacgtgacagtcttgctgagtacggtggttgtactcagccttgctcaatttttcccaaacccagaagagaagttcctggaagatgaaggctttggtgtctagctcgtgcctgctgtcaagcgcctgtggtcgtcgccctagtcttccgctgtttcccgtttgtctttgtgtgtgctgggccttcgccgcccatgtaataaattaattatttacgcttccgcttgataaactctgatgctgctgatggtcttcctctgattgtgagtacaccagtatgtcgtcaataaagaccacaacaaacttatccaggtattccatgaacactttgttcattaagttcatgaagaaggcagaagcattggtcagaccgaacgacatcaccgtgaattcatatagtccgtatagcgtggtgaatgcggtcttcgggatatctttttcacggatgcgcaactggtgatatccggaacgaagatcaatcttggagaatacagtggcacctttaagttgatcgaacagatcatcgatccggggaagagggtacttgttttttatagtaacttcattgagagctctgtagtcaacgcacatcctctttgtcttgtctttcttctccacaaaaatcacgggagcaccccagggggaagtgctcggccgtatatatcccttttctttcaactcttccaactgtttcttgacttcggctagtttatttgctgccatacggtagggtcgcttgtataaaggagtggttcctggagcaagatctatccggaactcaatctctcgcttgggcggcataccgggtagctcttctggaaacacatctccgaactcattgacgatgggtatttctggcaatcctagctaatgaagtactgaactgccggcggaagttgggggtgcaaagaaaacaaccggttgatcagggccccgatacagagtgacagtgcgccttgcgcaatccactactccttggaattgagccaaccaattcatcccgaggatcacatcaagttcttggtgtctagaagtatcaaatccgaggggaaaggaattccttggatttctataggaacggcagggctataatactttgttgtcataacacctccaggggtggtgatgagcagagggttcataagcctttctacccccagctgatttctccccacgaatggcacagatattgtcacgtcctgataaattcatcccgaaataaacaaatcattttctaaaaggaataatagaattaattaaaattcgaaaagaaattggcaaacactaaaatacgtacaagaaaaattcaaatgtggcccggagaatttttgctaaattctccttggtctaaaaggagccctcaaattttcgtgcaattttcagagcacaaataataattattaagaaataaacaaagttaaaatgattttataaaaagaaaaaccctaaaaatccccctttcctctcttgggccgaattcggcccatctctcccccctctctctctcctctcccccgcggcacactcggcctctccccgcgcgcgcgccgctgacgggcgggcccgcccgccatccccttcctcccgccgctcctgccgctcccccgcgccctagcgctgccgccgccgcgaatcccgccgcctcccgccgtccccgcgtgcaataaagtggggggaatcattccccgtgattccctccccc

SEQ ID NO: 47863 - DNA, 2951 bp, Oryza sativa
  unsure (1)..(2951): unsure at all n locations
aattggaccgcttcaagtctctaatttttccttaagaagtcaagaacccatttttgtgctttgttcctgcttgttatatggagtttattagagtaaaagctttttcttttccgttggtcgtgtagacgctgcagcttcggaagatccgctttcgtggaggttgaagccgacgtttgggaaagcgagcaaggcaagtcacatcatccttgagcatattgaatcccagtttataaaattattttgatttaaattaatgcattatcgctttatttaaattcccgcgttatcactgttttatttagccatgcctatttacctttgttatgaccttattattattgctattgttattattaccttgttcaccctaggataaacaaaaccccaactagtgggtaccctattcatggttccactagtatgaatttaggtagatgctttgctgattaaataggcaacattaggtggttttataacttggaatattcatatctcttggatactatggaatggttggcttatggtggaattggacatacccctctcttcctctttcaaagcccctaaaacctatttttcggtggggtttgggtgcatgccagtcgtgggaagtagcaccccggccaatataaggactaagctcgggcctctgttgcaaagcactaccgtccttccacatgtctagtgggtaaggcttagtttgtggctcagtctggttataaacaaaagtacacggatggagatggacgaagtcgggggtcgatggacatctctaggacaaatgaaggctacacgagctgtggcccggtagtcgagatgtcatggcacagggccggtgtcctgctgctgggggctcagtcctacctacctgtcccgggggttccggccgtaggtggggttgggtcggtactcttgtctatggctaggatgggttggaaactatgtcacgtcttccttccgtataccgtggtggtatgtggcacgtggttacacgtgaggaagatgtgtcttgtgggtaaagatgtacacctctgatcagagtataatctattcgaatagaagcgccctcggttatgggcaagccgagcaatgtatccaagttagtattttaattcttaaaatttgcttaacaactaaaatgtggaatggtttgcctgggttggcttgggacgtgctgggacccagggtcgggttgccagttcggtctgaatcatcgtaggccttgggttaaggcaggttcgtgtgggttcacggccttgattaataatactgtgtagctctaggatcgtctttataaaatagctttgggcaactaagtaacttttaaatgctgtttactgcaaaacttaaaccctatattattaccccttgtacccccttgcattaatcatgcatctgccggtgtggcttgctgagtactgtggttgtactcattcttgctcaatctttccccccttcagtaagagaagctttggagaagaagtcttaggtggagtcctggcttataccccagttgagcgcctgtgaagatggagccgtaggcccgctagtccgctgctgtttatttttgattgtcaggccttaagtgcctttgtaataatgtaaatattatcgatataataaagatgtgtcttttatatcatgtttgtgtgatgtaccccggcttttcctgggacggggactaatacactagcgttcgggaaaatgtatttttctcggtcgcgacaataaacgagtgggaagctctagagtcgaacaaaatggtagcagggatggaatgaatgaggaacgtaccaacgatgacgtctggagttgtcaacacatcctcggcagtcacgtggttcacacggccccgaatgacatccttaccaccgttgttggggcggggaggcgcttggccttgctggcgcctcggctttgggcatttatccgcaaagtgcccgggctcgaagcagttgaagcacagacgctgttgaccttgagcatccctgtggccttgtccaggttgcacggctggtgcaggagggcggggtgcacgggtcccttgctgattctgctgctgatgcggctgtgggacgcgcaccacgaattgaggtaagggcgcggagcgaggttgctgttgctgctgctgcgaggaggatccccttggataaggattggtgtagcggatcctttggttagcccccgttggttgcggaaattcgccaagcgacgcttgtgcgactccaattccttttgcttggcttccaggcggatgctcttgtccaccaggcgctggaaatcaggatagtccccggagaccagacgcacagacagctcagggttcatccctgccaggaatttctcctgcttctcctcatcttcacgaacatcctctggggcgtaccgggccaaattattgaactcgtgcaaatactccatcacggagcggttgccttgtttcaactcccgaaattccctcttcttaagggccatgactccggcgggcacatgggtcctccggaaggcggcagtgaaacgggcccaggtgataggctgtccctctggctgcgtagcctggaagtggtcccaccatagagatgcgggcccctgcagttggtgagcggcgaagatgactttctcctcatcattgcactgtacggtgtccaactttttccccacggcatgcaaccagtccaaagcatcaatggggttatgggagctagagaaggtaggcgggcggatgcggaggaactcgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 47864 - DNA, 1315 bp, Oryza sativa
tccgcctgcacggctggcctttatgccgccgttgttgggcgtctacgtcttcaccgaccggcttgccttcgccgccgccgactggtgtttccgcctgcacggctggcctttatgccgccgttgttgggcgtctacgtcttcaccgaccggcttgccttcgccgccgccgactggtgtttccgcttgcacggctggcctttatgccgccgtagttgggcgtctacgtcttcaccgaccggcttgccttcgtcgccgccgactggtgtcctcgcctgcacggctggcctattatgccgccgttgttgggcgtctacgttttcaccgaccggcttgccttcgccgctgccgactggtgtttccgcctgcacagctggcctattatgccgccgttgttgggcgtctacgtcttcaccgaccggcttgccttcgccgccgccgactggtgtttccgcctgcacggctggcctttatgccgccgttgttgggcgtctacgtcttcaccgaccggcttgccttcgccgccgccgactggtgtttccgcttgcacggctggcctttttgccgccgtagttgggcgtctacgtcttcaccgaccggcttgccttcgtcgccgccgactggtgtcctcgcctgcacggctggcctattatgccgccgttgttgggcgcctacgtcttcaccgaccggcttgcctttgtcgccgccgaccgatgtcctcgcctgcacggctggcctttatgccgccgttgttgggcgtctacgtcttcaccgaccggcttgccttcgccgccgccgactggtgtttccgcttgcacggctggccattatgctgccgttgttgggcgtctacgtcttcaccgaccggccgcctcgtccgccgccgaccgatgtcctcgcctgcacggctggcctttatgccgccgttgttgggcgtctacgtcttcaccgaccggcttgccttcgccgccgccgactggtgtttctgcctgcacggctggcctttatgccgccgttgttgggcgtctacgtcttcaccgaccggccgcctcgtccgccgccgactggtgcttccgccggcacggctggcctttatgccgccgttgttgggcgtctacgtcttcaccgaccggccgccttcgtcgccgccgactggtgtcctcgcctgcacggctggcctattatgccgccgttgttgggcgtctacgtcttcaccgaccggcttgccttcgccgccgccgactggtgtttccgcctgcacggctggcctttatgccgccgtagttgggcgtctacgtcttcaccgacgggcttgcct

SEQ ID NO: 47865 - DNA, 1032 bp, Oryza sativa
catatattctataacacgttaccctttgagcactcgctcgggggatatttttatctaatgttcttttctgagtgttgatttcaggaaaattctattcaacattgtcgaagacttcatgtctctgtggttctacaccaagatcgactaaggcgagtacgacaaatgttgacaaggctccgtcgtagactctgcgccttctcgatcactcaagaatggttggtggatctcaacaaggaatacggaatgaagagatggtgtacccgccaagataaaatttcatgacttcaatccaaattctcgattacagcaagacgggagacttagtcgtatgctctgtactttcttggttgacgttggagattgactcagacaaaccctttaggtgcctgcacgaggctgataaaggaaatctaacgttatctctgaactcaccgaaaacggtcacatgagctcgataacagttcctccaaggtctgctgtggagaataggaactcgttcatttgcattgaagtcgggggctactgtcagggttatggataccacatacctaatagtagttgactaaatcttagcaggacccaccacataccatgtcctatacggaaacaacctgcggatataggaggagttatggataaggaaagacaaccagagttctatatggaaacgacaaggactgctcggattgtatccatattggtttccctagttctacttggacaaggggacacttatgggtataaatacaagaccccctaggaggagaggggacacgaccacctcaatcaacaccaaccacaatcaacatacacggaacaatagaagccacaacatacaaaccaacatacaccaagacaagacgccggatatcgactttagggataagcacggctagtcccctacggtgtctctggatactgtcaggagagacgaaagtgctatctctgacctcaccgggcatgaactcgaggaggaagactaccctgttgtcgactacgagtcagacctacagaccgccatgtcgacaacag

SEQ ID NO: 47866 - DNA, 8032 bp, Oryza sativa
tttaccttgggatgctaggaatggtctttttgtgggatggagggagtacatgctgagcaatttatatttaggcatttaggtgtttacagtatccttatacgcaactttgagatggctttgctgctactgaagaaagatcttgtagttaactttgggtttccccgcaaacatcttcgcacttcacatacatttttctgcactgtacttgcactgtactgtagcattccaatgctcttttcttttatatgcatattgctatggttgcaaggacctcatcttaacgaaattttgcttcttccttttttgtttctggcttcaactaatgtgcagaaccgtcacacctatgagaagccagtgagaatttacaattgaaatcacttctgactgtgctggccccttggtggtgtcaaatctgaaagcagcaacagagagatgtagtatggagaagttaaactcgaacagggaaaagcagcaacaagttttggccatttgggtgccgtggcctctattcctttctaccggtgctgtttggatgcagaagtgcacttgatttcattgttcatgatgacaaatttttcatgattttccaccatgctttggggcaatggtgcgtgctattgaatttccttaagttgggtgtgaatgcccccttagggtagatgttgcttcatttttagagcaaagtttcggtacataagattttggtaggggggcatatgtatacagggtatagttctgactcatatcgacttcttgtctttgtgtggatgtaacaatggaaaacatcataccaatcttgctgtatggctcaattttatcttcctttcgcagaaaaaattaaccagaattactgccgcagttagtgcggcgctgggttccgtgatagtaatagctgatgtaagcgtggatatgatgtaattcaccagaaatatgaaatatcccgatttccttcgagaaacaaatatgaaatatcattgaaatgtggtacttcttttttcctgctgcttcggaaatgagtatattttgatcttcggatggttgtctcgttgatttaccttcacatgtggaattagacaattagtgttagatttggtctaagatctgctatcctggaggaaaaagattttgaattggagttttaaacactactacattctcaacccgttattgtcgtacggagtatttctctgtaaaatcgttctcaaactgtcgactgtagggttgtacatttcgtattcaattttccgtcaatggagaactacatgaggccgtacatatgctcatcccagtgaattggttagattcagcgggtcaatccgtacttctggtagacacagccgtataaattttcgtcgtcaccacaatttcttttttccttttttttaagaaacatcgtataaatgcttgtcaaacatgtgccctgagattgggtcggtatattcggtatattttgagattactttaccacaaatatcttgttataagtgaatatatcataaatggattattgtccctcgagaggtcgagggacgtcccctcgttttgtgcatgtcgttcaaaatgttactaaattttttaaaatttttttgtcaagatagatcaatatatgatatatcttttcacaaacatgcgagttaaaattcgacttatacaattcaaaacaaaaagaataaatttgactgtgaattacacattcacttcatagtcaaatttgttatttttgtttttacttgtataagttgaatttaaatttgcatgtttgtgaagtaacatatcatatattggtctatcctaccaatttttttcaaattttttaatgactttttaagtgacatgtaaaaataagtggatattcccttaaaggatgatttgagtgttccgaatatatggagtgtagaacctaaacataacatgcaagttccactataaatctggatggacaaaagttccacttccaccacaagtaactcacatgtctaataatatgtaaaaaaaattcattggtgctcacaaaaatttgtaggtggacgtgtttatactttaatgtcataaactaggtgttctttgaaaattggagttttccaagatgcaaaaatatatattaaaaaatacagcacttaaagtgcatataaacttgatttcaggaaatttttgcatcaacttatatattgacaatattgtccaaaaaattatatctcatgtcgcgtataaaatttggagtcacgcgttcgatattcttctctcgtcactacgatctcaacaaagctccagtccacttaacactgcaactcccaacctcaccaatggacaacccgacgccgtcgtcgagctccggcggtggcggcgccgccgccgccgccaatgccagctccgacgagcaccgcaagacgtcgccggcgacggccgctgatttcttcgacgaggagcacaccttcgacgatatcctgctcccggtggacttgttcgacttcacgcacggactcgacgccggcgacggctgttacgtagacgatcaggctgcgattgggcagaagccgctgtcgccggcgccggagccggcggcagagcagcagccgtcgccggcgccggagcacggcgacgatgagcggctggtgatgtactaccaaggacaggagtacatcttcgaccccgtgcagccgcagaaggtatctcttggtcttgctgcacaatgtgcttgtttcttggtaactttctacgttttttttttcattctcttccttggaaatataattatgtttcttcattctttgatcctagctagtacttgatgagtttcggctttaatttgtttgcaagaatttggttagaaggttttgctcttgtataatgtggtatatttaatttgctcttggataatttgtttcggctttaatttcattttgatcctgaaaaataaggagctctgttcttacttcttgcatttcacctaggaaaattagtagatacgcactgaaggcttttgacttaaaaaaggatcagactgttattatctccccttttgcattgttttttttgagatcactctacctttcttttgcattgacactgttagatacagtacttatgagcaacatttgtggttgctttttttaatatttgtggctctctgttggattcttttgctatgttgagttggttatcctcctgttgcattgttatgtatgcatgagcttggcatgaccaattcaatgtttgtctcttagcttgtagctaatttagaacgcgttgcactaattcttgtttcatcttttttttctctgatcattattggatagaagcagaatttcaatcttaaaatgttcttcttcgatgacaaaatttgtagtgtagttttatttttgcgtagccgctcaacacgagtatagtacttactaactccattccaaaatacaagggattttgctcggaagtagtgcatgctatccatgattcttttcctaccatgtcatgcgctcaagtcttctctgcattcttgtttccagtgcaatattgaaaaacttcactatatttattatgtattgctacagtttaccacttaaatagttaaataacatcgtattacagcactgacaatattgtgatactgttacacagattgaaaatatcttccaccatctgaatggacaggagatgattccacagagcatcaggccacaacccactaacctggtaattaaatcatctgcatttttcacaaccatttgaaaaaaataactgcattgcagatcactctctgcagcagttgtcctagcagattacaacttctctgaacttttcatcaggtaagacccatcactgttcccgaggacttcgacaggtttgctgcgctgacgcggtatagggagaaaaagaggaacatcaagttcatcaagaaggcggattacagtgcccgaaaggaagtcgctttgcggtacgcatcaaaatcttcattccgaaatgttaatttggtccgcatttgctagtacttaacaaattttggttcttgtgaatttgctcattcaggatgaaacgcagcaaagggaaatttgcacctagggttcagacctctgaaaattccttggcacacagaaaggggataactttgtaagttcttttcaacagatatatacttctgattttctgaaaccttcattgcattattgcaatgtggatgctgcttgttgatcgtatactatttttaattcatgcagctgcaccaactgtggtgaaagcagcgacgccacacccatgatgcgccatgctcccaatggaaccaaatcattttgcaatgcttgtgggttgatgtgggcgaactcggttagtgtccacatattccattccttccccttatatatcttgaaattttttttgttgaagcaaatgtttgcttgaatgtttatatgggttactgaattttctaccttcacctgcagagaaaaataagaaagatcagaaacccaacttccggggagcaagaagatcaataatactcaggatcgtttcatttcatcgatggcattcttctttgattcgagtgcattccaatcgaagtttagatgaaacagaatatagaacaacgctgatagcagctatagagacgggagagactgagagagctttgttcttgtagtttacctccggtgtgctaggcaccaagtcaatgatagtgagtagtgatgtcgtaatttgaattttgtagaggataatttaatctttgtaattgaccctgaaacctctgaatattctggatttttttaaaaagaaaaaactggctgttttcgtagcagtgacgtagaaatagtcatgcgatgcacttactatgcgggttaagtgtatttgtggtggtgtatatgcgtgtgtgttcaatgcaatgttataaaggaaaaaaataacctatcagctatggatatgtgcatgctcatccatccatgaatcccactgagcttccactgcccaagggcctgtttgtttcagctacaacataccaattttaaattttagaactaattttagttttttgtttgtcgtttttagtaactttgcttttgcttttgaattgctaaggatagaaatggaaagtcctattaaaaatattattctatatcaatcacatatcttcggaatttagagacagtcacacaaattttcttcagttttaactagaggtttagtcataggattgattcctagataagttgtatctgcttttgagctggtgttgtttaagactattttctcatcattctcctagaaacctatagacttggttcagacaagacttttgcaaggggttgtagctccctgacatgtgagttcttacctcctaaatcaacgagtcaactacggtcaacctgacacgtcagtaaaaaccgcttcccaaaccatcgaaggagtctatttgcactgtttttaagataagaaagacgttatacccggttttgtggttgaggtaggcgattcaaacagtagtaagagatgaaatagacttgtattccaaaaagaaaaggactcatcatccaaaaaggccttccaacaaggccaaggcccaaatctcctagtcctacaagcccagtagaatgttcggcccagcagcagagatccccttcccgatttcttctccatttccgttctttttttccgcggaagtcgaacagtttcagtccacagcacccgcgcaatcccccgcccatggcgacctccgccgcgcgcgccgccaagcgcgccaggatcgccgccccgccgccgccgacgccgacgccgacgcatctgcggcgcggggacggcggctacgtgccggggaacatcgtcgagatcgagctctccaacttcatgacctaccaccgcctcgcctgccgcccaggcccccgcctcaacctcgtcctcggccccaacggctccggcaagagctccctcgtctgcgccatcgccctcgccctcgccgctgaccccggcgtacgtacacacctactgcctccttacatttcccgcggcaactgtttttttcccccctcttatgcgaatacgacggctaagtgtatgaacaaatgcgtgcgtgaacggaatgcaggttctcgggagggtggccagcgtcggggcgttcgtcaagaggggggaggagtccggccatgtcaagatttcactcgcgggaacacacccgaacacattatccgcatcacgaggaagatcgataccaagaacaagtccgagtggcagctcgatggtataacctcctcctcactgcctcaccttccgtactcccgttagcactgcttgttgtgtggtccttcattctgctgagctatatatatgttaatttaaagaattatgaaaatgaaggaggcgcgtcactaatatttatttcctgcaggcgccactgtgccaagaaaggaagttgttgatctcatcaagaaattcaatattcaagttaataacttaacacaggtgtaccttcagtttatgttaccgttccctttgtttacattcgttatcattttgctttgcatcttaatcaagaggagccacttatccatttgtcgtgaacctattcctgatttctgttttcctgctcaactgtgttcagcttgaccgatccttcagcgtgcccttaattcagtgacttaataggcttggcactaaaaacttatgctcgtgtgtatatatatgtatcttctgtgttctaaacgccacgtcagtgataagtagtactgtcgtccttacgctctgaacattctatatttcttttttgaaaaaaaaaaactggttgttttcattggcatttgcgtgtatatgcttgtgatgtgtgtatatgtgacggtgtacgtgcgaatgtctcttcaaagtaataaaaaataaatggaatttgtgatggatgtgcacactctatgcttttgtgtggagctcaaactgatcttgcttcaggggtttactaacgggtacttaagggttccaagcaggtcctgtttgaaagttaagatacgctgctgacataaaatggatatctatttgattaatatgataatttagctttcaaaaataaacataaaagaactagtgttctaagcaatatagtagaatataaagcttttgaaaggatagactggcatttaggatttagaagcacaccatttatgctttgttttgaaccaaaaaaaaaagcaggaaagggcggcgttgggacccaccaactctgatgctaaaaaggaaatcaatgcttaatgtgccctgcgctgcttcttggggagaaggatgcatgcatggggtagattggaacatctgacgtgaagtcagagagacgtggtgactgaaacgtgggtcccaatgctcgcgagcctacctgtcagtgatcatgtcagggagcagttcacgttagaggatccggtttctatgagatactggaaggagaccaggtggtatagatggctagataggttgcccggtctggtctggcctatacatgactaggcccacgaccgagagcagtcagaccggcacgatacgtcctaaacgagcgggtcaggacatgtcagccaggggccctaatgggcgatcagtcgtgccccccgcgtgggacacggtcagtttttgaccctctcatctctcctctctactatatgtatacatacatatatattttatatatatacgtataaactttgtatacgtatgtatataaagtatatattatgtatacatattgcatatatttatatttttttaatatgcatatattttttatatacaaaatttgtttatgtatatatacgaaatatatcaactttatatatgtttgtatatatgtgtaatataaaaattacacatatataaactttatatacacgtatataaactttatatacgtgtttaatacgtgcatattaaaaaagggaaaaactgacaaaaatacagaaagaaaaaaaaagtgcaaaaaaagaaaccagactaaaaagatacgaaaagaaaaaaacaaaaaaaaagtgcgtaaaaaaacgaaaagaaaaaagagaaaccgcgggcgccgccgccgcaccccccc

SEQ ID NO: 47867 - DNA, 2051 bp, Oryza sativa
tatgtatgttccttggtcgtttgtaggatttacaaatgacgatcaactgaagaaaagtttctgccaaataataattaatgtcaattgtctttctggttctaaaactatttaaggtcaacaaaggcttatttctatactttacaaatgatgccctcttcactcatcgagtcaaaattgactctgtgtgtaagcttcttaggagtagcaattaacaaaagtagtagctgggttctcctgatgatgccaggtgctaatggaagtatcgtgtagtgttgacgaaggtccctcctgatgatcctccttttgaaagaaggcatgaatcaggagagtgttctcatttcaatctgggttgctgtatagctttgatgtggaatcctcttgaatcttgtttaattgctgaacttgatgtgtccattagtctgcatgataactgttgcctaatcctgttacatctttataaatgacatgctatctcttcttttcccctttgaaatattcaggaggaatctgttgaatgttcttgactttctcaagaggcccaatgcaagtgaacttgtatcagggactacagacagggtaaacctgcatgacaagttccgcaatgccatcgatatgacttatcctgggatgattaaacagcttgaacttgaagctcagcagaaggctgctgctcgcaagaagaaagtctcgttctgggaatctgcggtagatgccaatactggaggattcaagttctcattctgatttcgtttctagcagctaggtctgtcagtctgatacttgattgctgttcttggtgaaagttcgacgattttgccattccatttaaatgctcaatcacatctgatttcctacctgaattcaggtttatgagcctatgcattgtctgaatctgtcttaactgtatcatcttaaattttggaggaatgtagtcccagacatgtatttcattgttgttgttgttgtaacatgtagcttacacaataataaattgatcattgaccttgtgcaatctcctatcttgtctgacttcccagatgtggcctctaatcttgtattctgatgtggcctctaatcttgtattcttagatgttagctttggtcctttggacgccttaagttgattagtggtacatctttttgctggtgaccgggcgccgctaagtatttgactctctgcggaatcttgcttcaaactgtatcatgattcatgacagggcaatgaattagcattaccaaaaggaatagagttgtatgtttcatatagacctagtttattggattaaacatccaaatcttagctaaaatacctccattctcttttaaatgcaggcaacattagtatctttcgaccaattacaaaagtactacgtattttcttttggccaattacagaagtacatgcctttgccttgtacataggttttacttagtttaatttgcttcgtaacattaggaggaagaacgctcctcaatcttcagaaggctgcaggtgtatctgactttgttctgttaaggcttacacatcatgtacagctgcatgtttgtaactctcaattgtcaacatgacaacatgggcatacaggagatactagtagattacaacaagttacatcatgtgtataaggctctaggtacatatatgcatccatattagtctttacgccttttgctcccaaataacaactgaaatctgtacaattattccaggaagcttcagctttcagggatcactgcagctgaaaatccaacctcttgtatataccaggcagaagcaagatcccaagaggcaaaaactgctgcttgatccatgtatggctcaccaaaacaaatgtgcaatgaccatgacatgtgtgagaaggtgtttttctgtaatcgtaaaatcaatcgacggtcaaccaaatctttgtccgtatcatcctaagcaagcgttctcaaccatctgaggagcccaagaagacccgcatctagtacaggagatctttgttccagtcctggatgaggatcaaagcagcaaacaaacgtcatttttctgccaatatcagcttatg

SEQ ID NO: 47868 - DNA, 1801 bp, Oryza sativa
ggtacataagggattaggtgaactttcagtggtacacgggggattttctctaaaaaagcttatgtgtcgtcagtaaaaaacaatcgtccgactccagaaaaaaaagaaaaaatagtctcaccagtaaaaaaacaaaaaataaacagttttttttcaccggtatttttgcgacttgtttttgcacgcaaacgagttttttttgtgcgcattggttttttttcgtccatttttttaaatccgttcaccgcgcccctcctagatgcttttggttttttttgtcaatttttttcaccggttttttctcccttgcagttttggtttttctcatccggttttttaatccgatttgttcgccgcacttctcccgagttgaacctcggtgccatattgattgtgtgttttctactacaatttgattgaaaaaaatcgattcccactcctctctcatcatttctccatgattttcctagctttatttcgtcagatttaatctaatagttgccgatgatgacgctccatatcgatcgtgcgttttctattccaatttgattgaaaaaaatcgattcccactccttcctcattattttctccacgattttcctggctttattttgctggatttaatctaatagttgccgacgaacttccttaatcgtttttaccccgagtttgattttaggaaaaacggaaagagaaaatcgagtggatcaaaaaccctcaaccaattttgggtggatttgataggtcgaaggaagcaagccaaacggagagaggtagcggactggcctagggctgaaaaggaaggaaggctttcggcctaatacacaggaaagattttcattaacttttttaattataatctatagtgatcccaacattataattttcattaactttttttaattataatgtatagtgatttcaatatttcattttattactcagctcttaatatatcattgacaatcatctttacccgttgcaacgcacgagcattttttctagtaaatttaaaagtcaaggttcgaaagacataaacaaagcccatatcaagaaaaggtccacttcaccacaagcacagccacacaaccatgcaaaagcaggccgaagaaaaagcatgaatgctaattcgtgtatacgtgctagcaaacaaacttgcgcgcggtcctgaccacgtcacgacaagcaccgaggtagggttagggtttcgggagtagggaggggaagtggaggatcacagttaaagggatggcctagggaggcggtgggcagtagtggcggtgccgaagcggcgaggtcagcagcaggtggtgggctagtgttggtggcgtgggcaaagcaaggtgaagggtagggccagtgttttcctcgttttccgtcggttgccgatgcctgaagaattcaagagcgaataactgaatatacctcctcaagactcaaagttaagaccctgtttagttcccagaaacttttcgtaaaaacaacacatcgaatttttggacacatgtatagagcattaaatatagataaaaagaaaaactaattgtatagtttgcatggaaatcgcgagacgaatcttttgagcctaattaatccatgattagctataagtgctacagtaacccacatgtgctaataacgatcgacttaattagctcaaaagattcgtcttgcggttttcaggcgagttatgaaattagttttttcattcgtggccgaaaaccccttccgacattcggtcaaacgtccgatgtgacacctaaaaaattttcatttcaccaactaaacaggccctaagatc

SEQ ID NO: 47869 - DNA, 2070 bp, Oryza sativa
agaaggggagggtcaaaaaatagacaacaaccaccttgcctgacggaaagtatttttctatacctaggtgccacacctaggtgccatggcacctagatgtattcatgtaatttaaatagttgcataaaaattcattgaggaacctgatcagtaaccaggcagacagcaagctggtgaagttcagcattctagtttgatttcaccacaacatgcgagctagttactacagagcgaaatgaagtactagaaagttagcgtgattctgaaacatgaatacttggctgaaatataggaacatgcacattgactgatggtcagacacataagtacattaatgttatgtatcataaatacataattcaaacttgagaagaatacatattcttagtttcttcagacagcaaagcaatagatcagaattgtagttcagtttcaccagaaagcgtgaaatgcaacacaaattagtcatgattatgaaacatgaatacttttctaacataattgagcgcccctgtacagaaactcatatacatatcataatactagaggactctatcatgagatttcttcactcttaatttctgcagattagtccttttttgtgggagttcttttccttcaatccttgtgtagaaaaacgtcaggaacagcagctgggtcgagctcgtagcagtcatggagctttccacctttctcttttgtcagacaaaacgatggtattcgatgagaaaacctcaggctctctttcacaggaatcttcagtattccccttcgtacatcaggcttgaacacagagatgtaaccatcaactttagtcagataaccaaataatgtgaaagcttcagtggagtcgacgatcttgccaatagcatacttagtaccacgagtgctgcgggaaggaacccacttatttgaccagttcttgtagatggcccagacctcacctatctttggatgaatttgaaccttgcactttgctccaatttgtttggtttctattaaatgggagaatgcacaattttcattaaactttgtttccatgttttggatttcaaatgtaccacagctcacaggtacatcatgctccaaccagagcttctcctacgcttgttgagggcaagcctcaagccaggccaaatccgcgttgaacggttccatctcaactttgcttactagaggactcaagctttctcaatgggggcaaaagaaaatcagctacttcaggctacaaattcaaattgcaaatgaagatattctgaggttagatgtggcacaagaaagcaggttgctgaccgaccttgaacgccgactgagggctgccttgaaggggaaatgtctcgccttggcctctcttgaaagaataagagtgagacaaagagcaagaattcgaaacctcaaggagggtgatgctggcactgcctacttttacatgaagttgagggcaagaagaaggaaggctttaataccaaggcttgagcacaatggcaaagtggccacgacacaaattgacatgcaacagttagcttgcgaatactttgaaacaatcatggggcaggcagaaggtgattcaaagcaatttaacttgcagtccattcagatggctaaaggaaacttggcatcctttgatgaaaacttcactgaagaagaggtctgggcagcaataaaaaatctgccaactgagaagtcgccaggccctgatggatatacttcgctcttctaccaaaaatgctgggctgtaatcaaggatgaccttttggcggccatggggaaattctgcactggaaatagccaaaatcttgaattgttgaattcagcacaaatcacactcattccgaagaaagaagcgccaaccatgttgaaggactatgggccaattagtctcattcatagcttctccaaattggcaacaaaagtaatggcacggcggctggcaacaaggttggatgatctggtaccccacacacaaacggcattcatcaaaggcagatccatacatgaaaatttcatatttgtcaaaggtatggctcaacagttccaccggcaaaaaaaggaagttttactcctgaagct

SEQ ID NO: 47870 - DNA, 2146 bp, Oryza sativa
cctgggactgccactatctatgagaaaaccaaccaaggcagagctacaaccagtcctagacaagttagcaggcaaggttgcaggttggaagccaaaattactgtcacctgatggtcgactttgcttaatcaagagtgttctgatggcattacctgtgcacttcctatcagcgctgcaaatgccgaaatgggcggtgaaagaaattgaacgcaaatgcagaggattcttatggaagggacaagaggatgtaagtggaggacactgtctagtggcctggaaaaatgtttgtgcgccagtacagaatgggggattgggaattcgaaatctcgacgcctttggtcaagcgctaagactaaaatggttagccaaaagtcttgagcaaaaaaatcgaccgtgggccaagtcaggatataaacttggagaagacgtggagaaaatctttaactcagctgctgaattctgtgttggaaacggcaaagacacaaagttttggacagccaattggctaaatggtggaagcattgcttggcgatggccggtattgtccacttatgttggccgctcacagctgacagtggcacaagctttaaccaacaacagatgggtcagagatctgcaaggtgcactctccaatgaagccatggcacaattcttccagctctgggatgaagtacacactgtcgagctaaatctagaagaagacaccattcgctggaagctttcctctgacggacttttcactgtatcttcagcctatagccttttcttcatggcaagagagatttgccctttcagcgaacttatttggcacatcaaagctccatcccgagtgcgcttcttcctatggttggctgccaaaggtcgctgcctaacagctgacaacctgggcaagagaggatggcagcatgaagattgctgctccctttgtcagagtgaagcagaggactgcctacatctgttcgtaacgtgcgctttcaccaggagagtatggaggatgatgcagggatggattggaatcaatttcctcttgcctacagagaacgaaccagccctggcagattggtggatgaaggcgaggatggcttttcggacgggctacaggagcatcttcgacagtgttttcgcgctaacatgttggctgctggggaaagaacgcaatgcgcgtgtctttgaacagaaatttcgaagcatggaacagcttgtgcaagatatcaaggaagaggccattgtctggaagacggcaggagtgttcacaacgtgcaatagcgagatcacgtaatatgcattgtaatttgtagaagttttctagcttaccgggtcagggcttttgccccaatctgttttcgacagcatactgtcgttgtaagctctttaattgtaatgtacccttcttttcttagtgaaattggtcgaccgaacctttcggccgacccggcaaaaaaaaactttgcttacccaaccatagatgttggggaatttatcagcatcactgtaaagagcccaaatctggccagcttcaaacttatcatgcgagcggtcttgttcgatgttgtagaattctgaatcagggcatgcataacagattaattcgatatttgttttcttgtcaagagccatgtaggattcaagagtaatggaagtaaatgccgaatccaagtcacttggaagagctgcagtgtctagttccaggaacccttctgcaacacctaccctttcatttccattcgtcctatagaaggggatactgtgagaaaaacgaagtacctcacatgatgatatcgaaaaacatgactcgttcttcgctttcgcaaatagactgacaacccctgcaattctgaccagcggtgaaaccgtgacaccatcatccattgagccactggaaaggacttgcacaatatcatacccatatgattgatatctatccgctacgctccggcccaagcctcccggcgacgggcctccgctccactacggcagaagctggcctttattaagtgcaaatgaatttggatcacaactcaacaaactgcatgctccatcctttataaagagcccacacggccacccctcaccattgttaggatttatatcacacgagttaccatttttgcctgtcgacgaaacactgtggataagggctgcagga

SEQ ID NO: 47871 - DNA, 1886 bp, Oryza sativa
tcctgcagccctgcactttgaggttggaaggatcgacatgatttatccgggcataagctcttggcatgcaatcatggccatcatagactgcccagatctgatcaaccgcaatttgggagacatctctggacttgtcaaaattaaagaagtctggagaagagtaggcaatcacaggattggcagaatcaggtcgcttggagtccagccgacggaggggcgtcgttgctgtagaggccacgtgttggcattgcttgggagtcagtgaggtagtggcaagaggggcattggtaggtgctaggcgaaagccggcccaattcttgggcagcaacggcgacgtctttgggcgttgcaaccctcttgagggcgttgttgaggtgcctccctccccctcttcaaggatcctctaggtgaaaacctcatcctttcgggatgggcgatggcggcgttttgaatgtcgtgaccttcttgaaggcatcgttttggaggtggccgtgtgttcctctcggtgtggtggtgtgtaggcacgtggccgggtgtgttttctcttgtccggttcccctgtcccctgctgcttttgcctttggttgtaaatggctgttttactcctctaaatgcaaaaatacgctagaagcgtattcccaaaaaaaaaaggattggcagaattctgagaagaagtatcagtatcatctttcctatgactttgttgattgtctccatgtttttcatttccttcctcttcactgtccacttcgatggggacatgttgtttggcaaattgattctcagtaacagcaacatcatcattacatatttgctcattactccaatcagcatcagatggagaattatacttccttttcctctcaatattagagttcatagcacggctgctgtcagagctatcacagagctttctccgacccaatatctgaagactggatgatcctggagcatttgtccctgctgatacactttctccagtcaaattctgcacagcgatggagtttggatcaggactccttggtaccaaagttccgggcatatcattgtcagcaggaggcacatgagatttagcttggctaatttctgaaaattgaactctgtcacttcttgtcaccaggcctttaccttccatgtcaccagcccagccatactgttttatggattcatcagtttcttcagtatctctgatttgccaaaatcaagtctggataagggtaggcaatcactgaattgagatacttctgagcagcagtatcattaacatttttctgacaagtttgttggttgcctccatgtcttgcatttccttcctcttcactgtccacttcgatgggaacattctgtccagtagattgattatcaggaacagcaacatcatcattacatatctgctcattactcgaatcagaatcggatggacaaatatacttcctttgcctcttaatattggagttcataccatggctgctgtcagaggtaacatagagctttctcttacccaatatctgaaaactggatgattctgcagcattttcctctgcaggtgcactttctctagtcaaattcttaacagagatggagtttagatcagaactctttggtaccaaagttccaggcttatcattgtcagaagagcagatgtgagatttagtttgcttcattgctgaaaattgaatggcctcgcttcttgtcaccaagcatttaccttgttgatgctgattaccatgctgattggggacactacttcgttgaaatgagaacatttctgacggtgaaagctgagacctttttgcagcagttgataggattcttgagggcacagactgctcacgcagtttgattgcaaagaacttaccacaatcattgcagcgggccaaaaagtt

SEQ ID NO: 47872 - DNA, 3116 bp, Oryza sativa
  unsure (1)..(3116): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncacacttgtggccaactatttttaagccacactttgtgccaccatgcctcaactagcctaaacttagttacggcaaggttaggcatcaaccaaacatccccttggtcccctcaatctgcagggtcgctgttaccatcgtcgtctcctgctcacatcccaacaccaacacaaatcctccccacagctcctcccctaccgccgccaagccccttccctgccaccaccttcaagcccccattctgctgccgccttcaaaccccttgcccgtcgccgcctagccccctcccagccgccaccaagtcccctcaacgccgtcgcctagccccctccctgccgccgcctagcccgcgcaaagtgccggtgggaggggtctgttcctgactgacgcacgctcgccgccacttgccgcgccgccggatggggtttctttcgggagtgaacccgtgcacacgagaggctggaaggtttcccctacttggatatttcctaagggtaaaaaggtcaataacaaattaaaaaaaatattttctttttttctctatttctttactgccataaacccggtcccactcaattccgtctaaaccttacccttttggttaaaaaagtggggataaaaacaaaaaccctaaaaaaggtaaaatcaatattagacatggcagaaatgaaattatcccaaaatattatcagctgatagttaaatatttctacttttgagataggattgaatgtgttcatgagccaagtcctgtctttgtatcccactggtctctggcggcttccctagagcctctggttaatggatttgttgatcctatgtcaaaaagaaaatttctgcttttcagatactccctctatcctataagacatggtcaaatttgacatggtctccaaaactaatatttgtcttataatttctcatatattatagggaaaattggaaccatgccattataattttgcaaaatttgagatatgccatcctgaccatatgaaagtaaattcaaatgtgaatccaatgatatattttttagcaattaaatttaattcatattgtacttgaatgttggtcaaaatattttaaaggtagaatctggaaatgtgtggacaccttatattatgggatgggggagtaggatctaaatcaaaatcgaattctcctagattaattcaatagcatcccatttggccatttgcaaaaacttgtactagtacagttgaagccaattttgacatactattttctcttttatggattgtagtatcaaattaaagcaaactgatcatgtttgatgaaccatcattagttcaaattcaaatactcctagcattatgtttcaaatgattagtcccatttaggcccgttcgaatcctctataaatgaaggataaactttgattttcgtggtacgcttttcaaacggttaaacggtgtgtttcgtgcgaaaactttctatataaaagttgttctaaaatatcagattaatccatttttcaagtttgtaataattaaaaattaattaatcacacattattactacctcgttttacgtgaaacacttgatattcatctttatgggtctgtttggttcacagcccaaaccagccatcaagttgtggcgtcgccagagattgtggcgagagaaataatcgccacagctgtggcggaaataagcatgcaaatgaactagcaaaaagtgtggctgccacaactcacgtattaatcaaacatcagtcaaactgttgtggcagccgcatgtttggcgaggcaatgtgtggcggggatccaaacaccccctatatcttcagaaattcaaacaccaccttataagcaactttgagtgtaaaaacaaagaaaataaaaggagagctttaaccccctcctctctgccttttcccacgagtggagtgaagcggaggagaaggaagcatcgcatccgcctccgatccggcgatggcgagggcgccgccgccgctgtcgtcgttgccgccgccgccgcgccggcccacggtggtgctgcttctggggctggccctcgccttctgcctcgccgtcctctccatccagtcctcattcttcaccgctccgagtgagagcgctctcccgaaaacctagctttcgttccccttcgttgtgtgggattgatggggagggatggattctcttgcagggctggcgagtaggctggatctggactccgacgaggtccgcgcgctctcgggcttccagtcccgcgtccagcagtgcgtggtgcgtgaccccggcttgctctgtgctctcttgaattcaaataattgtcctgccatggaagccttgattgtttttaactaagcacatttctgctttgaagagatcaatttgagttcacagtaattgtggattgtgtcatagtgaagggcaggggcagtgaattagctactagtgttatactgttatggtctacccgtgtgtcgtgtccgctgaaacaaccatgaattgttcatccatgcatggtgtctttgcaatcagtcaatcgtgggatcacattattcatcaaattgctggttcttatttgttacgtttagttcttgtttgttatgcatgaatttggtcggagaaaggatgcgatttataggacaccattccataatgaacaatgaggcaatctgcaaaatggtcatctagaatctatgtgaaactcagtttcagttttagaccttctcaagtattataagttacagatttgcagcattttcctttgatcagcagtagaagtttcatttacatgttctttactctcttgcttcttttctagcttgcttctgaaatctcaactttatttaggcaagaaggggacttggcctcacagcagatattattgatcattgcaagctagtccttagatttcctaaaggaaccaacagcacttgggtaagtattccctgtcatgttcacatgcagttacttctgttaacggatttgtgtccttcaacaaaggtccactcaagatat

SEQ ID NO: 47873 - DNA, 2478 bp, Oryza sativa
aacaggttagtacatggtttatgaattatgaaatagcgtgtttattagaatatatacttatgtgttaatgctaatatgatgccagtaccgtaacatgacgactgtgttgacaagggagtacttagatgtgcgacctgatgggtggttggattatgcagccaaaaggattgcacagctgtaagtttgatacttgttgcacatttgcactattcttcgtaacgaagtgatattaatccgcatactggttaatgtgctttaaaaaatatgcagcggtgctgacaaatgctacaatcgtactttgtgcgaagagcttcttagtgttttactccctgctaagcctccttttcatcctcgccagtttgcaacatgtgctgttgttggtaactcaggggatctcttgaaaacagagtttggacaagagattgatgcacatgatgctgtgttccgagataatgaagcacctgttaataaggtaatctcattgagttcttcatatgtatctaagctaacacttcatatgtatctaagctaacttatgtgaatggcctattttagtgtgttcttgttgaccccgtaggcagctaagctcctcctgttaagttattactccattctctcttcttaatgcctaccctgaaccccttgccatcttattagcttcttgttattttaggtgtcttctatcctaactccggacatctaaaaattatattttcttctaaagttggcacagattgacactcgtttactaattttgctcttattttatctttggcctgcagaagtatgcaaaatatgttgggttgaaaagggactttcgactggttgtcaggggtgctgctcgaaacatggcgccaatactaaagggctcctgtaatgctgtaatcctggtttcttccagataacttcaatcctgatagtgttttaatttactttttcataaatgagagaaaatataatattcgtattggtgttctctattatcctcgaactattagaaagcacatggcaatgtcgttcatttctggttttcgcaacttggaagatgcctgttaagcttgcagagacaattagtattgtgcatcacttgaggactaatatattattccatacaaggacatttgtgtaataacaccagataacttttatttgtagcttaactagttcttataggaatttattatacttcacttaagttgctctcttctaataaattttagatgcatgagatcactttttatagtagtcaccactagatgagcttttaaacaggagtctaactgtcctgcttttgttgcagctgatgaggttcttattataaaaagtttgacgcacaaagaaatcaatgcggtgataaaggtaaaaggttatatgatcacatttttctttcgtccagctgagcatgttgtacaattcactatctgtctcttcttgaatcatactaatgtgaagcatgaatttcatgctgttgtgattttcttcttgttactatggtttttggggactgaaatcattcacactgaatacttggcaattgttttaactggcaggaacttccaaacccagtttatctttttcaaggcatagtcttgagaagaggtgctaaagggactggtatgaagtcaatagaattggccctttccatgtgtgatattatcgacatgtatggattcacagttgaccctaactacacagaatggtaagtcaatgcatggatgtgttatatgtagatatccatggtactattgttctctatgattttgtgcaaggatgttttatgcccacttcattgtttcaggacaaggtacttctcacccccaaggaaaggacacaatccactgcaagggcgggcttattatcaacttctggagtgccttggagtaagcctccaggctctcgcccatgttttcgtctgatttgtctatatgaagttgtcttgtctaattgctgtttcctgtatgtaggtaattcgaatccattcccccatgagagcaaagagggtagaagattggtcggatatacctagcagggaagagatcagaacagcgcatgctgcggcttttcgtttaaaaaggcatgaaactggtcaatctgatcaaatggggccatttagcaactgcaaggtatggggaacagttgacccagattacggacctgtatcaggaactccagacatgagcgaaacacgaaagagctcaaactacaagaagtgggaggtactcccattcgacagcttacgaatggaggctcaggaacaccatgtccagatgggcggcgtatctctgtacaagatggatggaaacaagctagatgatcttgtttgtgtgagacatgaacgttcatctagttaagtcagcacttaatctttgcctggagatggcatcttgaccctgtggtaatcttcagaggcatatctacttgtcagttgtaagatcacaagaggcaaaggattgaggctattctttagggtttctcatt

SEQ ID NO: 47874 - DNA, 1240 bp, Oryza sativa
ccagggaacagctttttttcaagcctctttattatctctgtcgccacaagctcctttttcttctcataatccttcctggacagaccctgtggtggatattaggaataaataactaaataagtacattggtacaaaaggcttagtttctcacaatttgaaataaattagattacagcaagagcacagtccatacttcccaatcctctatccctgcagttgtaaaaatatgaagtatatggtgtccttcgggagccaaggatgggtcaagcactgtagggatacttaaaaatatgcttccataggcttctccaattagcccagtcatcctggcaattgtaattagaattaagttattatggactaaaactgttgtgtaccaacttagcattgtgtacccattgcctgtgatatctgatacccacagtggagtcatacctacctcaagtacaaaatggtggcaatcagtatcagcaggcaaaactgaggctttgacacccatatgaatggaaaggaatgatggtgctttaacataattcttttggaagtttttctcctcttctggaagctcttcaactttcaagagtttacctttgagtagaagtaattgttatttttatggacaagtacaagtggttaacaaataataactcaagaacaaaactgagttgtgaattttgagcaaaggttgtgaaactttcagcaaataatattgtaacaaatgaatttcaacgagccgcatatttttcaaataaaaatagataagcaggattaccaaatgtatcccatctggtagcattcgatatcactgttttagcaaagaactccttcccatttgataacctgactccaacctatagtaatgaaatgctcagctaacaagtcgataaaagctccagatatttagtctaagtaagatgaacttacagctttgccattttctaaaattacattggtcacattagccttgtagcgtatttcactgcctttgtcaacaagcccatctgccaaggacatagcaataccaccaacaccaccaactggatagttaattcccccgaagtgcctatcgcacaagacctgttatttcacccttgagataacagaaatttaaatgaatcagaagcaaaattctgagagtcatgcattccacttaccatgcttgcattaatcatgggtgtttgcaaggcattgactgtgctcacaataaagcactacaaacaaagtgaataaactggtgtta

SEQ ID NO: 47875 - DNA, 4849 bp, Oryza sativa
aatacaatgggtcagctacaaaatcttgtagaggaatatatggatgcggttcttatacctagcgtcaaacattccagaggcttttgaaaaaattgcccaaaaagatatagaggctcctcagggacttcagctccaaagaatttaatgaattgaagatctgctcatatatgagaaaacaactgtacttgatatatgcttgcaaagagtgaattcaaaataccaaaaagaaaaaaaaagtagttgtagataagagtggagaatgaaaatggtatcacagtaccttccaacatgtgccatagaatttcaggattccttccttttcatgaggaaatttattaaccagctccgtgacgaagtcatcatactctctatgcacaagaactgagaggtcaccaggtaggtggaaatgaaccgtagaaggatccggtataacttccatcttatgcccaactgcttctagtgcttgtgtaatcaaattcaagttcccctggatcacagacacaaagtcatacttaagataaaatcaacactcaagagacaaacaaacattatcggccactagtcccacccacacatggcattactctcagcaacagcaatattgcacacccattcacccaggcatgcccactgccaagtgccaacctatattcctaagttggacacctgtagctgcgattttcgccatcatcgcaacattccactccaatcaggtaaagtaccttcatatcagggcattacgaggcataaatgcacttgaaaagcaataactttctcatcgtctagccaacaacatccaaatcaatccctactttcccttccccaattcttgccgtcctcgacaccgcacttcacatagtgctcccagcaatcaatcactcactcaaaaccaaattcgccaacgcaagatccccagaatatactagcagcaacgcaatcatcccaattctcatctacacccaaccgtgctcagtcactgtcctcaccttgtcggagaagccgaacatgacggaggagccgacgtcgaaggtgaacccgtcgcggcggtagtacccggagctccccccggggatgacgtacttctccagcaccagcaccctcgcccccttcgccgccagctgcgtcgccgccaccatccccccgatccccgaccccaccacgatcgcgtcgtactctcccccaccctcctcctcctcctccgccttcaccaccgtcttctccgccgccaccgcagccgccgccgccgcgcccgcgcctttcctggtccctcgtcccagtgggcgggcggtggacggccggcctactactgctccggcggcggagggagcgaggagcggggcgcacgggcgcgcggcggcgaggaggaggagcggcatggcggcgccggtgaagcgcgggagctcgagctgggtggggtttttatatgggaggagaggccgcggtggaatctgcagcgagaggattccgccgcgggaggtggtggaggttagtggagggaagacgagggcgcggcggataggcgaagtggggggccccacatggcagcgagaggccggggcgaagtgggccggtgaccgttggtgggcccgccatgggcggcgacgaggttgggctgcgcattgagcagcccatgggccccgctttgcttcgcttatcgtaattgcccacgtggcacacagtaatagcggggttagtcgggctgggaccccacgtgtcggcgacacgttcccgcgcccatttttctttacattatcctcggagacggtggccgacgtcccgttattacctctctcgaaagccgcgcccctcgcacgcgctcaccgccaccgcgctcactgacgtcgtggccccaccgcctctacccccccacaaaaggcaatctccgccgtcacctacgcctaccccaccataaaaggtcactgacaggtggtccccggagagcgggtcggggcaggcgaagcggtcaaaacgtacttaaaaggcgacccgcttgtctcactctctctctgctacagctagcctacgcggttgacatgtgggaccagctttgatggtggccccacgtgtcggtgtgtgggtaggtgggggcggcgtcggggtgacgacgggtgtctcggttggggtgagggtgggccccactggggggtggggtgagggtgggccccactggggggtggggtggtggtggccgagtggagaggaggcacgcgcttgctcgcctcgtctcacgatacctttcttctcctttccccatcgcctcctcacccagagagaagaggaggttggaggaggaggcgaagaggctagctagctagctagggtttcgtgctccccatcgcctcgcgcgcgcagccggatccgatcgggcgtcctcgtcggcgtcggcggcggtgcccctggtaaggccggatcccgatccttcccgttcggttgcggtggtgggtggtgtggggggcgtcggcgatctgggggcggttgggcgagctgggtcccttttgtggggggcgcggggttggattcctcgggttgtggggtggggtttggatgggggggaattggagacgatgtggtgtgggttgctgggcttgggtctaagtagggatgtgtttgttcgggtttggggtttgatgtggtgagaattgggggggtgttcgtgttgtgcgattaggggaattcgcggtatgctgcgtgcttttgttgaattgtgtgagaattttggattttaggtagttctattgtggggtggggggttaattgatttgggcgtgactttggatcgtgattccgggggacctgagccgtgccgtgtgaaatcgcgctgattggaagggtactcgttagaccaaattgttctgttctggggtttatgtttgatttggtcggcgtttgctatggtttggaggtattaattggagagaatttgagctggttgaggctctaccgagtaaaaatgggtcttgtgctggaactatgactatgattacatagcattacctgatagaatcattatggggcttctggaattctgatatggggaatataactttcttatttttcccatgtttggcttgatgagttttgacataactggtagtttttgttggctaatatgttcatttgctcggagtatatatcctatgaaaattggcataaatcttgcaaatctagttttcattagggatagaagttcttgaaaaaaaatgaactattgaaagggattagggaggatttgcactacagttttacaatatctcaagatcattttcaactaactcccccaagtgcaaaagatcatacttggtgactagcgagcagtgaattcgtatgcactatacagcaaatgaaaatgagtttaacaatgcattttacttggctacacaacttatctgtggtagttttttttttttggcaacttcggaaagctatactttgttaaaactgaatttgaacacctgtgccattgtttacaggctctttttttcaacaatataacatgtttgtttaagtgtatactatatttgttttcatgggatcattttggcctcagctgtgaataactgatgtgtttgctttccatcgtgaagccattttgagactttggtcaattgaagtgtttatattctaagcccttcttttctccatattctagatatcagtgttgtgattccgttgcaatggcatctggaactgatgagaaagccaagatggagggtttgacatcagctgcagcctttgttgagggtgggattcaggatgcatgtgatgatgcatgtagtatctgccttgaggcgttctgtgagagtgacccttccacagtaagatgccttatcttcaattgtatgttttttctcatatatgacattcttttaaccattttactgtgtttctttgttatgtagttgactggttgcaaacacgagttccacctccaatgcattcttgaatggtataatattgaccccagtttatgcatatcattggtgaaaattcttatatttctgctgtgcgctgtactttgtctgtctgaatttatttgagttgttcctggatcaactgcaagcatgttgacattatatatcaatatcaaactatttgggtcagttttgatttcatgtggtcagctttgcatgcttgaggttttgggtagactatcaactgttctttttctattgaggagttgttataaaattcagtgaaggaatgaaccagacttctagtacataatatcctgctctctctagggtgctaatcccatatatttgtgcattgatgaccatgatacacctactgtcaactttttacacttcttccagtttgcattaaacgtcagtgtgaccagacaatatacctaaatactttcaactatcaaagtatctacctattagtatagtttccatgtgctaatttcagtatttccatacattcctatggatgcatgcatatcatgattgtttaattttattgagattaaatttctgaaagccctactacctttggtaaaaccatcacaaaatcacattttcaagtgattgtttcacaacatttgatctttcgaaacatttgacaaaactgaactttagttatttccatcatactcaatgtacttggccccgcttgatagttactagcatatatgttccattgtgaatttggctaggtttgtgagactaacagctggtgtcgatagaatacaatgataatgcttaaaatgtaattttgtgaatcctttttttaataaataaatgaggcctgttatgaatttttttctcaagattgcagtttgcgatagctttagcaaatgtagtgctgttttatgaaaatgtactcctttattaattgaaggggtgct

SEQ ID NO: 47876 - DNA, 1367 bp, Oryza sativa
atggtcgtccacagttcttagttttttcttcgcatccaaacatgccttctgctggttcagtttcttcatcgtccgttcaaggggaagtggataatgaatcaagtcctgtccacacaactggtgaattatcactgcatgctaacacccatgaagaagcaggcaatcaaagtctgggatgcttacctacgatgctgatcaagatgctgttgtttcatctggaaatagtacccctgtatctagccctaggtttttcaacaggtaaattgagtcacctatatgcatgcactatgtccttatgttttttttttatgataaccaatatgatgatcctggtgtatcaggaggcattccactgggcaatcaactccagtaaacaacgacagagctgggccttcagatcttcagtctttctcagactctctgaagtctcgcttaaatgctgtctctatgaagtatggagttttattttcttaagttgcttcgaaagttgtctatcaacttttatgttaaatctgtttctccttttgtccgattcaggtacaaggaatctattacaaaaagtactcgaggatggaaggagagacttttttcgcgtcattcatctgtggcagatcttggttctgaagtaagaagagaagttaatgctggaattgcatccgtatcaaggatgatggagcgtctggaaactagaggtagtaatggtagaacaagtgatggcccagcaatatccacttctgaagttattcccagtacagaatcaagcaatgagagagttacagaaaacaatccaactactgcagcgacaagtagtggcaacacttctgcgtcttctgccccttgtgttacaacaaccggttcaaattagcatgttataggttccgaaagaaggcctgcacattcccattcttctccatcaaaggtactacattttcaactgaaagataattattgcgatatatgtagttttagtatgcattgcttctagacggaaggataatttatgcactcaaccgtggctgtcttaccttgtaatttagtcatttagttctagttaggttaagggttagttattggttgactctcacatttgagaaaatgccatttatgtagaaacgggaatttcattttttttttacatccaagcaagagacgctgccaacaattatgtttagttaaacaaatatggatatgggttacgtccatttattagctccaaatgattatcttagttcaactgtctgtttgctcacaactgattcatgttacacggattacaggattgccattgccaggcatgggcaggtgaccaaaagcaacgtcatgttgtcatcctcagcattgcataaatcacctccagaaaatcggaa

SEQ ID NO: 47877 - DNA, 2933 bp, Oryza sativa
tcctgcagccccgaattggttagaagaatgtgctttaaactatgaggtcatgggttcaaatcttgaatttggtaatttattttttttatttttccagaaaagaggaaacaaatgtttcagggagaaaaaaaagaaaaaaaagaaataaaaaaagagagagatcggtagagagagagaagggaggggatcgggagggagggaggggggcgatcgaaaagagagagatcggtagagagagagaagggaggggatcgggagggagggaggggggcgatcggtagagagggggagggagggagggggggcgatcgaaaagagagagatcagtagagagagagagaagggaggggatcgggagggagggaggggggcgatcggtaagaggggggatcgggagcgagagagagaaaagagagagaagggggagcgagagagggagagaagggaggggagcgagagagggtggatcgggagggaggggggatcggatgagaaggggagggggggtatagaatattcttaccacacacacacacacacacatatatatatatatatatatatatatatataatcagaatataatcatgtaagattttgttgtaaagatttaattgcaacgaacacaacggtataatcggattataaatcggataagtaatttaagagaaacttctctaagaaaaaaattgagtgtactagtattagttttttttttttggaaagaagggtgtctctctttagcactattcagctagtgctctcgatgtagtcgcgtccctaatctatcatatatatattggctacgcacaactactctctgcaggtatcttttcgcttcaaatcaggatgaacggtgagtcgttcacagcagctgtagctcgtcggtggtgaaaataatctcatgcaccaccgttcgccgttcgcttgagttcgcatgtgttctctcgtaacgaaggtagggtcgttcccatctgtggtgattttttgttagatgatacagagatatgattcgtttgttacagtataaagcacgtacaatagtcagatggaatagtccgatgggctttaaatgtaccgtggtcagatgggtttaaagttggcccaacatggcctttaaatatatatagggggggagagagagaggcggtaaccgaagacgttgttaggatcgccgtgagtttgagaaagatgtggggtacaacacaactgtcgtgtcctgaattggttgccgatctctccatatatatggatgagatcatatatcttgtttcacaacataaaccatctaattttacacaacatggaaaaaacatgtctataataaaaagtcccataaaagggaaaaataaaaaatgcgccgtctgtgaaaaagttaaaaaacacctttttggaaaacaataaccatccgattctagaaaaaaaaagagacaaaaaacatgtaaaaaaaccgttccacagaataaacaaagtatgattcaaaacctccataaaaaaagtttcctccgaaaaaacgttttcgcgaaaagaacctgttccgtgcaatgttacgctctatatatttctatctctatcaaaagcgaaataataaatttcttcttcgcattggttctcgacgtacttgttaagaaactacgggtgaaactacgggtgatgttatccacccaaaaaaaaataggaacaatggttactaatctaaccggtagagaagaggagatagctcctctctctccctttggtgtccctgtcgacaaccgacgcgatgttcctaaagatcgcatccctacggttggcaccgcttcacattgtataattgtactgttgatcaatgagaaaatatccgctcattcgctctattgtatcattcaattctctctcgctccaatcaacttcatccactttcaacggtactttttttatttttcattcgtgttaacctactttctgagtcccgtgggtgccccccgcacatcaccagattaatttacttcaggttttttcgcacgtatatatccagttcatgatcacaatttgatttgatccgtcttggtccattttgaattttttttttgtccgttggtagagatcacgtccatcgctaaggatcgaccacgtcggtgccgatcaaatacgatgcttgcggcacacaaactttccttgagctgtatgtgccaaataaaagcagcacgcaaagtcttatggaaaaagtacaaattaaccccctaactattttggtgaccgaattacccccataagctccaccatcagactttgctacgctttgaatacgggacaattacccccctcgaccgaatctacagcggctttatcctacgtggcgtacacgtggcagtctagtaagcattttattttttaaaatatagtgggacccactcgccataccttatcttcccctcttcttcttccttttcctctctctcgggttcagagtgtgcacggcgagcggcggcgcgcgggggcggatggtcggtcggcacgcggaggccagcgatggatagtgggcggcggcgtgctggggcggacgggcggttggcgcgcgtgggctagcggcggaatgcggagagggcacggcggaatgcggggagggcacggcgggcaacgggcggcgccgaggaggccaggagggtgttggaggcgacgggctacggcgacgagtcctcggctcaggcgggcgctgccgaggtcatccttcctgccggaggcagcggagagagaggtgcagagcctcttctctggttccgatgtggagtcggcgggatccacggcctccccccgtctctctctctctctctctcggctcaggcaggcggctggcgatgaatcctcctcggggagggcgcagcgagcggcgctcgtggcgcacagggcacggtgggtggcgccaacgagggcattggaggccgtgcgctaca

SEQ ID NO: 47878 - DNA, 2095 bp, Oryza sativa
ctccgcctccaccctcgccaagtcgccgtcgccctctgccatggccagaccaggccgctgcttgtcgccgccgccatggatgaggctgctgctgtggcgcatggggcagatggaagggtcgacgaggatggacggccacgcgtttcaggtctgcaatttttccccttcccttctttgcttctctcgttgacgtggtggaggcggcgcacggtccgtcgtcctggtcgtcggcatcgtggccgtccaaccacgtccgccagcgaacgcagagcaagctcgggtgaccggcgatggaggcggcgagttcgggaggtcggcggtgggggcggaggcagagcgcgtcgtccttggctcaccgcagccgcatgctctctcctctgctcaccgagagagagagatagagaaggaggagagaaaaaaacgctgataagtgggccccactagttttttttattggggcaattgtgtttttacctttgctttacgtctcaattgtgattttacccttgctttttagggttttgtgattttgcccctgcttttttgaaacgaagcatccgtctgccccggtttggacggtagtttggtgggcccgggatttccaaattaaacgaagaaagaaaatgctattataatttgtgaatgactattctacccttgcttcaatgaaacaaccaaatccccaaaccttgctgtcccgatccaattgaaaaccctagcatgctgggttgcaagcggcggcggcggccgcttacgcgacaagcggcggcgcgcggcagggaggagtggcggctcgggccagcacgcgatggagtcgggcgcgggcaagcgcggcggctccgtcagcacggcggccccgcggccgaggagcggcggctccgtcggcgcgtcggcgtttgctcggctaaaaactctgggttattacatgctttccataagttgtgagagcaggctgcaaaaacaaatagggccagctttgaggtgatctggtgatgtggtcattacttcttccacgaaattgtatgatattgttgctgcttactgctcgatccgtcgatatagatttgagctcttccagagttctccagccagtttacatctgagaaggatgtggtcagatggacagatgattctatcgtcggacaagtctcacagttggtgtttaatctgtttctgaatgcgagccagagggagattctgcaggtatttgggattgctttgggttacagatttgtaagtaaagtatagtaggcagctgaagttgtttgtttctgttgaagctaggaggacagttcttgtattttgctgaatttgatgctccgatagggctgcacctattagcgtttgaagtttggggcaattgtgtttctgcccttgctgtcaaaattttgtcaaaaatattgtgttctgacatcgtttataaactgtgttcaaattattgcgaaaattctatcaaaattgtccaaaatattgtgttatgtcaacttttataaaatttgtgaacatttaggtcccgtatgaaattcgcataaaattaacttgaaacatgtatcctgtgcaagccaaaacatgtccaggggtatatttgtccattcaccacacatttaacaccgttaccattagttaacagagtaggggcaggcaattgcttcgtttcaaaaaaacaggggcaaaatcacaaatcctaaaaaaacaggggtaaaatcacaattgagatgtaaagcaagggcagaaacacaattgccccttatttgtttttgctgactatatcgctacgtgtgtgccacgtaggatgaaaaccgcttcgaaccgtgttagggtggtaatttgtccggtattaagagtttggggtgttaaatgtcaggttttcgagtttagagggtaaatcagtcgaccgtaatagttagggggtaatttgtactttttccaagccttattggaacttaaactcctctcgtcacctagcttcttgctgctaccaagcagccaaacccaatcactgtgaatgcgacgtgctcttgacgatcgttcacgcaagatttgaggtgagagaaagtttccatgatttatccatatttttagattggttcaacca

SEQ ID NO: 47879 - DNA, 17071 bp, Oryza sativa
  unsure (1)..(17071): unsure at all n locations
ggtgaaggatagaagaaaaatgatatatgtatttagatttggttaaaaattcagatccaaagttcaagatttgatttgagagaaagtggattaaatttgattagggttgatgtttggcatgagtgatgattttgacacattttctcctgaaacatatacgacacattttctttttggtgctatatgacatatttgtaagacatgtttctgccacaatgcatggaagaacggctaacagcttctgcccacacgtcaacccacaagcatcaccatttcctctacagtttgtgcaggtgcacagagaaaattctacagagttagcaaggcaggatactatgacaaatgcagtttcagaattacacccctgaaaccatcaaatattttcagagttattccgcggttttctttccctggctctgtacagatgaagccaaaggagtcatccggactcctaatttcatcatgaataccaatcaaaccactttggtgtgctgcattccactgataacttgaaacaaactagcaatagaagcgcgctacgctgcgccgcccgaatcaattgaagtccaatatgttcgatgaataatatgcatctactattcacccatagcattggtttatgctttcgtctatatcccataaactacccttataaaaaaaatttgcacatacaaaaatagtgtataggctaaaggagaaaaccgaaaggtatcggaagtttgaataaatagaaaaaaagggcaaattacatgccaatttcaatgagtttacagaggtttcaatgctacccctttttcctctgtacgctagaatcacattggactattggatgctaaaaacagaagacctaaatgcctactggtggtccatattaaatatatgcaaagctaaaatgaacagatggaaaatgatgttttttaagtgcaacatgcaagtgcactactcaacaacaatcctccgttatgtgcagttagtgacatcagtacacctgaaaaaaaatatactacctccatcccaaaatatatcgcaattttgagctgtgtacctaaacatacctttcaagatatagggctagaagtttttacattttgggacaaaggtagtagaaaattttaatagtaatgttagtacagctaaaacagtatagtatcaaccacttatatagagagataatattttcagtttggcatcacaattctaaacacatgaaaccaatttttctaccaaaagttctagcttttttggagtggagtagtacaaagtgctgctaccacgtggcaaagtttatgagcgaaagcatgcataatcaattaaccaaagtatggatgcaataacataagccttatagttctacaatgcatatatacttcttcaggtaggttccatttttttcttccctgttccttttaagtagcaggcaaaatatacaatgtggaaacaaagagcttgtaaaagcacaacggcagcaggctacactacagtttgacgaaacagatcgactgcacaacttttaggatttaaaagtgtgctttcacaaataatgaaaaaacatgtgtaaaatagtctggtgaactaaacagtgaaataatctctctgagcacagacatgtaaaagcaaaccaactgaaagacaaaatataaaaaagattgactcatgatattgctttacctttgcatcgtaacggttaggatatgtctagcaaagcattcccattgaaccagttgatgcacccttcaaaagaaatttacgtccgtctcagatatgaacaggaaatcagctttccgtaatggatccaatccatccatgtctttttcgacctaataaaaaaagaacatagagatatgtgatgaagcatgaataaatgaaggtcattctcgagactgctaatgttttcatgactcaaaaatggaaccatacttcttttaaagaaaatgattgaggacatatcctaacagtgtgtatagtcataatcgactgataacattcttttggtgcctttcgtgcagtggcgggcccaggattttgaacttgtgtattcgaaatggcgagaggaaaaaattttgttcatacacctaaaaacctaataattggcttgtatagtatcacacactaataattatataatatatagcgtatataacataaaattgagcataagttgcacacattgatagaattgatcatcacgtgaaattgtttaacatatagaaatactaattgataaacatatcaaagtaccaacatatggaatacaaaaatgatagaaaatgataaattgggaagaaatcttacaatttagagattaacttttcgacgcttgatattttgaaaataatcgatgatgtccttgtcctggcttgcaaaaagaattccctttcaatgaatgtaaccaaacaatcattcaagcatttttgtcccatcttggttctcaacttgtttttgatgtagttcattgaagaaaagaccctctacaaactaagcaaccaagcaagtatactaaatcaatcaattgtagttccaatcctaaaatttgcattgcaattattcaaaattcgtgcttttgattcaccgtgtgtatgtggcagtgtggtggcggcgtggcccgttggcgtcttcgcggcctcggtcgtcggcggaaggcgggaaggggaggaaggcggctcagcgcccagccacccacacggccatgccgtcgccagcacaccacacgggcacacaggccacagcccacagcacgccgcgtgggcgcgcggcccgtcgctggagccggcgacgccgagtcgacgacgtgccactacctgcttggccgacggccgctgccggcgctgcgccgcagctcgcgcctccgccggtgcgcccagccggcggcgccccttccatgctgtggtgctgctcccgcgcagccgcgctggcgcggtctccggctcgctgcgacgccgccgccgcacgccgcgcccgccgcccacgccacaacacacgccgccggctgtggctgtctccaagcaaaattagggttagggtcttagggaattggggattttgggaggaggagtggaaagggggaggggagtgtaaaatttaggtccaatacagcagaaatggtaaaacaaggcccaaatgagtagtttaactctttttctttatctttttcatacatatatgaactatagagtaaatatacctattttttatccaaaatcttaggtatacatctgaatacccttgaattatagctgggcccgcccctgccttcgtgttttgtagagatggcatgaaagatacacatcaatgctagtctaaaattccatctcaagtgaatcttagggataaatgtgaaacaataaaccttgatgaggtaactaaagtagaaattaaatatttgaaatgggtgtaactcaatcatcaatgacataatggagctactgaaatggtgagaatcatttcctccattagctacttaaaagaggctaacagagcatgaatactcaattcacatcatatcacactggaagaggcattggcaacacatggatgaaaaaattcttcgtactcggcaacaccaacagaaaaaatctcttcatgcaagcaagagaaagctttaaaaacgaattggtgagatcaaatagtagagacacgaaggctatcaaagtacaatgtatatatggaagaaatttcatcagagcatatgagagcagtataataacgccggttgttatgttaccaatgtaactcagaagttgtactggatggtctttacaaaaattaagctcaattatgtagttatgttgttatacaacaatttgtgtattattcagcagatgaaatgcaagatgcatgacgacgatatacataattaaccttaatcatagaatcattatcataagattaaagatcaagcaaaatagcaatatagtctatatggctctggggaacttgaacggagctggcaatatttttcccttacatatgcaagcagtgtaagtaacattttacacttgatggtgtaaatatccatgtctaaataattttttgtataaaaagaattagtaagaatagctaatcaggttgtactggtcgaaaaagaattaaaacaataacaggagcatctgtaatatagaaacctataaagggtgaaggagatgtaacaatgtaaaataccttcgatagctttgataataataactgcatgcaacacccactaaaagtatgatctaacattgttaacgttatgataggatactttgcatagagatgaagagatcaattaaagaacacatctcaacaatatatggatttagaatacttcaagggaatataaataactctgatgtggtgacatacatatagttcttatgtagctaaaaataggaaagcaacctaggtaagttaaaaatgcgaggcgactgatagagaggattttgacattgaactcataaatcccttccctaagaaatgtgccatcacttgctatatacttttttgcttgtctgatgcaccctactgacatttttatgatcatattagacataaaagactaatgaattaccttcagtcacttactgattgtactttgagataccggccgatcaatgcagtaaacatttacccaatcaagttaattaacatgtaaagcaaagcagaatgggtatctacatccaagtggtgtatgtgtatttgcaggaaaaggtattaattagcaaacagacttacatatgtgatcctttcgtttatgcttccaaaaataaatgcaggcctgcacataaaaaaagttttgaatcaacggaatatggccttctaacaatgaaatctgtgcttcgaaaaatagatgcaggcctgcacataaaaaggagttttgaatcaacgaaatatggccttctaacagtgaaatttcagaagcataatgcaggcaaagcatttataacctcatatcttcagacttattgaccatgcaccacagaaaaatcaagtagaggtttctgttagatagatctcccacccgtacggcccaacggcacaacggaccttgaccgcgccctaatcgggggcgtccagcccaatggctggtgggctgtcacgtcctgataaattcatcccgaaataaaaatcattccctaaaaggaataatagaattaattaaaattcaaaaagaaattgacaaacactaaaatacgtgccagaaagattcgaatgtggtccggagaatttttgttaaattctccttggtctaaaaggagccctcaaattttacttgaattttcagagcaccgaaaatatttattaaacaacaacaacaattaacaaagtttattaaaaagaaaaagctaaaaataatccccctcctccctttgggccaagtctggcccaaagtctccctctctccccctcggcccgcagtccaagtccctctcccctccctttgtttttctctctttcctcccggcagcccactccctcctcctccttcctcccggcctgcctcggcccagcagcccggcccaagccaggtcgagccgagccagccgcgtgcacgcgcgccgcgcgtgcgctgactgcgcgcgctgaccgcgtggggcccacgcgccggtcgtcttcctcctcccgcacggcctcctctctctcccgtgaaaaccctagttcgttcctccctcgaatccgcgcgatttaagcgttggattccaaaattaattggggagaattaatcccctttccttcctctcccttttcccaataatctcccctttaatcgtgcactattttgaccggaacggctgcgccattcatggccgtcttccatggccgccgggcgccttttccgccgtcgttccccgctcctcccgtgctcggctcgcttccctccgctataaaacggaaccccctcgctccgttctctcgttttagccccctcccgcgccctccccgtggctgcaccacctctccccgcctcctccttctctttcctcggtgccggccaccctccagccgcccctaccgccttgcccgagcgccggtcggccgtgccggcgcctcctccagcgtcgcagccgcctcctctgcgccggcctgccctctgttgcccgcggaggcctccggaagtgcatccccgccggcaacagtggcgttgccgccactgttccgtcttcggccggctgctgttcatcgccggtacgccgaccgacgtcgccatctcctccgtcgacgtcgcagccgcctcctctcccccagtcagcccttcgtttcgcggggaaaccactggagacgcgtcctcaccggcaaaacagtggcgttgccgccactgtaccgcctgtgccgccttgccggtgcagcggctgtcgtcatcgccatcctccctcgacgtcgccgcgtcgccctccaccctggcctgccctcggtttcgccggaacgccgttgcccgcgtcggtctcgccctccgcctcgccggagttccttcggcaaccccttccgctgtgcccgtgcgccggccgacgtcgccatctcctcctccggcatcgcagcgtcaaggttgccctcggcctcgcctcccctccatccgaaccccgccggtgttcgttatcgtcgtctctgttcgtcctcgttgacgactcctccggtcggtcgttcgtcctcgccggctcgtcgtctcgctgcgccgccaccctcgtcgtcatcatagcggcgtgttccgcgccgtcctcgtctccgtgcagctgctgccggctgccctcatcgcctcctcgccggttcctgtcgttgtcctctcgtcgttcccggtcgtcgtggcattcgtccctccgtcaagccgttctcgtccgtcgtccgtgtccgtcaagtgtgccgctgcagccccgtcgttgtcttcgtcctcgcctccgcgtcgccaagcgttgcgccggccgcgtctcgccttcgtccaaggatcgccgccgaagtcgtcccctcgcctttcgtctccgtcattcccggccgtctccgccgcgcccgttcatcgttgtcgttccctcgcctcgtcgcgtggtggtaaggatctctccttcgctgccccgtcctcgtcctttcggtatcgcccgtgcccgttgtgcggttgtcgaccccggtacccgtgtaccggtgtcggtagttgttcgcttgtgcgtgtggtgaccgtgttagtgtgcccgctcggtagccgcgtggtttccacgtgtgcagcccgtgtggtgtctagtggagtccgtttgtcggccactcgcctcggttgacacacgggatctgcttccgtcgacccgtggactgtctctgtgtactcggtctaccgcggtcctttaggttgacatgtggggtccgcatgtcaacggcgcagccttcctgtcttttccaggctagcgcttacacatgttttatagttgcaaaacctaattataataatccgcaaatctccatgtaacagcattaaacttcggatgatcatatcttggtcatacgagctctgaatcgatccgttcaagtctcctaatgtttgttataacctaaagaaccctgtgctttctttttatgtattgttattgcttctttataggcttgtagctttgcttgtgtgcttcgcgtagtcttcgtcgttccggaggttcccgaagcgtggtttgcggtcgtcgccgaaggttcggaaggccgttatctctgagcaaggcaagtcacatcatccttaagcatattgaatcccagtttataaaattattttgatttaaattaatgcattatcgctttatttaaattcctgcgttatcactgttttatttagccatgcctatttacctttgttatgaccttattattattgctattgttattattaccttgttcaccctaggataaacaaaaccccaactagtgggtactctattcatggttccactagtatgaatttaggtagatgcttcgctgattaattaggcaacattaggtggttttataactttagactttgggaattctcatatcatttggatactatggaatggttggcttatgttggaattggacacacacctccccctctattcaaaacccccaaaatggttttaggctgggctcgaggtgcgtggttgggttttgttagtcgtacctcgggtactataaggattaagctcgggcctctgttgcaaagcactaccgtacttccacatgtctagtgggtaaggcttagtttgtggctcagtctggttataaacaaaagtacacggatggagatggacgaagtcgggggtcgatggacatctctaggacaaatgaaggctacacgagctgcggcccggtagtcgagatgtcatggcacagggctggtgtcctgctgctaggggctcaatcctgcctgcctgtcccggaggttccggccgtaggtggggttgggtcggtactcttgtttatggctaggatgggttgggaactatgtcacgtcttccgtccgtataccgtggtggtatgtggcacgtggttacacgtgaggaagatgtgtcttgtgggtaaagatgtacacctctgatcagagtataacctattcgaatagccgcgccctcggttatgggcaagcctagcaatgtacccaagttagtgttttaattcttaaaatttgcttaacaactaaaatgtggaatggttggcctgggttggcttgggacgagctgggacccagggtcgggttgccagttcggtctgaatcatcgtaggccttgggttaaggcaggttcgtgagggttcacggccttgattaataacactgtgtaactctaggatcgtctttataaaatggctttgggcaactaagtgacttttaaatgctgttttctgcaaaacttaacccctatattattaccccttgtacccccttgcattaatcatgcatctgccggtgtggcttgctgagtactgtggttgtactcattcttgctcaatctttcccccccttcagtaagagaagctttagagaagaagtcttaggtggagtcctggcttataccccagttgagcgcctgtgaagatggagccgtaggcccgctagtccgctgctgtttatttttgattgtcaggccttaagtgcctttgtaataatgtaaatattatcgatataataaagatgtgtcttttatatcatgtttgtgtggtgtaccccggcttttccttggacggggattaatacactagcgttcgggaaaatgtatttttctcggtcgcgacatgggcccccgtcacactgcgccatataaaagaggggtggaggccggcacggcacaagggacgagattcaccgccgccgccaactccaccctacaaaccctaatccgatcgagaggggccgtagccagtgacgggaaatgccaccgccgcgccacgacctcgccgggatcgcccacgaccaccgctgttgcagccgtcatcgccgtcgacctcaccggcgccgcatccatgacaaccgagtgccaacgacgacgatggccggcacttcttcatcctccaacacctcaaccggtcggtctatctaaatcctctcccgttttcaatctctatagttcaaacatcaatcccaaatagaaccacccgactagatctaacctttttcccgcgcgcgccaaaaggccgtgggccaccgggaaaaagtttaaattaggtccctcggggggccgaaaaagaaaggaaaggaatagtagcatttttccttttaaattttgtcaatttttcatgcaaatttcaatagaattttgaatagatttttgcatgttttacctctgtttaaatttgaaccaacgggagaatttttacagagagtaaattacagagttttgctactgttcatatgatttttatatagtttttccgctgcaaatagataaaattgatgaaaattagtgtttctaaaattaaatttcgaaccaacgggagaatttaatttttggaacattaattatgtgctatgatattgtaattttctgaccaacgttgataattgcaatgttatagttatggttatatatgttatgtctaattctgcccaacggtgatataggcttaatgcataatattttaatgttaatgttgttctcaccgtacatgattattttaggtagctacttcttgatgggttgcattaaagatattccgaccctaaaaggagataactacgcagaatagaaaagaaaactcgaccttgctttcatcttgggagaggtggactgggtgttgactaccccatgtcctatagaacctgctgaacttatcagaggtgaaaatgagtcagatggtgactggcaaaagagacagagggacaatgctcctctcgtcatgtcgtatgacattgaacaaaagaaatggtccttagccaacaagaaatgtttggctatggtaaagaacacgattgagcctaccatattgggctcaatcccagagtgtgacgctgtctcagagtaccttgaaagaataaagaggcagtttactggctcttcaaagacttatgctacacagctgatcaagcagcttgtgaccgaaaggtaccatggaggtggtgttagagaccacatacttagaatgagcaacatggcttccaagttgaagccaatggatttgggcataacagatgactttctggtccatctggttatggcctcattgccaaagcagtttgacaattttattgtcaactacaacataagtccagagaaatggaactttgaaaaactcattgctaattgtgtgcaagaggaggagagaattaaagagtcaaatggtggttcaattaactatgttaaagataacaagaaaaagaaccacaagtctcccacctcaaaagctaaacagtctcagcatctgcctcagcaacaacagttcgctgttgagaaagatcagtgtctccattgcaagaagacgggacattacaagaaagactgtcctgacttcttgaaaatgatcatggcaaggaaaggtgagaacattgttacatttgtaaatgaatctcattatgttggttactctagatccacatggtggattgattctggagcaattattcatgcttgtaattgtttaaaggcattccgttcgacgaggactacgcaaagaagagaaagctccattagagttgccaatggagttgaaaaaaaagttgaagctgttggagatcttcctctagagctcgcgaatggcttcacacttttacttcgagatgtcttttatgttccttctttgcaaagaaacttaataagtttatcaaagttggattttgatggatatgattgccgctttggaagtggcaaatgtgaactatggtataataatgcatgtattggtcttgctgtgctgtgagacgagctttatttgttatctctttttgagaatgtgaatgttgtgtcctcgttgacaaaagaaaacaagaaaagaaagagaactcccgatgtctcatcgaaactatggcactgtcgtttgggccatatttcgagggggggaattgagagactagttaagaattaaattcttcctccattggagttctcagacttagaacaatgcattaaaggaaaatttgtaaagagcatcaaaaagggtgcaaaacgaagcacaggaattttagagatcattcatacagatatttgtggtccatttcctgtgaaaagtgtggatggctatgactcgttcataacattcacagatgattactcccgctatggttatatttatccaattaaagagcgatcagaagcattggataaatttaagatattcaaagctgaagttgaaaatcagcatgatataaagattaaagtagtaagatctgaccgtgggggggagtactatggttgacatacgccttatgggcaagtccctggaccttttgcaaggttcttgctagagaatagaatagtagcccagtattcagcaccgggcgaacctcaacagaatggggtagctgaaaggcgtaaccgtacccttatggatatggtgcgcagcatgatgagctactccacactaccactgggtttatggatggaggcgttaaaaaccgctattcatattctcaacagagttccaagcaaatcggtgcccaaaacaccgtatgagctatggacaggaagcgtaccctcgatagctcacctccgtgtgtgggggagtcctgcagaggctaaagtatttaatccaaatattgggaagttggatcccaaaacagtcagttgccattttattggctatcctgaaagatcaaaaggctatcgtttctactgtccaaacagttatacaaagtttgtagaaacgagacacgccgtcttcttggaagacgaaatgattagggagagctcggtagttcgagaaattgatcttgaggagaggcgggtgtctgtacccgctccgtcgactcaggaacctttcttctctctacctgctgatgttgtgcctgcaatacctgtcattgaggtactggcacctgttgttacctctcctgtggcaacaatgaatgaaaatgataaacctgttatacaggattcaacagaaatggttgccacactaggaggagctgcaacagcctcaaatagataatgtgctagtacaggagactcaacaagagcctcaggtacaggatgtgccaaatgtgcaggcccctagaaggtctgaaagagtcaaaagatcggttatccgtgatgactataaagtttataatatagaagagtcgcatatggaggatgatcacacctcatatgaagaggccatgagaagcgctcgctcatctgaatggttggaagtcatgaaagatgaaatgaaattaatgaaactaaacaatgtttgggatttagaagaaattcctaaaggagacaaaacagtaggctgtaagtgggtctacaaaaccaaatatgactccagagggaatatagaaaagtttaaagcgcgacttgtggcaaaaggcttcacgcaacgagaagggattgattacaatgagacattttctccagtctcttgtaaagattccttcaggattataatggcactagtggcacattatgatttggaattacatcagatggatgtaaaaacgacatttctaaatggagatttggaggaaaaagtatacatggcgcaaccgaaaggttttgtcatgaaaggaaacggaaatatgggatgtcgtctaaagagatccatttatgaattaaagcaagcttcgagacagtggtacttgaagtttgatgggacaataaagaaatttgggtttcaagagaatgtcgaggacaactgtatttattcaaagtttaagaatgggagatttattttcctaattctgtatgtggatgacattctactggctagtagtgatgtcagtctactgcaggaaacaaagaaatttttgtcctcaaactttgacatgaaagacctcggtgaggcttcatatgttttgggcatagagattcaccgagatagaacaaagtatgcattgggactttctcaaaagacatatatagaaaaggtgttgaagaaattcaatatgtacagatgcagtgctacacctgctcctatagtcaaaggggaaaagtatggggcatcgcaatgtcccagaaatcagtatgagctcaatgaaatgaaaacaaagccatatgcgtcagctataggaagcctagagtacgcgcaagtgtgcacacgacctaacttggcatttgttattgggttacttggcagatttcagagtaatctaggcccagagcactggaaattggtaaagaaagtcttgcattattttcaaggaacaaaaggcctcatgctgtcttatagaagatcagaatcgcttcagattatggggtattcagattctgattttacaaaagataatacaaagtcaacatcgggatatgtgttcaccctggcaggaggagctatttcatggaaaagctcaaaacagactatcactgcagggtctactatgtatgccgagtttatagcatgctatgaggcaacggggcaggtgaactggctaaagaagttcatactcagtttaaaggtggttgacagtattgagaaaccactaaagttatactgcgacaacgaacccgcagtaatgtacgctcacagcaatcagtcaagtggtgctgccaaacacattgacataaagtactatgttgtgaaggacaaagtccgggatcaaacaatcagtctcgagcacattagaacagaaaggatgctcgcggatccactcacgaaaggcctaccacccaacgtgttcaaggaacatgtagccggcatgggtttaagggaagccttatgaatcctggactacagggcccaaaagtaaagtatatgtttctgaatagagatgtgtatagtggctgtcgaatccatcggtgattgactgtgacgatgaaacatgctctattcacaaatctgtgatggaatagaaaaagctaaaagaaatagtgagatcaagggggagaatgtagatagatctcccacccatcgggcccaatggcataacggaccttgaccgcgccctgatcgggggcatccagcccaatggctggtgggcccccgtcacactgcgccatataaaagagaggtggaggccagcacggcacaagggacgagattcaccgccgccgccaactccaccctacaaaccctaatccgatcgagagggggcgcagccagtgacgggaaacgccaccgccgcgccatgacctcgccgggatcgcccacgaccaccgctgctgcagccgtcatcgccgtcgacctcaccggcgccgcatccacgacaaccgagcgccaacgacgacgatggccggcacttcttcatcctccaacacctcaaccggtcggtctatctaaaccctctcccgttttcaatctctatagttcaaacatcaatcccaaatagaaccacccgactacatctaacctaggtgatcctagagcaaagtctaacagtttccaccagtcatataagcctgatatgaagaaagcatgagatgcaggactgtaaagagaactgagaaatcaatttgaggagtagtatcagcaggaggagatttggctgctgccacccatgtcgagtttcacctgttggttaccgcgtgcttgtaggcgctcgatgcggcacagatcttgcagaaccaagttcgcgtgggatggagaaagagacggtatggcggcgacagtggacatcgaacttgcaagaaggtggcagcagccgctgctagctcgctgggaagacgatgacggtaaccactggctccgcacggcggcagcaacggctggctcaacgagcttgagaggaaggcagcggctccggcttcgcgagctcgaggggaaggcggcagctggccacaggctccatgagaccatgagcaggcgtcggaggatttctgggaggggaaaacgtgagacaaaggaaaaaagaatgaccagacaaccatcgtcgccgagccgtggttgtcttcgtcgcagtcgtggccgagcctacgcagggtggtggcggcggcctgctgaccccgtctgggcagcggcggctctcacccctctttagggcatcggatccgctggtaccggcggttctcattcctttctctgggctgccggatccgccggcgaggagaacggggtcactggatccggcggccccggcctcctcacggggagatccggcgactcgttggtagggagcggcaatggtggcatggcgagtaggttgagggagtggaggagaagggaggctgcaatggcggcacgacgagtaggttgagggagtggaggaggagggagctgcggcggcgacgacgcacgcgagggaaggaggacggtgaggctgcggcgcgattggaggaggtgggcaaggcggcgtgcgtggggaggagaggacgggcggctagggtttgtactggctgaagaatccagaccatccgtttccaatccaacgatctgacgatggtggaagggtagtcatgctgggacacgtggacggtcaaatcggccttagcttgtgatccgacgggccacgttaacggggatgtacacgctattagcggaaagagcaagggtttttctgaaaaaaaaatgatgacgtggcgccctaatcctcagccattcccacggcttttaagtaaacaaattgctcatgttcatgtacttgattccatcatcttcagaatgtgttttaggttctcccttttctccctgtaatgcattggcgcagctagtttgaaattatgaatgttagtacctgacgtccctgtactgcatttgtgcagatagttacctgacaatgttctactaactgaatagcaatgtgctgtacttgacaaaagaaaagcctcaaacctgttctaagcaaatgagggggtgtttagatcaggggtgtaaagtttttgcgtgttacatcggatgtttcatgggatgtggcatggggtgttcggatactagtgacaaaactaattacagaactcgcaagtaaaccacgagacgaatttattaagcctaattaatccgtcattagcaatgtttactgtagcaccatattgtcaaatcatggagcaattaggcttaaaagattcgtctcgcaaaatagtcgcaaactgtacaattagttattttttagactatatttaatactttatgcaggtgttcaaacgttcaatgtgatagggtgtaaaattttggggtggatctaaacaggctctggaaaagaaaaagaaaaagaaagagaaaactaccatgatggatagcacaatgttacctagaagaggcccgtggtcacattaaaagtcagtgctgctacagggagaaactattctaacttttgaggggacagccactggtgtctaaaccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 47880 - DNA, 2850 bp, Oryza sativa
tactatgacacagtcagataaacccacctttttgcgacaagttttctcttcagtgaaagcaagttcctgtgtggtcaagcaaagtgtagtgaaactaaatgaaatagctaagtgcaacaaccagaaaacttatgcatcacctcttcctcgtccttgtgaagatctggatacaacgtcaaaattaaagcgtcaaaattaggatcaaccttcaacgaatgactacttgcaagggtgcggcatgctgggcattcatcatttctataaaaacaatgtatcactcagtttaacataaaaagtaagtaccacattctatttcaaaaccccagtcaggtccattctttcgaatggcattgacagcattttaggtgaataatgttagggaccatacccaagccacatggatttttctatgcagtccctacagaaccggtgcaaacactccgtaattatccttgccttctggataatgcctgcaatagggccataaggcattcagatgatcagctatgcacagtttgtgcagagatgctatttaaaattccacagatgagaagcttactcaacctagtgtaataaactctgtctagttgtgcttctctaaaatatgtagaacatgagcttagtgatgtacctttttccaaagtaaaacatgcatgttctcttagacatcttgttatttatcagtggacagcaattatacacaatatcttttttatacgaactatatacatacttggataacagaaatatgtggactattaactttgctgcttcactttttatagaaaatggtgattaaaaaaatcttacatctacagaacaatagacaatttgaagtaaaactgtaaagagggaattgtgcaaagtaaagagggtttttatctctactctggaagcaagttagggaaagcaaattcctacctaagcatatagggcactgcacttccttccgtatatccattaacttcactagtataaacctgtatgagaaacaatatttagataccaatttcatgcattggctaaaatcaaggtcaagtgtttcactatccattattgcatgggttactcatcaatattctacaatatatggaaaacagagaagtgtaccacaagatttcttttcattttattaaaacagaagaattaatagctactattcactgaagcctggctagaaggtattcacaaggtgactatacaaagacagaataaaaatatgattccattaggcattagcacatcataagtaaattgagactataagggcatgcacggtggtcatcaatgtgctgtcttagcaagtgcctcgttcaatactccctccgtttcacaatgtaagtcattctagcatttcccatattcatattgatgttaataaatctagatgttaataaatctagatagatatatatgtctagaatcattaacatcaatatgaatgtgggaaatgctagaatgacttacattgtgaaatggaggaagtagttgctaacatggaagggagaaaatggagagaaaatagagttgcatcttcacaaaacaacaacatgagcgtgcaggttaagaaaaagtagagaggataaaataatctaagattgaattccatgttatatactatggtcatctgtacatgttgtcttttgagctagctttagttgacacgtacctataaatgtggcagtggtctcaattgaaagcttgtgaagtaattgacaggctgaaaaaggaaaatgcacactagcagattcacgctcactgaaaagttcaatgaattcaattaaccagcagaggcatctatgcaatgcaggaccaacaaaatcgtaaaaaacaaagcaatacgagatatacaggaattgcctgcacaattatcttacagaagaactcagtttgtgcaaaacattcaccttatatttcggagaattgccttaaatgtcacatgcatgtgggttgtaatcttacaacaaaactagtactttcacacagacaccatctaaattaagcattcataatcttaacaactccctacaatcctacattacgaatcttggggataaaaaagagggggttttttttgacgcaagaaaagaggggtttcacaaagatgcgctccttgcgtattccaaaaaaaaaagagggtttttctccctatccgttcctccttgcgaccttgcaatgcatgccatcgttttctagattttccaccaatccctatttaaaagaagtgttgcacaaaatttccaattaccgcgcaacctccaactgccatcccagaaccccaggaaatcaaacagcaacaacatgagctgcacagaatcgaccccaatattcccaataaaaaggaataacgggagagagaaagagagagggatctagagccaacagtcacctgtgctagggggctaacaaggtcgtcgttggcgggagcagtgaccggagccctgggacccaccggcggcgaggtggattggggcgggtccccgtggcactgtgatgagtgagggcgtggatagtgggcagaacttcaggtaggaggctgtgttccatggttaaatgtagcgtcccattatggtggcctgcgcaaattacgcaactagcatctttatatttttctctcactagataaaatatctggtacattgcaacggataaagtttattttaatcttattattgttatatggtttattttagatgaaatttactgtgggagttcagttggatatatatatttttagaaaatcatgagctgcagttaggagtcatgcggggtttttttaacagtttcttgtatgattccttttgtattaccaaaagtgaataatattaaaaatcaattcaaatacggata

SEQ ID NO: 47881 - DNA, 9026 bp, Oryza sativa
tcaaagacaataaataaaaagaggaggcgcggacgggccatagaggagtataatggcaacgtttgatgggacttctaaaatttataaaaatgtaacccaacgagaaataaactttgaaaactataaggtccaatttttaaaggttctaaaaagaaagaataaatataatcagtggtggatcgagcaagcacataaaaaaggcgtgacaaagtaaggtgtagcagctgatatgacttaaaaactataaaattagaagcacgaggatgataaggttttgtcttttaaaatcttaagacaatgagatagctatttaataaattttaagtaaaaccatattaaaaaatagataattttgtatgggtgctagccgcgtaattgcgcgggccacccagctagctgtccagaatacaagcacagaagcagatggtggcatggatccagccaaattgtttatgtttgcttcagtcttgtttggtggttgtgtagcctccttggccacttctcttgaagcacgctgcctttcggtgtcatacagagacctcttcgcatgatcactcaatactgcatgagcttctgaaacaaatctgaatgctgcttcggcaccaaacagagtattattatcaggatgaagccgatacgaaagtatgttgtactgctttcttattactgtttcgtctgccattttatccacctgaagaacaccataccaatccaactctccagatatctttgcctcagctgaagaaagaacttcacagacagttaacagctgggagatgttctcaagctcaggaaaaagcctttgagctttaatcgcgatcttgcgggcaccgacaaagtctctattttccagcttctttacagcaatttctctggcactgaaggcctcctctctgttgcattccatcaaagtattccagaaatttgaccaagaaacccttcacatatacttgttccagaatggcattaacatgctctacctatcatgttatcaagatctataaaatgtgagaagaactttcagtgcatcaggccctgcatgcatacaaaagagcatttttattaacagaaaaaatatatatggcaaaattatgaatactctgggaaaaaaaagaaagcacatttggatatactcgtgtagtcttattcacttcagaaaatggcaatttggaaaaatgacatacagttccttcaaaacaaaagggatccattttgaaatgttttgaaaaaaaaactggatggcatctttccaaacaaccatattttgaagtggcatatatacattcataaaaatctttaaaaaaattgccgaaaaagaaagaggggaaatatttcgatcctactcgatgtctactaccctagcctcctaaagcacctaaattaagaggtctgcacgatcaaatcgctggccatatcctcgcgaagaacacactaacccccagaacgcaaaaccaaacctccgatccaaaaaaacctaacacgcacgcacaacctggcataaaccaacctacccaataaagaggagaactcggggcaatgggacgcaaatgctgaacagatgctacctccgagcagatctggggctagagcgtgatccgcagcggccggcgccggcgagccaccggggtgggcagtgggtgtcgttaggttcttagaggaagagcagaggcagaggtgaggtgagtgacagagtgagtagtctactgtggtcgaattggacacgtgtcatgctaggaagtgaagtcctcgagatcaaggataatttttcaatatatgccattcaattcgtcgcactttcagattttgcccctcaattcgtcacacttttagaatatgtcatcgaggacgtgaattgtttcattccgtgccactccatccatccaacgccacatccgtcaatctgtccgtgcccgtgccgtcgttcgtccattgggcggggagcagctcgtctgtcctccctgcgcgagccgccagccgatgaggtccttcctgcacgcgtcgccggctgcagtcgaagctagtggacgcggaaggagttggagttcccgcactgccgacgcgagcgttcatctcctgcgacacgcactcgccgttccggccacgcagcgtgcacccaacggccctgtccctgtcaccagcaccctcctcgtccccatgtcgtacaacctctgcccatggacacgagcaagaacagcatactcacaaacaagaataccccgtgaaccgatgaacgacatgaagtaatgtgtgcatgctcgctggtgatgtccgggatgttgaggccattggagaagcgaccggcggcggctggacctcgtcggccagcgagctgcgtgcgggggacctcgccggccgacgccgtgcgcgaggagcagctcgtcgatgacggccgaacgccccaatgtgccaatcgggaggacgtcggtagctggcggttctcgacggcggccggatgcgtatgctgggaagacatcgactgctgatggcgggcagatgtgtgcgcatggaggacctcggcggccggaggcgctcgacggtagcaagatacacgcgcaagtcattgccggtcggcggcgagcgctgggaggacctcgccggctggtggctcgcgcgggaaggaccgacgagcgagctgctccctgcccgatggacgaacgacggcacggcacggaccgactgacggatgcgacgtcggatggagggagtgtcacggagtgaaacaattcgcgtctctggtggcatattctgaaggtgttacgaattgagtggcaaaagctgaaagtgctacgaatcagatagcatatatactgaaaattctcgagatcaacggaagtgagtgataggggtctttttttctagggttaatttttttttgaccgaaaaacagtgggggagagagatggcaacgggtgcatatccatcgggttcctttgccccatacccacacgcatgatatcaaaatatttccacttaaatacccacacccgtcgcgggtacaaaatcgtccccatacccacacccatgcggataacgggtatccaacgggcacccatacccatataattgacttgtagtatttatagttttgtactctaattagctatattagagttgtaaaccattaatattttctctagcaacaatgctattaatattagtgttcaaaggcgagtaaaaaattatacaactacattacataatcaagaaatcaactaataattttatataactagtctagaacaatgcttaaggtgtgaaaagagttttatgctatgatttagtagtcgttgagacctatatggctctgttttaggctcaatcaacaggtttttttttacccacgggttggtgggtacgggtgggtaaagaacatacctatatccatgtatctaatgggtaagagttttcacccgttagtagatccatgggtataagagttagaacacgattagctcctaatggagtaaaaacccgtcgggtctcgggttatgggtccccattgccatctctagggagaccccacgtttttctagggttaattggatctatgccattacaaatatgcatatttagataaatgtcattacaattcgtcaattcgtaactatgccattgtaattttataaaattagaattgtaccattgctgttaggcttccatccatcttcctctttttttccgtttcttcctctttttttccggtctttttccattgagctaccgatttcttccggggggatcgatccacctattggcggctgtggatgatgtctggtggaggttcaggggcaccaacgccaccgtggccagtgcgttgattcttcctcctgccatgcgcggttggtggccagcgcacggcggcgtggcggccggcacaaggcagcgctgcggctgacggcgagcgcacggtggtgtggtgtccggcgcaagcacggcgggcggcggactcaacgcggtttcgacacggacttggcgagcggcggccggggcacggcgcgtgcaacggcgacgcagctcgggcatccggtgctgctcgccgttttttcttttttttttttcgttttctttttcttatgtgatggtgccagtcaccgtggggcggtgcgccgcaacccagcggctcggcggcgcaatgatggcggctcagcgaggacgtgcgacggtgtgacgcatgcatagcgggcggcaccttggcgcgctgcggccttggtgctgcttcggggcaagtggcggcgcggtgctgcagcctggtcggcgctcggcgtcggaatgacttcgtgtgtggcggctcctagtttgtcacccagacaaacatcaacaagacggcgtgttacctcgtggatttgatcggtcgattgcccagccagacatggtacttcatgctggcttccgatgtgaggccaatgagctgcagcctgcagcaggtgagcagggactacatggcggcgaccgtgccgccctgccctagcacgaggttctccgccgactgcatcgtcgccgcgtcgaggcgttcgtggtggcggcgcagcgggcgtgacgtgccacgccgccggatttggccaccgcatcgcccgatttggccgccgccaggccaggtgccgcgccgagccaccagcctgcgtcgaacccgctccagtggcgcgtcggagtggacggatgggaagaagatggaagagagaaggaacaaaacgaaggagatggatggaagaagacgggagaaaacggaaaacaagaaagagatggatggaaacgtgacagtggtggcatgtttctattattgtaaaatttcaatgacacggtatgaatatgcgaattgtaatgttatttatctgaatatgcatatttgcaatagcatgatccaattaaacttttttttctactcctctgaagtttatatactaggagtttatatatatttttttcgttggccacttgtgagtatattgactgactgcctgcctgcctgacgctttctatgattacttgtggatttaatagttggatttaatagttgggtttcttttgcagtaatttgtatcgtgatgtacaattaaggaaaaatgaatgtataactgacagaaaaataaatgaatgtaattgagagagagagagaagtaatgtttcatgaaattattagacaggaaacttctcttctttatacttaaaatgtacgttgtaacgggtcataaccacagaagtaggaatggactatagggtgatttgagataaaacattgatctggtggttgccttcggtgtaatggaccatgcccatataaatagatataggttataaggtaatttaacataaaacattgatcgggtggttatgggaggtggtgcgctcggttggaggataaaggaggatgatttagcttttaagattgtagagatattggatgaatcttctattcaagccatctcaagaaagggaattgtccatgctaaatgctactatctctatttttagcaaagtaacgtgtaccaaaataaagttatttcttcacctacctttttctcttaaccaatcacaaccattctcttctcctttaatcataaccctcgtccaatcatttctatctactttcgttatatccgtgtctatctcaaaatggtttcattatgggacagatggagtattatctacccatttattgccaattaaatgaaagccacgtatggacgggtgtgcctaatggatgaatgttcaagcacgaacacttttggcccggctcacatgcatctagcctaacaaaaaaagctatttcagaaattttttatgtgtatgtacaaacttttaatataaaaaaatatttgaatccaaatcaaacatataaacttctgttataaatctctactattttaaaaattgaagatgtttttgccggcactttggtacgttatccgtgtatgagttggttttcgaaatacagatccgtatttgagtcgggttttaagttcgttcgtttttggaaatgcagaaggagtcgtataagaaatttaaataaaaaattcgcatattaacttgagatgatcggactcctacttacagctcatggtttttttagaaaaatatatatccaagcgaattctcaagtgaatttcaccttaattaaaccatataacgataataagataaccttcacccgttgcaacacatggatattttttctagtttacttaaaaatagaacctgtacggtgccaaaaaaaaattaaaggaaagaacatggtgtataaagtgtctaagccgcacgcaaacttttgcacgatagcctttccggaccgcacactacacatgcgtgtaccctatttggcacgtgctcgcacattacacatacgtgcaccctatttggcacgtgctcaaaaaataaaagagaatactcttaatgtgtaaaagaaacgcgaatattatataatgaactaatattaaataaatagaagaggtgaggcttcgaacccataccgactagcccaccacattgtggagccagaaaacccccaagtatttttcatttatgtgtaaaagaaactccaatatataaaattgggaaaattgtaaaaaccaccccaaatatcactctgagtttaagatgccccctcataagaagatttgtgcaaatccccaccttctaattcaccttggtttgatttagacaccttctctccacacgtgcgtgattcctggagaatctcatggcgaaatcaacctagtcccacttagagtgaattaggaggtgggaatttgcaacaaatctccttataggggggcatatcaaacttagagtgatatttggggtggttttttgcaatttttcctataaaatttaatattccatatcacatttatatagacctgtggtcattgtctgtctcactgtctgcatgaggaaactccatactgaatattgaatcaccaccatgccactaacactgagacctcatcaggcatgcggtagcaacagagtagcactataatttgaggatttttatggtataatatactagtagtatatattaccagtataaatgatctaatggtttagattaatttgatcttccactcaattagcttgtaatataaattgacaaagggtatatttgtctttcaactaggtgaaaccccgcgcattgctgcgggaatttagtatgataacaataaaaaaaataacgtgcaagatagctagataacatcagattaagtaaattaatgtggtttatgataatttaaatttaaatagtatgtagaatggtgattgaaatgtaaaaagtaaggtggtatgactttatggaagaagaaaagtagagagatagtttggacagtagattaatcatttaaagggtaaaaacaattgatgtgatatgacttaattagaggaaaaaaggagaaagataatttaaaccatagattaatcatttaagcactaactaagtgaggatgaactatataagtatacaggatatcataaaacataataaagatatacattaaaacattatgtgaattatgttggatgataatttaatttaacatatttgtatttgaaaagctcttaaattctaaaaactataaagatatagcgtatttgcatgatgtttaaatgtgatgattgatagtggatgatggtgtggcatcttgttaattagtggatgatgatgtgtcatcttgttagtggatgatgatgtgtcatctttacatgttaagcttaaatagttagtatagttagtgggggataactttatagtaagataggaaaagggagatttttatttttttttcctttgacggatcccgctcgagcgaaatcctaattgagccgttcgccttccttcgtcacggcgatcgaccaccgcgtgcccacatgccacaggcaccctgcgccaccgcaatgtactagtaagatggtattttagccagaggaattaatgaacttcacatgccatattgaaaagcaagaataagattactgtgcccatggcggagattgagaaacagcatttttcatcaccaacagaagaattcatttggtggacacagtatatacaccaggtagagtataacagatccaacagattcatctatcaattttatggatcatggttctgcatgttagaccttaacagtgggagcaagaggtcggaggtgggaggcgggatgaggcagtgggctcgacgtggccaacctcgctgccatggtttggagaaggcagaggttgaatacgggggagaaagccggcggctagggtgggagcctacgaggcatggcgccggggacgcgggagaagccgagtggggaaggaatcgggccgcctccacgtgcatcgtcttcgtattctggaagagcgctaccatgaccacacgacgagatcgacagggtactcccgatagaaacaattgtgaacttcaaatggctaaaaagccctttccagatttttaccaaataccaaacatacccttctatatactgctaggatatacttgcaatacaatgtaccgtaaatgaattgtataattttctctgtgtaaacatgaatgaggatttgcacagaaagttaacatggccagacgaatctatgtttgggtaaatttagataaatcaggtgttgaacagctgaaatttgggtggaaatcctccattccttctgtagaaaaacgtcaggaactgaagcagggtcgagctcatagaagtcactgaacttcaaacccttttcttttaccagagagaacgaaggtatccgatgcgaaaacctgaggttctctttctcaggtatctccagtatctccttcccaatgtgaagcttgaacacagctatgtatccatctagtcgtctacttcactcagaggaaaacagtgtgtgctgccttcagagcacctgatgatcttgccaatggcatactcaagacagctattgaatctggaaggagcccaatcaggtgaccagttcttgtagatggctcaaatctcacctacctttgggaaaaaaaataatttgccgatttgaatcacacatggattgggctgcaggaa

SEQ ID NO: 47882 - DNA, 2499 bp, Oryza sativa
tgagtggatccagctttgatttcggctatccagagatagagattggggaacttatcatggtcactgtacaatgcccaaatttgctgatgttcaaacttatcacatgaccggacttgtggaattcagaaacaggatgcgcgcaactagtgaattcagtgttcggtctcgtgtcgagagacatgtaatgggtgagagcgatagaaagaaatgttgaatccaactcacttgaaagatgagctgaagtatctagctccagtaacccttctacaatgcatgtttctcctaaacagaagcttccgcgagcaacaggcaattcctcatcactccatttcgcctcttgtgcattcatagctttgtgctccagccaagtgaactgaactttgaggttggatatatcaatgtgatctattcgagcatagactcttggaatgaaatcatggtcgtcatacagtgcccagatctgatcaacttcaatcctgttgatatctctaaacttgccaatatcacagaagtctggatagtggtaggcaatcacaggattgttcagagtcctgactcctgagaagcagtatcaccggcttctttttggtaattctgttgatcgccttcatgttctgcatttctttccccatggatgtccaatttgatggggacatgatgttcagtagatagacttacagctgaattatcatccaatatttgcacataattagaaccagcactaggagctcaagctgcagctggtgaaggcaccatgatctgctcaacatttgaacttgtttctgtatccatgtgttccctcggttgaagaaagcttaatatactgggtctgctgtgatatcggcgcgaaaacgcttctgacgaagttcggtaattgctgctgaagctaaaaggaatctcgacggcacagcctgttcatgcagcttgaatgcaaagttcttactcccttttgtttgagagatgttcagatttgtgtgctgctttcatggaagcatactcccttttgctgtcatactacaaagatctcttcatatgatcacacagtattagatgagcttctgaaaccaagttgagagcagattcagcaccagaaagagtgttttcatcaggataaaagccacaaggcaaagcttgtcatgttgatattttaatgtggtgtcatctgctgttgcctccacttgaagaacaccataccagtccaaagtctcagtaggttttcgcctctgctgaagaatgaactttgcagacagttagcagctgataaatgtagtcaagatctggaaaaggcctttggcacaaaaaatgtccttgttttccaacttcttcactgcaatttatctgacccttacagcctcttctctgttgcattccaatatgtaaaaaagaaaatttagtgcatcagttcctgcatacatacaaaaaaatcactaatagagaaatgtcaactgtgtgacacatgcacccaaaaaacaaggcaaaatttcttgtgcacaaacaccacctcctatttcaaagattgactaggaaacaatcttacaatactacatggataccaacatcgcatacatgtagtagtgtagcttggaaacaatcttaataaaaaaatcactaattatcttaatacaattttgctatatatttgtcgacaaattttcccccaaaaatttgacagatataattacagtacaatcgtaatataattacactgtaacttgcatgtcattacactgtaactataatgtaacttgtacgtaactttcaaaaatctctccgtaacatgttatttgggtcaaatggaggtcgtgggaataaatcctttcacatatgtgtgtgctgtgattttttttcttcctcaccataacaaatcttgtatttccactgtttcacaatgtaagtcattctagcatttcccacatacatattgatgtttatgaatctagacatatatatctatctggattcattaacatcaatatgaatgtgggaaatgctagaataacttacattgtgaaacggagggagtaataaatttaacgattcaaaatcacgtgaaacttacatacaagttacactgtagttacatgcaagttacaatgtaattacactacgattgtactataattacatctgttaaatttttaggagaaaatttgtcaacaaatgtataggtggtcccatcaagatatgttctgggttattagtaatttatgaatcattccatttatcattctctgccaaacctagcaagtaggatttgttccaagtcaatggtattggagtcgacacagaaaaagaaaaggctgtattttctggacgagtaacagaatgacagaactacagaaaaccaaaaatgagtagcgtgcatcttcgatgttcttacgtttccaattaaatcactgaacacactaaaagctgtgtagagtactacagttcctggcctcctctttttcgggaaaatttgggtacactaatttgctgattacaatgtactgaaagaaa

SEQ ID NO: 47883 - DNA, 1694 bp, Oryza sativa
catgccacgccggtaacgctggtacgttatccagcccataacagtgttcctatacaggaaaacgtcaggaacagaagctggatcgagctcatagaagccacggagcttgccacctctttcttctgtcaaaaggaaggaggggattcggtgagaaaacctcaaacgatctcttgtaggtatctccataactgcactttgcttgtcgggcatgaacaccgctctgaagccattaagttgggtcagaagatagattattatacttgcttccgtgcgcccaacaatctcaccaacgacaactcgcaagtatctactctgggaggagtccactcagatgtccagttcttgtagatgcaccaaatttcacctacttgcggaagaatttcaatctgccggtttgagccattctatcctgtatgtactaaatgagaaagaataatttctctcatacttggttttccagtcccggattttaaatttaccacaagagactggtaagtcctgctccaaccaccgtttctcctgctcatattcaggagaagcctcaagccagatcaaatgcactatgaacggttgtcgctcgactttgcttatccaaccatagaacttggggaatttatcaacatcactgtataaagcccaaatctgcccaggttcaaacttctcacatgtgcggtcatcttcgaagttatggaattctggatcaggatatgaaaaaatagttggggttggggaagggcagcctggcccagaattattgccaaaaccattggcaacgtggccatttttgggcaaggatgagtttttttcagaagaaagactctccttttgtgcttcagaaagattctccgtttgttcatttccaggatcctttctactacttctactgtcagtcgtcaaatcaatgagtgtactgccctttttcttgccaagggagatgtaagagtccagggtgacagaaggaaatatcatatccatgtcaatggggagacaagaagtgtcaagttccataaaccctgccggggcacctactttttcatttccagttgtcctgtaacaggggatattatgagaaaatcgaagcaactcactcgatgctatcacaactgcagatttgtctttagctgccgcaaataaactcacaaagcctttaatcctgactaatgggataacagtgataccatcattaactgagaaacctgacaatatttcaacaacttcataatcataagaccgatggctgtctgcatctgaattccactgcatgctccaatccttataaagagcccataactcacccttattaagatatacttcataggcaatcctctttttgccttttgtccatgaaacaatgtgagagaacatgagtctgtcatgttgaccctaagcaaaacttaccacaagcaacaggttgttcttcatcagcccatttcttctcttcttcacttgctgcattgtactccaaccaagtgagatgagctttgaagctggatgcatcaaaatgttcaattcgagcataaaatcttggcatgccatcaaggtcgtcgtaaagggcccatatctgaccaagtgagaacatattaatatccctgagcttctcaaaatcatagaaatctggatatggggacggaagttctaaagaacaggaatgctcattctgacgaacagtattagtagcttcagcattggcattg

SEQ ID NO: 47884 - DNA, 724 bp, Oryza sativa
ttcctgcagcccacagctctataccagatttgtcaccttcatcttatcttcaagtttctcacagagaactctgttgagctcttgtacatcatgttgcatgaaggaatcatatgtgtcccatccaaaagatttggtcagctctttggtggctacactattgtcactatactggagcttgtagaaaaggctctgcaatgccaacggaatactcccagatggcatatcattttcggtggttggcatatgatacacagcctgggtaaaataatgaagttagtcaattagttctggaaacaatagtctagaatgctctgaattatgatgcatgatctcacaccttcctgaagtatggtatatggtatagtgtctgtagtagagagttcatgtaacaggtagctccttggttcttcaggccaacgtaacctgtttctttttttgaatcatatgtccaataatcaaccattttgcggacagcaacctcagcctccacaacaacagtatcatcgacaaggtatcctctacttggatcatagagctcactcaaaggcataaaagatgtgaaaccccaatcactctcacgtgcattaaattgatgctgagtatctgccagacagagaatcacaggtccatcagtgatagatttatcccatacaaatcactgaaatccgcagaccaacgtaaagtagatctactcagcatcatttgatcaagtagcagtatgcct

SEQ ID NO: 47885 - DNA, 1879 bp, Oryza sativa
attgaacagaaaactatagtgtaccctcaggatattcctgcaagcatgccaacaagaccaaacaaggtgctcgataacgcaagatcataaaggttgacaagcaaatagaaccattttcaaacatatggcatccatttacttgatgaaagcacgacctctgacctcaagaggagcaagtttttgaatactacgccgtgataacagtttgacaactagtgaaacatagcaaagtatagcatcatcatactctcaagcttatcatgtattgcttttgcattttaagtgtattcacgtaaggagttgtaaacatcatgatggaggaccataacctttgcgtatcgtatacttctgttggatctggttgacaacggccaagctaaactgagcatatcggctccaaccatatgggaggttagcagagtcggcaacatccaagtacatggagaaatggtccacgttgttccccttagggaaaatgagcacacgcctgcatgaaagcccgccaaacattactatcatccaaacattcaaaaagaaaactaactccattaactaccctttttatgagaccaggagctcaccatttgtacccgccaacgacaaacgcatccgagtagtgcttcttcgcattgatccgggtgaagttctcgatcgtccacgtgaaccgcgacgtctgcgggtcctcagctggctggctctccgccgtgctagctgcctccgtttgcgcaaccactgctaccacaaaccacgagcatatattactaccaacccacaaacactcccaacaccacacattacaaaaccacgctgtacaaatcacacggaagcaaaggaaagcagcacagtgaacccccatagagagcaatcaacatggcaccttccatgggctgggcggcgtcagcagcgacgagctcctggtgaggcacgagcatctcgtcctcctccggctgcgcaaagaacatatcgacaaaaagaaaaaaacggaaaggggggtcagatccagcgcggaggcataaaccctagcaaaaaagcggcaccacccgatcggacgcccaccgcacgggccaccggagaacggtgcagccctagcgagggagatcgggcgggtagacaggagaggggagagctctctctctctctctctctatctctctcgcgcgcgcgcggagaggcggttgcttacctcgagcgggggaggcgtcatcatagtcatggagaggggcgcctgcaggtcgtcggcgtcggtgagagcggtggcgtacggcctccgcggcggcggcggcggcggcggcggcggagaggagagcagcgggtggaggtggaagcagcgagtcgggggcggaggagaagggaggggggagtgcgacgaggaatggaggagtttgggagttttggaaggttgggggtggtttggggatttcgtgtgccgcaggctcgcagcgcaggtgagcgagaaagagagagagagagagagagagagagagatcgagggaagcagaaatctcgttccttttccttgccggttgccgttttactctgcccctcgaatttcgatgtgattttatttttttcttaatgatgaaagttttattaagctcagtaaatttaatcgtcaccgtacaattatcgtatttcgcataaccaactcacatatgttctaatgaaaaaacaaaatggattacaatgagaattttggtgagattttatgtttggacaagatgcttttcttagttggttttccttaccttttcctatagcacgtaagctcaaatcgtgagggcaggtttgaaacataggatagtaaaatataaagaaattaaaagtgtcaaagtttttctgatgctataagagtataaaacatagacgagaaggaaaagga

SEQ ID NO: 47886 - DNA, 21360 bp, Oryza sativa
ctgcagcccagcttgctaaggcattcacagtgcgtcatccctattcgaaaaaccttagagtgccacgtagacttggctacaagttcaaaatttagatttctcatggtgcaagtggctctaagggtggctttgattttatatttcaacccctacaactctttgttttggtcctcatgtttttaaaatttatgtggaggtccaaaatttacaacaaacaccctagaacagattatcaaatcccatccctccccttccccaccccttctctctcccttatcccctccctcgcgttctctgttgccagcccgatccactcatcgcctggtgcacacccctcttggcctcctctccttctcccctgaccagcagccctccttccttggcagcctccgcgtgcaccacccctcagtggtgggagactccaagcgggagatggtgaggtcggcggcgcaaagtgtgggggatggcaggggctcggcagcaacgttggggatggtaggagcttggcagcgcaggagcgtcggctcccccctctgcttccacagctggcgttcctcctatgtcatgacttcctctctcctctcctttcttcacgtcacggcggcagtcaagaggccgggaccgtggcagcgaaggaggccaagtcagggtggagccactgagctctccggcatcttcctcgcgccctggctagcttggtcacctcagcgcgaagtggacgacgggacgacgactttgccgagtcggggatgacgacgagctcgatggcgcatgacggggatgacgccggattgagcttctcttccctccccttcatggtgaatcaagcttctcttatcttccctccccgacgaagagcttatccacttctccattctgcaggggtcgcaggggcggtgagggcatctccttccttctccactttttgccttttaggtttcagcgccaagctctgacctccacagtgcggtttcgtgcctctccccatgcgcccgcacgccatcaatcaactcggagaacgagtgatcaatttgggctctgcattgttcactagggggcacgcgaggcggacgtggcaacgaatattcgtagtggatggctcaggcccaacgacacgtgtgtattgtgaatggccttaagctatgtttttaagtccattttcctaactttacccctcgtttttcgcgcgcacgcttcccaaactactaaacaactagttaggtgcccatgcgttgcaacgggaaaaaaaatactgtgatagctaacctaataaggacaacaaatgagaggctcacttcaatttcttgagtgttaataacaacaaaatacagtgaaggcagagaccagtacacatagttcaatttatctttgcttcctattcttattactgtaaaaaatttaccgtcagtaacatgaaaaaacagtagctatatgtggtgcagggcaattacaccgtgtgcaccaaactatcaagacaaagatatatatagcttgatgtactggttctgaagttcttaaatctccacaattgtggttccattgtccatgtaaatatcattaaataaaaatggactaatatacaaatttcagaagattgataaatcatctaaacatttgttccctacaaaagtgcttttcatcatcatattcatatggtacttgactatatgttgaaagacatccacatttagaagtgctctttaccacagttttgaggtcttctcttccctaatctataaaattacaaaaacgtctggcatcatctatcctcttgtctcttcaaaattgatcggattagtggcctcttaacacaaccatagctacaccgccgacatgaacaataatacatatatttatctaaaattgatcccagaagtaaactgcaataattttagtagagctcagtttacaaaacaaacaccgatgatatagccaagagtcaggagaagaacatatatcatttaggtgagataagaatgacaaaactgcgtattactctgtacaagtagagattgtattctctgcaaccttttcccttcacccaactcaggaaaaatttgtaaattgtcaaattttgctgaaagttttttctggtttgaagaaagaagaaaaaagagcatgaatgtctgatatacctgctgagttactgcagttcttctactgacagaactttgtcaaacaagaaaaaagatctccttccaacgcctcctcaaaattaaaagggactttctagtggccagttgatgattccctgaccatagtcacttgaatgatagcaaatgtgaaaaataaaaggatcaggttgaaacccctctacaaaattacgagagtgagcatctatgtagcatgaaaatagatgcagataaatcaagaagtacaaacctcattatttccaattccttgcgagcattaggaaatatgagcaaaccaatcgatatgttgcacatccccaccattaatgaaacacaatgctgaaaaaaattgcatttagaaacaataaagataaatatgcactgcacatttccaggtcattgtggagcagaaacaaatccataacaaatcagcaagaggaacataccagcatccagcaacaacaaaaacaagagccagggaggacgttgacaccaggctcttctttctgccggtgacgaccgcagcgatgggggtggaggcatcgtgagggacaggtggtcctggcgacccgcggcagccagcagcggagggcgaggaatttattttattcacttacatctaatccacgatacaattttccttttctcttacattataactttgtgtgtaagcttgttgatgtataaactttatgcacatggactttttaccgtagaaactttgtgcacaataactttatagctatgcacatgaagtcttcatgtccccatcccgtcataacaaaacaaatgaattctaaaataaagaaaagcttaaatatgttttagttgaagctcgaacaagaaacaaaacaacgttcttctggccaacgaagttgcctccattgaagagacgatttaaaagtaccaataaggaaaacagaacaaagcattttaacctgagcggtcgttaagccaaatctcatgtctaagtaaagaacaagagcaaatggcaaatccaccaagagaaaacttaaaaaacttgcaatttgaaaacttaatatttgaatacctgagtcatgtattgttaacagatttgaaaacctgagattttcaatcaagcaaatgtctttaattatctaaaactggatatttaaatatctttagccaattctcaatgagcactattgaccatatcacagaaactgaaccggacagcagaagtggatataccacttcagcatacatggcctaaacagactatgttttctaatttttcatctcagataattaatgattattgctcagaaataaaaataatttccactgtatataccacgaaatggacctgaatagctagtaggatataaaatgtcaagctcaaatttataattgaaatttgttgccgttgttgtggttgtggtggtgctaaagaagtcagtacaacctcaactcaacagagcctagtagctgaggtttcctttcaatatggataaaaggaatatgcaaaagatattattttgaagaatatgcacaaataaggttttgaaggaaaggtagtaagttctgcatctcaaggctaacgtagaaatgaagcacatcaatagaactgattcagtattagaggaaaaggatcatatttaatcatctcgtgacaggagttcattttgttagcaaacctctgcatctcaggctaaaaaggaaatgaagcacatgaattgaacttcagattcaggaaagggaatttagccatcttatgacaagagtttatttacttcaacggtatggaatattcaaaattttatcgttctaacaattaaacatataatgagatttatatatggttcacacaaaaacgatgaactaatgtacgctagcacaacagggaacgggaaaaatgcacaaacatggtactgcactaataatcttacctgttcctccgtcgccgctgtccaggcagcgagggaagcgtcgaggatgtagggaggtggcagggcggcgtcagaggtcgaagggcagggtggcagcatcgacggggctggggcagtttgtttcggggataagacagacttcacgactccggcgagataacgcccttaatgaggaatgatcgatggccgcagattaggaacggattccagggcaagcaataacagaggatcgatggcggcgtcggtggcacttgcggtgggcggggcacgggccggagggaagggaggaagctcatggtggaggacagcaagggcggcggcaaggacgccctttcttgcggcggcgcaagtgatttggaaggggagggggcagtgaggggaatcgacggtggctcggcatcaaagggggaggagcggttactttgtgcaagcgtggatggaggcgcggggcttaggaaagttgctttaaaattaatattaatctatttttaagttttttaagctaatacttaattaatcaagcgataataggtcgctccattttgtgttcccagataaaaagaagtttccaaccataacaatatgtgccatttcagtagccaaaccaataacaatcaagaagcgtgttgttttagccaaatatcgatcaatgtttgcctgtactgcccattgtgtccctagtaacgtcagtctaaaattaagtgcccacttgtctgaattgggattaaataccaagctcgacgaccatatcatgtttttagtcctaagagaaatacatacgtttaatcttaaatatatcttagtatttgtctatataattacacatatacatatatagacaaacttatattattttactaaatgatgcatcaatattgacatgtaccataatatactccattaacataagcttggatctccccgacacccccccccaacggccatttggcacgttgtcatgaaacattacaattggtggtgtttgaatctcccgaagatgaagataaagattaagtgttttacgcaaaactatgtggtaataacgtgtgattaattgagttttaattattacgaacttgaaaatggattaatctggtattttagtacaactttcatataaaaagttttcgcacgaaacataccgtttagcagtttgaaaaacgtgccataaaaatcttcatcttcatccaactattgttggagaaacgaacaggaccaatgagtaagctcaagattagatgtggactcttgaagcaacttcacagtacattcattgtggtcacatgtgaaaaacatctttggtgtgtaaaaacaaccacgctgatcgatatcatcctgagttaagagatatgcaaggataggaaggaaataattgttcaacaaagggcacaagttcttttagcctattggcaaaaacgaagaagccatggtaaagacaattgctaaggctaacctaatatttaccttttggagaatagccttttaatcctactttcagaggttagttagccctagtttatacataagcctaattttctccctactttatataaggcaatttattttgttggtctattgttgtataatactgtattttttaagagtcataaatttttgtaactatatgcatgtgcaaaaataagtaacttggaaatcacctttacaaaacaaacatgcaagcctactttcgctatgaaatatttataatttaattggatatgagtttaaaagggcacactactaatcatcatcgtggtgttctgaaaattagtaagtactcgacaaattattaaaagaacccattctacctgcaaattttcttcagttcctagtaaagtttatttagtattgacaatatatatatataaagaaaaaccaacatgcaaaaaaggggcgtataaaacatattttcagccaattaaatattatgctagagtggatcaaatttatgaagtgtttttttttcattgtggccaaaagaaaccaactccaagtaatatttgttaatgcaatcatgcttgaaagttgaaactaactctaaaaatatgattagaacttgcgttaattgtaaaacagtcttaatctctcgacgagtttaacgtaaacgaggattaattcatagtcaaagattacatcaccaatttagacatatctaatcatgtatgttttttattcacaatttcttgacattgtatttagttttacaaccttttgctcccttaaaacttgacatgtatggtaaataaaaaaacatcaatgtgtgaaaattcaagtgccatcgatgagctttaacggaggaagccaaactctattgacaatattttagaacaaagagagtagaaattaacatctgaaaaatgctattggtaaatttctcataaaaaaccaacgatacttacaaatatatatagtttggaatagtaataataagatattttgccactttcctgaatctcgttgtgtcaaccttgctgtaccgtcgacgtctaaaacagaaaacgtaaattgagaggggtggaggtagcacaacatttggaccgaacccgacccaccggtgcgaacccgtcccggtcgtagtcgctaggctcgcgcacctcttgcttcagcttcactctggttcacacggggaatattccgctccccccacaaaccacgcgccccctcctcctcgcgccgcctccgcgccccgaatcaaagcacgcgaacgctagggtttgctcttccgctctctcgccgccgccgccgatggcccagcgctggcgctcgagggcgcggcgcgacccggacgtggacgacgaggaaggctcgcccccggagcggcggcgcaggggggctcgaagcggcagcgacgacgaggaggcgggcaacgaggacctcagcctcgagatcgtcgcgcgggcggcgcggcggcggcggcggcgcgaggccagcgccgggttcgcggccgacgccttctcgtccggggacgagatcgacgaggatgccgtggtggagctcggcgaggcggatcccagcagcaggaagcggcgcaaggagaagaagaagcggcgcaaggagaagaggaagcagcggaagggggcgccgcccgagggctcgccctcgaccgccgccgccgacaaggaggttcacgtgggcctttctttcccctgatattgcttgtgctctatctctgcatttagttcaccatcccatgccagaattgagttggattctttttattttgagactagaattgagttggattgtgagctgtacgtggactgattaactaactattctgttggatcttggagttcatatctaccgcctctctgcgaatgcagccgtagtgattgttagtaagcattcgatatattacgcccaaggggagcaaacacgtatactgattgatatcggtttatgtaaaatgtttaaaactttaaaaggcaatataaatttttttgttgaaagggtctttcgattctgtagacttcaagtgaaaataatgttttatgttgctgcttcttagaaagtatacgcgtattgaactatttgtgaatttattaatggtatggaaaccttacaaatagataactgattttatgtttgtgagtgagcattggtattcgatgtttctttgttgggaatggattactaacgctaatatgtttcggagttactaatgcgcggatttgttctttcagtctcaagttgctgggacccaggaggggcaaactggcacagcacaatcagtgctcactgaagatgggcctgatgtccctttatctgacaatattgttttacggaagcttcttgtaagtaccaagtgaatttccttgcatatgcacatgtggcacaagataataatactcatgttgcttttcctcatgatccagcgcataccaagatactttgatcctggtgaaactttattggaaacatgctttaattgtggtgaggagggtcatgtagctgtgaactgtccaatggaaaagcggaagaggccttgttttgtttgtgggttgtttggacacaattcaaagcagtgcacgcaggttggtctccctagctccaaggcattattgcttggtgacttgggtatgtatgctcatgcccttgacaagatcatcttatttagttttccattaattacatgatgttgctgcatttgttatttcaactcataagttaacatgcttgccttgtttagataggttccagacttccagttcattaatcacacatatttacttgcccctgccaatgcttcttgcctgtgtggcatggcctgccaatttcaggaatcaaacatttgttaatcatttttgtagggtcaagactgtttcatctgcaaaaaaggaggtcatattgcgaaagactgccctgaaaagcacaataggaatactcaacagtctactttttgtttacgatgtggagaatcaggtcatgatatgtttggatgtgccaatgattatccacgcgatgatgttaaggtcagtattgttttctcatggagggatacttgcctaaggaaaaaaaaatctaactcaacatatctttaaagccacctctcacttttaatatgctgtggctacaatctaaatcctactgttaatgcaaactgtgctgcttcagaatatacctatgaatgaattgtggttttgtcatttacgttgatccagctttatgtgctattcacaagcttggttaggttttgtgagccagcttaattttacattaagccccttccttatccttctgtgttagttgaatacctgaatccacatgttttgtccacttaattaacatgcaatataatgcaagtcattctcttatgtagcacaaaagtcctgtagcagcgagtttgcattaattgaagtcatagtattatccaaacttattttccccctccatctactttgttggtctgtgcaggaaataaaatgctatgtgtgtaatcagaaaggtcatctatgttgcgccgacttctctgatatttgtccaaaagaagttagttgttataattgtgcccaacctggtcatactggtttggtaagtttagtggttattatggcttcctttgtttctatatgttacgtctcacaacagctgatcatggttatggcttcctttgtttctatgtgttacttctcacagcagctgatcaatgtcttctgaaacagggatgtgccaagcaacgtagggaagctagtaccgcggcaactccaactttgtgttacaaatgtggcgaggaaggccacttcgcacgtgggtgcacaaagaacaccaaggttgttagaagcatcttattaattgtctactgataagagttgcttggggtatttatcctgtgtacatcctgtttccctttctgcagtctgatcgtatgaacggtgaatcatctgcatatagtcggaaaaaaggcaaaggcaagaaagattttggcactagatcagctcctcatgatgctcgcaagacaagtaaaaggaaaagccccttatttgaggaaagaaggaactcatctcattttaagtccaaagctaggggtggttggattgcagacgatgcggatgaccagccatacaagaagtgcaaacccaatgtgtgggcttctccatctacccctaagaagcaatacaataaccatcagttctcttctggtggtgactactcaactcctcagtcttcaagatggcagaaacacggtttcgcatcgccgagcgcaacttactcaccaaacacaaggaagcatagcttttcatcgtcgagattcgccagcaacactcatgtccggtttggaagaagctagctggaagctagtttttgacatttttttgccgttctgtttacaaacacaattgatcatcacttgtgcctgcaagggctgtttctgtatcttaaattacacatgtggtgctgtcgtgctgctgctgctcagttccagcttccttgcttcccccttccagctccgagcacgctttccttgtgaaatctcgcggctgtggcgagcagatttattaccagacacttgcatgcgcgcctggtcttttgttatcgttgtgtgcagcctacatgggcaacctactctggagctctttgctgcatcgaatcttacctctcccaacgatggctcgcagtgtaggtatgcatccacaaggcttctcaaaactagcccagtcatcctaccaagtgcactcagtttgggttaaaaaaaatcactgcttccagaactgttaacagtgtgtttactgaaagttctctgcatgttttccatgtttagtaaattaattaattgtgcgctatcaatttttctcgtttctagtgctctggaaatcttgtcgaaatatactccccttcccataaaaaataaatctagtacaggatgtgctacatactagtactgtgaatctgatggccccattatttcgcttatccgtggaataagccaaatgacatatttacaaatgaaaagctacagcctcgtcgagcttgctctatgcagcctcatcgcgtcggagaccgaggagatgtgtgttagtggctgcatcattgagcttgagctctacggcctcctcgcgttggaggccgaggagagacacgccagcggtcatcgaggttggagaggctgggaggagccatgcgcaatgaccgtctacttgaactcgagctctgcagcatcctcgcgtcatccacgaggcgtgcacactactaggaaaacgttttttccgtgctgttgactctgattttcgcgtgcgggtgcatatgtcgcccgcacggaaaaatccggaaattttttttcaaaaatccggtggcggtgccgctcccggccgccgcctcctcgtcgtcgtcgtggtggtggtcggccgaggatgccgctcccgcactcgtcatcgtcggcggcggcctccgcgccgccggcctgagggaaggaagaggaggggaggggagctggatcctgcggggggaaggtggccggccgctggatctgtgctcccgctggcctccgggctcccttccggccgcaccgccgccaatgcccctcccctccgctggatttggggagggaaggaaggggaggggcggggaggggagcaggatctcgcaggtgagagggtggccggccgccggatcggtgcggggacggccgccactgctggatccgtgcgggggttggccgccacccgccggatcccgctcgccatcgttgcgctgccactgccgacgagttccgtcgcggccgccgcgcgtcgtcgttgccgccgccgtcatcgcgcgccgtcgggactcggggaggagaggacaggagatgacgaggaaaatgaggagaggagaaaaagaggagatgagggaagaaaaagagatagagaggagagatgagaggagagagaagggaaattttaaagtggataggacggaaagggagggtgggtatttttgcgtgcggctctcttaatagatccgtacgtgaaaatatgcccatttttgcgtgcggtccatttaagaggaccgcacgaaaaaaccaattttttggtgcgatcctcttaaatggaccgcacgcgaaaatgagccctattttctcagacgcgaccagttatgtatggcctatttgcaattacaatgagtcactgtccaggaaaatcttttgtgtagtagtggcatagaggaaggggaggatgtcacctaaaggttctcaagatgacggcgtgaattctcacttcttgtggtaatgaaaagtgaaggtggaggttggctactatctctagtcctagaccatccaattctttgctgtggtgttgcgtcccttcgtgggtgatctagttgagtccatgctgcttgatttttggcgtgtccaccgttgtcacctcgggaccttcgccgttcttagagataggcggcgagagggtgagggaggaaggagggacaaggcggagaagatggtgtagatgtgttgatctggtagcaaattggtagcaaagtacgaagggtggtgtcgagctgacagctgcatcgacggcatcgagctggggctagaggcagattgctcttgtcctccatcttgccattatctcgaatgagggtaggtcagagactcagaggcgaagctcatcgtacttagtggagatgcgctcaatgagggcccgactcttgtcatatctgaaggagtctgaggcatcttcgatggcccctctcattgttggcgggtagaagccttaagcctatagtcacctggtcgcgccacttctaaccttgcctatcctagttgtaaggctcctggacgacgataagttgatgagcgagcatcccactctctcaggaggtagggaggtgcagataacactaatacgtggaacctattattactttaatcatgtaggacgagtaccgccttgaattttgttaggagggtaatttgtctgatttgaaaagtttaggcgtacaaaatgtatgaaagtttatggggcgatttagaccttttctatattcttctatacacacataaatgtgtgaattatgtattttgtaggtgatagctacaccgagttagcgtattaatattaaaattttcaatctctactagctagtggagtcgagcattcacgcaaccatgacctgtatggtatatgagcccatttacattatacactaatcgtacaactaaaataaatttatatcaagttttagctggtccatatgcaacaaagaacacattctgaatgagagtcctgaatagaactgtagcctaaacaatagaggttcatttatgcgtgaaattaaattccagtccaaactataatgttggtatggggtagcctaaacaataaatgttcatttgtgcacgaaattaaattccagtccaaacgataaaaaaaaaaattttcaataaagtcaaaggataacaagttcaatcgggcctaggatatatgcgaaagaaccagctgtcgctcaaaatacacatacagaatctcaagtgctcgctcggctcaggagagggtgtttcactcattggcgttcccggcctcaatatataagatggtgcaatgtttgttcagtaggcgaggtgggactaaaaggagagcttactagctcagtggcttcatcgtatgggcctcgaaactcggcaagcgaaagggccgcagcccatacgtgtggtcttcggctcttcgctgctgcagacgattttgaaattgattggttgtttgaatcttctaatcgcttacgatttgtctcatcgctacgatacgatgccccgccgccgcgaaccctccgcctccgcagccacacgaccgcagcgacggtggcgcaggggctctcccgccgcgccgtgcaacctgccgacggcgtgttccgggaggaggctgccggtgatcgtgccgttccacgggggcgcgttcgcgaggggcgcggccgacagcgacgccatcgtggtttcatcgcgctctgggcatccacggccgcgccgtccccggcgccatcggctgttggccccaccccggctgctgcggcggcggagctcctccgccgggtcgcggcgcccggggtcgacccgtgcccggcgctgcgtaagctcgcggcgttcctgtctgacgacgacgtcgacgaattcgacaagaacgcgctcgcgagggccggtgggcggtggcgcggcggagaccgtggcgtcggtgctccggaggagggggaagggcgatgatgatgatggcggcgtggaggccgtcgaggcggccgtccgggtgctcgcggtgctcgccacgtcggactgcatcgaggaggagaacaggaggcgcgtcgtcgccgcgctcgccgcggggggcgccgccccgtcggtggcggcgtcgctggcgcgcgtgatgcggagcgggagcgggctcgaggcccgcgtcgacgcggcgaggctggtggagtcgctgctccgggacggcggcgaggatgatgaagtgcggcgggatgggcggcgcggaggcggcggtgtccgtgctgtgggcggtgtgccaccggtacagggaccggcgcgcggcggaggcggcggcggcgtccaagggcgggctgacgaagctgctcctgccgatgcagagcgggtgctcgccggcggcgaggcagatggcctcggagttccttaagatgttcaaggtgaacgccaagagctgcctcgccggccatcctgcaccgagacctcttcaacggcggtggcggcggcggaacgcgtgtgcgggcatggagcacgcgcacggcgaggacacccgagcgccacgccacgccgtgtcgtctcgtctgagcttgctgctgccgtcgccggtctggatgaggcggcggaggcggagacgtgcaccacaagacaagactgggcccccacattactggtgggccctgaccggacaaccagaccaaattccgccacctccgcttccgtcgcttctagaagccgacggttatttatacccccggctctttcttcattcctcgcctcgcctcgcctcgcctcgcctgagccccaagcccccaacctcaatcgcaccggcgaccggagctcgctccacccccaccccgctgccgccggcaagagggtggcgctctgctgcgacgtgcagagtccagctgccgacaacacggccgcgcgctcgctccgggagggcagggaggccaggcaaagaggccaagaacacgctcaaaaatcaagaacgcgtgacatcgatctgcgcatggcgacgccaccgccaccagctgttcaaaagatcaaggtagactaggtgtccataaccttgatataaaaaatagctgcttattaagcaaatgacttttccagttgtttaatggtgaaggcctatggcaagaccttttgcgaaataaatacttaaagggtaaacctctctctggtatgtccagtaagataggtatttctcagttctgggccggtttaatgaaagtcaaagaccaatttcttagatttggttcttttagatgtggcaatgggacaaacataagattttggaaagacacgtggttgggatcgcgtgctttcaaagatcaataccctacattatataatgtggctcgaaaaaagcagtatacagtggcagaggtcatgagcacaacgccgctaaatatctcttttagaagagctattgttggccaaaagctaatcgagtggaacgatttgatcctcaagctagctaatataactctgtcaaatgaaaaggactgctttgtatggtcgctccataagaatggtcaatttttcgtcaaatctatgtatgccgcgatcatgaactgtaatgttcggataaaaagagaattatgtgggacttgaaaattccactaaagatcaaggtctttatgtggtttcttcgtaagaaagtaattctaacaaaagataacctggctaaaaaaaaattgggggggggggagacaaacattgttctttctgctatgcacaagagacaatccatcatcttttctttgagtgtcatgtcgctcagtttgtttggagatgtgttttttttttgcttttaatatctccccaccccgtaacgccaaaaacattttcggtaattggcttagaggggtatctaggtccattaagaagatgattctaattggagctagcgctgtatgttggttaatttggcgttgtcgcaatgataaagtttttaatggtaaacaattatccaaccctatgtatgttatcttcatgtcttcctactggctccacttctggtctacaatgctaccacaggaggagcaggatactatgcacaatggtgttacactcttggaattggtagccaatggtctcttattccactatgggtggcgtagttctataagaattgctagctaaaatattttatgtgtttaacgctagtcaataatcaaggggagttggagatttgtcccatcaccttatttctcattttgatttacttttatcttacctttttattactattaaacttatggctgtgtgtcttatgacagaagccggagatgtaatccatttccattatctcaaaaagttggtagcttgaccaagattcactaattattctcagaaacgacatatcaagattcaaattcagattcaacctcagggctcagggtatagaagaagagagcgaagctatgccatgtcctcgctgatgtggcgtagaagctgtcctcgatggtcaattcacaggttccttaaatttgtcgaagctgtccgaaacgtcaaacagaacagaacggatgtaatataacatatacagtatgtggttgaaggggaagatgacaaaaaggaaaatggcgaggagattttgatcaagcactgtgaagttgttgtgttctctttttgacaggaaggggcttgctgttgctgacatgcgtctcctgggttgccagacaaggaataattcatcgtagtctgctagcttcagtaggatttagcttcaatagttcatccctccatttttgcagaatctgtcaatgtatttcagaacgcgaccacgcttccgtcttctgtcttcacgagatggaatcgtattccgtttgattcagagtcctattccgatccagagtttagatggaattctgttctgacgcaagcactgatgtttggtcggattccctcctgctcggattggggagctataaatatagggggatcaggtcacgttggttccaagattgcgagtttctcttcagaaatcacaacagaactagttcttccaggattgcaagagccaagagccagggttttactgtacaaactctgaactctgaagatttgccaacttttgcaaatccaattctgatccagagtttagacggaaatctgcccatgttctcatttaaccactgaagttggtgagatttcctcgtcctgctcgggttggggagctataaattcagagcgatcaggtcacattgcatcaaacattggagtcttttcttcagaaatcattccagtatagcaagacatccaccaagagccaggctctttttaacaggcaatatgggctgtacaatctccaaagttttcccaagttttgcagagaatttcttgaaaggggccaaggcaggaaattcactggagctgccgcaggatgtgctgatggagatctcggataaaattttttttaaatttttcaaaagtgtccgaggacaaaccaattcaatcgggccaagatgaatcaaggatgcacaataaagaaacccacgtgttcgacgtgctaggctcggctcaggggagggggtttcacgccgtggcaatccctgcctcagtatataagatggtgcaatgtgtgttcagtaagagaggtgggactaaaaggagagcttactagctcagtgactgcctcgtatgggcctcgaaacttggcaagcgaaagggagcccatacgccaccgtggtggccgtcgggtacctgctcaccccggcgctgaggtgcaacgcatgtaaaataataggaaaaagtacaccgaaggtccctcaacttgacatcaagttacaaaaacgtcctcaaaccgcaaaaccagatatccggtgccccttaactaatcaaaaccggtcactttaggtcctccggtggttttgactccggttttatcctacgtggcagctgagtcagcgtaggacccacgcagaccccacacgtcaggtgtccacgtcagcacctctctctttccctcttctctttctttgtttctcctctcgtgccagatctcaccgagaacgtggtcggcaccctgggtgcggcgcgttctcgctgccggtgagggcactggtgccgctgctctacacggtgcgccgcgtgttcgtcgtcgtggactgggtgtacatttgatggcacgaacatcactgggaggatcatgaacatcaccaaggaaatccacccgccatgacgcacctgcgtgaggacggcggcaaaggacatcccgagaggaagcgcgagatcacccggcagctggcgctagcggagcgggaggcgacacccaaccacacgctacggcgggtcatccaggcagggtgcgccacgcacgccttcgagcggttccccaccccgtgtgcgcccgttgactcctgccgcgtcgccgcgctcattgatgaggggacaacgatgctcggcggcggtggcaggcagcggcagctcaccgcgctccgggagatcaaggccatcaccaccgagagcgaccgcaacaagcgctgcgtcgaggccactcctggtgccgtcgagttcctcgtctccgtcgtcgtccagagccacgccgccgcctccacctacatgtcggccaagtcggacgatgacctgctcgactcggtgatcgattcccccatctcgacgagctcgccggaggaggaggccctgggcgtgctctactccctcaagccgttcgagcccaccctgcgccgtatcctcggcaaggacaatggcggcttcctcgacaccctcgcctccttcctcctactgaaggcgatgatgtcagcgatgccgccggagcggctaggctgtcgccccatccgtcgcagcatccggagccggacccccttacgctgccgatggcgagcgttcctcgaagaagcaggtgagccggacgacaaggcatccgcggccgtagccgccgctggcgaggagtaggaggatgacgctgctgtgtccatctcgcggcagcgactgacacgtgagatttgggggagaagaccccgtgatctggcatgctagctgcggccacgccgttcgggcggtccggcgtcctgccgccgcaggcgctcggccaccggcacgccgtcctccatcgtcatcgtcgccgccgaacccgcggacgctccgggaagccagctacttcttgggctccgtctcggcggctcgccgagacagctcgtctcgtcccttgagcgaaccggcagtagtagcagcaacatagccacgacgccaagaaccaccaaatcccccaccgctacgacggagacgaccaccacgacgccgtgtccagcgtcttctccgtggacgctggctcatggccgccgcctcctcgtccaactctttatgctcgaggcggcgcgagctcaagacgtgggtctccgaccgcctcgcagccaatgacgcggtcgagctcgtcggccgcctaggggaagctcgcgagaacgaggaaggaaggagagaaatagagaaagagaaagagaaggggggaagacaggaagagagaggtgctgacgtgggcacctgacatgtggggcccttgtggggctcatgctgactcagctgccatgtaggataaaaccggggtcaaaaccaccggaggacctaaagtgaccggttttgattagttaagggatgctggatatctggttttgcggtttgaggacgtttctgtaactcggtgtcaagttgagggaccttcggcgtactttttccaaaataatatgcatgacgctacttcaacatgcgttctgccagtggagtggttagttacttttgtttgttgtcctcggcccacggttcgagtctcggttgtaccctctttttacagctccttatatcaatgggttaattggatccatgccattataaatatcagggttttgaaatatgctattaatattacctatttggattcatgccattataatttcacaccttttttagataatggaataaatatcccggcctttgctcattagagctatagccaattattacaaggaatcacacaaacaacgagtgaagttcaaataaaattaaacacacccaaagataaaaaaaccaaaccaagaaaaggagcacacatttattcaaatctatttgtgaatctccatccatggttcgcaaatatttgcataaccgtcgtctccagtttatggcatgcaaccttcataaactctccatcatcttcacacttttgcagctttgcccaaaaccggagccaatatgttgccttgaatattacctgcatatatgagatagatggtgatttgtcaaaaactatatcattcctactcaaccacagagcccaacaaatgacagatgctttaacaagtatgagtttactcatcttcttgtcaatccctaaaagccaacaatcaaacatattagatatggtactagggaggtttaaaccaaaagaaaactgtactactctccaaacaaattttgcaaaatgacagtcaagaaaaagatattgaatggtctcattttccatacagaaacaacatcttaacctgccattccaattccgtcttgccaaattgtccttagttagcaccagccctttaagcaagtaccacataaagatcttaatattaagtggcatcttaagcttccaaacaatcttatttctctcaatataaccattattaattagagcaagatacattgacataacagaaaatctaccattccgatgataattccatctaaaacaatcagaggattggttcaactgaatatgtataatggaagcacacaaatcatgccaatatataagattctgaccaactaaggatctcctgaaggaaacattaagtggaacagaactcataacattagcaatagtagaacttttccttcggacaatagagtataaagatggatatttatctttaaacgccaagtttcctagccatttatcttcccaaaaccttgtttgattcccatcattcacaatccaagaacccatatgtaagacagtatctttgaccttcattagacctgaccaaaaatgagaatcaccatgtttcctactttctctttaataaagtctgccaaacaccttcctcattaattaatttaaacaaccacttacttaagagacacttgttttgtatttccaaattgtggacccctaaaccaccctgatccttgggttgacaaactatatcccatctagtaagtctatactttttttttgtggtcatccctttgcccagaaaaaacgtgatctataataatcaattttttgaagaacccctttcggtatctcaaaaaatgaaatcataaacataactaaacttgaaagaacagagttaatcaaaaccagtctacccccaactgacaaatgttttcctttccaactacagagtttttcctcaattctttgctcaattacttcccaatctttattattcagcttcctataatgcatcgggataccaacatatttaacaggaaacgagccaagcttacaaccaaagatgttagaatactgatcataaaactcctttgcgtgaccaaaacaaaataattcactcttgtgaaaatttatcttcaaaccagacaacttttcaaacacagataaaatcaatttcagattcttttcttgttgtaaatcatgctctaaaaaaataatggtatcatctgcatattgcaa

SEQ ID NO: 47887 - DNA, 1922 bp, Oryza sativa
tcaatcttaaaaatcacaacacttttatttttacgatgtaattcatgcatagtttcatgcaaaataacaacaccttccataatatttctcctaggtataaaagcagtttgagtaggactaatcaccttttgagcaacactcattatcctatttcacacctatccattatataccactacttacccctttaacacattttccaagatattatgaccaaattacccatatattcttcttcatcggttcgtcccctcccctctctatcttgctcgtcgaacctgacatcctagcgaacgagacgaggtcacgggcgcaggggatgttcccacctggccggatgtgctcgcgctccgcctcacgcacttgctgctctctccggcgcaaccctccgtgcccatggctgccgtgctcctgcgctgtttcatttccgccagggtcacaggacacgggcctccacgtcggggatccccaagtccatttggaagaagctctcctactccaacaggaaaaggagcagcaggtgcaaccacctgctgcttgcttgcatccttcctaatgccatccaataggaagagtagtagcagctgcaaccaccggctgcttgaagggagaaggagatggaagatgaacatggtagagaactagagattggaagaggatgaggatgaagatagggacaatttggtcctataagtttagaaaatgtgctgaatgggtaagtagtggcatataatagataaatgtgaaattataatgacatggtttcaaatagataaatatcaatggcatatttcaaaaccacgaaagttataatggcatgggtccaattaaccctaaaattaaagatcttgaaggtggatgattttaataataacatttttggggaaaatatatgctagttaatgacatgcatgcatgcacgtcttatatcatgaaacaatattaaaaagtagttgtgccttatattatggaactgagggaatactagttaagaagatttacaaaagttttatgaataaaagcctaactttatggacagaaactatcaacatataaactttatatattcatatctctatctctatttattataaaaattgaagatgtttatgtcggtactttggtacgtcatccgtatttgaatcggttttaattttatgtttcggttttaatctcttatctctatcttctctacttaaaaagaacaagaaatttccataggcggtgaaaaaagaaaacaaaagtctgactaaaaaggtgaaagaaaagaaaaaaaaagtccaactcaacaagcaataaaaaaggggaatgctaaatagttgtcgacgtcgcatgatttttgatagctaaatcattgatgtttcaatatatttagaaccgttgtttcatatgttgtagcaaaatgtttcacgaggtgatttaattgtgtttcagcttttaaaaagattgaaacatttccaatctacttggtgaaacatttacggtgtttcagctttctaaaaaattgaaacattttcgatctacttggtgaaatatttttgatctacttgataaaacagttttaatctacttggtgaaacactgaatgatgaaagactaaaaaatcatgcgaatcccatatagatagtcccataaaaaaagaaaaggagaaaatcccctatgtacccatgaaaattcacctaatcccttttatacccctgaattttgctcaatcccttacatacccctgaattttagtttggatcccttccatgccctttccgctagttgaccgttaaattcttttgaaaaagttcattttgccctttgctatgaagaaacataataaattaatgaagtacattgttggaatgtaaaaatttattggatcaaactattatatttatgagtctgtgatgcaccatattatttgtgacaaattt

SEQ ID NO: 47888 - DNA, 1293 bp, Oryza sativa
cacttggatgaactcctggcggcaccacctccggtgggaacatcacccacttcttggctcccttgatcacagcattccacgccgatgtcgagtttggatcaacatgaaacgacgaccctgaacctgccggcccaatgataacccatcggtggtccggcctttcctccccaagcaccccgaataggtcctctcggaagtacgccggcacctcatagtccctccccatctccggcaccttctcggtgaacttggcatcgaacaggtacaatggcctctcctcctgcacattgtcggcatactggaggtacctatccagcgtcatgctcaccggcccgacggcgaactccttcccggccgagaccttcagcaagtgctccctggtccacttctgcaatgctggccagctctcgaggcagccttccagaagcaccggcctattgggctcctcgaattcggagacgaattgctcgacggacatgccgcggcggcgatcgatggtgtcccggtggagccactccggccgcatctccatgttggcgcagagccagctctggaagaggtagtcggagtagaaccccctgatctctaggccccgcggggggaggtgggcgcggccgcccgacgcggcggcgatgtaggtggcgcgccacgagcccgagaaggcgaagtccccgccgagctcgtcgaggacgagcgcccgccagagcgggtcgtgggaggcgacgacgtagagcgccctcgacgccgcggagagcctagcgaggtcgcgcgccgcgagcaggccgagcacgtcgaggaggacgtcgtcggggagcgggcggagcgcgccgagccccgcgtcgcggaggttgccgccgccgccgaggaggaggaggttgccgagcggctgcacgaggcatcccccatcgcctcgccggccgctcccggcaccccccggaccggcgcgcgcggaggtcttcaggtggaaggcggtggcgtctccggcggcggcgtcggcgaggcggttcttggatttggtggtcttcttggggcgtttgctgccgccgcggccgcggccgcggcgacggctaggtttggggttgcgaatggcggggaggaggagggagtggaaggcgctcggcatgctcggcggcggcggcggcggcggcggcgggagaagggaggggagggagggggtttgagacttcggaaagtataggaggcaaatgaaatgggcggaatagacgatccgacggtcagtgatgcaactctgcgagaatggacggcggatcgatacctgcgatcttgaaatcc

SEQ ID NO: 47889 - DNA, 6503 bp, Oryza sativa
  unsure (1)..(6503): unsure at all n locations
nnnnnnnnnnnnnnnnnnnnnnnnnnnnnnnnnnnnnnnnnnnnnnnnnnnnnnnnnnnnnnnnnnnnnnncgcacgccacgtcgccggcctcgagtcgacgacgccgtagcccaccgacatgagcggcgccaccgccaagttctcttcctcctaccacctcgccgccgcgctccgccgcgagcccgacccggcggccgcgctccgcctcttcctcagccccaccccgaccgccgccgccgggccatcctcctcccccgcgccgccgttccgctactccctccgctgctacgacatcatcgtctgcaagctcgccgccgcgcgcctcttcccggccatggagtccgtcctcgcccggctcccctcctcgctccgcccgcgcgagcccctcctgtgccgcgtcatctccgcgtacggccgcgcccgcctccccgccgccgcccgccgcgccttcgcgcacccggcgttcccggcgccgcgcaccgcccgcgccctcaacacgctcctccacgccctcctcgcctgccgcgcgcccctcccggagctcctctccgagtgccgcggctccggcatccaccccgacgcgtgcacctacaacatcctaatgcgcgccgcggtggccgactctggctccgtcgacaacgcctgcctcctgttcgacgaaatgctgcagcgggggatcgccccgactgtcgtcacgtttggcaccctcgtcactgctttctgcgaggcaggacgtctagaggaggcattcaaggttaaggaggtgatgtctttgcagtacaacattaggccgaacgctcatgtgtatgcgagcctgatgaaggcgctctgcgagaaggggaaggtggatgatgcgcacagactcaaggaggagatggtgagcaattcagaacctttggtggattcaggagcttatgcgacgctggcaagggcattgttccggttagggaagaaaggagaggttgttagtttgctggaagagatgaaggaaaagggaatcaaggttggtagagaagttcataattcgatgattgcagggttttgtgaggatgaaggggatctggatgctgcatttgcagcgctcgatgacatgcagaagggtgggtgcaagccggactcggtgagctataatacactggttggtggtctatgcaagatggggcggtggcgggatgcaagtgagttggttgaggatatgccacgaaggggatgccgtcctgatgtagtcacctacaggaggctgtttgatgggatttgtgatgctggggggttcagcgaggcgaggagggttttcaatgagatggtattcaagggctttgcaccaagcaaggatggtgtgaggaaatttgttgcatggattgagagggaaggagatgcggcgtcactggagtcagtgttgtgccaattggctagcgttaacgccttggaatcaagtgagtgggagaaggcaatgagtggtgtgctccatgatcctgcagagcagaagattgtgaagttgctggataatttgagcttggcttgattatatatccctatggattgttgtcactgtactggttgtttttctgatctgccacagtagtttactgatttaaatttgatgactcttgagtaattatcatgggaaggaaagagatacaacatcatcaatacgaggagtttgtcattaaaaatacatgccaatctaacatcaatggtgcattcttgaagcaaatgaagcaaggagtcatagggatgattgcaagtgatgatacagaccaagtcttatttttcataacgctgccgtcttcagcaatgattgcaaacagagtttgagcatgcaaatatgctctgtccttggcaaagatttggatcaaccgcctaatcatcgttgagtaaggcactgcaaatccagttgagcttctatttctctacgatgtggcatggagtccatccaaattttttacaccgaagaaagatgtctgaaaacttgcagcggagatatcaaaattaagaaaaaaaaaactcggtagagtaggacatgaaattgcctggaatgcaaaattatcaggacttaatgctgttatgttgtattttcagtccaagttcagggttgtatatagcaatatgagctccgggattgtaccccctatacccgtgatatctaatactcctaaagatctctcttttcccataatgaggtaactagccgagatcagcgaaaagaagaacaacacgagtgcaacagatctggtgacatttttgtcagtcgctaacatcgggaaaagaaaaagagatcccgaggcacattgaagttggatgaaatcatcacagttgccttgttgtcgagggtacatcgattatcactgaaagaataaataactacgaggaccaatattaaatctaattggttgcaccataggaaaccaacctagccagcccataggaaacatagccagttgagctcactttgcaaattaaggttttttttatatgtgaatgaaatgagcagtaactctaaatatagttaactaaagttcaaaaaaatatatagttaagtaagtttggtccaagcaggggaaggcctatcagtgactaatcctagcccaacaaactatctgggccaggcaagtcctatcacggcccaaataacaagtcccaaaacagagagcctaaacaacaactccatccgagccgtccattccgcgatcagagcgctctctccgccacccccctcgctatataagcacccgagggtgcatttctagggtttccgccgccgaagccaccacacctaaacccttcttccctctcctcctccgccgccgccgccctcccctctcgccatggtgagtgaacccctcctcccccctcgacgccgccggtgaaatgctcggcttctccgtccatcatagtgtgacggggtttcgtggagattggttggttgctcacgccgcgtgttttttgttttttttttggggggttttgcaggcgtcggagaagaagcagtcgaacccgatgcgggagatcaaggtgcagaagctcgtgctcaacatctccgtcggcgagagcggcgacaggctcacccgcgcctccaaggtatatcctccattggttcgattgatttgggtggtagatctgctcgtccgcgatatgctctaagcaaaagtttgtctcaagaaatgcatgcgtcgcagttcgaatcgaattcttgcttccgcttccacgatcttctgtatgcaactcttgatttctttttaatcaaaaaaaattctctgtttcgttctccttcctaggtgttggagcagctgagtgggcagagcccagttttctccaagggtaagcgaattttgttccaagctttgtaatctctttcatcgcgttgttaccaatggtgccaccgtgtggtttggtttcttacggtgagagcgatgcgatgtttgcagcgaggtacaccgtgaggtcattcggtatccgtcgtaacgagaagatcgcgtgctacgtcaccgtcaggggcgagaaggccatgcagcttttggagagtggcctcaaggtcaaggagtacgagctgctgaggaggaacttcagcgagaccggatgcttcgggttcggtatccaggagcacattgatcttggcatcaagtaggaccatctatctgtcttgcactcatgttaattcatacggtttcagtgtgctttccttctgtttatatggctatgacgaattggttgtggttgtccggtctctggacgtttatttacctgatgccattgcaatctgctttggtggataataggcttggtagatgttcctatgtgaaatataaacacatgtgcattcttgaatgctcagttgctcgttctttacatttgccgttataaatcattattctatcatataccgaatgattttatttgcacatatagcctactagttttgttccttaagtcattgtatgtcatttcataaatgccacaatttgatccttagtcattgtatgtcatttcataaatgccacaatttgacattgcatggaatttctgatgtgtgcgccattgtttatttctacatgaagtggaaatttgtgatgcatgaacgaaatttttgcccctctttggtactgtcctagtttaaatagttttacatagaagttattttatatgaacccaggtgtaactataggggcttatgacctcaagttagataatgttattccaggttaaatatcttaatttaaccatgattaaccaagatcagaacactgttctcatctttatcaaatagtttacttttgattgtttttgtgaccttatattacgatgtttcttgtctacaattaacattctgcaacattccttatgtttcctagtttatattttggtgttactttgcaactcatttgcttgagccacttgtatatctgaaacaccttttctgtgctttgtattgtagataattcgtattgtagacaatcttataccaagcgtaactaggagtactcgtgctaagagaattaacttgtctaatcaatgtttcaggtacgacccgtcaactggtatttatggcatggacttctatgttgttcttgagcgtgctggataccgtgttgctcgccggcgcaggtgcaagtcccgtgttggaatccagcacagggtgaccaaggaagatgccatgaagtggttccaggtcaagtatgagggtgtcatcctcaacaaggcccaagcaaacacgtcgtaattggcaagggtttaaccagttatcctgtagaattaagtgagggttcatttgaatcatggaactgtctttcttgaaagccaaatgcactgtcaattttgcctctgttggagttgacctgcgtctatatttccattaaatgcttaatgatatccttgttttaaatcttaatattaaggcagacttggaatcaatccacccgctttgttacctgtatttctgccttatcctgtgtcaggcaaaagctaagtagcaacagtcaaattgttcattttagtgatgttttatttggggtgccaatttcttcttttggactgcgacttgtgacatcttcatggcggtatacatcttactctcttggtaatgtcaatgcattgctatgctttgggcgcatgtttttatcgatatggtgtgtatttgttcttggggacatatccggtaaaaatgagctaagtgttgaaaactcgtgaaaattatacctaaaagttttgtaaattcatgaaaaaaaatactagagataggtgtagatatgaaatacattctcaccaaatctcacgttcaaactcaacttcgtttaggagtaacaaaaaagacaaatttcaggtgaatagtaacatgacactattcacctgaaatttgtcttttttgtttctcataaacgaacttgatttggagttgagatttggtgagaatgtatttcatatctacacctatctctagtatttttttcatgaatttacgaaacttttaggtatgattttcacgagttttcaacacttagctcattttcaccggatatgtcctccttgttcttagtatgaaaaatggtaaattgggtaaaaaaaacactaaaagttttgtcatctaagggtgtgtttggttgggggcacgaggctggatgggagatggccacctgattttttttcttagtgtttggttggagggcagggtggatgggttccctcaatatgctggatgagtgcatccggccgatttggctggccggatgaagccatccagttttggtctgggtgatgtgtcctttggtttggtatgattggtttgattttctgttaagcaagccccaaatttttttctcctaaaccgtttatctaatttgtgatttgattacaccattatatttgttataattaaatctttaaaataagaatgattatattttgataatatatatatatatatacaacaaatgggtcctactaacttatgtctttttccatccatgctatattcattcaaccaaacaagaaattggatcgctatatctatataaaccaaataaaaaattggatcgtcgtatccaacaaaatatggtcccatccatgcatgactgtgaaccaaacacaccctaaaatagccatctcatctgaatagctgaaaatgatttatccaaaatggcaatttagaggatctcaaagcacatgattatggagcaaccatggcaagacgattacaatgatcaagcacgcaatcaagagattgcataatgagtggctcttgcagaagccgctgcatgccttggaggagccttcgacgtcgacgcccgccgtcgcgtgccaccgcttcatgaactccttgcctccgccgccccagccggtgatgttctccgccgtctcgccgcagatctcgcagcgcctgccatttttgtgaattccatgcaaaatattgtaaatatttgcgtaccgcttatatatgttgacaaatatatgtatttttctgtaaaaacgttatactttagaaacaaatcgtgcttagaggtatatata

SEQ ID NO: 47890 - DNA, 6170 bp, Oryza sativa
ttgagaaaataaaaaggtttagtaagatcccacaagaggccccaaaataagacccccttcctcagctgccctcaaacttgagggctttaaaccatagaccccatccatagttgtggtgataggaggacatttccaccggccgttactctctccatgtagtcatcgttccaccgttggccctactctgattgtatccatgatgatcaccacccttccccgtatctctacaatgccacctaagctcaactagtaccgtttcaccgcctcgactccacactaggagctcaggtggagccttggctcccaagctcgggcactcttattcctttcaagcttcttggcctctcgagctctagcagtgaccatgccaccgtccttcctacctctaccgccctccctagcgtcctatgatagtcacccagctacttcccccacctctgaatgtgcctcctccgtccattgccccttcctgcctccaccatcaggactctgaggtccctcgacgacggatttggttcctgtgcagtctttagtatgactacaacttaggcagtcatacaatagccgtaggatgcaaatccaaaggcccaaatttgataagacactgttcattcggaaaatccagcacaagattattatggcaagcctactgtagcatttaatctggactttccattgaaaaattgaatggacaagatcttgtgcagtccctaaagtgcagttacagttaggactgcatctgatcccaatccctcgacgaccatacctccggccgagagcaaggtattttttatgactattggtattttcaacatttaataatagtatttatcatttccatttatataaatatgaatttgaattgtggtgtttgaaattgtgaatttgtatatagctgaattctatgaattaaaatatttgtgtttgaattaccatggtattgaactacgtataaagcatatgatgaaataaaaaaataaatgtgaattgttactcgagttgaagatattttttatccttatgaaatgaggcaacacttattcggacctaagagggttgaaacgaaggcattgtattgtggatccggatcaccttagtttagagcctaaaaatataggcgtgcagtaccatgagtcaatcgctatggtagtaaacaattatttttgtagttatttacagtagcaacagtataaaacatgaattgtactatatcgcattattgtttattatatattgtagtatactgtagtgatcgatctcgttcgttcgttacaaatcggatggctgggaaaaccctagtcatggtactgttcacctctcactttaacccctaaagtcaggggggtctcaatccattgttttgattgtagaagcagaacagtgctagaggaaaaagattggattgatgctacaagcaaggcaaattcaaagttgctactagtacaaagaaatgaatcaccatcaaagataagttcttgaacagtgtgagtgatacttaggtccacatggtgctgagtgtttgcaataattcacatgtgtagttttctatcagtattttaaaagggtagttttcttttatgctactccctctatccacaaaagttacacatattacttttgacaataagaccaaggagaaattaaatcatcttggatgttacaaaatcaaggagtgaatgcaagcatacaaccaaagagtatttatagatgatttcttgggttctaataaaatatttaatttatctcttcatttaagttttgaatgcataaagattacaaatatgaacaacttatttgaaaaaactcaaatgtgaaataggtgtaacttttctggatggaaggagtagctattaataatagctaatttttggattaatagcaccctaacttgtaaattaaataaaattgcttgttggaccaatcaagatgcacccaactgatgccaggtcaatgctcccaggctcccagttggtataggtaatatgctaggattgcaagggattattccaccatgattgcacggctttattctttctttttcactacagcgaagattccgtcccattattgtcataatttatggccatataaataaataaataacttagatattacgtacttcaaactggtttcgacagaaacatgaacctcaccagcacatgctaattaaatcgctttgaaataatgagtcctttttcatgaaaaagaaaagacgaactctacaccccatttacatatttcaccaaaatgttataacatacaatatatctacggcccaaaatataacgatttttatcttttcgaataaatgtagtaattatctttagaactaatctcaattggaatttaattgaattcatggagaacgaagattgcatttaaattattgtagggaaacaaagaaagctcatcaacaattttttttcttgaaattatcattaaggaattcatcatccattaactttcttctatgtacaaagaaatggatcgaggttgatcggaattggatgggagtgagtacctgttgcccctgacggagaaccacgcctcggcgcaacgccggtgcgccgccgccagctcgccgcggcagccgcacccgagcctcaccagccgcccgctcccgctctccgccgccatctcgccgtcgccgccgccgccgaggtggcaaatcctgcagcccgtgctcgggcgccggctgcgatcatcatcatccgccgccgccgcacaactctcgtcgacgtcgaccaccacatgcgcgatgacgcccgcgtccccctcccctccggcggcggcgatcaccgccatggcaatgtcatgatggcgatcggcacgcggccatgtgggctgggcgcatcgatcgatcaaccaccagggaagggaatctaggtgttggggaatatagtaataataataatgacaagaaatcaagaaatgggagaaaatgatgggggacggggaatatcgcctcggtgctgcgaactgaaggaaaaggcgcggggagggggagggacgaagctataaacaagttgacctacgacatgggatggtaggattggagacgaatcaggccatgtcatgtcgaggaaggtgggtccaactagtggtggagctaaaaccttcacgcataggactgaatcaatgtgagttcaaatattttcacaaattatatactcccccagtccctgttttagtattataagttgttttgcctttttttctatagtcaaactaagtttatagaaaaaaaatgataacattttcaatacaaaacaaatatattattaaaatgagtaaatttcacaaaactatatgtattttgatctaaccattagaaagctatggatttaaggcgttgtatcataaaactatagatttaaagttaagtatcacaaaactgcatatttaatattgaagttatcacaatttagagtttaaatccctagcaccattattatgctagagcaataaacattattgttttgtaactaaattggttctaaacctatagttctgtaataatgtagtaactaaacatgtagttttgtaacatttcatcttaaatgtgtagttttatgatacatcgagttaaatatatagttttgtgatagtttggtcatagtatgtgtagttttgtgaaatttactctaaattttaatcttacaaacctaacaagctatggggcccaagccctaactgtcccatgccttttttttcatctctataggtggtatgtaattcatcttttaaatgctcgctctattcaaaaatagttctcgttttagagtttaaagtttgccccaattcaatccacactacagtactacttgttacattaagaaataatcatctttcatttaaaaagttttcccattctacacccaacaattaaatagcaatatagttttctttctttttaaatcttattttatgctaaacaatctagaaaaatgaaagataagtattgtgcatatgggagtaaggggttttaaaacgacactaattgcttatggttgaccatcgaaagttgtgccatttttttaaaaaaaaatccagcaatgcttgatgtagtctttcgagagagagaaaaaaaattcaaatatgtccttccgtgtagcacggtacatgtacagtgtacactgtccacggctttaaggtaaacagtcaaggatggaaggaacaaggttacaaggagagttattcatcagaggcatggtggcatttacatcatggaatgtgaacaaaacagtggcagtttacaggttacaactacgcctacattagggaactatattcttctgttacaattgggcaaaaaaaatgaaagaaaactcagtcatggatctaaacatttcggtttcctccgtcataccagctgatcccggtttcactaccaaactcgcgatgcaaaaacttctcgatttacaatgttgttcttcttcgatgattgaattgaacttccaacgaagcatttgcatatcatcatctgaggaatcatattttctattcttcttgttttgcggggattcgaagaatcatctgactcagccttcatgtgaacttcaccggttccgcgaaaacgatccaacaaaaggtctggtggtgtgcatttagcatttttagctcccagtattgaagaagttgtgggtagcttgccgtcgaacatgttctggtatgagcctgctgatgagctcttgagaagaatttgctagctgtagagaccaaaaggcagcaccaatgagcaccaaggagagtacacattttctcatggataccaagatctgaagttgtgtagcagattatgtttcatctgattcacttacttcgtgtttgaagttgaatagtggtggaaatggacgtccgtttggcaagcgtgcattcggctctcgcagctcatcaaagaaaggatgtgcacatgcatcaagctgcataaagatattcaaatgaataagcacatcggaaaaaaaatcaatattaagttgtcatctggctattgcaattacactgaataacgactaaacatgagacaactatcattcatccaccccaacattgatttggtaatggaccactaaagatcataaccataatggccatgccccactaaaaccaaagttagtgaagactagcattcttcaatctactttaggaaaaaagaaaaaagagaaagaaacaaggagtgtttctccactccaccccatttcaggagttgcacaaatcaaagagcacttggagggcaaagtgattaagaaaattccttggttacgctcaaatttgtgcaactcttaaagggtgaaaagtaacagctcatatgaccagctacagtaggcaaacttgcataacagcaataagaaaaggggcgttttacagtacccctgctgtgagcagtagtgaaaaatcacttttctactgttctgctacttaaattgcagcaagaatatactcacagcagtgcagcggagactcggtgaatattgaagaaggcgtgaagcgaggtctattgcttcaggaggcatcctctttggaaaacctacgcagaagttagaaaaatcagtacctgtatgcacctccttatttatacattgcattgtaaagctatctggtgtccagaatctattattggaaatgagcccagctacattttcatagttgtccaggaaactataaaagatgacgtgatatatgactcaacatggataagattgtatgcttaccttgtgccaagggtgagcttttatctgtggaaacctaaactctgtatagttcgggttcatgcaacgtatttcctcacgggttggtgtaccaagaacctgcaagaatatcatacaaggttagagaagatgcccatactcaatagtaggagcaaaattagaactgcatggcatgtcttgcagtaccttaattatctctacaagctgatcgactgcactctcccctggaaacaatggctagcaaaaacaaatacaagataatcaaaatcacagcaacagtgatgacatcatgcttaaataactaaaccaaaagtttgcagatctgtcaaccatagaaaaaagaaaccaacctgaccaaggagtagctctgcaagaacacacccagctgaccatatatctattgatgtagtatattcagttgcaccaaatatgagctccggtgctcggtagtagggggtgcag

SEQ ID NO: 47891 - DNA, 8884 bp, Oryza sativa
  unsure (1)..(8884): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttcagtacttggttttgatgaggccttcgctgtctagtcccactttttgttttgcggcgggcaatcttcgctccttgcttgtgtttgctaggtgaagtcggagctgcttcgtagggtgacgaagctgggcaacgatgacacgttgcattctctttctaggggttttgtttgttggccgtgaataggatgtggcgtttagacggctttggctgaagttcttcgtgggaagttgaagccacttgaccattgacagcgagttaggtatggatgatgcaaccgatttgaagtcggagctgctgtgtcgctaggcggcaagctcggcaacaatgacacggttgcaaggtcggaacccctttgccgtcttggtcaagcttggtaacgacgttctatgttgggctccgtcagtggtttctgttgttagtgagttgtggcgtgtgcggtgcagctattcagccagccggtagttgttttttcttttcttgtaacccgtctagggtttttactcctgcttattgaaaatataattggcagttctcctgccggtttagtttcaaaaaaaaaagttgaatcagatgcacaattgccatcacacaagggaaagattgattcattcggttcgatatgagaactcaacttcattgcattgatagaatttatgttaaaaaaacaccttattgttatatttttagatagtgaaaaatcttttacacttttggtctcaatacaaaaattgtagtattgcactttacactccataaattcttgagattaattacaaccaataacataataatgtacgactaattattgcacccatgcataataaagctttataattatccgttcgaacaggttctaacgaacgggagatttcgaagcgtgaggcaccgggtgatggtgagtagcccgcggccacgggtgtcagtcatcttcttcgccgggccgccgccacgggagcgactagcgccgctgccatggctggtggcggaggatggcgggcgccgccggtacagggagttcacctggcgggagtacaaggcttcagcctacaggaccaagctggctgagaacaggctatgtcactttgaaactgaagctgactgattttatttttttttagtgtgtatagaatgtttgtatgtctcttttcttttgtggttttatgttttcctttttcattttggccagcgtgtttgtaatagttgatatacatgttgatgggcaaggttttcgtgttgatacaagcagcacactacagagtagttcatacatttctttttgttcggttttgtgaatttaaagttggctaaatttttcttgattgtcgtgcacctgactagttgaattactcgtgtgatctttttgttttcttctaattacgcacagaaacacactctatacacacacatgcgtactcacacatgcgcttgaagagatgaaaaccaggagcacatccctaatctcataaagttttagttgaaagcctacttgcaagtgtgtattaatcatggacatcagaattttaaccctgaattgtgcacctatgactttaccaccatgtcaccggtgcttccccaattactctagtgattctagatgccgtaattcatatgttttgaagtgatgagcctatggttagaattttgtaaagtgatactagaattttaggattatatttatactagtattaaattgaagtaagtgtactatatatattattattaatctgcagactgtagtaggactaatagtgctcaggcaaggtgaaaaatctgtatgaaaacaatcttctcttgtgataatcacacagagttgtgtaactgatgtttttttttaaaaaaaaaaagaaatctcgatgtcccatattgtcacacacgcggaaccaccatatttaccttggataaatggatactcattcagtcagataacctttcacaccattctagtctttaagcagaattcgtgagaaaactgttgttggtaggagcgggattcagtttgatcggcgtcttttaggttcgtctccaaaccacggttatgcaactatttgccaattatggttggagatttacaaatagacttcaataattgtgatctccttacgttaggctggtttcaataataatgatcttcggtgtgttctatttatttagatttacactatgttcatgaaaactactatgtaataattggctgtagctcttttgagtaaaggccgggatattatattccattatcttaaaaaaaaaaaggttcgtctccaaaaatttcggtttctaagaaatagcaacgaaaaacaatggggtttgggaggttggtccagatggacatggacttttatgctaattctgttttttttggggggggtgatttgcacttaatttgttatgtcattccgctgctggatcatactagctccctaccctcttaggttgagttttttttggatggagggagtacgtgtgatcaatagttacagcttagtcttggcacaatccaatcggcgagcgctatcaacctgtttatgtgtgggttaaaatcaacaatgagcgaagaacaatgttacttgtgataaataggtcatatctattcttctaaagccggcggtggatgccggcatctgattggttcagttgatggtcctctgtttgattgacacgtggcacaaagaaacaggtgaacataccgctggagagatccggaaagaaaacgaaccgtgcgtgcgtgcagtaaaaagaaaaagaaaaagatgcggctaggccgctcgctccagggctgtgcgtgattcgtatgtcagcctggtaggaaaaaaaatcatcgacagcatgcgacctaagacagttgtgcaatataaataaataaaagaatgagatagaagggggaaaatgtcaggattcatagatttccatgtttagcaaatttattcaaaaagttaaatcaaaatcaacgtagtaatttcatcctgttaacatttatactccatccatcccaaaatataagtatttttggattctggcacggcctccgagatgctactttgatcaataatatctattatagtaaaatgttttaaataaaaagtgttgcatattatgatagtttgtttaatgataaatctaataacatcaattttacatcatagatcttttttattgttttgctattaatggtcaaagttaaaaatgtttgacttgtcaatgctaaaaatgctcatattttgggacggagggagtaataaatagtaaaattaaatgtacggatagttaaaaatcttcgaataagtatgatctactataggtttaataaaaaattcaagacaaatccctatggttctatagaatgaaaacaatatgtagcaaaactagatggtatttatgcgtgaatgttccaaaatatctaccattttaagtgcaacggtgagtttccgtgtccaaatttgatcgtccgtcttatttgaaaacttttataattagtatttttgttgttgtgagatgataaaacatgaatagtactttatgcatgactcatatttttatttttttaaaaaaaattaaataagatggatgattaaaattaagcacggaaaagcatggctacacttaaaatgagacggagagagtcgataacaacaaaaatatatttaccatgtcggtgtgtcctatatttatagaaaaatgaaataatatgtagatagaaatcggtaatctaagacacattaattttaggatacatattttcagctaattatacaaattagatgactcacatgtaaacacattttattgtacgaaaaagaacaatttttagaaaacaaaattttactttttttttctctaatatcaccatctgccatgattagttcctggacatttttatataaacacaaaattgaaaacccattaaagaatcaccttgaatgtatatttcctaaaaagaacattataacaattatgctaattttgataaaattctttcgacgtatgttgctaaataatacacatgggttataatttagtgggcgcgccaactggggcgctttattattttctagttactattgaagtattgatgctggcaactgcatacatgtgcgaaagaaatttcacttcaccaatcaactggaagtagtatacttattggtggtgattgttgaaatgggtagctcaacaaagaaattaataggattaattgactggagcacatgatctgacgctttacaaaagaagggaagtggaacggcagagtggtgggattaattggcttactctgtcaattaggccttgacatgtaactgtgcagtactcgggaggagatctgaccactgcgttttcatccaacggctgctattaattcgaatgacgtggatgaaccaaagtgcacgaaattgataataagcacaataagtgaggatcagttgtatatgcttataggatttcagtttactgttgggcccacataaagatgcgtccgtacaatgcaaaacagtatgaattgaattgattttgcagtgtgatctagtttaacttgatggtaccctacacgttgcgaccggacattttgggcccatcgtttggcttttattttaactaggaaggtagcccgcgcgttcgcgcgggcatgagtcgtacgccaagtttgaggtatttataaaagcgacatattaacaggagaacatctgccacgatttctccataaattatttttgtcagcattaatttattctttaataatattttaacctattagatttatattatatcaaatataagtagtatctataagtaattatttataatattcttcatcattttaaaaaaaaggtagatttattttctttagaaaacatgtcaacgaaagtaaaagtaagtgtaaaataaaaattaaggtgtttttattttttttaattgtataatatattatcataatatgttaaaggatgaattgggtgggacattaagctacacgaaaaatgcacggttttatatagtctaatatgattgatatattttgagaggcgatctacctatgaacatttcatgtagagtgaatgagaggctccacgcaacctagcaggaatacaataacgtcgaaatatcattgcaccgtaatatttttggaatttcatgtaccataaataaacacttgttaaaaggtataggagcgcacacatgcatgttacgcagtgagccagacagagattctgatagactttgttttttttcccaaaagatagatatgatattataaaaattgggtccatcggtttaagtggaaaccgatggtcgattatatgagtgttttttaattaatagaatgccacatagcgacttagaagtgtttataggagtgctaggagcaatcatatgtatgatttagatgctatgatcattttaagatcgtttatttatcttttaaatttaaaatatcatttatttacaaaagcatcaagatcaattcgtatatgtaaatagcccccacgtgtatgttgtgagaaattaataaagtttttttatgaagaaattaattaagttggtagaaagtcattagatgtctaacaatgtacttttaatgggttagtttcattaaaaaataagctagcatattttgattttcaatgacaaattttaatattttcttttatttagtggagcactcaagatggatgtaggtctagaatgcaataaatccaatatagatgttaaaattatatatttatttgaaaaataaaaatagatatataatttatggtacaaataattgtaaagactcgtaaaattaatccggcctttattaaaaagtctgaaatagcacgtttaagtataaattagttaatatatttctttgttagtttaatgcgtacagaatgtaacggtataaactttataaactttatttaaatagtgtatgatttgaaaataatgctccacataaagggttcacgtatacctttatttaatgggtaaaaatatagtggtgtaaactttattttggaaagaaatatatcataatataatcatataagttatgattatataaaatttaactatattaactgttatctcgattatatatatatgaaaagaaaaaggagggaaggagatggaaccgtacgtacgtacgtacctacggatggtgtggaattgtacgttttaagatcaatatagttaatctgacggtatctactagtggacccactattttaagtaaaaatcaatggatagatgcttttcttttttctcagaatttttttgatttctctaatttattagagcgccaagtggcggcttaggagcgtttgtaggaagattaatggacttttagtatataatagataagccaaaacggcttattagagaataaaaataaatttacatgtaaagcttttatatatgtgttctcggtgatttaaaagccaatgctaaaaaagaaactacgttgaaaatatctcaaaatcaatatcaaaattaagtttgaaaattcaaaatttggctttttctttggctgaataggccatccgatgagagcctttgtaatgtacatttgtacatcactgcaaataataccttggggaacattatacagtaattgaattattcaaaatgaaacctcagcaagtttttactgaaaagataattcaagcactctatggtggtttttaatgtcctgaagatgaagatgaagattaaatatttcacgcaaaacgaggttataataacatgtgattagttaagttttaattattctaaacttgaaaaatagattaatatgatattttagagcaactttcatatagaaagttttcacacgaaacccaccgtttagtagtttgaaaagcgtgccacgagtatccaaaatttaatccaaccttagttggagaaaagaatgcaattgtgaaatacaacctgcaaattgccatagcttgtaaatctacttatttagtagtagcaaatagtagcgtcagttatgctaagtaaaagtgacaagtctttctactgggactactgaagctaattagttatcagttatcaccaactatacatccttaattattgaggatataaaaaattgcacattgatcgattaacttaatataggtactgtcccaaccgaggaagagtgattcacagacaattgattgaatcggcaagttttgtcaacgagaacaataattaatttgaaattgagctaaacaatactgaaacttaatccgaaggaatttctatgaaattttgaggtctaactcaaactaaaaaagttggcgggcgaggagcatacatatacctgaacaaacatacatatactgaaaagagtgagcttgtttggttacacccagtcggtgcatatatatactcgaacaaacatacagtgtaaactgaaaagaaatgagcgggtgttgttaacattgtttgctgcaaagagtaaataaaaaggaaaagacaattttattttgatcaaagaacaaagagaaacatgtataccagggttgctgtggggatctgctctgcatcctgtgctatgcagagcgagaggaaaagcgaagccgtcctatgagcgaggagcacgcttgtcgttgatgtgcttgggaggctccagcaatatagtatggtggtgagaggaagattaatcgaaaggaagtaaaattaagaggtaatagcaatgctcgttggatcagattgatgccttgtttaataggctaagttcctatcaatgcagtgacatgagtagcacctaaggtcttgagttcaaatctccatagtagcgaatttcaaatttggttatttgagagctaagttccttatttaataggctaagtttctaatttaaaaagccgtatatatccgattgtatatagaggccaggtaaaaaaaatacccttctcttaaaacaaaagatcgatgcctcttgtagttatcaaagtcgagtggtcgtctggtagtttcgataggggaggcaggaggacaggttgacggccgggcttcgctgccaattacaattctcatccagtgcagaagctctatcaccacaaccatgcctaatggaattgtggagactggtattcgcgctcgcttgcgtattgcggctgtggtggctcgcactcgactgctcatgaattggttgtttattgccggactgtatcatgggagagaattctatccaactgctgacatcaaagatatagattcatctaacgatgaagataaaagtgatgatgtggctgcacgagaggacatgaaattagcaataataactacagtaggtgggatcaactatataaatatataggatagtttttatcagtacttgagatggtcttaccatgcacctgaatcctagacgatgattatacacctagacgacgtcaatttgatcacatttatattgcaaaataatcatgcctatttgagaaaatagtactccacaagatgcacatgcaattgggccaaacaggtgctaccatggctgtattttaccaattatgttagtagcacaatgagaaatatatgccaagattgtattgaaccaattatattagtaacatcaaaatctcccacacatgtgttggagaattcttcttttccaatcaagaactgtacaactatgtgacacaa

SEQ ID NO: 47892 - DNA, 13708 bp, Oryza sativa
  unsure (1)..(13708): unsure at all n locations
aaaaattgccgaacgccttacttgttcggctccaagacagacaaacgataanatagaccctctatttaatatggtcagaaccatcagataaattaaaccctatcaacaccttcagatactagttccctgcaaatatatctgctagcaaataggacttgtgaaaaaccacttagttgaatgccaaaatgtttgattggctaaatatatattgcttgtacaaggttgctctctcatttatactggaaaaataatccacaatatccatgccaataaattcattctgcttttgttgggggatcatgcattagtgatgtagttcccacattagcttcatgcatgacttctcaaccaaagggggaaaatattgccggaaaaaaaaaaggaaaaaaatcaagtttgatgagtcttatacaacttagttgacatacggatttggccatacatgtttggtgcatcgaacagaaactacccttgagacgcaacgacaagagaacatgacatggtgcatgggagcagaaactggatgagcctatgcatcaaaagcagaaactggctgatcctatatgcataacatatgcgtgcagtgacacaaaggcaaaactcaaatgactaaaaatcttcaatgcacaccactaatttctctttgaatatatggatataggtaagcagctaggtaataaaatgttttgatgctgacttatattatgggcttgttcagattgatgtcattttaaaccatgccattatttggtaaagatgacaattatgtagctatatatatttattttgttaccaaattttggtaatgactatggaattttgacaacattatattgagcacatcctactacaatttggcaatgttgccaatttacccaaattttagaaaggttcattttggcatcaatctgaacagaccctaaatcacgcttgccttgatcgttactccatttgttttatattaagtcattttgtctttgttctaagttaaacctcattaaatttaatcatgtttataggaaaatatagcaagatctataacaccaaagttttcattaaatccattcaatatatttttatagtatatttaatttgttttggaaatgtttctatatatttctacaaacttacttaaatttgaagaggattaacttagggcaaacccaaagtcttataatataaaacggatggagcttgtatgttctaacaagatattgccatattgatgtacacctaatattgagttttttcaaaagactacctaatagtgaggttgttatccatgggccaaaagcccaagtttctcaacataaagtactgctgtgtgagctcttccatggttacacttggtcattgtctgtcacatgcacatctattaacttattaaagcaatagaaaaaagagccttcacgttcgctctcatggcctagaaattctcatattaatcaacgaaaaagaaaaaaaagagtccatatagaaatacaaattagaaatagctgaaattcagaattaaaaattagaaatattggaagatgagactagagtctatgttgtatacaatttagaattaatagaaattcagaattaaaaaaataagaaaattaaaattaggttagagtccataaaaaataaaatttagaaataactaaattcgaaattaaaaaagaatatcgaaagaagcgtatagagtccatatagaaatacaatttataaataactgaaattcggaattaaaaaaataaaaaaatattagaagaagagcatagagttcatatagaaatacaattaagaaataatagaaattcggaattaaaaaataaggaatactaaaagaagagtataaagttcatataggagtttagaattaactaaaattcggaataaaaataataaagttaaaagtagagtttagaatccatatacaaatacaatttacaaacaacaaaaattttaaattaaaaaaatgggaagaagaatctagagtccaaataggaatacaatttagaagtaactgtaattcgaaattaaaaataaagaatatcgaaagatctgtttaaagtccacgtataaatacaattagaaattttcaaaattcggaattaaatataaataatattggaagaagagtatagagtttatatagaaatacaatttacaaataacgaaaattcagaattaaaataatggaagacaagtctagtgtccatataggaatacaatttagaaataactaaaatttgatattaaaaataattataactatcatgtatgtacaatagtatgaatattacatattggtagtttggtaaagttagtacaaaatttaaaattatgttttcattttaatatattttaataataaattgagaaatatatatgctattataatgatgctagccgcgcaatctgcgtgggctgccatgctagttactaatagtgtagaagtatcgaattggagttctagctataatataatatagtttaaaagagcacttattttttaagaaacacagtacaaaagagcacttagactgagcgtcagatctaaacaactctcaggatataaaagcatagcattcaagcgccttagcccacccagtgaaaggtgttatttttcatgtttttagagtgtcacaaaactaataagacattaaacatgtatttggtttaagaatgaggtggctatttttttgatgggatggtcaaattatctgtttggtatgagatggagtggtcttattattttgagggataggaaaggcccgtatctcagtgaaagaaagtgggtgggattggtccagtaaaactgactctggtcttagggaatattctccttcagagttcaatccatctcatatatcctcaaaccgaacaccctaaataatgggtttgaaccaacccgaccaattccatacattgaaccaaacagatgtttaattgatgattgaaatagcacatgaaatttattgttttatttttaatattgcatacgcaatacatgcaagagaccaagctatattgaaaacatcgggcatatggtttcatcaagattaaacccatttcatctcttacttcattattaatttcttaccacatcatgaaaaatgttgacatgatacaatatttaatacggaataagaatgaaactcccattattgggagtggctttagcgttattgacttcagtcatgctgtctcacaagcttttggttcatacaaaatcgtgaagcacatctgctccctctatcctaaataaaacaaagtctcgctttgcataggaactttagtgataaaaaggactataggtacataagggcattgaataggtacaatgaagcttctcgattcgtggtaagatgatagtaaggatatatgaattgatttgttttccaacggatggagcattctatagctatagatcagatccagaacaaaagcctacatatccatagtgatgtgagctagctctggagtcggactgcaaaaagattgcaaattaatcatagtctggtgtcttaaaaattattggatcgtgcaaaatagtgccagtttatacagtataggttaaatccaaaagagaaacctataagttcccttatcttatgactcctttggaacaaaggaaaagtgaagcatttttcagaggatttgaattctatggatagaattcctatggagcgatttggaacaaaagattgaacccttaaaattccttgagaaatcctatggaatagaccatttcataggaattttagataaaaattaacataaggtctcacctcatggacttctctttttgtgccttcaattcctatgtatttcttgagtgccatccaaacgactattatttaagaatcttgtgtttttgtttcatgtaggaatttacaaggcatgacattctaatcttgtatatttcctactccatgttttcaaaatcgtgcgttctaaagcagcccatgccatctctagtgtacgtaataaatcgagtcgttgtatatttgatagtaataaagtccgaattaccccctaaactattgacgcagtaagatttaccccctaaccacaataccaaacatttaccaaaactcttcaaactggttgaattaaatacccccagtactgtttaaagagattttggcctaggattgcacacatggcgacaacctagcactccaatcagcaacaaaaaaaattccaagtaggcccatatgtcatctctcaccccaccctacccctcctctctcgaaaaggacaagaacccaagagattggcgggcagtggcgcttcaatcccccacaatctttcccgagaaaggccaaggcaccggcactgggtgtgttgtttcctgctgaggtcttcctcacgcctcgtagtgagtgctagcgcccgtgcctgccgaggtctccactgtgcaacagaggaagaagggcgttgatgccacacacagtcacgaccttgtgggaaagaggggaatgcgataagggcaaaaatctaacagatcggcccaatgacttttttttataaaaaaatactaactggattgtcacgtaggactaaaactgtttcagattgagttagtgtgttatttgccggtttgaacagttgcatctggtattaaaatttcatggggtaattcaaatgatggtaatattttaggaggtaattcttcaaaaaccaaaatgtgtagacttctgaaccgtcacaataaaaaaaaggataattgcttatttgaccatattttgaaagctaactactgaccctatttttttaagtttgcttatttgaccccgctttttaaattcagagtaaccgtctgcccctattttcattacaccattaagtttcccttcttcttgtacaaaataaccaaaatgccacgagtacacatcaaaatgaccaaacaactttcacttcatccaagccgaccccgacctcgaccatggatgactgacatgtgggcccaaaaagttgactgcatcgtatttttgtcactgatacgtgggcctgaaaagacgattgtactgtacctttgccactgacgtagtcgaccgcagaggatcctgactggtctcatcccggtggcgaggcggctagctcatcgaggccgaggcaaaggctcgcggaggcatgcgtgaagatagctgaggcgcatggagagagcggcggcgcgacctgcaatggacggaggccaggatggtggctcgcggtggccggtgcggggtgtggaggagcgggaagaaggggaatggatctgcggccggcgcatggctcggaaagagaagcgggggttcgcagcaaggaggcatgtgaactcaccggcatggtgctcggcgaacgcccggcacgaagctcggctaatgaccgggacggagggagacagtggtcggttgctcgcatagcagtggaaccccaaatcttgtggtcaccggcttcagcagctgtaggtgcaggctctaagaatattttttcctccggtctctatctttgttgttcatgatttttttatttttgtgtgaacagagcagtccaagtggatttcttcgtagggatattctgagattttctggttgaacttagcaatcgaagcaatttgaagacaatagtttagttctgattcttgctctattggaaagctctgaacttttgttccactgtacctgtcggttgtccatctgaatgaaggcatgagcgtcattttttctataagttaacactgttatactgttttcacggaacagggtcagacctaatttttatttttttaaaaaaaagtcaaatgatcaaacttcgaaaaatatggtcaaattggtatttagtctttaaaatatggtcaaagtgcaattacccatataaaaatatgataaaaagcatgggaaccgagacgacatggttatcaaatgaacagcgaggatacataaatatagattatttcagtttattattggacccacataaagatgcacatacaatgcaaaacatatgaattgaattgattttgcagtgggtcctgacttaatagtttttacaacaagagatggcccttaccatgcaactaatagctgatgattgcatgtttgcatcatatttatactccaaaattatcataccaatttaaaagaatttaaatgaatagtatacaatgtgcccatccaattaggccaaacaggcactggcattatcatacgaattatatgttcaattatgttaatacgacaataagaaacacatcaaaatctccctgaggagtcatcctttctttctcaagacaaaaactctcattcgaacagttagttctcatttacttatacaacatgtcaaattgagtaaatggcatcatcttgttccgatatctccaacataaaaacattcatacttgcaaccagatcacacatagacataacttttatttggtttactccaatatcccctttctccaatggtaaataaatccttgatctctttctttctttgtctttcccttctttctaattataacattaagaaaagggccaaagcgaaatggtttgacagactcagcttgtaacttataaaggtagctgctctcctaggtctgttctctctctatctcagagcataaatgactttggagtaaaaccctagcaaagtcattactcggctccagggcaaaccgatcaatgaaaaagacctttttttagtttaatatggtcagacccatcagagaaatcctagcgctatcaacaccttcaggtccgtgtagttgaatgccgaaatgtttgattagctaaatatttattttacataggtcactctcccatttatactgaagaagtaatccacatgatccatgccaatcagctcattcattttttgttgtgtcatcatccattagtgatgtagttcccacattaggttcatgacttctgaagcaaaggggcgaaatattctcgtcaaaacatgaattttttttaaagtacccttgggtgaatgtgagccattcattagattagatccaaagaaggaggtttatttctactacattagtatagttagtgtaataggtgtagtagaagggtacatctgaaaaaaaaattgtggcattggtataaatctctgtaatcagtaatatgacagggttacaaatgtacaataagcctgaccctttggttcaccacagctaggtttgtgttgcgagtttctgccaaggcgccgtgcagtcacatagacctggagccagaggtcgaatgttgctgccgtgctcttcgacgagaaaagcattgttttccatgccatcgcccccacgctcacttgctctaatactacaaggatgttgcaacaaggatgttcctaccaattatgtcaatatatttctttcttgataatattagtaatttcattcacgaattgaactatgataaccaatggtgatcccaggacaaaaattatcggggatccaatacatattaattatctaattattagctaacatattaattaatatggtacaaattagctagaattgaataatttacccaggtgtggtgagcccgggaaacactacataggaacacctccgatgataaccctagtagcagattgggcaacaatatcttactcaagacaatctcttactggggagcgaaagatattggcataaaaattcccttgcatatgtacattgagacattgcttcatgaatcggatcaaaacaaacggaagaatgattacagtggctccagactgaatgcagtggtggcagcggctcttgtgacgtaccgcatacaaatgaggggtgccgcctccacagagaggattattcgcgcaaggagtggcagtggtccctcactcctgaaggcgagcaagaaaggtggaggggcggcgagctcggagcttcaagcacgcgggtgggaggcggagccagaggacgccaattcgttcaacaagggtcgccacctagccgcatgttgtgcgtatagcggagtggaggggcacggacgggatgaccattgggcaccttgggcggaggggcggcaccatgcatcaccgttgtggcagagtcaggcttgcgctgtcgcgagagaagagccgagggcggtagcaatcacagactgggagcaaggcaacataccaaaatacctttctaccttaattaaggaaaaaaaatctaaaatacccatgaaaatcaactactatttgccgggggcggggggagggggcgccgtaaaatgacccaaaaaataaggaaaaacagttcaagtttgattagtcttactaaccgtcaacttgtatgtttcatggcctattgtgaatataaaatattaaaatttcactggataatgataaattatgttgttaaattcataagtaaattttgttttaaaggaagttgatacaaaacatttctatataattatagatgccaaaaacagaattagtaatttcttatataatccattctaatatttcttctattactttatttttttgaaatttcataatttaaaaattcaatactagaagtatagatttgtactgatcttttggtgtctcttgtaagcatttgctataaaataatttagcaagtttgaattaataggtacataaataatcttggtttggagttaagctttttgatgatttaataattcttatattcataattattaaatatcaagttgtattacatgtagagtagactcaattataacatatacataatttaattttaaaattcctaagtaaaaaataacatactgggtttgaagtcttaactaatgttttatcatgattcaaaattgttccaaattttggaatcaacaatgtggcataaatgacatgtcataatttcaatgacgtctcacttccatcattacagacatcattatccaccatattcttatttaagcttagttcactaatgatgcaacggaatttaaaacatcattgatgcttgattaactccacaaatagatttcttaagtctacaccctatatgtgacttgtctttccacaacaaaaaaccaactcaggctatgctatgtatattaatttttgcaagtcactgttaagagatgaaaaaatgttttgcaaaacttttacaactcatgcaaaattttagcatccacataatggagatatgaatcataaatgaggtagaataatctctcttgttggagattttgatgagctcccactgattttattatttatgcaatggaatcataatatatgattttccatcaacttgaatcacatgatttaaatttaattttacttagtaaattatcatctaagtaatgatcgatgtaaaaaatttctaggaatgaagtgtctctatcttaatgagacatctattatccactagaaatgtggctgaataacaaggccataatttcgagaacgtctcataatgattcaacctaaaaataatgccattaattttcttttgtaatactttgtcaaaccaggacattaagcatgtccctatttcttgcaaaaaaaacatacataagaaaaaaaatcaagatatgtatacgtaagatatagaggcaattttatttccccttataaggaatatatgagctttattatcattaaatttggagttgctactctctctctctctctctctctctccttagtaaagtttatctttgccatcaaatacatgatcttacttagcttgcttcttagtattttgtatttcttattgatatacaaagtgataaaacaagtcaattatgctccactttgtctcactgaatattacaattctgaaaaatgatcgtagtttagtaggagaaaggtcatatgaactgggcaagtggcgtatttaaaatgtgcgatgtctttctctaacctttttaatgacttatcattggtattgatgaactcctaaagtttgcaaaaacatttgctagatacagtttcgcattgtcaagcacaaaattatcctctaatattggcaaagatgataatcttaatatatattaatatatattagtgatatgcgaaacataactctatattggccttctcccaggataatttcatcaaaatgcctctggaatttaggaaaagcattgacattagccacgaaagcaacaagggatcctttgttaatgttaagtcatactaagaaggccttaggctcagctaaatcaatgagagaaataactcaatagacttaaattgataaataatattagctaaatttgtatcgtcttatatcctatttttaggcagttcacaaatggtgaaatttaacatggaaatgacctcaccttgtgttacggagaagaccacaattaattaccactgctaagctccatcctccatgctctcatcctcctcccatggcggatttgcaaaaacaccaaaccattgccattgcttccttcaaaaatggctcctccacacctccatttcctcctcgtctctcacccattaacgacatgggctctccacgttcagccatggccgccgtgaacatacactaatccggccgtcgcctccaccagctgccggtggcggcgccgccgggcgccggtgtcaagatgccggagaagggcaccgtggtgatgagccggtacgagctcggccgctcgctggggcacggcacgttctccaaggtgtaccaggccaggagcctcgtgtccggcgagaccgtcgccgtgaaggtgatcgacaaggagaaggcgctgcgcgccggcgccggcatggtcgaccagatcgagcgcgaggtcgccgtcatgcggctcgtcggccgccaccccaacgtggtccgcctccacgaggtgatggccagcaggagcaagatctacttcgtcatggagctcgtccgcggcggcgagctcctcgccaggctggtcgccggcggcggccgcctcggggaggacgcggcgaggaggtacttccaccagctcgtcgccgccgtcgacttctgccacagccgcggcgtctaccaccgcgacctcaagccggagaacctcctcgtcgacgacgacggcagcggcggcggcggcaacctcaaggtcaccgacttcgggctcagcgcgctcagcgcgtcgcggcggcacgacggcctcctccacacgacgtgcggcacgccgtcgtacgtcgcgccggagatcatcggcgacaagggctacgacggggccaccgccgacgtctggtcctgcggcgtcatcctcttcctcctcctcgccggctacctcccgttcttcgattccaacctcatggagatgtacaagaagatcaccaatggcgagttcaaggtccccgactggttcacccccgacgcacgcagcctcatctccagactcctcgacccaaaccctacaactcgcatcaccatcgacgagctcgtcaagcatccatggttcaagaagggacacaccaagcggccggcaagctcgaacaccatgaaactcaacgaggaggagaaaccagcgaacgccgccatgaacatgaagccggcgagcttgaacgcgttcgacatcatctcgctctcgcagggattcgacctgtcagggatgttctgctgccatggccacagcagcaggacgcaggatcagctgttcgtcaccgggaagccggcgacggcgatcgtgtcgaggctggaggagatcgcggagacggagcacttcacggtgaagaagaagcagaagaagaggcaagaagaggacgggatggcggtgaagctgcaggggtggaaggaagggaggaaagggcagctcgccattgacgccgagatcttcgaggtttcgccgtcgtgctacgtcgtcgaggtgaagaaaacggccggcgacacgctggagtaccaggcgttctgcaacagagacctcaggccgtcgctgaacgacatctgctggacctcgccggcgacagcagcgtcggagaagaaccagctgccggcagtgtcggaggtgtcgccactgagtagtcctcggaattgatgtgacagattatctaggtgcagtggcagatattgatcatcagatatgtgctgtttcccttgttgtttcctttgctttgaattgttgttttgattttttttttattcttgtttgtgtttcataatgatcttgggggtagtggtctggtatttccaagttcaagatgaatttcaattattgtttttttctgttcttttgttgtgtggtggactggtggtttagtgttgattgttggacataggtgatagaatgtgttctccttttgcttaaattgcatggtccatttgtaaggtaaattaatggcatcacaccaccataatatccaatttatgaatgttttagaaatctcttttttttaagtcttcttgagtttttttattgtatttttgggaaattctcgatctcaaatgttgaaaacagtatatgggttgttgacttgttggtcccctacaaggaaaattggtaaacagacacaataggcccaacaaattgacggcccaactgtttacgcagctccctgcttttctggatgccgtgtactcttctctgaatatgctgcccctctgaatgctacgatcttgacttcaagtttctgaatgctaagtactagcttataattatatggtacctaggatagtaaatttgagtttccgaataaatcgtgtttcatttatagtttatataaatgaagagagaaaacaatagattgctttgagctgaaaattacacaaccgatttggctatcggacgcatgactgctgtatttgttttcgcgtacaagtactaggttagcaaaacacagatccattccactggtcggacatatttgtcacatgcgatcttttgtggccattgccatgtagacaaatgtccgattccaataagaacacgttggcttccaatagaaacaattgctgaagatcatttgagagattttggaaatctgtataaaatatggtcccatttaattcaatggcgcaagcaggaagtatcccccctcatggctgagtcccagccaacaaaaataaagtatgtccaccccaaaaaaatcgccccagttacaacaaatgattcgattattgtaaaagacacaatagtaccaccacggcaacatttaagctaggataacttggtttaaacttttgtctaccaaaaccaactaccgatagtgtaagcagctggaacgttattatctccactcgagcaaatgataactccgcatattaacctccaactgaagaccttatattccaatctgcttctcgaacttctggatttgattcaagaatatccatgtcatctgcacaaaataccactcagtgaggatgcatgtggagaactagagacaaaaggtggtacaagtacagtgcaaagatgtgcttaaacattaccatcacatggggagcaatcctgacacagtacacagggaagccagtgtagaacttgaatgggccaccgctcttgaaggtcttcatggcacagtccaaagaaccggtgtacgggtacttcccactggcatcaggttgcatcttctggatttgtgtcttcacatagtcaaaaggcagactgcaggccgatgcaaagaacccagaaacagcactggctcctgtaaaagaagttgtaatatttcatatgaaaactttgtcctgagcatagaagaagggcagcaggcatgtgcttacataaatttgatagtaatgtgcaatattgaaagatcatattttactcaactacagcaaattcttaatgcatgtaaagcaaaggggtgcagg

SEQ ID NO: 47893 - DNA, 2729 bp, Oryza sativa
ctgtaatcttaccaagtacagtcgaaacttctccagcaccaagtttgtctctgaatagctcaacactctgatcataggaaccaagcatacccatgttcagggccatagctctaaccacagtaggtcctgctcccttccaaagggcaaggacaccttcatcagcaataatacggtagagcgcatggaaagcattcttgtagttacggcgttgtgcaattggcaaggtcgaatcagcttgcatcctaatgagtgccaaatcagcagggctaccaacacatgctccaatagctccagcagtaaggccaataaaagctttctgaactaaaggcaatggctttccatcattcttttcaattgctttgtttgtcagaaccctgaattagataatcaaatatcaagttccaacctaaatattgacaaccatctaaatcagaataaatacttagaatcatgaagcaataaactcaactaatccagctttatgatgatcaaatttctctacacagtaaaatggaacaaccgcaggagaacaataaagaaaaagatgaaatattccttaaaactccaaaatagcaaatgatacatcaggccaagtgtactacaaaataattctgctaatagcatgattaaggctgtgtttggaactccaagttcccaacccctctccctcgttttccgcgcgcatgtttttcaaactgctaaacggtgcattttttgtaaaaagtttatatatgaaagttatttaaaaaaatcaaattaatccatttttaaaaaaaaattaactaataattaattaatcacgcgctaatggaccgctccgttttccgtgcggggagattgggttcccatccctactatccgaacacagcctaatcactcttaaaaaaatcccagaaaataaagaataatgatatccccggtaacctaattttcctcaaagttatcgagcaaaacagcattggcacatttctttcagttactcatcagcaagacagcaacagatagcaatcagcatagtttatgcacatgtttggctctcttgcccagtgaagcaggcccattcatcattgttaggtaatgatatagtttcgtagacctaaaaaggctttgttttgcttccagtaacaggacgtgtcacatcagatatcatgcacacacataactaaattttgagttcctggtacagtacaaaaggtgagaagaactggcactcttaaacttgaaacaaatatggtcatcgaattaatatgacttcccctaaggaatgtagcagaaagatcctagctggtaactacaagattcgagtcatgttttcaaatcgtcaacctaatcgcgattagtcatcctagtcagtaataaggcaactcaattataaccacaattagtcgtaaagtcatccaattagtattaatcgtcctagtaggtaccgaggagactagacgcaagtttccaatttgaaatcattgattctgaccattatgagaataatacaacaaaagcagtaaccatttaaaatatttctgcccatggaaaacaagtgatctatacaaacctgaaggatccaagacgagcagtagtatatgtcgcctgccttagtaaaccagctgacaaaccctgcaaatgaggtgctgaagaacttcaacaacatatcaatccaaaactaacaaccgaacatggtgtaacaagtgcaaaatagtgaatccttgttggttcaagctaaaatgctaacatagtatattgagacatttcaaggttaaacaaggatcaaatcattattgatacgaacaatatatactggataacaatgtccaagttggacccagtaaaatctcatagtaacctaacataaccagcattgagaacacacattaaaatgtttgaaaatgaatctaaagcaccttcagtagaacgaaccttgtaaaaggaaccaataccctcattagcaagcatgttctttgtgacctgagctgcagatccctctcccagctggatcttcacctgaaatcaaaataaaaggaagaattatgtacaggaagctcacgtgctaaataaagtaggtaccaaccataaaccaagccatcagcacattgatagtgatggctactagccaattcccatgttccaacagatcttgctgacatttttttccccattttgtgctactaatcgataacagatcacgaaaaggaatagcaaggaatgcatcttctccgcccaccagactaaaaaattagcacgtttgcatgccgctgcacaaatgtagagccatacactaaatctgctactgctacaattttcacagattaaatgttaatggatcatctcaggatcgaccaattaggcaatttactacacaatccactgacaaatttacctaagatggcgatatgaaatacctcaagaaagcacagagaacagcgagcaacaccaaactggcccggctctactacaatccgcatcacgtaaaacccaaactccacggatctaatagatcgtggcgaccgaactccatccgagacaataattagctaacggaaatgagttcccaagcatccgcgcggacgccatcgacaaattgcaacagatctaaagcgatccacacccagccacccctataagcgagctccactgcaccactcgaacccacgcatcatcagatccaacccactcctacgcagctacccaccagatccccctccattacaacggatccaagccctccaccccga

SEQ ID NO: 47894 - DNA, 1337 bp, Oryza sativa
cagattaggtatgccacaaactctgagatgctatgcaatatgtattttggtatatattatttcattagttctgggttggggtatggatatcaagtcttaaatatgagcatatattatgacagataatattattttgcattttgagggaacatttacatctaattcactttatgctgaccgttgcagttgaataattgtggtgtacctatatccattacattcttattgtgaagtttgctctgtattgttaaagtaattccgattttcagttgtgttatttttatcattgctataacaaaaagcttatgtaacttcatgtattttcaggggtgattttgcatcagagaattggaacattgaacccagtttgtttttccctaagcaatacttttctgagtgagtattttacacacgtttatcctcggtctgttttctgttgtttacagttgaacaatcttaatatcaatgctacaggttcatcttcagtgctcatatgaaagcgtttttgttgataaattcccagcacacttcattcttttttctatcatgagttcctgatgataaaaatgcacacttctcatatcaaacatttttttgtagtacctgaaattgattttactatctgtggttctatttcctgtagaacagaggtgtctgcattttttctcatttgaggaaaagcgcattttctgcctctggtattattagtcctaaagtctgtaaactctgaggctcactatttgttttcactgcatcaccactgaaaaattggaagatgttatctatcccaaaggagatcatgatgctgtttccattagcaaaagagatgttgagctgctgctacctgaaacatttgtcaacgatacaataattgacttttatgtcaagtaggttgattttttttatgctatctgatatattagttcgatttgaaattctatcaataggaatgcaaccacagttcttgatctttgatttttagatttgctgcagaattgttctcttgtcataaattacatttaatatttaaatcctcactcgcaggcacttgagcacaagaattgaacccgctgagaagcacaggtatcacttctttaatagcttcttttttcgcaagctggctgatcttgacaaagatcaagggagagctccagaaggtagagcagctttcctacgtgtacgcaagtggactcgtaaaataaacatattcacgaaggagtttctgtttattccagtaaacttcaagtaagacacaagacgatgaaaattctgttgatgcagtgataaccttagtgcactactaataatgtttctgcattgcagcttgcattggagct

SEQ ID NO: 47895 - DNA, 17438 bp, Oryza sativa
atttactcttataaatttgttactgcagtttaaaatctttattgcaaagccgccattagaatattgcaaagttaccactgaaatgtcgtttgaatgacattcttactagatataaaaaactagtggtaaatttataaatgccccttaaaattgttctgaaaaaactttcttacactatttacttacactaattacttgctactctccctacttcatattataataagtcattttgacttttttctagctaaatttttttaagtttgatcgaatttatagaaacataatagtattttcaatacaaaataaatgtattattattaaaatagattaaatgttatatttaataaaactaatttagtgtcatagatgttgctaatttttctataaatttgatcaaacttaacaaagttgcctagaaaaaagtcaaaatctcttactttaaaatattgaacttctatactcctttaaaaaggtgtagtagtaatggtgatgagtggcaaatctatcaccaccacaccaccaacaccctacaattttaaaatgagaaaggacatatacggccagagggcccacatgtcaaactgtttatgacaaaaaaaaataaacgtgtttctctatgtttagagatcgatatatgcgggcatgccagtgtaactaagtacacaaaatgaacaaaataggaaacatatgctttataatctcaagatcataaatacaaattcccaacttaatatatatatatatatatatatatgtgcgctccattgcctgtcgttgaacatatctgaacttgaagaagtggtcctctggttcctaaggtctcgaaagatgcctagttaattacctccgcaagtctaggcctgcagagcgccttcgattaaactgcttgtggttgtctcttcgtcttcgcttcacattctccattcatgatgagtgttggtgaaaatggtagatgtatatgtgggtgttggcaacgtatccatggcctcatcggtccgtgcgctggtgttggtgatgtagccttcatataggctccacccaccctcgtcgctctgcgttattagtcttgaacgatgtggtggtgtagatgagttgcttttcatcatgcatggatctcgtgtagcttagacaacttagatgtcaccgcaatggcgtcggaaggtgttgaagggaagatgagttggtgaagtcacttggtgtacacaacaaccgaataagcatggttgggcacctcttggctagctgagattaaaagaacgaaaagttgttgaagatagctggtgtagatggcagccggattaaacatggttgggcgcctcctggcttgtcaagtcctgggtacagtagggatttgtaaagcgatgttaatgaagaagtagatgcaaaaaacaactagacgaatgcggcttggcacctctttcgaatggtgggtctactattgatccgatcgatatgacgatgaacccaaaaaaggggctctacgagggcgccggtaacgacaaccttggaagaagtagatgcctcgacgtagcgcttcggcattcgtgtgaggatgcctgtgctcggtggccggcgacctcagttgcagtacctcggcatcccatgagaaggcacacgttgaggaggagatgatcgaccgggagaaacaatatgacgccactttggttcactgctatgggtaactagtctgtctcagtgcatgtacgttggaaggccagtacgcgggcgcgtcgccatcgccggaatcatcaagctggctcatctgttggcatcgctctctcttcatcccgccatagtttgcactactccatctagctagaatctccggtcgcggtgacgcatcctggcgctgctatgtcatcaagatgctaggcgtccttactttactggttgcagcctatgcctcacaatgccaccgacgtctattcaccctcgtcaacaatgccgtcttcctcacgctcatcgtcaagctgttcgaggagaacatcggggtgtcattgctaggtgcccgcatgctgtcgtcaagaccgtccataagattttctctttatcacaccagagtcatcggttgtccatccatgatgctttctcctctcgtgttggagtcgtcatgctgtccgtccgtggtaccccccttgtcacgccaagatgagatgccatctgtttgtgatgtctctcatccatgacgtctcctctccgtcacgcgcggagtcttcatgctatcacaacccaaatatttttttttcatgacagtccgccgtatccttataagcatatacgctaactatttatatatatatgttcataaagatacaaggcaagatgtaatgtctaaccataacagctggagcttggacacctacagcagtggttccatttatttttcaccaactacattgcatattacatcggttggttcactgaccaacttattgtcaccaggacgataccctatacctagcatatggtatgtcctcttgtatgcttctaaggactaagtagaccgcacccccactaggtttgcatgtcattattttcctcagacatctcatcttgactagtttctgcgcacatcaaatggtaataatatatgagtatattatacatactcagcaagattagtacatatagctatagagatgtttttaaagacagaaaatactactacccatagatattaacagccgataaataataaaggatgtaacatagtaaatgagttaaaaaaatacactgcagaggtattaaagtaatcgtcataatttcattccttcaatccattttcgtccccaattagggataccctcatatgagaatcacaccgtcgaattcctacttgtgtgaggcgttcctcatctcacactgatatcagcacctgatatcgttattttaggtatcggccgtctcatgctaggtatcctaatcacgttattattctcgctgataaaatcatcaatccattattcgggtgttaatattgtttattgttagattgttagtatcatcatctcaatataatacaggtaaacaaattcagttagagatgattaagtaaaatagttgatggtgcagccttacctagtttcctgccgtcctatccgtgcgtctcaccaagtcaaatatgcaaatctttgatattaatcaatatataaatttgaatgcaagatagctactaacagcctactagaatatagctagctgatgtgactatgctaaaggagggaaccaactagtgctagtaggtgcttgcatgtactccctccgtcaaaaaaaggcaaactgtgggttcccgtgccaacgtttgactgtccgtcttatatgaaatttttttataattagtatttttattgttgttagatgataaaacatgattaatattttatgtgtgacttatctttttaattttttttataattttttgaaataagacggacggtcaaacattggtcacggaaaccagggtttgtctttttttggacggagggagtacgcatgtagctgctgctagccattaaaattcgatgcatgcatgtagctgctgctagccagccagagtattagtcttttcactaatatgtatattttctacactaatccatctacttgtagctagacatcaggtgtttattctagccatgtactcataaaaaccaatggacaagggctgtgtttagttcaccctcaactaccccaaacttctaactttctatcacatcatattacatcaaaaactttcctacacacataaactttcaatttttttttccaaactcccaactttccccaaacttccaacttttttcaggaactaaacacacccaaggttcagtgtattacctggaaggcttctactagctctaaactctcaagtctctcacagacctctcgccacagccagagcagggaaaagtactactgatggggcatgagctgtggggtcgcgtacgagttaaatagtgcagcttccttcagtctgaagcggacatctgtccaaagccatgatgatggggataggattcaccctccctcttccttacactagaagggttcaatcctatccatcaaccctcagtgatatttatctgtcctcctcccaaaacaattcaagaatgtataaatggttccctgctgctattattcactactactacacatgctgatctccgtgacgtctccttttcgccataccaatatgatgggatgccactcgtctatgtattggagcgtcactcatctacatcaacatgaagcaagaacgatgtcatctgtgatgccaaggagtcgttcatgcttgtgctacaccaatgatgctattgaccgttctgtcgacgaggcatatacttcttccaaggttgttgttgttatcgacgctctcatagagcccctttttgggctcatcgtcatatcaataatcaattgaattagtagtagatccaccatctgaagtaggtaccaagccacattcgtctagttgttgtctgcatcaacatctcgttacaagtccttgttgtacataggacttgacaagccaaaaggcagctggccacgtctaatctggtttccatctacagcagttgtattcatcaactcttcattcttttaatctcatctagctaggagatacactaactgactccaccaactcctcttcccatcaacaccattcccacgccactgttgtgacgtctaagctacatgagattcatgcatgctgaaaacctatccatccacaccaccacatcgttcaaagaccgatgagcacgaagcgacgagggcatgcagaggctatatgaaggctaggtcaccaaccgataagaccatggatacgttgccggggcccaaatacatttaccattttcacaaacactcatcatgcatggagaacgtgaagcgaagacgaagagacgaccacaagcaccttaatcgaaggtgctatgcaggcctaaacttgtggaggtaattaattaggagcctagacttgtactacctccgttcgaaaatacttgtcgctttgagtttttgtttgtaatttttgatcattcgccttattcaaaaaattatgaaattattatttattttgtttgtgatttgctttgttattaatagtactttaagtataacttatcattttgtatatttatactaatttttcaaataaaacgaatgggtcaaacattaaaaaaaagtccaagcaacaactaaactagtacggaggtagtaaaacggaggaggtattttacgataggggagtactacgagtactgtgctattgacaaaacgaaactgttgacttgtgagaaagcgtcgccactgtcgcattcactgacactgcgggcccacccccactcctccctgtctccaacctcggtttccgcgcataaagaagagcttccgcttccgcccccacctccgcccccaaacccctcaaaaccctcgtcgtcttctcgcgatcgctattccctcctccattcctcctcctccacctccgagacctagggttccaatgtcgagcggcggcggcggcggcgacgactacaagcgggaggagtcggtggcactcatggtcatcgtctccctcgcggcgctctccctcctctccctcgtcgccgccttcgcctactactgctacatcacccgcaaggtctcccgccgcctccactcgctcgacctccccaagcaccaccgccgctcctcctcctcctcgcctcctcccatgcccccgccgctgcctccccctcctccttccgcgaatgccccgacgctcgggaaggagagcccgtctagcaactccgccagcgacggcgcggcggcggcggtcgtggtcggcggggagaggggggccgtccaggtgttcagctaccgccagctgcacgccgccacgggcgggttcgggcgggcgcacgtggtggggcaggggagcttcggggccgtctaccgcggggtgctccccgatgggaggaaggtcgcggtcaagctcatggatcgccccggcaagcagggggaagaggagttcgagatggaggtaaaaaaaataatctgcgtttcgagtaattaccagcaattgaaatgcgggtttccgtctgagattggggcctgggacagaataacatgcaacgggcggtaaattcgaatttaccacccattgcgagttatatatgttgatgaaattttgcggtccaatggagacaatgagacactgcggagtttccgagcgaaatggggtcactgtcgtctattggggttagttttggtttggcatcttgtcaaagatgtttccaaaaatggagtgttcggttgcttggtttggcctgtagttggctctaaacacacacatggagctctaattaccgtaaatctgggttatgatgttgctactgctggaattctaagctgttctaatcaagtttgagcggttaatatggggcattggtgatcttttggcaggtggagctgctgagtcggcttcgatcaccttatcttttgggcttgattggccattgttcagagggtggacaccggctgctggtctatgaattcatggccaatgggggtctccaggagcatctctacccaaatggaggtatgcacaccttttagcatccaattacaactatagttgaatttgatattttacaatgatttttaggcaggtttgatgttgttagttaagtgttgcaacatttgaacaccaaactatgagagcaaattgactgggaagctatccctgaacttagttgactattgtctttggatggcaaaactgcaaaacactagtgatgccacagctagaactagggacctagctgaattaattgcttttagcgcacatgaagtatttggttgataaccttattatgtcctgatactttgaggggaagaaatggagcagttgtaacagttgtcttgctgaggaaacaaacttatatctgactaaaaggagggaaagtgagattcaaataatacaggaataaaaattctaaatttgatgcttagtattacatatcagaagacaaacgaattgggagttgaatatttcatgtactgtaccttggtttttattactagacaccattggtcgtatgctaattcattatgaatttttccctagattctgttcatggattaacgaaaatgtgcaagagctctatttgcctctgccattctatgagtccattgggactgcttggtctggatacatgatatagcaatgaaaataattacattctctgtaatgctgatataggatacgttgtttgatgtttacatatgctcttgaagattgactatcccttcggaatgacagttagagaagagaacttacctaattggtgaacctatcaaatcacctatctcaaagtcacaatgtcaaaagaatcaaacagaatttccagttcatcaagaaatggtttatgtattcatgtaaagctttagcaatttagtggcctagatctatagtatttaaatatactgtctacactatttgcttggtttaattgctaaggaaagcatgctaacctcttatcagtgtgaatttactgattttagtctgtttaatactgtacaagaaagtggaaactgaccgttttaggccttctctcttccagataagaactcttagctagtcctatggtgaacaaggtgtcttcaatcttaaaaatctggtgttttttccacaaaaaaaaatcaagccttgtaatattgtaaaatcggtcatctggcctttgttgagagagcaccaccattatttttcatccttacaattgagttattaatctgttgagtcttgtatatatggcctgccgagatagttctaaaagttatggtttggaaaacaagtgaagtgaattcactacaaaattgcagtcattacatatgcattgtgttctttctttattggtatacattgatactgctttaagtccttaaagtgggcaggtagttggcatactgtgaaattacagattaccacatttcaattcttttggttgatatgaaaatatgaagtttctgaaaatgtttccttgtcatttaccgtagcatatcttttttagtgatggtattcattcagccaaattttcttcggaaatcctccccgtcgggcgcccgatggggagaaaaaaaatcaggcgccccgcgccgcccacgcctcgcgcgccctcaccatgcgcccccaccacgcgcgcccattgcaacagccgcccggatataatggaaacaccctattaagggggatccgtttcattttttgttccaccaacaatgtttcagctagtatactcgtgatgttttcctatgtatggatcacatgttgcagtgaatttttgatactgtttaatattttcaacttgatggacacgtggtttgttgatgtacacgagttttaagtgttgcaatggctttaaatcgtttgttgcatacgttgaaccaaattgtttcatctagcgatctgatcgtgtttcacttttttttaagaattgaaacattctttcatatttgctgaaacattgtttttatatagggtgaaacaacgcctgattttctggaaactgtttgtttcatacgttgtagcaaaatgtttcatgaggtgatttggttgtgtttcagcttttgaaaagattgaaacattttcgatctacttggtgaaacaacgcccgatttttgacaaaaatatcgggcacccgatttgtaggcgcgcccatttttctcgtcaactgatatcccacaaagctgacattgtaggttcctgtggtggtatctcaaaattggactggcctactagaatgagaatagctcttgaagcagcaaaaggtctggaatatcttcacgagcgtgttaatccacctgttatacacagagacttcaagagcagcaacattctactggacaaggacttccgtgcaagagtgtcagattttggtttggctaagcttggatctgatagagctggtggtcatgtatcaactcgagttctaggcacacaaggttatgttgcaccagagtaagaccaaattctgaacccattgtgaacgaacttgagtttgatactgatacattcaattctttttccattttactgtttgatttgataatataaatgaattgttgaactgattatactgtctctaatgtggtgcatgctacacaaactctgaagatatgctttgaccgggcatttgacgaccaaatccgatgtctatagttacggtgttgtacttctggagttgcttactggcagggtgccagttgatatgaagaggcctccaggcgaaggtgttctagttaactgggtaagaacattagctgaccatcacatagttgtaccgatgtatctttactttgaactgtttttcttcaaccatcaggaattataaaattagtactactgtttagttcatagtataaatgaggtaatggaacacttagtacttcagttgcaaaagtttgagatgctttccaagtgaggaaccaatatgtactaaggtacatcagtacatgtacttcaacactaaaatttaccatgcacttcaatcgactctgcttcattattcctgtcattttcttatgctagtgaatcacgttacagcttaattaggatccatctgcctctcttgttatactaggtaggaaaggttccatgtaattatttatcttcaaaaataatatttaaacattgcatatatctgacctgtggctagttgcattgatgcaggcattgcctatgctcacagaccgagagaaggttgtgcagatcttggatcctgcactggagggtcaatattcattgaaagatgctgtccaagtggctgccattgctgccatgtgtgttcaacaagaggctgactacaggccactaatggctgatgtggttcaatcgttggttccgcttgtcaagaatcgttctactccaaagacgtgcaaccctagtgtccaagcgtagaagccacttgaaggggaagttgaatgctcagtttccaggttggtgcttgacttttctggaaattttcatctacatctaacaactactgctgagtttatgagatcagtatgctccataacttaattctcttcctctgccagtgaattcctgattttgcgaggtgaatcgtaagcagttagatttagaaatcaagcattaatttagttcgatggaccagaaagctagtttcagtttgaagggaagtcctctagtcatgtgcaattagtgatcatgttaggtggtttggcttagtacttatggttgtgccctgtgggaatgatcagagagtgttgtttccagctggcagaattgcaatgtactgctgaattttcttttggcttgtcaattatgttaggtgtctttggagatccatgttcgttgtcttaactcttgtgctaatacgttggtctcatcagcttggcctataaacatcgccgatgtatctttttgtatatgtatatagtaggattctggaacttataaaaacaaacatttgccagttgagcattttcatgcatttcctttctcgttttctttaagcttccagcacatacttcagagaagcggcaaatttattatttctgtagaatgtgactaaaagttcccaaaaaaaaataacaatgtggtaataatgttcaggtgcatgtcaagtttccaacagcaaactattgtgacgggttgcaatttgagacattgtttatgttctctcttttatatattgagaggggagggccacatgattaatgtcgttgatgacccaaggaagatttgttgatagtgcatcatatttttggccttttgtaatttatcgtacaagcatcagaaactgcaatggacggttgatcggttagttgttaactattactccgtatgaattatgattgcccaaacctgaactgaagttgccgatgaagctgcatatgcattgctgtccagaaatgatggacttcaccagattggatggaattatttgcagtcttccaaatcaaaagtactatgctattgtttggaatttgtgaagttcataggaatcgaattattagtggaaacaattcagtttctctaaggctcaattcgtactgatctgcctccccaagtactttacgtaataagatttatgaacttcaaaaactggaatactgcagcaaatcttcagactaaagttatttgcatgattttacctaaattttttgtttgcactggagtaacatatcggctgtcctggtaatcaaacacatagaaaggcacaagtgccacgattatctgaatattctccagaggcaaacacactttgagctcgctttcagaaagcaaagcatgttgcatcctcctgttgcctgttgcttctcacaagaaatttatttattttatttaattttgttcagagaaagctatccagattccagatctcgtcgctgaccagcaagcacatggcatggccacatggcccaggtgtgagattctcagacgtttcaggaagaatcctaccctagtaaattacccatgtttttcaccagctcctctaaaatcactacgagcattaatcgaaacgacggttaataccatcaatccatatttttaaatttgatccgtgtatgccaaagggctaaaggattttttttttatactttcaagcttggatccgtttgaatgtgctgtcaacaacaaaagtttgatagagttcaatcaatttgagggctgtttggcttcaatccaaaatggcccttgatcttgcacatcgctgccatgcaatgtatatattatgatttcaatttccacgaaaacataaggaaacttgcaggaactaccctctatttgagctctacagcctataggatcctgactattgtttagtcttggaatttggaaatgtcaaaattctgaaattttagtaattagggccctttgatttggaaaaaaaacatagaaattttgcaagattttaatcctataggaaaatttcctatgaaggcctttaaaacaagggattgaatcatatgttatcctttgaaatttctatggaatagacaatttcatagatattttagagaaaatttagcaagggcttcaacctcttgggaattttcctttgagtctatctctctcaaccgattcctacgtttttcctgtggtccaaacaaatggttattcctgtgcttttcatgtattttgtaatcttctgttttgcacttatgttcctattagaattatgtgtttttcctattccttcatttttacatttctgcaatttaaaagggcccttaatatgtgagaatggccatattagcatgaccgtaacatcaatctgaacatcgcccatttcatctctaccctaccatcacaaccaatagagttgtactgaactggaattttttacactgtggcccttttgtaaaattattttacaaatatacctcttcgaaaagtaatttggaatatggaccttagctcttgacgccaaagtttttatatacgaacgtcagagacgcgatgggtccccacatgttagtgatccacgtaaaagaagttaacggcccctttgaattaaaggatttatgtaggaatttcataggattcaaatcctacagcaaatttttctatttggccctttgattcaaaggaaagctttccaaatcctatgaaattcctatggaatgacacattgcatgtggattttagaggatatatagcaagagctccaacttcttggaaaatttcctttgagtttatctctcatccgattcctgcgtttttatttttcttgtgttttgcaattatctgttttacacttccattcttatcagaatcctgtgtttttttcctattcctctattttttttcaaccctcgattcaaagggcctaaataagatgaactacttttctagggcgccaacacacaacatgtgtggcaaccaagttaggagtacagtatgtgtacatgatgccgagcaccacactcttgagaatgctgtagtgtgggatcgcccacactatcgaccaaccctacaatgcttgtgcatgcggatgtcgctgccatagcggcataagaccatggcacgctcgacgtgcttgacgccaactaatgttggtctggtgttcaccgccatcatacagttgaagtcagtgcggtccaatgagttaaatggcattggcgcaaagtcactggctcagcaatgaaggaaataaggtcagcgcccgagccatcggcactgacccctagccacactagtagccagggctcgaacgctatgttgggtaagaggaggctcgacgccatggacttcagcaccatggttttggacctcggcgccaaacaaggatcaagggaggattcaaacctgaaaagtaagtatttttcggcttacttacaaaatcaagtttttagaaaaggggctaaaatgtaaaaaataaatccagtcgtaggggaatcaaaaccaaacccgcagtttccgaaaaccaattggatggccagatcatggcccaacccccaacattcactccaaaacccaaaaccttgcacattgaccgaattccatcccatctgacgactgaccaacattgtcatctctagctggacaatgcaggaccaccaccaatcagctcctctggttctgtacacagtgaggggcgttttggtcaaagcatccgacatgtggggcccacataacggtcagtgctttgctacagcctacaggcagaggcaggcaggatgcatgtgagagacagcagccattttccccccttctttttctcttttttccgtactgatttcggcagcatcaaggactagaggaggaggaggagcaataaacaagtgccgccatgtcgcttgcccggctttcaggggcgcttttggaattctcgtttgaccgcctacaaacccacagcctgtccctgcaaccaatttggccctgcgccacgccacccccaaagctattagtactaaccacaccccctctctctctctctacacttagcagtagtactaagaccctcttttataaaatttttaagtcactatcacattcgttagcagtagtactaagaccctctttgtaaaacttttaagtccctatcacatcgaatgtttggacactaattataaatattaaacgtagactattaataaaacccatccataatcttagactaattcgcgagacgaatctattgagcctaattaagtcatgattagcctatgtgatgatacagtaaacattctctaattatggattaattagacttaaaaaatttgtctcgcaaattagctttcatttatataattagttttgtaaatagtctatatttaatactctaaattagtgtttaaaacagagactaaagttaagtccatgatccaaacaccacctaacatggacaattaggctgtactacaaccttttgccaagctacgtgtacaggtaaatcgcacacatgttgtcatctttggaggctgaaacatggggaaatatcatgtgaaaaccgttaaataagtgaaaactcatgaaaattatatttaaaagttctctaaatttatataaaaattaatagagataaatatagacatgaaatacatttacatcaaatctcaagtcgaaactcaacttttatttgagagaatataaaagacaaattttaggtgaatagtgttctattatttttcatccgaaatttggcatttttgttactcccaaataaagttgagtttaacttgatatttggtgaatatatttcatgcctacacttctctccagtaatttttcatgaatttattaaacttttagttccgattttcacgtgttttcacttatttgatggtttccatcggatatgtccctgaaatatggtattgaagtacaacatagttcatacttgggtcgtgtttgaagtcatgtaagggcgttataagctcataggttttgcttacatacaattggtgggataaaaaggcaccggtaatttcttcaagattgataaaataaatgtctagcgctataaggccatggcacacatcaaatgttgtttagaacaggttatttctagctccataaattgttggatttgaatttgtgattacattgataataattgattgaatcagtttgttcttattttagagaaaataaaaaaaataaaccactataatttaacttacaaactccaaaactagtctggatctgtaatttaggttgtgctaaacaaggcctaaagaaaagaagtaatgtttggagaacatgtttttaaatcaatatggaccatcttctaaaatgggcacactgtgcaaccgaaatggttattagcaacttaatatccaatccttaaaaaaactacattgaaaatatcctaaatcccaaaattaaattttaaaatctaattttggtagcgattgattatttgtaggggcaaatgatgaggccctaaatcaaccatgtttagctacttcctcgctttctttaagtatgtttcatacgctacaaactgatattttttgcaaatactttttattaaaaaaattattttaagtctgcaaaagctaatgtttaattagtcctacactaataatcctccttgtttggcttgccgctgataagcttagtcaaaaccctgatccgaactgcacgtaagaacggtcaagaaaccatttcggttacatcacacaacacagcctcatctctcatgctgtcatgcttgtggtgcacctagcaattcctccctccccatctgtcttcctcctctaatctaatccacctccccactaatccaccagctgtgtacactgcagcagcagcagcagctaaccactctcactaaaaactatagcagctgcagtaacagcagcagcatcacccaccttcttcttggtcaaagccatccatcccaccactcacccatccctcccagtataagccaaaccaatccatagaggaggaagaggaggaccaggtggtggcacacctaagctttgtgcagtgccattcacgcacctgcagcttccagctttgccacatggaccagccggcgccggcgccggagccgatgctgctcgacgcgcagccgcccgccgccgtcgcctgcgacaaggtatgtgactaaccggatcttggcgtgctgatccgtggttttgcggttctttgctgtgtgctgatttagtgtgctgttcttggtggagcagaagcagcaggagggggaggcgccgtacgcggaggggaatgacgcggtgaccgggcacatcatctccaccaccatcgggggcaagaacggcgagcccaagagggtgagacacgagccttcccccccccccctttgttgttttggtcttggttccatttcttgagttgcagtgaaatgctgccggttcttggtttaggaaggtgttcttgtgtgttctgcagctagtttcttagctccgtgtagtgatttttggtgatgggaaagccattggctctaagagaggcatgtggattagtggtcagattttgcaaaagaagtaaactgttggtagatatcagccaatttatttagtgttagttgttcatgttcttgtattactgcaagatctgttgtaaataactaaatatggcttgtttggtgctcatttttggtggtttgtaggggaaaaagttgggtgtgttggattacattgttgtgaacactagtgctcataattaaattttggtcttaagatggtaattttgtacttgattttcagacaattagctacatggcggagcgcgttgtgggcactggttctttcggtatcgtctttcaggtgattcatctttcagaaagttgttatttgtttctttcttttcgtgctgtcgacttgttggtctgatgtttagcttgctggtttcatgtgtaggctaaatgcttggagacaggagagactgttgccattaagaaggtattgcaggaccgacggtacaagaaccgtgagcttcagcttatgcgcgccatggaccaccccaatgtcatctccctgaagcattgcttcttctcaaccacaagtagggatgagctgttcctcaatcttgtcatggaatatgttccagaaacactctaccgtgtgcttaagcactacagcaatgccaaccaccggatgccacttatctacgtcaagctttacatgtatcaggtgtgtggattgctaatcaatcataaattttgaaatgcctgccttcctgtgtgtctcttctaagtctattctacattggctgcagttatttagggggcttgcgtacattcatactgttccaggggtctgtcatagggatgtgaagccacaaaatgttttggtaggtattcatgatcagattattattttgctatgcgatggcctttgattattggctctgaactcctttcttgcaatacaggtggatcctctaactcatcaagtcaagctctgtgactttgggagcgcaaaaacactggtattggccttttcgggctgcagga

SEQ ID NO: 47896 - DNA, 5025 bp, Oryza sativa
tggtggcgagaacaagaacagtaaaggcaacagcaatggcaatggcaagaatggcaatgacaacggtgggaacggcaacggttctccttctgctaccattgcaaccactattgtatcactgtatgctattgttctcttcttcccttctctgttggttcctttcatatgcgcaaatgagttagatatgcctattttcatggtttacactgatatcatgtttttttttcatattcctgttgttgagagtacatcgtttattgatttacgctatcataatttaaatttacatcgttatgatttactctcttattttctacatcaaatattaaggtgatttccttatattgtcaataattcaaaaaccttattatagccaaatatcatctacggttaagaggctcgtataaaaaattgattttcgcttatggttcttaaaccgttttcatagaaccatcttcttatagacaagagtagttatggtccaccactccacctacaatctaaggggcctcataaaaaaagatcgattaatctgcatagtggaccaagtcaattacgtagtcaatgcaggtttgtgtaccctgctatagctgagaacgatcgatcaccttttgagccagtcctcttaatcaattggcatccacagttgacaagatggcatgcaagaatctaaccatgccaagcggtactcgatcaacacgttaattcttattattaccgcgaatatggctgtgttcagttacacgttaaaattaaaagtttaaagaaattaaaacaatacgatgaaaaagttaaaagtttatatgtgtagaaaagttcgatgtgacgaaaaagttaaaaatttgaagaaaaagattggaatgtaaacatggcctatatctcccaaccaccactaggacgaaagacataagtgacattattttcagtgtcggcctgctcaattatacacaccctcttgacttcactcttccaattgcaagtctttccatgactgtatttatgtcagatttcagtctcgcctctatcggcatccccaattgaaatggaaattcccaggggcaataaaaaatttagcacgagatatatatgatacgttctaatactataaatctaaatatattctttttctagatttatgtggtaggatacgttacatctctgtattagcggcatcatcttttgacttgtgcttatgctttatcatctaaaatttgaatttttaaattaaatttggagttgattttggagttttttcatcgaagtttatttttcagcatttgcttttgcttttagatcgctaagaacatgtataaaaagctttattcataaattatttttcttaacgggctgtagatttattttctataaaacaaagggagcagaccgaaaactaccggaggtcaatgcatcctctacttttagttcggctgggtttagttccaaattatttcttcaaactttcaacttttctatcacatcaaagttttcctacacatataaactttcaacttttccgtcacgtcgttccaattttaaccaaactttcaattttgacgtgaactaaacacacgttaagaaaaattcattttctaagacatattactatgttttgggtaaattttgcatttgcctgcagataattgtcaaaattccattttgaattagatccaagccagtgccttttttatagaaataaaaactaagccataggattgaaacacggtaaaccaagcctaaaaaaggataaacagtagcgggtgcaaaacagcaaatcttatagaataaatattcaccgccaaaagaaaagacagcattattttcaacatgttaaataaattaaaccagaaaactaaaacaatatgatagagagcgaaattgcaacactttacaccaaatgttttccatagtgcatccgaggcagtcctctatattaatctcacaaactaaactctatgaaaaagaaagaagtctaaaaaccataatggtctctcgataaaggtgtcttacacaatctctctcctattctagagatgaataaatatcaacaagtcattcttctgatagaatagtaaatcggtcactaaacaagtttttttaggaaggtcagtaacaagtcggtgacctgtaggggtggcaacggggcggggcggggccgggttggcttggaatgcccccacctccaccctcatgcaggtatccccgtccccggcctcgcaaaggaagtcgggtgaaaaacttcacccgtccctacccccataggggacctggtgggtgaccgggtccccgcatcagctggatggagttaatactccatccaaatattgcaatacactaaataatagtatgataaaatttcaataaccctcgacagtgtgggtggattgaaggaaggaaagggattacgattgaggggactagggtattgagcttttatatgtcaactttgaatgggattgttgggtctatattattgtaatgggctacttttagagaagtaactcacatccgggacccctccgggtcacttgcgggttaattccgatccccatccccgttcctagaattttgtggggccccgtccccactcacccgcgggtgagaactctcccgcccctgtaggggcgggtcccctaccctaacggggaaattgtcacccctagccatacggcatgcgtctagacagatgcagactctagggtttaattgtcccttttgattcctatcatgttggggatgatgagattgagatgggctatgtcgcagtatgtaactcccacatcggggaagcaagaccccctttcgaagatttggacaaggggcgagtctaagcctgagtcaccctcaggatcaaatggacgtgatgaagtatacaggtttgagccatacggatgcgtaacatcttactcttgtgtgtatgtagactatcagtgatgaacttgtattacgatgagatataggacttatgtgagctctaattgctaaaagattcaaccttctattcattgggatagatcctccttttatatgccaagggaagtgcatagtgctaaaacttgcatctaagagcgggccctattccaaagagttgggtgtgtcttgtttcgtcgatgtcccctatagcaagatggcaggaagtgacatctttgctctccgattgacacacgatgcagaggcaaggtgatcttctcaccattgggcccaccagtcaactcttacaaggtggcaagattgaatatgctggagtgatatgggaggggcatgtccaccccacctattccttcggcagacatgggttctcgggaggctacatgcggcgtcatgtccctaagatgtgggtggatgagctgttctccaaacggctccctcctacaacggaaataataatattgagttggagttaagcccgttggcccaccaagcgaggtgaaaaaaaccccatagtgagcccggggcaatgaggtgtgctcgggcccctgcctagggccccaagtccattggtattgcgcattgagggtgcctccactccatggggcttgtttccatgcctggcgcactgagtttcccaggtctccagggatatttcctcttgcttctttacaggtttcttgttactttggacgagcttctcgaagatgtcgttaatgaacgggttcaaagtggttaccttcgtcaaagaagcaccatacaccttggagatattcttgtaggtctccaccctcttctcggtaccttggatacgtagatcttgtaggtttctacacttttcttaagatctgaatgtagatcttatacgtctcttgaagatatagattttgtacgtctcttaaatatgtaaatcttatatgtctatctcttgttgtgatacacatcatttggagccctgactattccagggaaccggggaccccattcccgttctccaaacaggccatattatagatcgactttttaagtcctatactgctgtatgcatataataatcaatacattttatgaacttggtcaaactaaaaaaattttaactgagaaaaagtcaaacaacttataatataaaatgggtaagtacctcttaagttcggccccactcatatcaagatgcgccactggttgacctgttctttgtcgaacatgttgccgtctgttagacttcttagagaaggactcagcaacttgtttatagcaattaccaattaacgtgggggcattttagcaaagctgcggagcatttaattattatgaagtggagtagataagttttcatttgttcaggctataaattgagaacagactctgccctctggtcacgcattctacacagaatctctggttttcccaactgtcagagaagtagagaacattccagcttagttgaacttctcacaaaaaaaaaaggtactccaggctgcctccaatggcggaccgaatccctgctgttgccgctgccattgccattgcctccctaatcctcgtcgttacgccggaaatggtctcctccggcttcattccacggttcaagctaagcccaaaggcaaataagcagatccgggacatattcaaggaccatgccgcggacttggccggcctcgccgcggacgccatccccagcaagggcgagggcgaaggcagcagcagtgacccaagtcaggccccggccaccaccggcggaacctacctcatcaccgtcggtgtcggcacgcctccgcagtatgtctacggcgcgttcgacatctccagtcagttcgtgtgggtgccatgcgaggagtgcgtgagcccctactcctgccccagcgacaaaaccggcgtttacaagacgctgccccgggagctttactcatgcggagaacagcgctgccggacaatcgtcgggcagccggactgcggcgcaccgtataatggcccatgcaaatacacctgcaggtacggtgtgcgggcggaacggaaacggaaggacacctcggcctccaaccgttcacgttaggtgacaacacgatgccagtcaatatgattttcgggtgtggcctcgaa

SEQ ID NO: 47897 - DNA, 6733 bp, Oryza sativa
aatacgacgacaccgccgccggcaacgcaagcttcatcctcttcggcgaatacgccgtcccgcagaccagcaatccccggtacactcagttttggtcctacgaaaacggtgcctacagctacctttacctcgttgggctctccggtatgcgagtcggcagcaacaacctcaacatgttgggtgcggggtcgggcggccgagacccactcgttgcgtacctcagcacctccgtgcccatcacctttctcgagaagaacgcctacgaccttctaaggcgggagctggtcagcacggtggggtccgacaccgtggacggctctgcgctcggccttgacctgtgctacacgagccagtacctggccaaggccaagttccccgccatggcgctcgtgttctgggacggcgcggtcatggagctgcagccgcggaactacctctaccaggacacggctaccgggctggagtgcctgacgatactgccgacggcggtggccggcgggctgtcgctcctcggcagcctgatccagacgggcacgcacatgatgtactacgacatccagatccagggccgcgggtcgctgtggttcgagtcgttcgaccagccgtccaagtcgtccaaccgggcgtcctcggcttcggctgccgcgttgccgcggatcatctcgacggctgcggcgatcgcctgttccgtgtggtctgtcgtggcgtgcatgttcgtgtgaactgcttgtgttgtgctacggatggactgagatatgtgttattagaactatcttaaaaaaaacttcgcaatttttttttataaaactttcaaatgtaagtatagtgtaactatattataataacttatatataactagaaagtaactacattgtaactcgtatataatttatacgtaactaaaataaaaatatccaaaaaattatatggcacggtggtagcatagatcctcaatgagctcaacggtgtgagatcaaattttagcagctacacttgctaatttattttttctcctatttgctagcacgaatcttaaagcaaatctaatggtctaaaattgaaagttttccccctaatctagcaattccgataagggttctcgaatgttggtgtgttctcgtatgagtttagatcggggcggtagccgcggtacgtctcacaggttgtgcagctcttgggacggcgctactacgagcgatgtggcttatgagtttgtctcgatctaacattccaagtctcgagttgcatccaaccccaatacgctgcaatctatactcatcgatttaagtaatagtaagagagagtgacatatggagcgtattgtgttattgactggttaattttcctttgtgatcagaacaaatcagatttttgactttcttttgtgatcagaataactcacatttttgccatccaaaacaaagtagtggacatacgcatgaatgaaccgataacaacatcaaattcaaaccgatgttattgaacatcctaagggtaagagcaatgtgtcactatatatatttagcctggggtgccaaatagactaaagaacttcaaaagccactacaaaatgcaatgtggcctaaaaccgagtcatttatgtttgaagacacacatgtggcatggcctagcccacggagccaagatttgtcccagcacataaaattacctatgtaccctcgaaatcaactagtacactgccctttgacgaggccggtacaaccatgtctcatcgcctcctcctaacagcatctccttcctctcctcctcccgcgccaccgtacgccagtctgacctcgccgacgatgaagctccggagtggcttcgtggctccggagcggctatccccaaacgcggcacagtctccactccctccggttccagccatgcacaggcttctctgaaactatctgctgctgctgctgaaagcctgaaatgtgagtggggctttgtttctttctttgctactcccgtgcatgtcttggatcctttcggtatggtctcttgctgcgccgtgtgagattcttgcatctgctacacatgggttctttggtaaagttggtttttgcctctttcagttcttggtctgcttcatctgtcttgttatcttccatttgctaatcctttgcattttatttgttgataaatggagacttgtgacctttcatctcttgctcaagtttcacctctcttcctgcatctcactacctgatttggtgcttaatctaatccaattcctttttggttcttgtgattgcggtgggtgattaggtgcttaacataatcccaatcctagaaaaacaggagagccggccatggctgtgattgccatggctgctgtacggcgagccactggggcaggggaagccggtcatgtcgccggagggcgtcgtgccgagagcacagactcctctggatcctcctccgattccaaccatggaccacgcggaaaggggaaaaagaaagcggcccgtgcgcgggagaaagagggggacgcgggaaagagggcgatggcgagggcaaaaccgggatgcggcgcgcgcctgggcacgagcacgaagccactcgccccacagcgcgccggccacgctttctcccagccgcgcgcagcttcgttttcacccaagaccgagttgcttcgttttcacttgcgaacgtggcgccgatttctccggatttgtcgacgtgtacgcctcaagccgaacgacaccgtgttgcattgtaaaggcctaatagaacgggggatcccaatgggcgatcgatcgtgggttagcgatcgatcccctctccctccctccctccaccggaagaaaattctctgcggcggactaccccaaaatcgaattcatcgcatcaccggagaggcagagaccaatatcacttccttcaaggctccaaccgaggagaagatatcaggtttcttgaagcgatattgaatattgatcctggcttctctttacaatggggtgctcattgggattggaattagtgtgctcacaagccctccgccgtttgagaaggggaatgcggtggatgatgccgaggaggaagcgaccgtcaaggatatcacgaatgagaagctgaagttggcggcacagaacatgccacgggagatggcggcggcggcggatgggtggggctccttggcagggggaacccgacgccccgacgggtgaggcgtagtcgtagaagccgaggagcgtcggcgggtggagcgcacgcacacggcggaggaaagcaggatcgttgacgatgcagcggaaccgaggaaggaggcgcagaccgcgcatgcgcggccgacatcagtgacggacgggaggcatatcaggacctccacgatgaggtcgtaggtgagaaccagctcctgggcgttgagtcgactatagagattggacatcggctcggctcgaaagaactcgggctacagtaaaaacttagacatgcgtcgctagactacgcggtgttgtacatgaagtgtcatgcggcatcgccgcagagaattttcttccccctccatctggtttcctttcttgggtaccacattactttcctattttagtaaatttgtacactaaagtttatacacctcaagtttacacatttaaggtttagagaccaaaagtttataagtcaaaagtttatatatccgattcaaatttgaatttgaattcaaatattttttttatatatagtatttctatatatcaaaagtttatagacctaaagtttataagtcaaaagtttatatacccgtttcaaatttgaatttaaattatatctaattaaaaattgaatttgaattcaaatattttttatatatagtatttatatacatctaaaatttatacacctaaagtttatagatccaaagtttataagtcaaaagtttacatacccgattcaaatttgaatttgaattcaaatattttctatatatagtatttctatatatataaagtttatacacctaaagcttatagactcaaagtttataagtcaaaagtttacctacccgattcaaatttgaatttgaattcaaattttttatgtataagtatttccatacataaatttgagtaaattgtatattggtcctggttttcttacctgtgttgcacaatggactggatgctaccccatattttcactttaatacatatgaagttaccaaaactttcatcttggactagtggcccacatatcatgtagaaagtgttttcttccatctctcccgtcttcaccgacgaatgcatcaatctcatcttgggcccgtggttagtgaccagcagtccagaatgagtgcagctttgttggtgtgatttgcttggggttccaattgaagtccgatcttgagcaacgcaggttggccaatggatggaccgagatcgatggagcgccaggctgtacgttgtacgtgccttcacctgtcaagctcgaggggcgcccgcactcgtctcccagtggcagcgccaacgacagagcccattccatctcgcgcattgcgtcagccggtggagcggtcgtcgacgggcacaacctatggagccgacgagcggtcatcttcaagagggagggatgcagggcagagctgcagaggacatgccagcggccactcgatgttcgtgcagcctgctaggctgctactgctgcattactggggaagagatgagctctgcccgatcaggatagggactaataaaagaggaagatgaatggctgaggctaacatgtgagtcaactagtccaaattgcatagtttggtaacaaaacctggttcaaagtgaaaatggttgtacgttcctagtccagtatgcaacttatgtaattaaaactagtccaaagtgtaattcactccataattttttctaactttttgttttttttaaaaaaattttatggtgtactgtagtaggaagataagaaggggaggagggaggagtgtatcgagtagtataggggagagggcaggcaggtgatcgctgggcggacaggggagcgatcacccgcccattagcatttccgtaatagaataatgttttatgaaaaaactaatgaactttttttgaacgaaaaattaatgaacttcaagtagcgaaggaaggtaaaatagagagtagctttcacgaaaccatgttcaccaccagcacgagtgcacaacccaccccacgaaacaggcgatcgtcaccgccgccgggaattaaattaaaggccaaaacaaacactgtacaacaaaagcgggaaaagcaaaacaagaaaaaccaaaattacaggagataagggggaagagaaaaaagaaagccacacagggaggatagctctattcgattgcttgaaccgatgaacccagagcttggcatcttggcagcaacatctgaggaggcggcttatggatgggagttcattttggaacacgacttcgtttctatggttccagaggcaccagcagcagagaagaaacaatgtgttgttcaacggtaccggggcaccagcaaggttgttggtgtgcagcatgaagagggttgtcactgacggagtgagcttgatcaaattccagaaagctgatgaaaaagggcaatcgaggaaaaagtgatccgtatcttcaggagagctctggtagagctcacatgttggggatgggagaatcttctttttgtgtagatttactctggtcggaagatggttgaaagctagaagccaggcaaagaatttgatcctggggggggggggctttgcttttccagatgtaagcccattgaggccattcctgaaactttgccatttgtagctggtagagagctgaagatgagatgacaccatttttgcatttggttttacatattagctcatcctgggtagccgagaggggggattgctacaataaaacctgagggtattgagctgattatgcgcttccattgaaagacgtgggacaagggtggcagccaggccattttggataatggcttgcactgtgcagtttgacttagtagagtgtgtgtagagagcttggaatcttgaggcaagaggctgatcatccagccaaatgtcgtgccagaaattgttgcgcctgccatctcggacaaccaaattagtttgagatctgagaagtggaaacagggcaatcaaggatcgccagtgggggcccagggctgaatcagcatgctccctccatatccaatttgtccagggtgaattctaggtgtacagtctgtaaagcatcttgatgagaaggcagatgttttgtgtgtgaaggcgtttgattccaaggccaccttgctttttgtctatgcagattaagtcccatgcaatgaagcatttcgagccgtgacatgattcctccccagtccataggaaagcccgacggccattgcataggtcggtagaaagtctagcactgagttcaccaagaccgccctgcctgcatagtttaagagagaggcctgccaccccgctaggtatttgttaacttttgctatgagtggttgaaaggcagtgaggggtagcttagtagctgatagtggcaaccccagataagtttgaggaaaagattctagcttgcactggaggatgtctgctaattctttgctggcttctggtggagtgtgaagggtgactagggtacttttgctgaagtttattcagagacccgtggcctgtgcaaaggagttgagaattgtttttagagcacttagctgggaggcttctgctgggcagataataagtgtatcatct

SEQ ID NO: 47898 - DNA, 1145 bp, Oryza sativa
tcctgcacccctgcaaaatccaatttcaagacagccgtaggcagcttacatttgtgacaacactggagaatttctgttgcatatagaaaagtttctgagatgcttctccttttcataaagcctgtttgctcccagtctatgagactgccaagaacggattgtaggcagttagcaaggactttcgacagtagtttgagatggcagttttgcagtgagatgggtctataacaatatggggagtttagtttaccgggtttgtgaatgaggactatgtatgctctgttaagtctttcaagctgggcagagtggttgtgaaattcagtcaacaagttctgtatgtagggcttgatttgctgccatgctgccttatagaagcttggaccaaaaccatctggacctggggcattgtaattatccatgcagtccaatgcagactttgcttcttgaagagtgaaaggttccgagatctgctgctagctcgcattgtggactgtattctcagggtagagatcttggagatgaaaatcccaggtggtgtttgctgagccgcccagagtttcgtagaagaactcgtaaagcgcatctgccttggtgtcgtggtcgaaaacctgcgaaccttgtagcaggagggagtggatgccattgtttctgaacctgtgtgacgcgtgtgcatggaaaaatttggtgttctcgtcagaggctttgattctcttgatcttgctgcgttgcttccagtagattgctttgcatcgatggagatcagctaacttgtcttgaacgaggtcccgtagggtgaattccgcagtcgagaggggcctagcttcttcaatagagtccaggaagtcgatgagcaaagaacagtcagaaatgttgtcgttggtcaacttgtgagctttgatccaattcttggtggcgaaacgtgatttcttcaggttagcaacaaggttgccagccgcgtctgtggggtggtgagtgggtagttggcccacccaggcccaaaggatagtggggaggaaatttggggagcagagaaagtgattgtcgaaacggaaaacttgagttttgggtattgaagtggaaatggatatttttagggggacgtggtcagaggtagtgcgaggtagggaggagagggaggtgtttgg

SEQ ID NO: 47899 - DNA, 12272 bp, Oryza sativa
ttcgataaaaaccggaggttttgggaacgaatcctcccacatatgtacgcgcagtgacttttttctttctccactcatacaaatcttgaagaaatctaacggttcaaaattatgtgaaagttatatgcaaattatattatagttacatgcaagttaacagtgtaataacactacgattatacgattatactgtaattatatctattaaatttttaaaagaatttatcgataaatatataacaaaattgtttcggatataggtccactgtaataggttgtcaactgcgagccgatataaagcggcggccacaagacgacatccaaggcccgaggatgggattcgatcgagtcgtgggctgccgacctgccgtgctgccatgccatggatcttatttgcatgtttcgtgtggtgtgttcttggcgtgggaataagttcactttaggtccctcaatttgtccccgaaccacaataccagatatgtgcatctctcaatttacaaaaccagtgcaaagaagatcgcagggcggtttggatgacggtttcgactgatgtaacaccatacgcggcgttgacgtggcacgggacccacctgtcagtgagtatctaattaaaaaattaaaaaaaaacactgaggccacgacatctctttctcctctcttctccattcatctctctccatttccgattccgagtcgtggttggcgcaccgcgcacgccgccgctcttctggacgacaacgggcggacgggccccctctcctccttcttctcctctgaaacggcgagagcagtggtggtcgtcggatccgcgtccgtcgcgtcggcttccgccaccagcttgggcagaatgaggaagcagctccgtaccacatgtccttcaccgcaacatcgccggagttggacggccccaatgtaaggcagctggtgatgcgctcgccgtcggtccctgctactcggccacgaacgtcaccataccgtaggggaaggggaggagggtgccccgtgccgtccgccgtcctgcatccggccatccaccgaagtgtcaccatctcattcacggagtatcaaatacgacaacatgaagaagatgaacgcacatgtgatggaggagaacgccatggacgtcgtcgcgagctctgcgcaagaaagaacggcacagttgcttacagttgtaagaagcaacgagtccattgattaactgatgataaaattggcaagaaacgtaatgccaagatcattaattacgtcattctggagttcatgtgattcccagtcaattctgatttccctccaactgaaatctgcatgacgaacagagccaaaggtgagatttttacaggaaaatgctgtctttttctgaagaactaggtgttggtttgcaattactgcccatgtgaagagcagtgctactgctatatctacaggtgtgctcccagaattatgtaactgcagccaagcaacaaaagtttagcgaaaaaaatgaacagatcatttggtgtcattttcatctgcagcagtaacgagaaaaaaaaaaagaacggatgcaggatggcggacgggcatcctcctccccttcccgtccgggcgatgttcgtgaccaagtcgcagggaccgcggcgagcgcgtcaccagctaccttacgttggggccgtccaactccggcgatgttgcggtgaaggacatgtggtacggagccgcttcttcattctgcccaagctggtggcggaagccgacgcgacggacgctgatccgacgaccaccactgctctcgccgtttcagaggagaaggaggaggagagggggcccgtccgcccgtggtacaccttctctagttgctctctatttatccggtttgcatggccggaggtaattcgatcgcgaccgggacggtaaatccagctctcacaagaaatacgcacacgccttggcagcgcgcgcagccaacgactcgaacgtacttacgtaccccatcgtcggcccttggatcgatgccgacgatattacgccgtacacgtacgtagttgcacgtgccaactgccattctgccaaccgtggtatatatcctcgtacgctagactacagctgtatgtgacaccgtacgtggatatggtctcagttttaggtgttgtggccaccggccgctgttatcggcgtcctcgcagactctcagttgacaatatagctaatacaatggacctgtatatcacggtcaacattaattaataggactagctatatttatggcgtcatattttttttaaaaaaatagttggtatgtatttaaattgtaagtctctaaattacatatgtaattttagtatatttacaatgtaagttctaaaattacatatgtaagtcttaaaattatatattgtcagggttacggataaggtataccctctacccttagatatacgctatacatcggtgtggtatatgtgtgcgtatacggatgttttttgtatgcgctaaggaaattcatcacggagtccacagatgaaaagattcctaaccggataggactgggtcgtcactgtatcatgtagaatccgatgtctccgagtcctacttggaaactacctgacctgcgatataaaagggaccccccgggaggacctaaggcatcgaatctcacatccgagacaaccaccatagcctacgaagccggagcctacaggagccaagtcgccgggtgatctagtcgactcgactacggtctcgtcggtatcatcgagttccactgttccctttgtaatatgtgatttccatcatataatcccatatcaactggattagggctattacctaccaaggggtcagaaccagtataattcctgttttctatttgcttaatgtcatattacgtagatcctcatactagcgtaccccaataccctctatatccagtctacgggtatcccccgtcgacaatggcgcgccaagtagggggacttggtgctcaagattctactactatgtcgtcaaatctcgtcaacaatagcgtcgaccccatcgtcaaccaaggagttccgacttcaacaatgctggtgtgtactcaagtcggtgaaatcgtcttcccgatttacaccatggtgccggtctcgactggtccatcaatgaccagaagtgagaatgccgtggccgtaaccccggacgaccccctgtcgaacgatcctcccgccgaagcggagaaggaatgtcgacgacatccaagcctgaggaagatcttagtgcggccaaatcttgtccttccgacaagaatcacgagccgacaaggacaacttttgaggcgacaaggtcctggtgtcctattcacaaaactaggaaatacaccctgcaagcttgctgggtttttctcaacgcacaagctgagatccgtgcctgcaaagagcatggaattcagcgtacttctccaactcgtgatatctattgtcctatccacaagacaaagaatcacgacttctcaaactgcaagattcttctcaaagccatgaagacgtcgcctcctaaggtccagtagtcacaaattcctcctagagatgtgaacaaggaacgaggagcgacggtcatcccagtcgattcgttggggtgatcgacatcgatccccacgagccatcagtcctacacttgctcgaagactatggctcattgttagcgagtacaccacatgacgtatttgctatcggtgggaccagcacgtctgcgcacgctaatgcagaagtggagaatcaagcggccacgccggcccaacaccttgggaccatcaacgcaatactgagagaaaccaccaatgatcccgtactcaacgatgatctcgcacggtggacagaacgactacgggaatcagtagccaatctcagtaacgcgttcgaggaggccactaccagagcacagacagaacaaccgacagctggcggcgccgacggcgagccaccggagtaacggacatcgcctcaatgagccacccctccgcctcacagcaccggcaatctccacgaccatctgaacgaccgccgagaagcgcgaggcgcgcgagacaacgagaatcgttcccgacatcgcgtctcttcgcgacgtcgcgagaacgaagagcgaggaggacgctcgggcgagaaccgagaccgtgatgaccgccacaaccgccaagagcgcgatgatcgcgaacagcggatgtcgggcgatgttggtcgaggacgccaccataatggtgacgatgacagagatcggcgcaggaacgacaatggtggacgatgacaggattcccgagaactcggacgtcatcctcggaatcgcacactagagccaagtgacccgtcgtcatcgtcatcatccacttcatcctcatcgtcagatagacatccacgaaggacatatgatcgccgacaacccactgcccccagcgtcgggtgtagagctttcaaccgttcgctacgtgatgtccgatggcctgagagattctgaccgggagcaatagagaagtacgacgggagtaccgacccagaagaattccttcaggtctactccacggtactctacgctgccggagcagatgacaacgcattggcaaattatctgcctacggcgttgaaaggttccgcgcgttcgtggctgatgcacctcccgccccactcgatttcttcatgggcagatctgtggcagcaattcgtcgctaacttccaaggaacatacaagcgtcacgcgatcgaagacgacctacatgcgttgacacagaatccgggcgaatctctgagggactatttcggcgctttaatgagtgcagaaatacaatccccgaaatcactgacgcctctgtgattcgcgctttcaaaaccggtgtcagagatcactatactacccaggagttggcgacaaggcgaatcacaactactcgaagattgttcgagatcgtcgatcgatgcgctcacatggacgacgcactgagacgtaagaacgacaagccaaagacgggaggggagaagaaaccagccaaagacgcacctgaatcaagcaagaagaaaagtaacaagagtgggaaaaggaaagctcaagtggaagtcctcgcgtcggaatatgagtgccctcctaaacacccaaaccggcagcgacacgaagagaatatggtaccccatacacaagtcggacagacattctctagaggattgcctcgtcttcaaaaagtcgctggaaaagcaactggcattggagaaaagcaagcgagtacgggtagtcgagaaagctgccgaggcaaccactcaggactcggattcggcatatccagattccggtctccatgtctcgcacatcttcggaggttccatggcatactcctcaaagcgagaatacaagaaagtggagcgtgaagtttgttcgacatggcagggggctgcacccaagataaagtggtccgaacagaagattgagttctcagatgaggaccaccccaaggctgctgttatcctaggacgatatccgatcgtggtcgaacccactattcggaatatcaaggtagcgcgagttctcatcgatggcggcagctccatcaaccttctctttgccagcaccttggatgcaatggggattccacgaagtgagttgacacccaccgatcaacccttccacggaatcactccttagtcatcgtccaagccattaggcaagatcacgcttcctatgactttcagccaagcgagcaacttccgaacagagcagattacgtttgatgttgctgagtttgacacagcatacaatgccatcatcgggagaactgcactcgcgaagttcatggccgcatctcactacgcatatcaagtactcaagatgcccgggccgaagagaacaatcactattcaagggaacgcaaagctggccgtccaatacgacaagcgaagcctcgacatggtcgagcacacgcccagcccacccaccgcaaccgagccacccaagaaagtgagcaaaacaaccaagacgccgaaaccagaaggcgtaatcaaaatcgttccactctccagcgccaaccccgacaagacagtcaagatcggggcatcactggacgagaaataggaactcgcgctcatcaccttcctccgcgacaatgttgacgtgttcgcttggcagccgtccgacatgtcgggggtccccagggaggtgattgagcacaaactcatggtgcgacccgatgccgagccaataaaacaaaaactgcggagatttgcaccagatcgaaaacaggccatacgagaagaagagctcgataaacttctcaaagctggtttcatcagagaggtactccatccagagtggctagccaacccagtcatggtgcggaaggccaacgggaagtggaggatgtgcgtcgacttcactgacctcaacaaggcgtgccccaaggatcacttccctcttcctcaaatagaccaactggtggactcaacagctgcttgcgagttgttaagcttcgtagatgtttattccggctaccaccaaatcagcatggcaaaagagatcgaggagaagacatcattcatcacgccgttcgctgtattctgctacgtttaagatgccgtttggactgataaccgcaggaaacactttccaatgcacggtccaaggggcacttaacgattagcttgggaacaacgtcgaggcctacgtcgatgacattgttgtcaagaccaagacaagcgactcattgattgacgatctacgggaaaccttcgacaacctccgacgatatcgcctcatgctcaatcctgagaagtgcacgttcggagtaccattgggcaagctgctcgggttcctcgtctcgggcagaggaatagaagcaaatcccgagaatatcaaggcaatcgaaaacatgaagtcgcccacaagactcaaggaagtacagaagctaactggatgcatggcggcactaagcaggttcgtcgctaggatgggagaacgaggacaacccttcttcgttctgctgaaaaaacaagacaaatttgtatggacacaggaagtcgaagaggcgttcatcgcactcaagtgctacctgtcaaatccccctgtacttgttgctctccaacctaatgaagaattattcctctatattgccgccacgccatattccgtgcgtactgtcatcgttgtcgagagagagaaggtgcaaagaccagtctactacgtcagcgaagctctccatgacgtgaagacaagatatccacagacccaaaaactgctctatgcagtaatcatgacgtcaagaaagctacgccactacttccaagcccatggggtcacagttgtctcctccttccctcttggtgaagtcgtgagaaacaaagacgttgtcggccgcattgcgaaatgggtagtcgagctaagccagtttgatgtctactttgtgccacgaacagccatcaagtcccaggttctcgccgactgcgtagccaattggactatgcctgaaaataggttagacagtcaaaccgacaatgaaacatggataatggcgttcgacggcgcactcaacagccaaggagcaggggcagggttcatcttgacatcaccttcgggagagcagttcaagcatgcaattcacctcaacttcagagcaaccaataacacagcggagtatgaaggactactcgctgggataagagctgcaaccgcacttggagtcaagcaattaatcgtgaaaggggattccgaactagtcgcaaaccaggtgcacaaagactacaagtgctctagcccagagttatccaagtacctcgcggaagtcaggaagctggaaaaaagatttgatggaatcgaggtccgacacgtataccgcaaggacaacatcgaaccagacgatctggcacggcgtgcatctacacaggagccactcgaacccggcaccttcctggacgtcctgacaaaaccatcggtgaaagaaacaaatgacgaaaatagcacagtcacacccgacatctgctcgggggctacagaggcagaaatgcgtcgtgctgacatcgagacctcagatgacttgcggatcccacttattaaattcataagtagcgacgagctacccgaggacgatgcaaaagccgagaaacgacgatgtgaaccttctcgaagaacatcgagaacgagttgccgtcagagcagctagctaccaacaggcccttcgccgataccatgagaagcgcatccgagcacgcacgctttcgatcggcaactacgtcctccgacgggttcaaagccaagcagcgcaaaacaagctctcacccaaatgggaaggaccgtacacgatcacgcaagtcctgcgaccaggcgcattcaagatttcagacggcgatggtcgcgagttggcaaattcttggaacattgatcaaccacgtaaattttatgtataaatcaatagcatccatacttgtaagacatattacctcttcaataaagtcttctttcaggaaaagattacaactaaagtgttccttcccgatgatccattaccccgatgacacctagcgttgaaacctatcctcatgtcctttacgccgtcttgacaaggcctccgaggaacctaagggaacttcggctggggacacccagagccgataaggccttgtcggatcctgtagagacgaaagaccatgtaagatctggtcgtgtaagagttctcgtcgtgcgtattaaccaagccgtgtaatcggaaattggattttccaacctcacggctaggggctaggattagtgtttgttcaaccaaggcaggtcaaaggtccaagagccttatcttccgagaagaattctccgatgacaaggctgggggttagggagagtgtatgactcaagtgactgatcgaagtcgctaagtgagaagacactcgcacacaccgcatacagagtaagaaagctcagttagatagatctcttttctatttcacaagtattttttacagctcgcaaaaattgaaaatatattacaatctaccctgagatgtttgtcacaggatacagaaactaccagcaagtccaacgccaatccatcgactgaaagattttctccgcaagcggtgccattgacttcgccaggtggtctatctctgcgggagtccaacgagaacgtgcaaacccttcgtggaggaactcgaggtgcagctgcggacgattatctcgtatacaggccaacacgtgccctccggcatatcggctcgatcgacggcactcctgcttcaaggcctcgtcgatacgcttgccgatgccttcaagttgggcacaggccccattcagccacgagatatacccggccaccgactcctcgggatccccgcgagatacttggagttcccggcagactccggccatggctgtgcaacaactcctgaggtacgagttgaaccacacctcacgacctcggagtgcttccacggcctggtcctttttcacttccaacatagtcctctcaagttctgccacctcaaacttcgtcctctagtattggatgcgatgatctcggtcggcaagcacactctcgaagtctgctcagtatggaagcgactaagtcaagctgccctcctctctcgagaacgcagcaaatcaagtcaatccagctgaaagagcaaagaagatgaaaacaaaaaaaaaccaacctaaggaagtcgtcgccacacccgtttccacggacaagttctgatctacgtcgtcctgcaacacatacgactcgaaggcaagtgccggaacgatcactggcaactcaggctgcccgcactgctggacatcctcgacatcgatatctctacaaacaacaacaaagtactcaggatcaaaatgctaaagaaaactaaggtgatgactgcacacacaaaggcagttggagccaacaaaagttttacgaagcataactgattaaggagtacagggaaactgaagtcctactcttcaaaaagggggagaacagactcccccaaatcaccgacttcttccatcacacccttacgcgcgtcgttagccgccccctgatccaggatcccctggaggtcgagttcagggtgcgccaaccttacgcacgcgaggacgtggcacgccccgatgtagatcccgttggacatatcctctctgatccttgccgcatgcttggaggggatcgcctccattgccgtcgcagttctgtaatcgaagtcgtcagcgagaactcatcgggattcgccgggatcgtggtcgtgacaccacactccccggcgaactggtgcaggccagtgtaggtaagccgcagcaagccacggaactctgacaggttgttctcgagctccgacatgcggtgctcgagcccctgctgttgccgctcgttgccggccaccagctccctcatcttctggaggtcctcgcgaacctccgccaggtaacgcgctagcttgtcgacgcgttcgttcgctgacgccgccgctgccgccctcgcctccgcaatctcgcggcctatgccgcgagcgctggcttggaggatgcgccttatctcgatttggagctcctcccaagtgaggacgtcagcgggagggcctcaagcaggcacaagaccgccggcagggccgctgggcgttgcctcacggctccgaggcacgaccacgacatctgtcgaggccgcagcaggagacacactggagttccctccagacccgtcttgcgctgccttcgcccgcgccaccctgtgaaagattgctctcaagacaggctacaagagttcgacgaattaacaaaacctcaaattcatcctcttacttctcgctaagcgttacaagcctatgccggcgcggaggcgggggagacgcgtcggaggcctagagtaaaaacgagcatgatgtgaggtcaagatcttcagtgatgaagggtcgggagagcttaccgatggggtgggcgtcttccgacgatttccgagcacggaggagaacttcctcccccttttcggaacattgccgccactcatcgtggcagcagcggcagcaacatcggacgcctccttggcgacgtccaccttcagcgaagccgccgcctggtggtccacgagcggtccgatgatatcagtaagagggagagcctgcactacataaagtcacaatgcgatcccggaggaaaaagacaacagggccgtcgagtacactcacattgatcgcggcttcgcgttcagctggctccttctcgcaaagagggacggggacgttgctcgccgttgtaggaccgctgatcatcacttgaccgacacggtgctccacggtttcgctgttcaattgtagatcgaaaaccagaaatgataagtcaggaggaatacacacttaaggaatggagtccaaaatacaagaaaaataccctgaggagaaacctgggtcacgtcctccggcccagaatagtgaaagggtgggtgggctcaagcctagaacagctggatctgcctacgaatgaagtcggcagcgacttcataccccgacaatccttgtactcggaggtcatcgatgatatcgatgaaggactgaagggaaggggttaaggcgggtttggcggtgcaagaagaaatcttgtctggttgctcctcagggacaacgaagactggatccgaattttctatctgaagatagaaccacctcgcccgccatttactacgagaagaggggcactagaaggggatgtagcgcgacttcaggccatcccaaagtcggaaaccaacgcatccagataccctgttggatttcatccaacgcaactcgtagtagaaacgaaagaggtcgagaaatggctctactccaatataggcctcacaaagatgcgaaaagatactaaggaaggcgatggaattggggttcaaatggagcaaagaaagaccgtagaaattcaagaccaaaagcagaaattcggaaggaggaggaagaaaaccacagagaatgtagtcctcaactgcaaccatgcggcccaggactggctcagggtcagtacctcctggttctctctccatggccccgcaaccggggagagcgccgtcctcctgtaacttcttcagcgacgcgccggtggaagtggatttgtcgagatccattgccgtcggagatcgtcggaggagggacggagatgaacaagctagggttttgcgggagcggagaagatgaggagcgcttagagactgaaaagttctttcgcaacaggcgacttcaaaatggatccccaaaactcttttaaaggcgcactaccggcggtgcgatttccaaggaaagaggagagatgcccgccgaaaatttctgggtccgtcacgcgcggca

SEQ ID NO: 47900 - DNA, 8749 bp, Oryza sativa
ttggatatatgctatacatcggtgtggtatatctgcgcgtatacggacgttctttgtatgcgctaaggaaattcatcacggagtccatagatgaaaagattcctacccggataggactgggtcgtaactgtatcatgtagggtccgatgtctccgagtcctacttggaaaccacctgacctgcggtataaaagggaccccccccgggaggacctaaggcatcgaatctcacatccgagacaaccaccatagcctacgaagccggagcctacaggagccaagtcgccgggtgatctagtcgactcgactacggtctcgtcggtatcatcgagttccactgttccctttataatctctgatttccatcatataatcccatatcaactagattagggctattacctaccaaggggcctgaaccagtataattcatgttttctatttgcttgatgtcatattacgtagatcctcgtaccagtgtaccccaataccctctatatccggtctacgggtatccccagtcgacatatatgtaaatcctaaaattacatattaattacatatgtaagtaatgtgtaagtggggtgtaactagtatgtaaatttgtataaatatataattacaacaagaaagttgactactacaaacccatagcaattccggatcaacaaataaaataaaaaaaatgcaaagggataaacaggtggaggaacggatgtgcatcgtgcacacgatgtccagcgcagcgcatcccagccgttaaaatccgactgtactcagccacgtaatgtggcgacactttttcagcaaatccgttaattaattcttccctagctattaacttggattgtcaaagctacgatcgacatggtcagcgagcaatcgaattacagtttatgttgccgagaacaatttgatcatcttttgaacgcgtgcatcctcaccaattagttttcagacacgatgcatgaacctaattaaccaatgctcttcttcttttatgcatgcataaacgaaagatacaatcccaagacgaacacttgcaattgccgacttaccgagaacaatatactatcttctactgagttgatctgaggttaaacgagaaagacaagtttcatataaattaagcatttcctttgatttgaatgtttcagccttagtgccttacttaccactagctgactagctgtagctacttgatcaagtatcccctctctacttcatcactcttctaattgcaagtgttcgtcttgggatttactggagccggtcgaagagtgatgggcacacagtttagtactccctccgtttcaaaatgtttgacaccgttgactttttagcaaatgtttgactgttcgtcttattaaaaaaattatgaaatatgtaaaactatatgtgtacatgaaaatatatttaacaatgaatcaaatgatatgaaaagaataaataagttcttaaaatttttaataagatgaatggtcaaacacgtactaaaaaatcaacggtgtcaaatattttgaaacggagggagtattaagtagggaagacttaagtcgttgaccacacagtttagtagttcatcgcccttgatgggcatcagaaaatttactggacccggtcgtccttctgtgagccaactaatctggatcactggaagtcagaagcaactcgagatcaatatgtatcgatcgagcgaaaagagaactccatctggtaggaatcttcactgttattttagacaacagatcgaggagagttgtcatgataccatattttaccatgcaccttgcccgaagctgtgtggtcaacgacttaagtcttccctattaacgtagaccaaattaagctatatggtcaatgtgctgtgctgatagaaacgctcagggatcttacgactagcttcacaaggtagcggtgggctaaacgatctgggttcgaagcatcacccattctaattactccctacttccctaaacgtttgacgccgttaactttttaaaagatgtttaaccattcgtcttattcaaaaacttttgtgaaatgtataaaactatatgtatacataaaagtatatttaacgataaatcaaatgataaaaaaagaattaataattacttaaattttttaaataagacgaacggtaaaatattttttaaaaagtcatcggtgtcaaatattttaggatggagggaatattttatatgaccaatgcgctattcttagtacattttattactaagaaatattggtcataagtaaatctttgtgtgtgtgtgtatactgagtaaattaatgtactatatagataaggaaacatttctttccgttgataagcaaaacccatatctatatgtatatagtagtaaaatttatttatagatttcgtgttgttaacaaccaaaagtagtttggtagtgttgcgtagtataactgcgtacgtgccaattaattagaaaagagttaaatgcataatgttcaacacgtttagtttaggcatatagtctgacgatgacgggtttttagttagtatagggttacagttttaggagatgcatgtatgtgccttctttgtgtaatggaaaaaaaaaacaatcataactgaagcttcacggtctacatgttcatctttctttttcccgacagcaagctacaaagagcctaagacgacaaacaggtaacataagtgttgtaatagaaaagattgtcatgtatgtttgcggagtgatgtattatatattgatctatcttattaatttttttaatttttttataaccatatagttgacatacaataaacgggtggacgttaacccgagtgattagaatccatctcccatgctatggggaaaccgttttgatcactcgggtggacgtccacctatttgttgtatgttatctatatagttatgaaaaaaaattaaaaagatagatcaatatataatatatcactctataaacatgcaggttaaaatttaacttgtacagattgtaataaaaataacaaacaaaactccacatgctatgcaataggaataggatgagaaagatatccttggaatgcaggattttaaaaacatagagaaatagaagaaacgtaggagttgattgtcatatgtaagcctgctaatggcctaagacccgccccattcccaatccacaccacagcagttagctcaaatagttcaaaccaacccaacccgcaaatctcctttcagaatccaaaccaatccaatccatttctcacctcagtccacaccgcactaacccattcccttcctatggattcagtccaccctgtcaaaccatttcagaccatttagaatccacccccgaccacaaacccatttgattcaccatcaaccagaacatgcatttcgtcacgcacagcctgaacggcagcagcaagccggcgttcatagcgtcgacgacatgtttgtgtcgacctcgccgtctgtcaagccgagcacgcggtggccgcgatgcagcttgttctggcgccgccgccatggtccacccgtctggcgccaccttggcgtcgtcgtcgtcgtcccgtggaggctacatgttgagcgaccggctctacagcccatctcacgtccgccgccagcagatgctgctgctacaacagcagcagctgctgcaggggcaacggccgccttcgtcctccccctcgccggcgacggcgcccagggcggcgaggcagaagccgctgccatcgccgccgccgcctccctttccggcggaggcggcgaggcagaaggaggtagagaggcaggtggacgcggttgttcagtcaaagccgtggtgtcgccgttgccgtcctccgcggatgtgaagaggccgccggcagcggaatcggtgccggagccagcgcgagcggaggaggaggcggccgtgatgcagcttgttaatcgaccagggaacatgcatcgtctcatcgaccgctggagtgtgttgtccacgactgagacctgatctagccttcttagtggaaaccattcacaatccatgggttcaatccatggactgaatccacattatactcaaaaaatcataaccatcaccaaaccgccccaatcctcttttccggtggatccaaatcgatccaacccatttatagcgtgtgcccatttcaatccaaccaaagcaaacccaaatacaaaaccaatccatttaacccattccaatccagtccattagcaggcttagtcatatgctatacaatgctacaaaatttcaagcagagtaagggtgagtttgagggataggagattgagaagattgggaagatacacaaaatgagatgagtcattagcgcatgattaattgagcataaactattttaaatttcaaaaatagattaatatgattttttaaagtaaatttcaaaaacgcaccgtttagtagtttgggaagcgtgcgcacggactacgatgtgttttctcaccctaactcaccagaaccaacgctccctaacaatagaagtgatgtcttttgaaacacagaaattttaggggaagtgttatgtgaaagagagagtagagaaagcacgggagagtgtgcattggacttgaaaacgagtggaaaatgtgattgttttagtatatatgaaccaactccaagtaatgttttgactcggtcgatcaaatttgccagccagctccgatccatttaaaggctataaatagcagtacgtccagtgttgtaatcacgcacattccacacagaataattactcttgtttaccataagtaatctatcagagaacattgtagctctctcttcgatttgccacaagaggtcgatcgggttgccttcaatggccggccgagcccccgccgtcgccatcgccttcctcgtcctcgtcgtcatgccgggaatggcctccgccggaaagatcccacggttcttggtaagcccaaagacaggaaaagcgttgcgggacttcttcaagaaccacgcgaaagacgtggtcggcctcctccccaccggcagccccagcagcagccagggcgcgacggcgcagatcacggcagcagcaatgccccgagcccgccgacgccgaggcgtgcccgccacgccccggccaccaccgccgtgacctacagcgtcgccttcgccgtcggctcgcagcaggacttctccggcgcgctcgacgtcaccagtgagttcgtgtgggtgccgtgctgcgccaccggcaactcctcctgcggcacgaacaacaacatgcccggcgtgacggtctacgacgcgcggcccgaggagctgtacaaatgcgagagtgatacctgccagcgtatcatcaagccgacctgcaacacgacgggcgatctgtgcgagtacacctacacgtacgggtacgggggtgacgacggaagggagacgaccggcaacctcgccgtccaaaacttcacgttcggcgacgacagcgaagacaccgccgtaaagggcgtcgtcaccttcgggtgcagctcctcaacggagggggacttcggcgcgtccggcgtgctcggcctcaacaaggggaatctctccctcgtctcgcagctcaacctcgggcggttctcctactacttcgcacccgaggtgaacaccacggacaacaacgcagcagacgacttcatcgtcttcggcgacgacgacggcatcaccgtgccagggaacagcggcggcagtcgtccccgctacacgccgttcttcaccaccggcgcagtccgtagcgcgaacctcgacctgtacttcgtcgagctcaccggcatacgcgttggcggcaaggacctgcagctcgggggcggcggcggcggctcggcggggggatccctggaggcggtcctgagcacctccgtgccagtgacttacctcgagaagaacgcctacggcctcctgaagaaggagctggtgagcgcgctgggttccaacaacacggaggatggctccgcgcttgggcttgacctgtgctacagaagccagcacatggacagggcgaagatccccgacatagcgttcgtcttcgggggaaacgcggtgatgaagctgcagcagtggaactacctctaccaggacgaggataccgggctggagtgcctgacgataccgccgtcgccggacgacagcgatgggttgtcgctcatcggcagcatgatccagacgggcacgtacatgatctacgacctccacaagtcgaggctcgggttccagacgtccgatccgccgccgtcccagtcatccgatctgccgtccaatccgacgtcatcggctaccgcgcagccaaagccacggggggtcgcggtcgcggtggtgacgatggcatgtttcgtgtggtgccttgtggtgctgaacgcctgaacgtggtctcctgaaacaactactactactattattatgcttttaattacctttaatttttttccttgctgttaggatgcattatagtagttcaattccatttcttctcaacaaacgtggtttattatgatattatgtaaaatcggtttgagggtgttgttcagttatcatggtatgcctagtaggctactccctccgtcccagaatatagcaacctaggaccggattggacatatcctagtactacgaatctagatagggggatacgtcccattcgatcttaggttgctatattctgggacggaggaagtagtactttatttgaatcggagtaataacgtagcttattgacctagttctatcagctcactcagcagatggggtttacatgtcagcgtccccttctctccctctcttttatctaggggtgggcaaaataagaccgaaccgaagaaccgaaccgaaaagaccgagaccgaaaccgaaaagaccgagaccgagaaattcgggtagtaattcggtctcagcatgtcaaagaccgaaatttgttcaggtaattcggttcttgggctcagttaaccgaattaaccgagaaaaccgaattgtggcccaataggtccaggaggcccaataggcccaatacaccactaaaccctagagacaacccgcaggctgcatccctatccatccagccatcgcgtcgccctcccttccatccccatccctatcgcaccgccctcccttccatcccgcgtgagcacgcctcctctgcctccatcgtgccgcgctgccgttgccgcctccatcgcgccgcgccacgccgccgcctccacatcgtcggcgccgtctccgccctccgcctccacgccgcctcgccggtcgcggcgggccaccggattcatcacgccgcgccaccacctccgccctccgccctccacatcgccggcgccgtgtccgccttcacgctgccttgccggtcgcgcgggccgccggccgctagatctatcgcgccgcgccgcgccgccacctccgccctctgcctccacgccgcctcgccggtcgcgtgggccgccggctgccagatccatcgggctgcaccgccacctccaccctccgcctccacatcgccggtgtcgtctccgccctccgcctccatgccgcctcgccggtcgcgcaggccgccggccgccggatccatcacaccgcgccgccacctccgccctccgcctcgacatcgccagcgtcgtctccgccctccggctcggctcctctaaattcgatctgaccgagaccgagaccgaaaaaactgagaccggtcttgatttttttgggatgaaattcggtcctgactttttaaaaaccgaattgactgaaaaaccgaagaccgagaccgaaattttcgggtagaccgaacgcccacccctacttttatcccttgcatcttccttagcgacgaaggctgtctccgcaacaaccagggtttttaattttgaaattggactttatgctggcggtgaccgaaatttcagaaatttctggccgaaattagttgaaaatttgaatgaatttgaataaaatttgacaaattcacaaaaaattgcaaaaaaaacccaaaaatttcgggcgatatttgagcataccggtggggggcgaaattactgaaatttcgaaaatttcgaaccgaaatttcaaaaccctggcaacaaccccaagttgaacgacgacgaggcggaggcgcacgggttgagcgatgacaaggggcagcctgcgatgaagaggagtggtgagtgatggcttgggcagctcacttcctgccgatgacgacgaagcgcatatgcggaacctcgatgacgacagcgaggaaactatccatctcgatgtccccacctgctagggccatcctctaaaagcaggtacaatagtagactataagtcagctataagcacacgtggaggagataagagaggagagagaagagaagcgggctacagatttgtagccagctgcaatacagactccaagacaatgtgtgtatatgacaggtgggactaattattaatgatgtagtatatatttgtagttaactatcatatgaattggctattagattgactatagatgatttggagttgatagttggctatactattaaacttgctctaagaccaccatggcctgctcgacaagtcctcatgctattgtagtattgtactccctccgttccaaaataagtgcagccatgagtttccgtatccaatttttattgtccatcttatttgaatttttttttatgattatgttggtgatatgggcccagtgataccaagcttagagggaagagattgtccctagtatccacgtggcgctccctccaagggggtcggccccgtgaataggtggt

SEQ ID NO: 47901 - DNA, 4723 bp, Oryza sativa
tgtgtaagtccctaaattacacatgtgtaattactgtgtaaatagagtaattacattcgttgatgaccaacacgtgtcatgcaaagcaaaaaggagtcgccaacttaggagcaagttgttcgattagcttatcagatgtacttgcacgaatagtgagaagattagatggcagatcgacaaactgactgtatttagcccagaaatatgtcgacataattttagcaaagccgttttttgttatacataaattttattttttaatttctttctacatagtagtaatgtcgacactgattaatttaaatgataaatatgatcaattaccgatcgatcgagcatcgtttccgaagatatggtaccaattccctattcatccttcctcccatcggcctctccatgttgccaccgcagatagaaaaagagaggaggaagaggaacggagactaacatgtgggtcccgcataaaattgactcaaccacttagactagtcaacaagctaagtcagtaaaaaacgctcttgaaactgttaagggagtcaaattgcattatttttaatagttagatggtcaagatatttaatattatggttgagggatccatacgaatcagattaaaactatatttgagggagtataagtcgacttattcatttgcattacggtgtgtatttcggattgggccaatctcataggttgtgcgatcacatcgaggcctagtaagcgggggccgtagggtggctgctagcatagcctgccctggttgtttgggaggcaattaggctgaagagtatgacctagcatctccaaccgcatctctatctctctctccaagttaaaatttagcaattttgaacgaaaaacacactctaacaaacttgccaactagatggccaagccatccggctggctaaactccccctcctgctggccaactttggccatccaaaatggcctctccaatggtaggccccacaccttttgcccctctcccgaagcagagatgccgtggacgaggacgatctccgccgagcacgacgggcacggcgcctttccgctcctcctcctcccttgccacggcaatgttgacgagccctggcgctgccgggcggcgtagcagcaggcaccccgaggccgccgccgcctgcgagatgtccaccgcgatggccgtgctgaagaagaggaaaaggagggaggggagggacagcgaaccagtggtggcgtctccagattggcgcgcgcgccatcctcccgccggcgccgcctacatccttgcaccgcttctgccggcgctgcctctatccccccgctgctcgcgccgctcccgctaacatcgcccctccgtcggtgctgcccctccgtgccgccccttcgcgctgcccctccaccggcgccgcccctctatcgtcgtcgttggtggtgcgatgcgtggtgttcgacgataggaaggatgttttgggggaaaaaaggaaagagatatgtgggtccattgttattttgaagaggattaatagagagtctgggcctcatcagagggctgctacggttggtggggaacttgctttaggaaaaaacgtattagtagcttatatgccatgggaaggttacaatttggaagacgcagtattaattagcgaacattggccaaatgctttcgctgataagccatttaagcaaaataagctaaccaatatgcattgaagtttagccgaattggaggcagctttggctgatcagccaaagcatttggccatccgatgaggcgctttgttagagtgaccatctagttaactagccaaatcaaatggagagttggccatatgggtgtttggagagtccaatttgaagaggctgttagagatgctcttagcatgtccccggacactcaactctttttaaagtcaacccaaaaggtatatctaaacgtagcggcatcgatactattaaagttgtcaaaattttagaaaaaaagaaaacaagccttatgttcttatcctccaaaatgaggccccttttaattggaggattgacatagaaatttagaaggttataattaatatatagaaaaattttctatgaaattatttgaaataaaggattaattgaatcctatcatttcctttgaaattcttatggtgaacaatcctatggcaatttcagagaaaataaccaaaagatggtagctcatgttttcatacttttttctcgtgttgtaatcaaacaccatttaaatttaaagtatttatgtggtttaccttcatgtagacattgagaatccatgtcattactctttgccacctggtgcatgcaccaccctacagtccaacacaactttcacgctcctggtgcacctcgtacagtttcaaacgtactatcaatttcaccctaagccctaaggggccaggtacatgtaccactagttcgaagtcgaagctaactgcagacagagagggcgcgctggaaaagaagggataagcgacgagaaaaacggcaaggaggcgatcgacaaacgagatgatcgatcagaggaccatgagtccatgacggctggcaagtctacaaggaattctctggcaggcagcgagccagcgaccaaagttttaccgatcgatttggcaatatctcctcagagtgtatatataaccttggaaatggattttttccctcgacatcccctcgttttgtgcatgacgttcaaaaagttattaaaaattttaaaaatttatcaagatagatcaatatatgatgtatcttttcacacacatataagttaaaattcgacttatacaattcgaaacaaaaataataaatttgaccgtggatttttttgtccctcgatggacatccaactaccaccttgtcagggttatggataccacatacctaatagtagttgactaaatcttgacaggatccaccacataccatgtcttatacggaaactgacctcaagggagttccggataaggaaagacaaccagagttctacatgaaaatgacaaggactactcggattgtatccatattggtttccctagttctacttggacaaggagacaactatgggtataaatacaagccccataggaggaggggggacaatcaacacccaacgggatcagcgcccaacgggagaatcaacatacacagaggatcaacacccaacacaatcaacatagaagcctacatacgccaagacacgccgccggatatcgacttcagagataagcacggctagtcccctacggtgtctccggatactgttaggagatatgaaagcgctatctctgatctcgccgggcacggattcaaggaggaaggctaccctgttgtcgactacgagtcagatcgtcagaccgccatgtcgacaacagttagataggctaccccaaatattgtactggtgtgaatatcatgaataagagcaataccggcttcggccaacaggatgtagggttattacctgacaattcaggggcccgaacctgtataaaaatccctgtctccatctcttttacctcagtctcgcgtataccctagcaccgacgatccccataccatgcaaataccagaactgcgacatcaaacgtcgacagtggcgcgccaggtagggggattttggtgcttcaggatttcgacgagatgggtttaagagatggactctccgacaacaagctactcggcgacttcggctgtggggagatccaacctaaccagatcagaaccatcatcgtcatcgacaacttggtctatcgagatcatccaagcctcaagatacgcggcgtaccaaaagatgtcagatcatatgatgtccaacgagtacgcaataaggtaattggtagattggtttttcaaattgatctactaatttcgtagatacatccggcatgtatctacaaaggtacgcaatatttcatatgcaatttatcgtacctattcatatcatacatcattatcagatccatgatttattatgtttacccagagcatgttctttatacaataatatctgtagcgcgagtgtccccgatgttaaatcgactacgatctaacgctgggggctcgctctgttttcttccgtataaatcatgcttgtttacggtttacataatgcctgatatttacatctgctcgttatatcctgataatactagaagatccatgcagttttttttgagtacatactcgacattatctgctatatatcttgccttctagaaaatatttttcaggaacaattgagcactcgagtaggtcgtggtcgagtacaccgcattatcgagaacgatctcgacaaatgcagagtcgtcgcgcccaacctatcaaagaagaccgacgacctatctcatagcgccggccatcgctggactactcgagaaaaggatgttaacggataattcctcgcgaacgtcgtcggcttgatcacccgacatgattgcgaacggacatccggatatgctataagttgggtgtgtgagtcatgctggccacatgatatgcacatgtaataaaccaactttagcgcccctataggtgattaagagactcctactcctggttctcgaaccagtaaaacgtagtgatctctctcgcctcactttaagtggtcgagttacgattactgcctggtcctcgaccagcgatgtagcgtttctcccactacttccactttaagtggtcgagctacgactactgcctggtcctcgaccaacgatatagtgtttct

SEQ ID NO: 47902 - DNA, 6013 bp, Oryza sativa
  unsure (1)..(6013): unsure at all n locations
tactttaactctctttttaatttatttaattttttatttccaattatagttaatctactattgggttcttatatggactcttattttaatattgcttatatttaattccgagttttagttaattttaaattatattcctacttgaactcttcttttcttttcttttttctaatttcgattttttttgtttttttatttcgaattttaattaatctcgtattggattcttatatggactcttctttcaatattttttatttttaattccgaatttctgctatttttaaattgtaatcctacttggactcttttttttgggtaatttcagattttattttatttttattccgaattttgattaatctcgtattgggttcctatatggactcttctttcaatatttcttatttttaattccgagtttcagctatttttagattatatttctacttagactcttttttttgctaatttcggattttattttatttttattccgaattttgattaatctcgtattgcgttcctatatgatctcttctttcaatattgcttacttttaattcggaatttcagctattcttatattgtatttctacttagactcttctttttttttctccaattaatgaggggaatttttagcccccacagcgaacgtaaaaatcaaatatgattatcgctgggttttttttttttactttctagaagtcctgctaaacgccttgaccgattgcttcacgacttgcccgtttgtaattctttttagtcgtcattaggattctattttgtgttttattaatagtttttagatgtctttattaatagtttttagatgtcccatcaaccaccaccaatatactcctttataggcatgttacttaattaatctcgtcatgtgtttcagatggtcttttttttagtaatcattattttttatctttgacaaaatatctggtgttggatgaccttgggaggttgacggtgataggatatgcaaaataacatctctatacacatgggtttatcttggaggggggggggggggggaggggnatatcaaaccatggtcatattaatgtagcgtggaagcctataagatatatatgctggtgctaagtcactcgatatggattagacgtaaatgaaaccctagtttgtattaatagtatatatgaacattttttgtaagttgttacaactatttgcacctatcatatataacatatatgcaatttactctacctttgaccttgatattttgcactgaatttaacagagttgcgtgatgtcaaattgttcactaatttacgcgcatccaacataataaaaaacaaaaaataataataataaacgaattaactgcccaccagatgtttttgaacacatcacgagatagtcacccttccaaaatacacacggcagcagacgaacaagaccccaacaacacgccacgaaacgcaagcaatagatttgtccgatggttaggtccaaccgccgcgacacacacaacgttcagttaggttccagtagctcacaggtcgcaacgcccctcacccaaacaacgattttgcccttactcttagcttaactcttacacccaatactgatgactagctacttgctccaatcttattagcagctaatggttttttctccggcccccaatttcatcatcaccaattcaccaagtaattaatcttcacactaaaccgagtcttctttttctctctctctctctcacaatctcagtagtaagagccagcctctgttctagaaaccgtgcgtgcatcacagacaaagctgtgcatggtgtgtcgtgacgagcatgcgtgagtgcgttacacgctcaagaaaagtgtgttagcttagcttagctagccaaccatgcatatattcgtcacgttcgtttcgagttgatcgatcttgtgtttaattccaagctcctcttgagcggccgtaattcttgatcgtcgttcccatttgctatagctagctagccatggaggacctgtcgctgtcgtcggagctcgacccggcgctcctctcgacgtcgacgtcgtcgtcgtcgccgccggactccgcctcgccgtccttctccttctaccacccttcgcctcccaactacaccctcgccgtgtccaacctctcatgccgggaccctcgccgcggctccggcggcgccgggttgctctcgtggttgttgggttctttctcgaccagctcgccgccggccaccggcggcgcgggcctcctgaacaacgtgtcgttcacggcctccagctcgcagatcctggccgtcgtcggccccagcggcgccggcaagtcgacgctgctccgcatcctctccggccgcggcaccggcggcgagatcgccgccaggccgcacgcggtggtgtccgtcaacgggcgcgcggtgacctcccgcgcgcggctccgccggatgtgcgggttcgtgacgcaggacgacaacctcctcccgctgctcaccgtgcgggagacgatcctgttcgcggcgcggttcaggctccggtccgccgtgacggcgcgggagcgcggcgagcgggtggaggcgctgatgcaggagctgcgtctgtcggaggtggcggacagctacgtcggcgggtgcggcggcgccggcggcgcgccgcgcggggtgtccggcggcgagcggaagcgggtgtccatcgcggtggacatcgtgcacgacccgccggtgctgctgctcgacgagccgacgtccgggctggacagccggtccgccatggacgtgctgtcgctgctccgcgacgtggcgcgcgcgcggcggcaggtggtggtgctcagcatccaccagcccagctaccgcatgctcgcctacatctcctcgatgctgctcctctcccgcggcgccgtcgcgcacttcggcacgctcaagtcgctggagcactccctgtcccgcctcggccacgagatccccatgcagctcaacccgctcgagctcgccatggaggtcaccgagcagctcgaggccgaccacgccaggttcggcgccgcgctcgccaccaccatccatcaacaccaacacaacaaggtcatcgacgacgaggacgaaagcagcggcgctggcgagcacgagcacgagcacggctactactgcagccgcgcggtggaggtgggggcgctggcggtgcgctgctggcgcacgatgcaccgcaccaaggagctcttcgcggcgcgcgcggcgcaggcggtgatcgccgggctggggctcggcagcgtctacttccgcatccgcccggacccggagggcgtcgcgctccgcctgggcctcttcgccttcagcctcagcttcctcctctcctccaccgtggaggccctcccgatcctcctccacgagcggcgcgtcctgatgcgcgaggcgtcccgccgcgcctaccgcctctcctcctacgtggtggccaacgccctcgtcttcgcgccgtgcctcctcgccgtgtccctcctcttctcggcgcccgtctacttcctcgcggggctccgcgccacgacccaggccttcgcctgcttcgcgctcgccgtgtggctcatcgtgctcatggcgagctccctggtgctcttcctcagcgccgtctcccccgacttcgtgctggggaactcgctgatctgcatgtcgctgggcgtgttcttcctcttctccggctacttcatcccgagggagagcatcccgaggtactgggcgttcatgtactacgtgtccatgtacaggtacccgctggacctgctgctgatcaacgagtacggcggcagcagcagcggcaggtgcgtggcgtgggcgggaggcgtgtgcttgaggaaggggggtgatgtgctgagggggagagggatcgacgaggggatgaggtgggtcaatgtcggggtcatgctagggttcttcgtcttgtacagggtcatgtgctgggctgtgctggtcaggagggcagccaagaccacgctgtgatttttcacataagtgtgtgttgtaagtagtactcgtatatgggaaatgggacgtgactacgcgtcggacgtccgatccactagagagctgagatatactgttcctagcagtcttgtttgttgaaatccaaagatgtgtagctcccctattttctgttcacgtgtccttaacatttttaaaaaaggcaaaatttgctataggacatttaaaatttgtggcttttactatgagacacctaaagaacatatatcttctcataaacactgcaaaaatatggtggttaacggctggaaacccgtttcattattttattatttccggtgaaaacagatcaagaaacttcaatgaaagacaagtttgcccttgcagccgccgtgggtggaggtggaacggcagtggccatgtggatgacggttgctgtggggggaagtcggagatggcacggtggtgcgagaggcactggagctcggcgtgtcggtcggcggccatgcgcatgacaagctcgaggtgcgcttagtggcagcggatctagaggcgggcgtggtcagggggcaggtcatcattgtggtcgaggtcccgtgcggccatgtggacctagtcgtgcaagatctaggcgtggtcgttgggccagcagcgggcaacgtagcagacgatagaggcagagatggggtcgaggagcccttgcggctggatccatcccagtcctagtcgctgtcgctttggcggcgggctaggcggggtcgtcgggccaacagagtggcagccgcgggaggtcgcccattgccggccgaggagatgaggcacgggctcaggttcatggttggatccatcccagtcctagtcgctgtcgctttggcggtgggctgggcaaggacgatgacgacggcaacgatgggattgggttggaagaatttgataaaagaagagccaatgccctccgatgacgacaagaaggaggattgtgatcaatggagttcctcagcttgccactcactagaagggtggattgtgaatttgtgatgtatggatagtgccagattcttacttttgttgttgtttctctctctgttttcaccagatataataaaataatgcggcgggtgtccaacaactaattactatatttttatagtatccacgagaagatacacgttttttgagtgtctcacagcaaagatcacaaactttgagtgttatgtagcaaattttgccttacagaaatgaggtgaagatcaaagaattggtcgcttaaattgtttgataataaaagtgtgaaacacatatattgtactattccatctattatacattactataagatacctttgaaagaaggcaccataatcattgtgaagtctagaaattcacacattaataaaaaaagaagaaaaaaacttaaccattagatcatagtggactcatattataatggtatagaaaaaagaaggcaccatgacatggttgttttcagagagacggtgaacaatgctgaccatttccctcacccaccaccatgtaagtgtagtttaaggatctatcatgcataacatttaggcttagcattctaaattactcgatatgactttacttattttgtaggtaactattatctggtggattctggttaccctctacgtgaaggctatatgtccccatatcgcaagacaagatatcatttgaagcagcttgataccaaaggtcctgaaaatttgcacgagatttttaactaccagcattcttgtctacggaatgtagttgaacgctcatttggggttctgaaagagtaagtggtggattctgaagggcatactgttttatcgtatggagaagcaatcaaagattatcgtagcatgcttcgtgttgcacaattttgcaatggacaacaaagaacctgacatggatgtgcacaatgtgtttggtgagaacaagtacctttgcaggtcaggtcaacaaattggctctgcccacgattggttagcggcgacagccaagctggactatatggtttggcatgaattggtaagtgttttgtta

SEQ ID NO: 47903 - DNA, 1242 bp, Oryza sativa
  unsure (1)..(1242): unsure at all n locations
aatcatcccgtcgaggacgtcgtcaccgtcatccgcgccgacgaggcgcaccactgcgacctcgacgtcttcattttttcaagttgatgtacatgaccatccatgacgagctgtctatgttgaccacgataacattcacaggtggtcgtggtgcgaggcagcgatgtggttgtagagtggtcgtggtgcntggtcngacaactccacgaccacctcgctgcctcggccacctcgacgtcatggccggcaatgctcctaatgccaccgccgccgcatagcttggtgtctgatctctccacgaccacctcgtgtctcaccccgctgctcgcaatggctatgcctagaccagacctcgcagagtcgtgggccacacatgccgcatgctgccgtggaccccgcagcccgtgccgtcgacgctgggattggatctcgccgcacgtcgccgtcaaacgctggccctgcaacgcaccgcgctgctcgccgccgccgtcgaagccggggccgaacaacgcagtccgcatgccaccccgaacccttgaaccccgcagctcgccgccgccaccatcaacaccggccctgaacctcgtcgtccgctaatgccgccgtcaacaatggcctcaccgcccaccccagagcccttacatgcgaaaagtctatactacccttccacctctcttcaaaagacggtaccaccatatgggctaaaatggtaccgcatggtatcgagaaatctcaatcgtttgatttgtcccaattgatggctaggatttagtaccgcctcccttggctggatgggagtaaatctcatgcagaggaggcaccttcgggttagtggatcgggaggaggaagagcttcagccctcatgcctcagcgcaaatagatgtatgatgcgaagtttcttatttgcccttccacaacgcggacccaggggaggtaccgccaaacgggattacggtaccttgcggtaccaacgtttatcagccgtcggatcatgctcaatggacaaataggatttggtacctcctcctgttggactgtaaaattcctcttaatgagttggtatgtaacatcagctgcatggtgggaagtagtagaatgtaacaatataaattattttgatcttctcgttccaattgaatatactgaagctatgtttgtgtttgattgattttgcagtgcacaatatcgttcgtgatgtaggagtcagcagttattgttctgtgatagccctagttaatttg

SEQ ID NO: 47904 - DNA, 772 bp, Oryza sativa
tttgtttgtgtatgtgtgtgcgcacgcgcatatatatatatatatatatatatatatatatatatatatatatatatatatatatatatatatatatatatatatatatatatatatatatatatatatatatatatgcttgcacagtaatgcctccctccctgtggaaaactctagtagtactagcacatttgcattcttactgcactgcaaaactgaattctagcattccacgatgctgaactaatgatctctccacgccggttttcagactgcttcttcgaattctatggctgcgacgggcggcgcactggcgcccctcgtgtctggccgagtcgccgggcatgacgatgatgacgggtgcaacgacgccgccgccgcggaggacatcgagttggcgcaggcggtgggactcggggacgcacgatgagcatgccggtggtggcggcaacgagacaggaaaaatcatgctcttgtagggcggtggtaacagcgaactcgttatcgactcgttggtggagggagtgtggtggtcatccaagagctcaccggtaggagtgaaaatgggtcacggaaatttcaaatcgagcgagcatcgttttcgtataaggggtaccgtttccgaccattatttttttttggagtagctatatttatggcgccatatttttcaccaaaaaatagtcagtatgtatttacattgtaatttcctaaattacatatgtaattttagtatatttacgatgtaagtctcgaaattacatatgtaagt

SEQ ID NO: 47905 - DNA, 1753 bp, Oryza sativa
ctttataaaatagatctaagtaaatccaaccatccaaaaaataatgggtgcactaatataagtaaaaatagatggtcagatttttcttattattatggtgccacttggcgatttgagagtgtttagagggtgccacttggcggtttgggagcgtttataggaagtttaatggacttttagtatataatagatagatagatagatagatagatagattggcgatttgggagtgtttatagggtgccactttgcagtttgggagcgtttatgggaagtataatggacttttagtatataatagatttaaagacaaatatagtaatatttgcattaccaaattagttgtattaaattaataattaaatatatttttctaataaatttatattgggtcaaaaatattactattttttttctaaaaacttagttaaatttaaagcagtctgactttgatctgaaacggagggagtactagtatcttacttcaattgcgataggaaaaactaatagaaaaaaatatagaaattaaaatagtatacttatcaaatcctataagaataaaaaaaatacagtaaagagaacaggagtcctcctttgataatgcccagagagaaacaaaggaaagttcaaaaaaaaaaaagtcacacctcttgttatttatagtatgcaacattttctacagaaaataaattatctttaatgatgttctaaattacttatttgtagatgaaagaggtggtactttatagccgtatcaacatcatgagataaataatattgaccatccgctagtctgaaattgtcatatagtactacaagtacaatgacaaaatgttcacagctgtgaactacgctggttacaggtttacttcgatcaaatctaagaacgtgtcacggaaccaccgatggcgacactattgcgtaaactctagatcatcactcaacattaagcaatcaatcaaatctacccctttttacgtatacaaattccctccattagtgcatgacaaagtgataaagttgtacttatatttcatactcatttatttttgacgaggcagtttctctctctgtcgctgtaaattaaacgaggcttccacttgtaacgaaagcgagagggagagggaggaaggcccaaggcgacaacgtattcgagctggtgcccccccaataataccactccaattcgcaatttggaatcgaattagaatttttcggattagccgcatcgcatcgctcccctcgcctctccccttcaatccccccacgccaccacgtcgtcgctgatcggaaaccgatcggcgattcaccaaccgcctccgcgtcggcggtggccgccgccgctgccgtgcgggagcgggggattcccgtggcggttgcatgtatgcgggaggggagaagagaaccaatgggggattggatggtgagggagcgggagcgggaggggaaggaagaggggcgcttcgccggcggaggcagccgcccacctccggctcggccgcgtcgtcctcctacccgtccacctccggctcggccgggtcgtcttcatccggcaggagggtggaggaggaggagcaagggggcggcggcggcggaaggaaacaggggaggcggaggaaggcggtcgcgagggcgatccgggagaggctgcccgcggcggtggcctgctggggcaacggcgcggtggttgatgggatcgggggcatgagcgggaggaggagcccggagggagagaccgggcgatgacggtggc

SEQ ID NO: 47906 - DNA, 8129 bp, Oryza sativa
  unsure (1)..(8129): unsure at all n locations
tgggtcttctagaaagtaaaaaaaaaaatgaattccaatgatagttatgtttgacttttacaatcctaatgacaacaaaaagtatgcggcggacgggtcatagaggagtatagtggcagcgtttgacgggatttctaaaaattataaagaaaataaaacccaacaagacaataaactccaatttttaaaggtttgggcttctaaaaagtaaaaaaaataaaccgcaatgataatcctgtttgattttaaaatctcaatgacaataaagaagggcgacagcaggtgagccgtagaggagtacagtgacaaagtcgctgacgttttggcggaacttctagaaagtaaaaaaaaataaacctaaatgacaattatgttcgatttttaaaatagcaatgacaaaaaagagaagatgcagtggacggtctggatgagtataatgacagtgtttgacgggacttctagaaattataaaaaagatgtccaacaggataataaactctaaaacttatagtttttagatccaatttttaaagattccaaggagaatgaatagaaaacagtggtagatcgagcaagcaaataaataataatatgacagaagtaaggggtagcaactgttgtaactttagaaactaaagaaattagaaacatgaggataataaggtttagtatttaaaaatcttaagacaacgagataactatttaataaatttgaagtaaaatcatattaaaaatatataattntatatgggtgctagccgcgcaattgcgtgggccacccagctagttatattattaaaacagctttgaaagaaggcatcacattcgctgtgggggttagaaattcccacattaatcggagaaaaagaaaaggagagtccaaatagaaatacaatctaaaaatagctgaaattcggaattaaaaataagcaatattgaaagaagaatccatataacaacccaatatgagattaattaaaattcagaataaaaataaaataatatccaaaattagaaaaaaataaaagagagttcaagtagaaataaaattttgaaacaactgaaataagagttcaactagaaatacaatttaaaattagctgaaattcggaattaaaaataagcaatattgaaagaataatccatataagaacccaatacgagattaattaaaactcagaataaaaaataaaataatgtccaaaattagaaaaactaaaagagagttcaagtaggaatacagttttgaaacaactgaaattgaaaataaaaaataaaaatatttaaagaacacaataagatatgaattaattttttttaaaaaaaactaaattctgaaattagaaaaagaaaaataagatttcaattaggaatacaatttataaatagctaaaatttgtgataaaaaaatattgaaagaaaagaccatctaaaacacatgacgagataaattaagtaacatgcccgatgatagttgatacgacatataaaaactgttaataaaacacataatagaatcgtaatgacgattaaaagagggacggcaggcaggccatgaagcaaatgagcaaaaaaaaataaatcccattgataatcatattcgatttttaaaatctcaataacaataaaaaggagaagcagtgggcgtggtgtataggagtgtagttgcagagccgccgacggttgacgagacttttagaaaataaaaaaataattccaacgatagttatgtttgatttttagaatcacaatgacaataaagagtaggcggcggacgagccgtagaggagcatagtggcatcatttgacgagataataaactctaaaaactagaaggtccaatttttaaaggttcggaacttctaaaaagtaaaaataaaacaatgataatcatgttcgattttaaaatctcaatgacaataaagaagggagacagcgggcgagccatagagaagtacaatggcaaaaccgctgacggtttggcgggacttctaaaaagtaaaaatgaatccaaacgataattatgttcgatttttaaaatctcaatgacaataaagagaagagacagtggacgggccatagaggagtataatggcaacgtttgacgggacgcctagaaattataaaaacgaaacccaacgtgacaataaactctaaaaactataaggtccaatttttaaaggttacaaggagaataaatagaaatagtggtagatcgagcaagcaaataatgaaagagatgacacaaggggtagcaactggtgcgacttttaaaaaattatataattagaaacacggggatgataagttttgttctttcaaagttttaagacattgagatagctatttaataaattttaagtaaaaccatacttaaaaaaatatatgattttgtttaggtgctagccgtgcaattgcgcgggccacccaactagttagctcgacaaaaataaagaatactgaaaaaagaagtctagagtacatataagaatacaatttagaaataacgaaatttaaaaatttaaaaattattaaataactatcacatatatatacactacaatatgaatattgatcagtttggtcaagttagtacaaaatttattgtcacttttaatatattttaataataaaatgtgaaaatatatattttagtatgtgaggaaaaaaagataatgatgtagacacgcaatctgcgcgggcccaccatgctagtttctataaaaaaaacatttcatcctgattgttacctaaagtgcccgtagcaacacatggccacgtgggagtttcacctagctagtcgtgtatatatgagtgtatacatctactgtgtgcttgctcgtacgaatcagcatcaaaatgattggagcagtactgcagtgctacgtttatcgtggtaaatcttgctgccagtcgaatggcttgagtttgagacctctaaagctcgtagactctaatttagtgattgcttcatgccacgaattatattggtgttgtgatttatatattgagaattcgatgttccatcactcttaagtttaggtttttctctttaaaaaaatgtaatttggttctcatggtgtgatctcagtagtttcttggtcttatttgtggtaaaaaaaatatttatgctaaaatatctaccatgtaacctacataacatttaagtcctgataatgatgatgagttcagcatcgagttagctctcaatgccaaatggtttttctgttttgaaaaatgaagaaaattgtggccaaactatactggctttccatggcatccatgtcaacgtcatatcatttgattgtatggaccatttagccaagtttgcacataataaacaagttggttcgaaatgagtaatttacagggcacatcattttgattggactatttagcctagtttgcacataataaacaagttgttttcgaaataagtaatttacagggctttctctctctcgctcacgtcaaggtggtcagggcgccggcgagacggagctcagggcaaggcgccgacgctcactgtggaaaagccaccggcggtgtccaaatccggcgctggcatgcacggatctagtctccccatgctcggatctgttgctctgggcggcggagagcagggtcggcgacggctgcgtggagattggcgacgacgactgcgtgtaggtggtggcattggcggcggggctggacgaagcggccgaccggcggcggggctgaggttgcgtcggcgtggagtgggcggcttcggccgcaacggcctcgagcggagccaccagatccggcggccggcgcaatagggcgccgtgggcggcggtgacagctgctagtgtggtgtggaggcgcggccggcggtgtagaggccgacgcaggagcggctggcgtggtggaggcgcggcgggtggcgcggaggccggcactgctcgggctggtggcgcgaaagccagagcagcggtggcccgaccggtgatgctgggtggcccgggtggctgttggtgagcttcgaggtggcagcggtgcggaggcatcagcgaggccgccggtgagcttggcgacggggtcgtcttccttgtggttggccaggctaccactgtgtttgggaagctcctccccttctttgtggggagcttttaggcacgatggaggcgatggccggcctacagggaagactcaggttgccaaggctaggttcccgatccggtcccatagatcggattcaacgtggaggccggcgagcagcgtggcagaggcggcctgggtcagcgcgctagggagtggtggcaggtcgtcttccttgtggttggccaggctaaccctgctagggaactcctccccttctttgtggagagcttcttggcaggctggaggcggtggtcggtcaacaaggaaaactcagattgccgaggcaatgttgttccttgtgcgggctcccataggtcggattcaacggggaagccggcaggcagcgtggtgaaagcggcctgggtcagcgcgctggccaaggtgactggtgttgtggcagtcttgtcgttggcaggactggaagccggctggcggaggggcgtcggtcgggtgtgttggaggccatgtgccaccgatgtttggatggtggtttcggattgggcgacggaccacgacggtagggttgtaggggttccgagcgaaatcttagcccaaggtttctttgggccaacagtgactactattttgagcatgataactctcctgagggtactgttgaggtacccctcctcccttagcaaggagctctgggtgaaaaccttgttcagtctttggatggatgacgacggcgtcatttggcgtggcgaccctcatgagggtgtcgttttttagagtcttcgctccgtggtggtgttgttggcctgatgacggccggttcggtactcggcttccctctctatagcgtgtgtttgggcagttggcacatggttcgaggcgtgtgctctggtgcacatccttcctcgacagctatctgttgatgtaaaacttttctcgtaacattttctccctatcttaattacattggatgacctccttcaatcattccagcaaaaaaaaaaagtaagttacaagttattgtgcctatttgcacctactatgtaagtttgtttaccattcatgcaatttagcctcagaaggataacttcccctatacattttcattaggtgtatcttgaattcacctttttcaactttgaactagtataagttacaattaatatataaaatttacactaatatattcatattttaatgtactcaaaaatattggttgtatagtttacgagataaatgttcaaagcgtgatctgaaaacttttgctaaataaaatacgcactattaagaatcccggggtaataatgattagtacagaattttgcataaacggagaaaacatacctcatccagaccatgtaagttcgacaaatgacgttcaatctgggggagcagagtaattggcatgaaattttcgccaaaacaggcactcaagtcagccagaacaaagcttaaatctttcaaagctactttgcatctcaatctacaattagcaccaaatattcttcatcatcatcacttagattttgcacctatatttgccaattaaaggaaaatcaggaagatcatagtctaaaattgatgcacttgcttatgcatttacaggacagattagccagctgccactaaccatttacataacttctgcttgaacactctacattccacacaagggaaatggaagaggaaagaatcgtgtaaaaagaatgcaagcccacatttttcaaacagcaggcccctcctcttctgggcctaaccaaaatatcatagccgcgtcagcacccatgctcaacggtgagagctttgagagctttgtagtgactgaccaagtcaaatttcttatgtcaatgatgtacatcattatcaatactgccaaccgatttgtcgactactcgaacattatactgctcgtatacccgtgcccgattctcttgccaccattgttctgcttgtgtctcgctgaaacgcttccggctgcattcagaacatagaattagtgagtatgcgccataacagaattagtgagtgtgaaaagtcgaacacagctccataacagtctaaagtagaaatcttcaactcatatagccagaacatttttgacccccaggaatatccaacctggttatcacttggtgtggcaccaattttaagtatacctcagtgagcccatgtgtcctctccttttccaactctctcgcttacatacccaagcccagcatgatctggacagccactccagcctaccttttacctgtctccagaaatggtgggcataatctcaaattcctgcaccatcaccaccaacaatctcctccaccatctccaacaatcacctacttgcccccgaaggatctgaaatgctggtgtgcccttctcacatccctgcaaggcacccactagcatcccattccaacatcttcacccccaaaatcgtccccacaactctacatcctggactatcatcaaggagcagatgggacgaggtctctactgcatccatgacatggcttgtggaagtgggagaacacaataatgccaaggagggcagaaaaatcaggcaaggcattttatttacctaaacctcactgaatgctgttacctatatctactcaatgctagatgctaaatcaagtcaaatcgagttggatggctctgtgtcgtggacagggtgctacatcaactcaaacaggacaggattgatttgaggcggtcacatgatctggttttgcaagttgaaggttctatttagacaggtctgttgtcaatagttattatcaaattattgtaatattcattgcattcttgatctgcacatatatagagtaagttaatagtggttttgtgtatcaagatcctctcaactagaggctactgcccacttcatgttgttctctccataaaaaaagagtaaacacttaaaaccccaaatatctatataggacaagcaaaaaataagttgattatactatatagtaagccaaataaatggaatgcccaaaagtgtcaatcactcaattgctgtcattgcttgttagatctagtctcatagactactcgccaaacgaataatgtactatgttcaagattgatagacaagatttttgctgactaatgactatatattttgcctctgtgtggttggtgtgtacctgaaccggaccctcttgagatctcgagtccctccaggtagggcagtaagagtgatatacacccctggttcatcttgctctacccattcagattcatgcttagaatctgaatcgggtagccttgttccattcttgggaatttcagggtgactcaacttatttctaactgaagttggtccattggaaacaagcaaaccattagaaccgtttgaacagggttctccagaacttcttgggctacccaaactctcagatgcaactgatatatcagttggaatagaaattcctggcagcggtggcagtctgctgttcttcaccagtcctgctccttcaggtagcttctctgccatgcccttcaactattacacgaacaaagaattgttagtgaaaatattcaacatattgtacaaaatcattatttgaatttgaagatgatcatgcattcttagtttcttaaatacaaagttaagatccaaataatgtcatttttagttttccactttccaactccactaaagcagcagactgtcttctatcaaaagtaatgcatgcacatttagtagtcatagactcgaaacctagaaaagttgtactcatcagggccagttagaaggcaccatgctgcctttgaccaatccacagttcccttggttttgacttttgagccattcagttttaatcaaggggatccgtttacacatacttgcagttttttactttgttagtttactaatgtctgtacagtagacatcctacttgaagtatagcaatcttacctgtgcagttaatgatttgataacttcctttgcagctttgcacttcgcagtttcctcccctgcaattgaaatagcttccttcaactgtttagttgttctctccaaatcagcttccaatagctga

SEQ ID NO: 47907 - DNA, 4211 bp, Oryza sativa
cgtccgtatctccatgtcctaaccgaccattcgcacctttaccccatgtgtacacctcagtccttgaagtcaagacagcgacatgataagcaccacatgagatctcctccacaaagtttttatgtagcttcccttcaacacgcacaggaagcatgccatctgcttgtggatttccaagctggccatagacaggacttcccattgtatatacatgcccagaggtagtcagcgccaccgtcatacagtgaccacaagctatttgacaaaagttaggctcgaccaaagcagctacacatgttgggacaagtcttgtatctttgtcaccatgtcctaaacggcctttatcaccatcaccccatgtaaaaatcttaccagaagaacagttgctagaactagaattgccgaccataacttcaacaacagcagcagtgtgccaaacaccacaagctgctcgaacagtccgtagccctttaagggattccacttctctagggactgaaagactctgtcgatctccatgacctagaactccaaaagatccatctccaaatgtgaatagctgtcctgcagaagttactatagccgtgtgccaggggccacatgaaattgctgaaacatgtatgccctctaatggtccattgacccttttgggtacccagtgactgacttcattcccgtggcctaaaagcccagaattggaagtaccatttccccaagtgtacagatccccagagagcgtaactgcacaagtgtggtactcaccacatgctactagctcaatgttcatattagcaagagcatcaataagctttggctggggcacatcacaatctacaccatgaccaagacgtccgcctgattcctcaccccaagagtagatctctccctgcttggtaacaagtgtggcatgccttcccccacaagaaatgttctgtacatcaagttttacagcaaattccaatggctttggtataagacaatccatgtttacacctgaggagttcccaactctcgaattgccaccaccaagaatcccctccccagtcccctctccccatatgaaaacatcacctagggcatcaccatcatcatgaccagaaccatgacttgatgaactaacagcactggataaactaacacggaaagcatccattgggatgccccttgagtgtaaatttgtgttatctgactgcccagaagacacggaatggacagaaccggcattagaatccgatgggaagaagggcttgggtggggctgcatatgacacaatgtcagaaaatgccttctccagaccgacctttggtgggctcccaaatggactacgaagtcggtaattttcaacaccatcctgttgcaggacaattatcaagatgtttgttatattaattgaagtagacagaagaataaaataaaacatggtcagtaagatacaattcttattgtggtgctgcaaagcgataaatatctatgtaatgagattgtacagaccatacagaacaaagagaacagcctaggtacgacataagacttttgccatgttgttcagatcttaaagcagcaggccaaaaccaaaaaatggaaaagaaaaaagatggaacatacaaaacaggaagagattgggtagttctgtataggtgacgaacacacaatatagtggcatagtgggatgagctgggtgggtagtgggaaataccttgtggacactgtcattgctgctgaaaggagaactcaatggggagcttcgtcttgtgtaagttctgggactagttgtaccagaggaaagcatatcacttctcgattctgttctccatttcctttgatgactacgtgttatgagggtttttagcccagcaaaccacacttcggcttcatctttatccttgcatatctgatatcatgataaaaccacatcaccaaacaaaatcaatttgctaccgaggaaaggggtttagtgtgcatcaaaaatggaaatcgaaccaagaagataaacagcacatataaaatgaacagttataacttacaatgtccaatgatctatcatgagatatgagagaaaatgactggcattccttttctggtcgtggatacctctgaaaaattgcctgcattggcaaaagagaaacagacattgttaggggagagttacagaccttaaatatagttgaatactcccttgtgatcgttttccatcagaaagcgaatgtaaaaaaaaaaaaacaacatgatgggacagatcaatttgtaactgccatatgtagctccttttctggaggcagtggcaaaagagaatcataaatgaaccatcagaagttgcatcagtttgaagtggtatgtaatttgttgttatgggggcaagactaatgattacagctatctcctaatggcataagttgtatcagtagtagatatcagaaatttgaactgtaaaagttcttgtcagttgtcagtaagaatgcaacgaaactcctcttaaggagggagaattatgttagggtaaaagctgaagagacacccacagatgtattcataaggagttaacgccaaaacaaacaagcaaaagaaatacactgttgttttaccagatatgatatgagatttgatcacaatggccaattagacttagagaaatctatattcctgaaatttgaagttttccagaaatggtaactcaccgttcgttgtccaggaattattctggacacatgactcaacctcagctgtttttcctctttcccggaaaaccatatcaatatagattcatcctgaatgaacaaaaacaccatgaatgtccataaatctgaagggtaaacaaagagggctttacaactcagtgagagaaaatgcaaacaaaactcacattggaaagcctaaatgggcaaaattttggcttccctctgcgcccgtacttcagcaagtatgctcctttcttgagagcagtgatggcctgagaaacagtggaatgttgtatcgagcatcagtagttagtatcacactactatcctagtaaaataataaaactaggtcaagaaataactctgattttagatgccacaaaggagaggcattaaatacaatggaacaatcacatgcattctaattggccatcgacatgttctttcagacaatttgaaactacttcagagctggaaatgaacattatattatgtatagcactataaactaatcggttaatactggagatgatgaaaatagcgttccagctattacatggagaagtgaattactaaagcaaactccctaatgcacaagagatgaaatgctacatgttacagcaaatgcaaaggtctcatcaataatctctgaaacaattatcatctttcgaaataagggattctcctagaagggtagcacatataggctattctctttgaggtaaaccataactcagaacttcattaaaattattcattgtgccatgtgagcacagagagaacaaaatggaaactcaaaaaaatgggcaaagaattttacaagttcattcaaggagaaagtatctgtcagaaattactgcagagaagacgtgtattgatccaattaacacactggcacttcccctcaaagcaataggacataactaatatagcagtatagctcaactcaatcaattaccgcacgcagcattaaccaacagcaaaagaaggttgggaaaccgttatagcataccactcccaactcaatcatacaacctgcacgagagcaaagtagtaacaaccagcaaacagcccaattcgattggccttccccaaaaaaaaagttagcaaacacaatcactgtagccaaatcaatgtctctggaattatccaacccaagaggccaaataacagtaattaaatcggcttccaccacagaaccctacttgcaggcagcagcaaagccgaggctccagactccccaaaattttggtttctccgcgggggacacgcagagctactgctgcggtagcagaattcagcagccgcacgaaaacgcacaaacgcaaagcaaatgcatctaccatccagagacgccttccccgccacgcgcggccccgagacgaggaacacaccgacagccgggatttcctcggcattcccaagccgagctaagcggaggatcgggaagcggctcacctgctcgatgtcgcgctccacggccccgggccgcgcgccgccgagatccgacgacgcgtccgacatcgccgccccccc

SEQ ID NO: 47908 - DNA, 12487 bp, Oryza sativa
  unsure (1)..(12487): unsure at all n locations
ttttttacaggaaaatcagttgggctggtatggttggtttgtttacgcgtgcggctccctgccgcgcgccgtgcagtgggagggagctggatgggcgctgtagccgttcgcctttattactactggagtcagtcgctcgccttcgtcgccgccgccgatttgcgggtggatgcgccgcgagcggtggtgcggatggggtggggcccacgtggcagtgagagaagagagagtgaggcggccggcgaggggaatctcggcgggagtgggggatagagagcgacgcgtggaggtacgacgcaccactgctagtactttgttgtaggagtacgtgctgctgctgcggtggtgctgtggactgctggtttctggacttctgacccgccgcgtcagaagttttttcgcctgtttctgcccaggcgtggaagattttggggctatttttggttttggtttgacgttatttttttttgtcctttcaattttccggtagctttgaataatatattctcccggtttcgtattatataagtcgtttgaatttttctcggtttcgtattatataaatcgtttgaatttttttttctagtgaaactttttaagtttgacctaggtttttaaaacacaaaataaatatgaaaatatatttaatgttatatttaattaaactaatttggtattatagatgttgctattttttatatatattaagtaaaatgtaaaaatttttgaatagaaaaaaaatcaaaacgacttataatataaaagtcagggttatgggtctggcaaactctctacccttcgatatacgttacgtatcgacatggcatacccacgcgtacgcgaacatttccttcataatctaaggaaacttttcacgaaattaacagatgggaagaatccttctcggacaagaactgggttacctacgtatcgtgctaggtctggtgtgttcgagtcctacttggagagcatcagacatatggtataaaagggaccccccggggagggcataagggatcgaatctcagagccaacacaaccaacataacctacgaagccggagcctgcgaagagacaagtcgtcgagagctagtcgaatcaactcgattacaacctcgccggatctgacaagttccatcttttcctttgtaagctgtgttttccaccgtataataccatatcaactggattagggctattacctgtcaaggggcctgaaccagtataattcttgtcttttgattgctcgatgtcgtactacgtagatccttgtaccagcgtaccccaataccctctatatccggtctacgggtatcacccgtcgacagtggcgcgccaggtaggggcacttggtactcaaggttctactactatgccatcaagcttcgtcgacaacaacgtcaacaccagctccagccaagcactctcgacttcaacgatgctggtatggactcaagtgggcgaaatcgtcttcccggtttacaccacgatgccgatctcaaccggtcctccaatgactgaaaactagaacgcagtggctacaaaccaagacggctccatgtcgaaaaatccacccgttgaaacggagaacggattaccgactacatccaaacttgggaaggattctgatgcggccaagtcttgtccctccgacgtaaatcacgggccgacaaagatgacttctgaagctatcaggtcttggtgtcctatccacaaaaccaagaaacatacccttcaagattgctgggtattcatcaacgtccgtgctgaaattcgcgcctgcaaagaacgtggaattcaacgtatttctccaactcgggatgtctattgtcctatccacaagacaaagaatcacgatctctcgagctgtaaagttctcctcggcgccatgaaagccccgtctcctaagtcatacgtccccgccagggataacggcaaggaacagggagcgactccagcctcagatcgattcgttggggtaatcgatctcgatcctcacgaaccatcggtcttacatctcctcgaagactacgggtcatcgacaacaagtgcgccgcgggaggtactagttatcgatgacgttggcacgtcagcgcaagccaacgcagaagcggcgaatcaatcgactactccagcctagcacatcagggctattcaagctatactgagggaaactccttacgatcccgttctgaatgacgacctcgagcgttggacagaacaattacgggagtcggtgaccaacctcagcaatgcgttcgaagaggtcgctaccgcagcacaccaagatcagccaccaatcggcaaccccaatggtgaagatccggagcggagggaatcgcctcgacaggctacccctccacctcgtggcactggcgatcttcgagatcaaattaacggtcgccgagaagcacggcgcacacgggacgacgcaaatcgctctcggcgtcatgtttcttcacggcaccatgatcgaggagaccgccaaaacgaggaccgagaatgcaacgatcgcgaacggcgggggccagacaatactggtcatggccatcgccgcaacgacgacgacgaaggagatcggcgccgagataacagcgagagacaacgacaagattcccgggatccaggtcgtcatcctcgtaatcgtacgccggagccaaccgacccatcgtcatcgtcatcatccgtgtcctcttcatcatcagacagacatccacgaaggtcacgcgaccgccggcaacccaccgcccccagtgctgggtgtagggctttcggtcgttccctacgtgatgtccgatggcctgagagattgcgacccggggccattgaaaagtatgatgggagcaccgacccggaagaattccttcaagtctactcgacagtgctttatgctgccggagcagatgacaacgcgttggcgaactatttaccaactgcgttgaagggttctgcacgttcatggctgatgcatcttcctccctactcaatctcctcgtggatagacctgtggcaacagttcgtcgccaatttccaaggaacatacaagcgccacgcgatcgaagacgacttacacacgttaacacagaactcgggggaatcattgagggaatacgttcggcgctttaatgagtgcagaaacactattcctgagattaccgacgcttttgtaattcgtgccttcaagtccggtgtcagagatcgctacactacccaggagttggcaacaagacgcatcacaactactcgaagattattcgagatcgttgagcggtgcgcccacgtggatgacgcgctaagacgcaagaacaacaagccgaagaccgggggagagaagaaaccagccgtagacgcatctgagtcaagcaagaagaaaaatcgcaaaaacgggaaaaggaaagctcaagcggaagtcctcgcagctgagtacgcgaaccctcccaagcgcccagacccacagggcagcgatacaaagaaatcatggtgccccatacacaaaacggacagacattctctggaggattgccttgttttcaaaaagtcgctcgagaagcacatggcgtttgaaaagggcaagcgagtatgcgttgtcgagaagaatgaggagacacctcctcacgaatcagactctgcgtacccggactccgacctccacgtctcacacatcttcggcggctccacaacgtactcctccaagcgagaatacaagaaagtggaacgtgaagtctgttcgacgtggcagggggctgcacccaagatgaagtggtctgagcagagaatagagttctcggaggaggaccaccccaaaacctctgttatcccaggatgatatccgatcgtggtcgagcccactattctaaacgtcaaggtagcacgagttctcatcaacggtggcagctcgatcaatctcctcttcgccagcactctggatgcaatgggaattccgcaaagtgagttaacaccaactgatcaacccttccatggaattactccccaatcatcatccagacctttgggcaagatcacattgcccgtgaccttcggccaagccaacaacttccgaacagagcatatcaccttcgatgtcactgaattcgatacagcttataacgccatcatcgggagaactgcacttgcgaagttaatggccgcatcacactacgcatatcaagtgctcaagatgccaggaccgaagggaacaatcactattcaggggaacgcaaagctggcggtgcagtgcgacaagcggagcctcgacatggtcgagcaaacgcccaccccacccaccacgtttgagccacccaagaaagtgagcaagctaaacaagacgccgaagccagatggcgccatcaagatcgttccactctctagtgctaacctcgacaagactgtcaaaatcggggctacactagatgagaaataggaactcgcgctcatcaccttcctccgcgataatgccgacgtgttcgcttggcagccgtccgacatgccgggggtccccagggaggtgattgagcacaaactaatggtgcgacccgatgccaagcccacaagactcaaggaggtgcagaagctaaccggatgcatggcagcattaagcagattcgtcgctaggatgggagaacaaggacaggcctttcttcgccttgttgaagaaacaagacaaatttgtatggacacaggaagccgaagaggcatttattgcactcaagcgctacctatcaaacccccctgtattcgttgctccccaacctaatgaagaattattcctttatattgccgccacgccatattccgttagcaccgtcattgtcgtcgagagagagaaagtacagcgactagtttattacttcagcgaagctctccatgacgcaaagacaagatatccacagattcaaaaactgctctacgcagtcatcatgacatcaaggaagctacgccactactttcaagcccacagagtcacagttgtctcctccttcccacttggcgaagttgtgagaaacaaagaagttgtcggccgcatcgctaaatgggtagtcgagctaagccagtttgatatccactttgtgccgcgaacagccatcaaatctcaggtactcgccgacttcatggccgattggaccatgccaaataataagtcagataaccaaggcgacaatgagacatggacaatggcgttcgatggcgcactcaacagccaaggagcaggggcaggatttatcttaacatctccctccggagatcaattcaagcacgcaattcacctcaacttcagggcaaccaataacactacagaatacgaaggactactcgccgggatacgagctgcagccgcacttggggccaagcgactaatcgtcaaaggggactctaagctaatcgcaaaccaggtgcacaaagactacaaatgctccaaccccgagttatccaagtatctctcagaagtcaggaagctagagaggaggttcaatgggatcgaggtccggcacgtctatagcaaggacaacgtcgagccagacgacctagcacgacgcgcatccagacgagagctgctcgagcccggcacctttctcgacgtcctgacgaagccatcggtgaaagaagtaagcggcgaagttggcccgaacacccccgacatcagctcggaggtaaccgaggcagaacacgccgttgctgacatcgaaactacagacgactggcgcagcccattaatcaaattcatcagcagtgaggagttacccgaggacgatacagaggctgagaaaataatccgcaaagcaaagatctattgtatggtcggcaacgacttatacaaaaaagcgtcaaacgggatatttctcaaatgcgtctctaccgacgacggcagacaactcctccttgacatacatgaaggcatatgcgggtcacacgccgccggtcggacattggtcggcaaagcctttcgacaagggtttttctggccaaccgcccttaaagatgcatgcgacatggtccagcgatgtgaagcctgtcaattccacagcaagcacactaagctacctgcacaagcgctccagacaatccctctgacttggccgttctcatgctgggggctagactaacttgggccattcccatgaggacagggcggctacagattcctatttgtggcgatcgacaagttcaccaagtggatcgaagcagtacccaccggggaaatcaaggccgataatgctatcaagttcatcagagggatattttgcagatacggactaccgcaccgcatcataacccacaacggctctcaattcatcagcgccgatttccaggattactgcatcggcttgggagtccaaatatgtttcgcctcggtctctcaccctcaaagcaatggacaagtcgaaagggcgaacgacatagtactacaagggataaaaacccacgtctacgacagactcatgtcacacgacaaaaaatgggttgaagaactcccatcagtactatgggccgtgcgcactacaccgacaacatccaataaggaaacacccttcttcctcgtgtacaattctgaagccatgctccccgacgagttacggcatcaaagcacacgagtacagaagcattccgacgagaaccaggagaatcagcgagagatcgatctaaaccttctcgaggagcatcgtgagcgagttgccatccgagcagctagctatcaacaggccctccgccgttatcatgagaagcgcatccgagcacgcatactttcgatcggcgactacgtccttagacgagttcaaacccaagcggggcgaaacaaactctcactaaaatgggaaggaccctacacgatcacacaagtcttgcggccaggcgcattcaaaatcgctgacggcgacgttcgcgaactagcaaattcgtggaacattgaccaactacgtaaattctatgtatgagtcaataccgctatacctgtaagcacccttacagtatcaataaagcctattcctaggtctcatatcacgaccaaagtgttttcacccaatgaccccttactctgacgacgcctagcgttgaaacctgtccttatgtccctttacgccgtctcgacaaggcctccgaggaacctaagggatcttcggctagggacgcccagagccgataaggccttgtcagatcctttagagacgaaagaccatgtaagatctggtcgtgtaagagttctcgccgtgcgtattaaccaagccgtgtaatcggaaaccaagctttccaacttcacggctgggggctaggatcagagcttattcaaccaagacgggccaagggtccaggagccttgtcacccgaggaaatccctcctacgacaaggctgggggctagggagagtgtacgactcaaacggctaactaaagtcgttaactgagaacacactcttacacacacaacatccagagtaagaaaacatttgttaaagatagatttctttattcacataataattcttactgtttttttacataaatctcccactacattacactttttcctaagacatctgtaacaggccacgagtactaccaagagggccaatgccagttcatagactggaataccttctcggctaatggcgacatcgacctcgcaaggtggtctatctccgtcggagtcctccgagaacaagcaaacccttcatggaggaattcaagatccaggcgcgggcggtgatctcgcaggcaagctagtacatgtcctccggcatatcggctcgctcgatgacactnnnnnnnnnnnnnnnnnnnnnnncgcttgccgatgccatcgagttggggacaggccccgttgagccacgagatatacccggccgccgattcctcaggatcgccgcggactactcgaagctccctgcatacccgggccattgaggtatagcaattctttaaatatgacgcaaaccacacctcgcggcctcggagcgtttccacggcttgctctttcttcatggctagcatggttctgtcgagttccgccacttcaaatttcgtcttccaatactagatgcgatgatcttgggttgcaagggcatcctcgagacctgctaaacataacgaccactaagacaagctggaaaccactaacccaacacggagttaaaaaggctactcacttgaggtggttgtcgccatgtcgaccttcacatcaagagtttggtcctcgacgtcatgtgggatgtgtggttcaaactcgagtaccggaattatcgccagtgactcgggctgcccagtgactcgggctgcccgcgctgctggacatcctcgtcatcagcatctctacaatcgacaagaaaaacttccgagatcaacattgaacaaggatggtaatcacatgcacgaaggcaaccagagttcaagatttacaaatgacaaaaatacaagaagtcctattcttcaaaaagagggaggacagactcccccaggtcactgacttcttccatcacctctctacgcgtgtcgcttgccgccccctgatccaagatctcacgcagatcaagttcagggcgcgacaaccttacacacgcaaggacgtgacacgccccggtgaagataccgttggacgtctcctccgcgatcctggccgtatgcttggaggggatttcccctatcgccgtcgccagctccgcaagagaagaagtcaacgagaactcatcggggttcaccgggatcgtggactcgacgccgcactccctggcgagctggtggaggccggtgtaggtgacccgcagcgaaccacggatctcggagagattgtctccaagttccgacatgcagacctcgagccctttgcgttgacgctcgttcccggccaccagctccctcatcttcgtgaggtcctcgcgggcctcagccagttcccgcaccaaccgctcagcacacgcgtttgccgctgccgtctccgccctcgcctctgagatctcgcggccgatgccgcgagcaccggcttcgagaaggcgcctcatcttggcttggagctcctcccaggagaggacggtctctggcagaccacgacctccagcagggtcgctgacggggccgctcggcgtcacctcccgactcccgaccacgggaacgacatctgttgatgccgtggcaggggatgcactggatgttcccccggccttggcccgagctgctttcgcccgcgcctccctataaatcgccatgaatcaaaactccactcgagcagaagacacgagaatctaaaagtttcttcacttacttctcgccgatcgtcacaatgcgctgacgtcgcgcaggcggaggagatgtgtcggaagcctacaagacaaccgacatagggtgagaacaaatcttcctcgctacataaatggatgataaggtgaaaattaccgagggagtctccgccttgcggcggtgtccgagcacagacgagaatttcctcgccttagtcggagctttgccaccactagtagtggcagcgtcagacgcctccttgacgaccttctctttcagagatgccgccacctgatgatccgcgagcggaccgacgacatcagtcaaaggaagggcttacgctaaatcatgtcataagctgattttgagcaaaagaaggcggacgcttatcgaatgaactcacattgattgcttcgtcacgctccgccgctcccttttcacaaaggggcacggggatgtcgctcgccgtggtcgggccgctgatcatcacctgaccaacacgccgctccacgatttcgctgctcagacctgtcaagaagaaattagtttttgataggtcagaggggatcgcgagtacaagcatatcgaagtgaatgcgagaaagataccccgaggagaaacccgggtcgcgtcatctggcccggaatagttataggccgggtgggcccgagcctggagcggctggattcacctaccgacgaagtctgcaacgacttcatatcccgataaaccccgttctcggagattatcgatgatgtcgataaacgattggagagagggggccaaggggggcttggcggtccagactggaatcttgtccagttgttcctcgggaacaacgaggaccggatttgagtccttgatttcaaggtaaaaccacctgttccgccatttactgcgagaagaggggcactggaaggggacatagcgcgacttcatcccgtcacgaagtcggaacccaacggaaccggacaccctattggattccatccagcgcaactcgtaataaaagcggaacagatcaagaaagggctctaccccaatgtaggcctcgcaaagatgcacaaggacgctaaggaaagcgatggaattggggttcaagtgcagcgatggaattggggttcaagtgcagaagagaaagcccatagaaattcaagaccagcagaaggaattcggagggtggagggagaaacccgcagacaacataatcttcgatcgcaaccatgcaacctaagatgggctgaggatcagtacctcctgcttccctctccgcgtttccacggccaggaagggcgccatcctcctggagcttctttagggtcgcgctagtggaagtcgacttgccgagatccatcgcagctgcaagatcgccggagatggacctaaagctgacgaagctagggttctttatgacggcggagaaggcgaggagtgctaacgggcggtgtgtgcttgacggagtgggcggacttcaaaatgcgcacttaaaatccctttaaataggcgcacccccgacggtgcgaattccaaggaactgagagaaatccccgaaggaaatttctaggtccgttacgcgcggcagtttttgactttagttcaaaattcactcgtgaccgttgggcttcaaacggcatgcttgactacaagtcatctccgtggtcctcgcacctggaatgataacgttctcgacacccgaagtcgcaaatggtcgcacgagttcattttgagtagaagtcaggggctactgtcagggttacgggtctggcataccctctacccttcgatatacgttatgtatcgacatggcatacccacgcgtacgcggacatttccttcataatctaaggaaacttttcacgaaatcaacaaatgggaagagtccttctcggacaagaactgggttacctacgtgtcgtgctaggtctggtgtgttcgagtcctactcggagagcatcagacctatggtataaaagggacccctcggggagggcataagggatcgaatctcagagccaatacaacccacatagcctacgaagccggagcctgcgaagagccaagtcgtcgagagctagtcgaatcaactcgattacaacctcgccggatatggcaagttccatcttttcctttgtaagctgtgttttccaccgtataatcccatatcaactggattagggctattacctgtcaaggggcctgaaccagtataattcttgtcttttgattgctcgatgtcgtactacgtagatcgttgtaccaacgtaccccaataccctctatatccggtctacgggtatcacccgtcgacaagatgtatggaatgctagtagtttataatagccagctggattaacggagtcatgttcggctaaacttatagagtgcagtcaaatctaccatagcaacccacaaattaatagtgtaaaaaaaacttatctaaattttgacaccaccaatatttcaaaaatgcttcaacccgaaattctttatcctaaccacaaactaatagtgccaaaaacttatctaaatttttgacactaccgatatttggtagtgcttcaaaccctataccaaactcacttatttactcctaagttggagtacatgtgagagaaacaaaagttttgctaaaagtacagcattatattctttctgtttcagttaatttgtttttcaccatgtgattgtttaactatcgtttgtactccctccatcccaaaatataataagttttagagttggacacagttattaaaaaagtaagtagagtgaatggtagagggttgtgattggatgactaatggaggtatgtgggaaaagtgaatggtggagggctgtgattggttggaaagagaatgttggtggagaagttgttatatttagggacaaatcgtaagggttaaaagttgttatatttagatatggaatttacattaaaatatgttaagtttgcgaagtgaggttagctaaactagttagtttacttgtgataaaattagcccatcctaattcaagtcctatattctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 47909 - DNA, 1030 bp, Oryza sativa
tcttggcgtatgtaggcttctatgttgattgtgttgggtgttgatcctctgtgtatgttgattctcccgttgggcgctgatcccgttgggtgttgattgtcccccctctcctcctaggggggtttgtatttatacccatagttgtctccttgagtagtccttgtcgtttccatgtagaactctggttgtctttccttatccggaactccctcgaggtcagtttccgtataagacatggtatgtggtggatcctgccgagatttagtcaactactattaggtatgtggtatccataaccctgacagtagcccctgacttcgatgcaaatgaacgagttcatattctcaaccgcagactttggaggaactgttatgagctcacgtgaccgttctcggtgagtttagagataacgttagacttcctttatcagcctcgtgcgggcaccgaatgagtttgcctaagtcaatctctgatgtcgaccgagaaagtacagagcgtacgactaagtctcccgctttgctgtaatcaagaatttggattgaagtcaagaaattttatctcggtgggtacaccatctcttcattctgtattccttgtcgagatccatgaaccgttctcgagtaatcgagcaggcgtagagtctgcgacggagccttgtcgacatttgtcgtacttgccttagtcaatcttggtgtagaaccatagagacatggagtcttcgataatgtcgaatagaattttcctgaaatcaatactcagaaaagaatattagatagaaatagcctccgagcgaatgctcaaagggtgacatgttataatatgacagactagtgaattgaatgtacagaccagtgttttgtatatgagcatcttctctcttaccgactccgatcagtcagtttgtagagtcatacactctccctagcccccagccttgtcgtcggagaatcgttctcggatgacaaggctcttggacctttgacctgcctcggttgaacaagcactgatcctagcccccaaccatgaagtt

SEQ ID NO: 47910 - DNA, 10420 bp, Oryza sativa
  unsure (1)..(10420): unsure at all n locations
tttcttcaaaatctaccttcaatgagggctcattcagtttagaggaatttcataggattattgtaggaattaaaaccttaggattttttttcctatatgcatcattcgtttcataggaatggactaccaaattcctaaggattgtgctcttgcaagtttattccataggattcttagcatgaagtgagacatcttcgaaaaatccctaagaaatgaagtgcatgtgacatcccaatctttttagggcttattcgtcctttggaatgggtactatactgtcattcgtttcaaaggaatgcaccaaatgaaaaattcctatccctctacttttttaagggaaaacaaaggaaaaaaaacaatccactccaacccaatgttttcaatcctttggattgtttgctacacaaccataggaaaatttcctatgtttttcaatccttaggtttgcacatgcattactatactattcctacgttttgaaaatcctacaaaccgaatcagccctacttttttattcttttaatttggaaatctaatgaaccgaataagccctaagttattctataggaatttcataggatttagaaaactacaatcatttgaatcatatggccgcgtacgaaaaattaaaattcttgagaggatttgaatcctataaaattcctacataaatcttaaaagctaatgctaaaaagtaaagtacacttattttcctaagaaaaattaaaatcaacttagaccatgtttgtttcaacttaagattactgtgccaggctactataagttatattataataaactgatataaaataagctgatagttctttgttactctgaattattagttgtttgttactaaatgttagccacccaataatattcggagttgctagaaatatggcgccatatgttacagtcgattttttttcagccacttacacagtagttacacctcatttacacacacttacatatgtaattggtatgtaattttcgaatttacatatgtaattttagtacttacatatgtaattttgagacttacattgtaaatacactaaaattacatatgtaatttaaggacttacaatgtaaatacatgccgactattttttgatgaaaaatatggcgctataaatatagctacacccataatatttaaaaaacacctttatagtggtaatggattaccagattatagtaatatagcttatagattgtaataatccatcataataaactatctatttgtttcaacttagttctaataattcagattataatatgactatgttgaattaaacagtggcttaaacgcgggacccacgtgcgacggcgagaagtcagaactcagaagtcgccggaagttctcctccccttctttcttagcgccgaagaagaagaagcagcagcagcgaatcgaacaaacaatacaaaacccacgcgacgcgactcaagacttgcacccaaatccattcccacccaccggattcgcatccgccgctgctggccccgtcgcctcgccctccgccaccgccgccgtgcttgctctcctctccctcctcctccagatcggcccgatcccctgcccaccccccctccccgatggaggccaagatcgggaagctcgtcgagtcggtggggagcttcttctccggcggcgacaccatcccctggtgcacccgcgacatcatcgccgtgagaatccattctctccgctcctattcgaatcccctgctgtggggagcttttttctagtactctaatttctaatttaatttattcaatggggggaggttttagttctagcgggagatcccgcgcggtgcttgaggattagcaactccgaggattggagggttgtactggggagcgaatggtcgagtgtggagtggttttcatgcttagtttaggcggcatggcagcctgcccccatttacagtggcttgtttgttccatcatggtggtgctgccgtcggctgcccgtgattagctcgcgtgattgtttgttgcaacgcggatgagtcaaggcggcttctctttattgagctgtgtgattttgattcctttttagcggttcacaatctgaagagtaacactggaactatctctgattcaatcatcactgcaactattggctaagaaaatgcacatatcagtctcactttacaaaaaaatcattaccctgtttgttactagatacattccaaataatgtttaggcttacacgttcgcgctcagagtttctatggttgtatgctttattagggctgtgaaagggaggtagctgaggctgcaaatgaagagcagaagagtgatagcattatgaggctgtcttgggccctcgtgcattccaagaaccaggaggatgtaaatcgtggaataggcatgcttgaaggtctcatatcttgttttgttttcgataatctaaacataatttttgcagcctaatctgttttgatcaatttcgttttgttttcacagcatcattaggtcaatccaacagcccactgcagactagggagaagctatatctgctggcggttggacactacagaaatggtgactacccaagaagtcggcagcttgtggaccgttgtttggaggtatgtgtgcaaatttttagcttgtagattcattggtataattcatattccttaatgttgttgtttttttcctggaagcaactttcatgtcatttagtttttgtgctatcaaaacaggatagagtgttgcattgaattattcggtcctaggtgactgcaaaacaaactttgaaattgtttgtgcaagtctgttcgattgctagcgtaatagtgctgtttttgtgccatatgatgcaatggaagtcaggttgactttaagcttgtcatcctttttcactgaattttcacagccaaagttgacacatgttggctacactatgtatggtttctggtttttccaattgagtaggcatcggaaattatcttcgttgatctggattgttatttaaaatatttgcctcaccagactagtcgacacaaagttttaatgctgttatgcaaatcaataagctctccgatatgatgtgttaatttcacccttttacttgtaacccaattccagctaagcaaggttaatgagtttaagctcattgcttttcagctcatgcttggtggggatgccttagctgctaatgcatcgagcccctttcagaatttactattctttgcatcttttgagagatttaggggcattggctgaaactgaaattataaaattgcttgtctccaatatgctattgctcatctttatcataattgcaacttcataactccgctgaagatgtttttcgggattttggttttcttgctgtgctgtgctttgctatatgttgacagatcgtggtgatttgctcagcattgttttcttgagtttgcttggtttgatgattatgtagtcatgggaatgtttacttggtcttcctagtgcttgtattgttttcttgcctgacctatgttcacaatgcaaatgggattgaaagttttaatcttagtaggcaagaacattttcatgtgagcatccttgtaaaaccattgtgcttgttctgtataccaactgaaacgtgagttttatatgtaacttgctttccttgtgcttcaacatgttttggtttgtggcttggtatctcctgaattaatctatataacttactttccttgcagattcaacctgattggaggcaggctttgtctctcaggaaggctatagaagataaaattgccaaaggtgagacattgagaaatttgttccagttatatcctatattattggttttgtattgagctacgtgatggattgtctcacaaatcgaacatttatttatttttcctcattttcactgggacaacaacttattttatgataattctgtctaaacatctgcatgcgttatctgcagatggtctgatcggaataggcatcgccacaactgctgttggacttctggttggtgggattgcagctattgctgcaaggaagaagtgagatgatatctgcttgctgatgtagtaaccaagtagatgtttggcttgtttgttcttttttcaattcgtggtattccagtcgagaatcgccacagtaatgtgcataaaacaaattgatgaccatggtactccggatgcaacatgtacctttccttttctttggttttattgtcactagtttcaagcacctctggcttgattctgatcaaacatcgatagtatcgtctgaaaacaagtgttggatacaccacggtgcgataaaacatgctccattattaatccacccaacgaaaacaacatcgatcctactcgcattttactaataactgcaacatcacacggtgtattttgttcaaatcaaatgagcaagcaataaaatgtccaagctgctacatggctacttctcagggccgacgagggtgagaagcgtgttcatgtagtaccccgacgtgtcgccgcggacgtcggcggtgaccgtggtgttgtacctgaccttgtactcctccttcaccttctccatgtccacctccgcccgcgacacgatccctctcgtcagcatctcctcgtcggtgccaagccctagaatcgatgtccggatcacctgaagaagaagacgagaaaaaaaaaatattgagtgaaactttactccaatgttcgcctaaagaagacgcgaaaagacaattgagtcaaagggtgtttttagtttacgctaaaattagaagtttgattgaaattgtaacgatgtgacagaaaagttgaaaatttgtgtgtgtagaaaagttttgatgtgacggaaaagttgaaagtttgaagaaaaagtttggaactaaactcggctaaactttgctccaatatgttctgtagtattaaggcgcgttttgaattacgggacatttaacaatttgtcacttttaaaatatgattaatatttatcacttatagtctgttctcatgatatgtgaattcagtgataaattattaaacgttcagtgccaattggaaaaacggatttgctagaaagtattttttaagatggttatgaagaagcaagtttttaagttatcgaggacgttcgattttaatttacctcagcgaaatgcttctccggcgaggtgaggcaccagagcgcggccttgagcaccgccgcgagctggtcgccgcggcggccgtcgaggacctcgtcgatgcccttgccgtgctcctgcctgtaccgctccagcgtcaccgcgagctgcgccttgctcctcgtgccgacgatgcggacgacgtcgtcgccgtgcagcgcctgccccctgcccaccaccgcgtcgtgcagctccgccgcctcggcgatcgccagctcgccgtcgacgccaccgccgccgtaccggtaggagctcacgaggcgcaccaggaaccgcctgagcgggtccccgaacagcgagcacgacgccacgtcctcctccagcgacgaggcgtaggcggcgcggtaggccttcctgacggcgacgaggtggtccggcgacgacgcgcaggcgacctcgacgagcacccagatgtggcggagctcgcccttcttcttcttcttcagggcctcgttggccagcttggcgtcccgcgccgccgggtccatcgtccacagcatcaacgcgctctgcacggcaagagagagagagagggagatcaatcaagaactcgagtccatcaatggcgccgccgcccgccggcgaggtcgccagggtgagggctaattacacggaagtcgccggagagctcggagtggagcctgtcgaggagggtctcgtcgtagaggccctcgtaggcgacggcgatctccgcccgctgcgccgccgtccggtggccgaggatctcgatcagcgcattctcgtccgttccccatcctttgattcagttcaaccaaaaaaaagaaaagaaaattcaaatatttgatttcgaaatcatcagttgtttcagtctttcagagctatgtagaacatgtttagctaatccatgaccaacttgaacaaacaaaatttctcgtctcttccacatgaactggagtagtagcaactaattactcgcaaacacttcagatgaaaacaataacaatgacatgaaaagcaacagggtttggcaaagaacagtgttcagaattcagtgctctttaagtttacattgtgaaacaaattcaaatcctaaatgttcatgatgtacaaagagattgaagagtccatttgtaccttgcactgcctttcttatgctctctgcatcctctgtaggggaaggagctgggtttgggacagagatggaagccatgggagcaacagctgctgctgctgctgcttctcctccacctgcagaagcagctgaggaggagagagaatggggggagaaatggaggaagaggagattgagtggaggtatgttatggatgcagtccaggcagcagcaccagcaacacatggcacacacacgcctcctacgcagcagagttgaaaaaaacttgaatgctagtagtatagctttaatctgcacatccaatgctctgggctctaccctattttttccatttgtatttcatggtatttttccatgatgttttttttccttactcatttttatgatcttggtgaagtgtttgattgtgtatgtaagtgatagtgattgattgaataccgtttgcaatcatggacagctcagacaagctgggacatttttttgtttttgtgtaatggttgcccggttggttccttggtcagtttggttttattgtcatgtctcttctaaaaatgcaaataattattgtgttaagtgcttcctaaacatatctttgaaggcttttgttcctaaactgtaatatataactcggctcgacgcccggtcgctccgcctcaggggtgacgcgggcggcgaaaccccatcgtcaccccctccctctccctcctctcccccacctcgccaccgcctgagcagccgccggcaaagccgggcggctgcaaagacggcggcggcgggtctctccctttcccctcactcctagtcaagcggttggggcgccgatgagaccggagcacgagaggcgcagcttggcgaggacggccagatccggagccgtcgagttcggatccggccctcccttggctagatctgggctggacgcgcaggtcggcggcggaggcggcggccgcggcgcgagggccgcgcggaggaggcggcagcggctcacggacatgcatcaactgctgcttctctggcctatgtgcacggggaagcagttggcggcggcgacgtctcttcttcccgggcggcttaaaaaacccacctcgtggagctcctcccctcctatggctagatcctgtcctggccgtggggagcttcgggagaggggacgtggcggtttgtgcagaggacgacggtgccatggcgatgtgcgggagcaggccgtgagcctacctgagccgtggggtggtgaactgggctaactggtggctgatgagatgatgtggtggttcagcaacggttgttgtgtgggtaggtggcgctggacgaaatcgttggcgaaagccttgcttagcctttggctggcacgacgacggtggcgcctttggcgtcattcccttcttggaggcgtcgttatagcgttttctccaccgctaccagtctccaggtaaaaactgtgatccggtttccggacgggcgatggcggcgtttcacgttgtatcctccttgggggcatcatcttggagaaccttacccatgcaccatttgccgctgctggactcctgtgtcagctcgatgcgctagatgcctaggtgcttggcgaggccttctccttcttggttcctttcttgtattggtagcatccagcttcttcgtttgtctctgtcgggtggagtcggagctgctacgtcgttggggtgcgacgaagcttggcaacgataacatttgcagtttctctctagggatgtgggtgttgctagtacaggctttggcgcttcaggggcttggctgatgtccaaagtatgagcttggtgttgctttgctcggtttggcgatgcctacaatgatgccatgattgccatggagtcggagctactgggtcgctgggcggctagctcggcaacgatgacacgtgccttgtgatgtcaacgctgtgtgccgcctcttcagcatctcgacatcgatgttcatcgttggattccgccatcatttcgttgatagtttggctagagtgatgtggagctccgtgtgctgtgtggttgtactggccacggtggaaaggcttggcgagtctctactcgccgagaggttgttttttctttttctgtagcccatctgagtttttactcctatttaatgaaatataattggcagttctcctgccggtttagttttaaaaaactactagtaagtagtaaccaatatgcatttgttacctttttatatattcacgtggtttacttaattaggaggaggattcatcatcaacttgttcatatcatctgcatacattgtagaccaaccacttagttgcaaaatatgaaaaagaaataattatctataactgacacattgtagtcgaatcacatagttgcataacttcatagaaaaaaatatatatggctaaccacttagttgcaatatataatttttatatcatccgcgacacgttgtaaaccaaccattttagttgcaaaactttgttgaaaaaaatatgaaaaagaaataatttgaaaacaacgcgccaggnnnnnnnnnnnnnnnnnnnnnnnnnnnnnnnnnnnnnnnnnnnnnnnnnnnnnnncaggcgctgtcattggattgatttatattttctttattaaactcttacatgtacaagtgaattgatttgtttgctcatattatggacatagctaactgaaattgttatttagtgatcacaagggaccaaaacatgtattatttctaattttttgaaatatattattatccataattcaatgcttttcaaatatgattcaatgcttagctcttaaggttatcttttgcatatcgattatactatccaaaagtagaggggggcagtactcaggaaacttacgttgtatccacaacatataagaatttgcacatgttaagcccatcatacaaaagaagaagcattatggtctctaagattaaaattcaaagggcctgactcgtttaaaaccacgtttctgtatttctctctttttttttagctttccatgcatgtgaaacgcacagagctgattttatcattttttcttaccttttaaaattccttccaattggaactgaaacattgtgaaatatttattttattaaaagaatgtcttttctcccattactttcatacaactgtgcaaaaataaagtgtgaaaggtacagttggcaatgttggagctgatagtagacttcatgctcaggaaactaaaaaaacaagtctccttgcggatcacgctgatctgattaaaggttttatactgaatcgaatataatttggttgccaacgcataacaaaacatttaagaaaagatgaacggccaaatactgcagttcatatgtgaaactcatgggatttctatgtggcagatgccctttttttctggtgcaaacatgccaagttgccaaatgccaacaactcgatcagatttcaactgcaatattaaaggtgatccgcttgtgcagttctcagtaatcagcttgtctttttcctaccatgtgccaatttttcatccttccctgcatgattgcagagggtgacccaacatcaaaggacaattaattagcttggtccacatttttgaaggtgacaattgccccagtaggtttcaaatgataggatatttatatccctggcacatcatgattttcatgtttcaaaattgccagcatgttcttatccatttcttgccagaacattgtggtaaatctaggaaccttcttgtttcacatgtttcttaaagacgatggtgatatggccacttatgcgttctgtcttagagaatacagatttttgtcaagtatatatacgttccagtgagcatgttactcatgccaagacaccattgcttaactaaaactgatcatctctgaaagttccaaaatattatgttaaaagaaaattatgtcaaaaagtcccaaaatacccgttggattcttttttcttctgtgcctctccccaattgacaatggcaatatattggacccaattatgaaactactatttattttataccaacaagccaaatacatcaagctacaatgtattgatgtagtggatgtctggtagctggttattgaccttacaataaacacttaagtagaagttgcgcttcctgctgtcagcttatttttcagaaaacagtccctctgtcatcgtagcaattgcaagacattgacaaacttaa

SEQ ID NO: 47911 - DNA, 1484 bp, Oryza sativa
gctatatagatttcagtaataagcttcctgcagatattaatagatgaaaaaactgttcaggcatgaatctagggtctaaaactcaaatttacagatttagtgaaatatatttggaatatcgaaaaggccaaggtgaaagtacctgtttacacatgcatctagttcttcaactatgttaacatagacttcattacttgcatccttgacaacagttgttctccatggtacaaaagaagcagctgcatctggaagtttgttaccaagattagaactcttaccagtcacaacattcaacattttgctgacaatatttggtggggcaatcatctctttcaagatgtttggctcagtagtgagtggaaaaccgttgtccatcatctcatctaaaatctgcactcatacaagtattatattttagagaatacacaaacatgaatattataaaatttgcctatcatggtcttcacaagcaactaaatatgctgatatttagactgcagcatgcagtctagatcgatgtttcacatatcaatagaatgaaaacaacaaagtgtcttgatcaatccacgtacattacagtagaaattattgctaacaagtatagataagtacttgtaaagttcgtcgcactggcagttgaagtatcaattagataagttgtaatacagagcaagtatttctttttatctgtgttgcaaacaataatatcattgttatggaacaagtgggatggcatagtagctgaataatatattttgtctaaccttaatttgatatgtaaatttactataacaattatacttttttatttacatagcaacataaaaaaaacacagcgcagcacaaacaccacaaactgagactaagaatgatatcctagttttgaacttgtaccatggtacacaactgtgtccaaaatctgtatatagagagatttaaaacctgtctgacatagtttgacaagaaatcttccagcaataaagtaaagtggcactgtaatatcatccaaatatttgcactagttttcaaatttcagaagactagaacaaggtgaaaataatataataggcaaccagctgcaaagttattatgtgatgtcacatagaagagcatatgaaaatagacctgatacacaagtacgaagttgtctttgattatgtcttcatttaaatctccaagatagtcagttaggacatcagcaacccgtgagagaaactggaagtcgcaaatcatattcacagaaccataaaaaagagcaaaagtcaaaacctgtagtcagccatggttcttggcatttcatcataaattactttagcaaattactgcaatgtgcatgtttcatggtagattggtaggacaattatgatagtgacaacaattttgtagttagttgcctgtttttactgataatgcttctaaagttccaaagttgttgaacacatcatttcataccttcaagaagctttcaagcatgacaacaaact

SEQ ID NO: 47912 - DNA, 850 bp, Oryza sativa
ggtcttcacctattaattttcatccccaatcgacacgatgcatgaacctaaccttggctcttcttgcatgcaatggccagcacgtccatcttcctattgttgccgacttgcggagaatataccgaagaattctgaggtaaaacgaaagacaagtggcatataaaattaagcatttcttttgctttgaatgtttcagccttacttatcactagctgtagctactcaagtatcccctccttagcttcactcttcggaagtgtttgtcttgggattgtatcttaggttctactactaggtaagttcatcgccctggaggcctggacccggtcgtccttctatgagccagtgatgaactggatcaccggaaggcggaagcaactcgagctaggtcaacgcatcagcctttcatcttccctcgatgtgtatgagcatctttacttaatttccagtttaaggtaaaaggctatactgcgtgttttactaactgtaattagctcatgaccgaggctataaatagccgtgcagtctcgatcagtcgtcaattctacacagagaatctgtaatagggcttgtttagattgacgtcatttcaaaccataccattttttagcaaagttgctaaatatatacatctatttagtttcttactaaactctaggaaataaataagaaatcataccaaaacttagcaatattagctagcctcatgttcgatcaatctccaacacaccttccgtacacacaacctgttgaatgatctggcgatgcatgtttcaccgtctgccatcaaagacctggctaaagtctgtaacctcgacgaggctgccaccaaagagctggaactggtgct

SEQ ID NO: 47913 - DNA, 5388 bp, Oryza sativa
aaaattacatcgctagcacgttagggcgggtgtgcagagacactctcatcccttagggatgcgatctaattaggcgctgtttgattcagcttaggattattataatctggattattaggagtaagctgaaacaaacaaatagattattataatctataagccagattactataatccaataatctcctctagaggagctttttccagattattgagtggctaaagacccactacatttggatgcctctaataatccagagaaataaacaactcatagcttattttatgtcagcttattataatccagcttagagtaatctgatttaataatctagattacaataatattaagctgaaacaaacatgacttaatcttgaaatgcgggatttggtcatagacgtatgatgtggctgtttttttttcattttctttggtatggtttttcaagactgtagacttataatcttttttactaatctaccaatacgaaacgacacactatcacgtgctttgttttaactagcctagtgcccatgagttgcaacagaaaacaaattaagtttttatcttattaaatcaattaataaacacttatttagttgaaataatactattattttatttattgaacaagtagttgattttaaaatttggggagaaccaatggtgaaacagtgagatgattcattgaaagatgatgtaatactagcacaggttatgcggcccacatgtgacatgtcagtgagtgatgtgggaatggacaccatcaatactaagagcctgtttagttcgcgaaaagaaaatttttggtatgttatatagtatatttgatcggatgttggaaggggttttcggacacgaataaaaagactaatttcataactcgcttggaaaccgcgagacgaatcttttgagcttaattaatccatcattagcacatgtgggttaatgtagcacttatggctaatcatgaactaattaggctcaaaagattcgtctcgctatttccccctaactatgcaatttgtttttttaatctatatttaatgctccatgcctgtgtccaacgattcgatatgatgtttttgggaaaaaattttggggaactaaaccaggcctaaagtatgcaccctccgtcccaaaatataagggattttgggttgattgggtggataggacacatcctagtactaataatttggatatttgtactcaggccttgtttagttctcaattttttttcccaaatacgtcacatcaaatctttagttacatgcatgaagcattaaatatagataaaataaaaaactaattcaacagtttgcatgaaaatcacgagacgaatcttttgagtctaattagtccatgattagccataaagtgctacagtaacccacatgtgttaatgatggattaattaagcttaataaattcatctcacgtttcttggcgagttatgaaattagttttgtcattcctgtccaaaaacacattccgacatctggtcaaacaccctatgtgacacccaaaaattttcttttcgcgaactaaacaaggcctcagtctacattcatagtataggatgtgtcagcatcggttaggacatctacaatcagggacactctactgagggtactctctgggaaactcccttcgcaatggaggacaccctagatgggctccccatgaggcaactggatgaaagtactcaagcccacaatgggtgtctcaaccaaaaaacccacagtgtgtgttttcctatactacccctctcttctccctatctctctttccctctcctcttttttctccgcctctttcccctcctcttcttttttcttcgccgggtttcactccctccgctcggcgccgtcgtcgtcctccccctccctctccctctctatctcgcgagcaccagtgccacctccctcctcgcccttcccagccgccgccgccgccactttctcctctctctcctgccgctgctcgcctctctctccgtgcggaggagtccaagatagaggtggagaaggtcgcgacggacgctcgccgctgcccgtctctgcccggtggccgacggcagcgaccaccaccacgaagttgtccgcgtgctcctcggtggcgagcacgggcgcctcaagcagtggcgatggcggcggcggtgcggtgcggttgcttctccgccagatccggttgtcgtcgccatcgcctctctctcctctctctcttgacgccgcctcccttctcgcagctctggtgacgcctcctgtctctcttgtcggcgtctctctctcgcgccgccgcctcgggttcctccccaccgccgtcgccctcctcctagcaacgagatcgagggtagaatgggaaatcgcaggtgcggtagtcgtgtccacgagcgccccaagcccccaacgtgtcgcctgcctacgactccccacgaaaaaccggcgagacgtgtagagagccgcgccccctagcacccccagcagagggacgcgctccatcacgggggaacagggcggacggaaaagcgaacggccgtcgctagtggcaagacctggggttacccattgctgatggccttagcgagcctcctatcacttacaggtgggcccggcggcttgcctcgatttccccgacaggccggctcgtcctcgtctccaaagtctccccaaactcgaaaaaaaagttaaaagaacacaaaaatggagtagtgtcctcctccagtcctcctcggcctttccccccgccacaaaaccctagagcgcgaatggggcggcaggtgcgcaagcacgagggctcgcacggcaaggtggacgcgccgccgccgaagaagccgaggagcaccgagcggccattggcaccgctcgccgccgccacgacgaccgccaagccaaggcgtgacgtggtgagacccgcggcgaggaaatcctcggcttcgagcgatcgcggccccgtcgcccccggcagcgacctcgagacggaaggttataggcccctcacgccgtctcccccctttgcttcgatgtatgccgattcctcacttttttttttaatgtatggttgctgtataaagatcgagcggcaacgcttttgatactgtggtgttattggtatgacgtggttaatctggatagacagcaagaaaaggagatttcagattagaaaaaaaaactttgcaaaaaaaaagaaagattaggaaaaaagagagctagtacattataccccctccagtttttaatagatgacgccattgatttcggacacaatcagtcatcttattaaaaaattatttgcaaatgcataacatatagatcatgcttaaagtacttttaatgataaaacaactcacaacaaaataaattatattccatccttttttaatagatgacgttgttttttaacacacatttgaccattcgtcctattcaaaagttttttgcaaatttataagatataaatcatgcttaaagtactttgcgtgataaaacaactcacaacaaaataaattatattctatccttttttaatagatgacgttgttgatttttgaacacatgtttgaccattcgtcttattcaaaagtttgtcaaacgtatgataaaaagtcaacgttgtcatctagtaaaaacggaggtagtaattacgtacttttttttaataaaacgaatggtcaaacgtgtgataaaaagtcaactcatctattaaaaatcagaggtagtaattacgtaaattttttgaataagatgaatggtcaaacatgtgccttaaaatcagcggcgtcatctattaaaaaaaacggaggtagtatgtttcaactactaccaatattttcaaccactagaaaagctagtttttacttctagtcaggtccatggtccatttaacactgtaagtttagaaccaattctatcaggcaaaaaaaaaagacagtaaatttcacattgctcacctttattaaccaaagtttcacaagtcagtaaaggtggctcaaagtgaaatttactaaagcaaagaaatgtccttctcgtcgtctccctgcccccaaaacctagtgcgaatagggcagctggggcacaagcacgagtgctcgcacaacaagttggatgtggggctgctgcccaaaactccaaaggactctgaccgtctggtgcttccacttgcccccgcccccacctctgagctgaggtgtgaaaatgtgagatgtgccgcagggaactcctcttttcgtgtctggtaatcctggcctccatggttcatgcggctgtggccctggcagcgaccttgactctgatggtaaggaccctgagctactgagatcagtactgagaaattgctcgaaatgcctagagatgtatgcagattactgtacgagcccttgcttggaaacctaaactatagtagtggtgaccttttgcttcaacctcaatctacaatgcacatacagattatttgttccagtagctcattattttttattgctatcaatcgggtaactaacatttatagcattttcctgtgctgatatcatttttcttcaaaatttgagtgaaatgagaggataataaatgaggcggatcgattaatcttgctgttagaagctcgggttcaaatatgcttttgtgttgtgtcacttgctaagttgaaaagttgcatctttgttggatggggattaaccttgctgttaccagctcaggtcaaaatatgcctttgtcacttgttgagttgaaaagctgtatctttgtcagatgggcattctttttttgtgaaatgaccttcatgatatgtggagcctgcagattcagatggtcttggctgcttgacccctgacagcacgaaagctacgcttcagcaggatgattatgggaaaggggagtactctccgggtgtggttctatctaagactggtatgtttaggtttgccggttctgttgcttttgtgttaatcatatttagtttccttgctgagttttgaaaattctcctttttatgagggagattctgtggtgaagatggcagtagctgatgtacaggacctgcctgttgaagatttgagggataatgaagtgatcactgtggatagtgaaggccctggcaagcctctccagtcaattccccttgttcaagacaaggatgcaatacaacttgcgagaacttttgtcaatgagaaagtcaaagagctaatggaaggtgtctcagagccaggagtcctgcagagtcgtttgtctaaaatcacctcattccttgttcaggtgatcttcctaagaatccttctggcttgcctatcctaagaagcaagtcacatgcaattatccttcttgtgcaggccacctctatagctgccggcctccatgatgaagtccctctacaaatacgtggacaaactg

SEQ ID NO: 47914 - DNA, 713 bp, Oryza sativa
ccccaccagtgacttatatttcgccgaattttttatttacagtaattaatgatccttaaattaaataaagagtaaatctcagattaaatttgtaaaaataggaaggacgctgttcccaatagcgtccagacttggacacactttcttttgaagagcgtccaaaggtggacgctgttcggacggcgtccaatctggttcacctcatcctcttgggttcggttgttctttgacgttctccacaaccatttgcaggcgaaggtgcaccatcgccggctttcctctcctccctgcacggctagggcagaggagccaccaccgccgtccacctcgacgtccgggtggcccgcaccgatcgacttccacctccaccagggaaggtacagagtccacctcggctccagcttccggggaggcggcccatcgctgtcctcctccacccttgagaccacagccgcttgcctccatgcccaagaaaccaccatcgtcgttcccctccatgttgtcttccatcccttctcacatatgccacaaagttctttcagaagaattgggatgtgttgaaacgggacattattgcggctgttaagctgttctttgaacagagaagaatgccacaaggtgtaaatgacactgccattgtgttaattctgaaaaagaaagagccaaaggatttgaaagattacagaccaataagcctttgtaatgtgatttac

SEQ ID NO: 47915 - DNA, 1197 bp, Oryza sativa
tcctgcagcccagacggtttatcaatggcgctgagtgaagctgaaagatcaggacggttacaacctctgaaagtctgcaggagagccctggaatttcccatctcttgtttgcagatgatagcctgttgttctttaaatcaaatatggaacagactaatgtggttaagagtgctcttactttgtatgagcaaagcacaagccaactcctgagcccggccaaatgttctttgatgtttggaaagcattgtggggatgctctgcagtctgacatcagatcacttttgcatgttcagcacacttcctttgaagataaatatcttggtctgcctactccgatgggtagactgaaggcaggaagataccaatctttgaaggagagatttgagaaaagattaacggattggaatgagaaatacctctctatgggagggaaggaagttttaattaaatcagtcctacaggctattccgacctacgtgatgagtgtgtttaagcttccagcagggctctgtgaggaatatatgcagctgatccggaaattttggtgggggagaagaccgtcagaaaaggaaagtccattggatctcatggcagcaactgattaaacccaaaggacaagggggaattggtttcagggacttgaagctttttaaccaggctctgctagctcggcaagcatggcggctgatctagtttcccaacagtttgtgtgctcaaattttaaaggcaaaatattaccccaatggggacttgtgtgatactgctttccctattgactcttcagaaacttggaaggggatggtccacgggttagagctgctgaaacaaggtctaatttggcggattggatcaggaagcaaagtcagaatctggagggataactagataccgagagagcataccctaagggttttgggaaaggctgttagatcgagaatcaaatgggtctcggatcttatggttccacatcaacaaatttggaatgaagagctagttcatcgaatcttctatcccctggatgctgaggaaattttgagaatccaattgccacatagccctgaaggacttcattgcttggcactatgataaggtgggtatgttcactgttcgttctgcttacaaattagccctacaggcccaaatcagagctgacgaagaggttgcacaacgctcaaatggcgatggtgataggaagtt

SEQ ID NO: 47916 - DNA, 24238 bp, Oryza sativa
agcaaaatatctctcgatctgtgcaagtacaagctgtgccgttgtgagttgtagtgaatcaattggtccagctcagagaagccgcgggtagaaagaaagaacgaggttttggaccctttttcccctgaagaatcgttaaatttgccgcttgcttgcgtataacgataatggttttgcaaggcttaagtcatcaagatggtggcaaaggtaccaaatttacgcagtactcccctccgtcctaaaaaaaccaacctataagagaatatgatccaaatttgttgtactaggaagtatctccttttagattggtttttttttacggagggagtagagctagggccaatagtggtaagtttgtttttttttctaaaatctcaatcatttaattagatattttaaaattttcttaagggaggagaggggttgtaaagttcccttcttgctcctttcatggatcctggctaaagaagccagaattcatagaatcatgtataaattaaaacatagaattcatgtataaatgtgtatttatttttttcggtcactttaagtttatcctaattcgtgaatgtgtacttattttggaataaaggtactacgaatttcaatccatgtaacagtggcgcatctccatctggccggccaccaaataaaaataataatttgtataaacaaaaagtttagtaaagcgttgcaaaaaaaccaattcaaaatgccatatgagtacatattcttgtttctgtgtgcacgtgggtgcaaaatccttttcgatgtgtgtagttttgccgacacagtccaactacctgatgcctgctgctggttccgtactttctctgtaggtcggctgctcactttgagatgttagcagggcagtagcagtgcaaggcacgtatagcgtgtcttcagccgtaaaaagtgaacgaaacaaaaaaaattggcaggaaggacacgctctccacagtgcgtgacccaaaaccaagaaaactttcatcctagtgggtcccacataaaagtaggtcactcccaatctctccaggctcatgtgacccaaatccctctcatcggtgggccccgcgctcaactttttaagtgaggttctcgatccttcacttggaaccgaagaagctagtgaagctatgggtcccaccaacttttttttaccacgtaggacgaagtaatgctccacgtatatgaagtaacgcccactgtgaagggccttactgctatcccatagtacgatcaccttaaactctcaaattcaactcgaattattgagggcttcaagtctaatactgaattattgttcttcaagtcttataagccaaaacggttttttaaggaagaaaaattaatttataggtaaaatttttatatatatgttcttagcgactcaaaatccaatataaaaatgccacattgaaattattttaaaatcaacttcaaaattaagtttgaaatttaaaatttagcttttgctttagcttattagggtatccaatggggctctaaactgggaggttcatttgctgcctgaggggatcatactatgggggtagcagtataacgagggatctaattctagatttaatttttatcctaaagtaaatgcaactcaaccatactactccctcaatttccaaatatatgacgccagtgactcttcgtataaagcttgagcattcgtcttatagtataaattttatttatttaattgtgacttgttttatcatcaaataaaatataatcttaacttatagtttaacatatttatgctaattttttaaataagataaatggtcaaatattataaaaaaaagttaacagtgtcatacatgaggtagtagtacttttcacatcaatcacatcccattcaaattttctccattttaccctcagctaccctcctactccatgaagtaatgctacatgtactaaaattttcttacaaacttcttactaacaaaattctcaaatgtccgattgagtaaactagaagttataaaagtcaagattcaaccataatgtaacacatcggtgtttgtaaaaagtttgtgaaaataatttaaaacagatatcgtttcaactctcaaattcaactccgtaggatgatcaccttttaactctcaagttcaactcgatttatcaaggtttttgagtcttatactaaatttttttcttccttttttaacaaaaaagataaactagaagatagttcgatagttcatttccagtcggggctcgtttggtttgtaggatttttaaaatgtatgaatagaaaaaaaaagaatagtatgggaatacatgtggaaactttggattgaaaaacataaaaaacttgtctatagttgtgcaacaaacaatccaaagaacatgaaaacaatgagttaagagtggattgttctttcctttgtcttccccctaaaattggagggatagaattgaaaattctctttcggtggattcctttaaaacgaatgacagtttgatgtccatttaagtattgcatacttatgtactttttctttacaattccttgaaacgaatgagccctaatgcctttgaaacgaacgagccctagggagccctagagctcgccatctctcttggctgttgtcccgtgtggctatcactccgtcaacctaatgtgccagtctccctgtcctgtcctccatggcccaacgatgctgcatgtttccactcaatgccatcatcggttttataacaatatttcgacaaaaaaaaaagagagaaaagaaaactctgaactccaactatagtgagcctagctccatcaagggctcaacacctccagcttccacatccaaaaataatgagtcttctaagtcaaagactaattgcaaatcttcaatctcaatctaaacagtaaacaccaaccttggtaagattaggcaatatatatgcatattttgtgtagaatttctacggcctacacgtacataaatttgttcaagtcagagatagcttagctcactcttttagtgtcgtagtatcttgttaacagatcatagctaaggcctgatgctttaattttcaagtgagatcgaatctaatactaacttcaaacattaatgatcgaaagcgataagtcgtgcgaaagtttgctaaagaagtaagcgcgtgacaaatgcgtcctactgcagaaattaattggtgtaccaattaacataacacacaaaaacgtgtggtaacaaacaaaacacatcgtgcgctcgccacagatgtttcacgctaagcttagctaacctgccgactagtcaaacattcattgccaaaaaaaaaaaagttaattcgtcccacggctatggcagcggcgcgcgccgcggcgaaggcggcgaggtggacgcggcggcgcggcggcgccggcctctcctaagctccacgtcgccgccgccctccactcctggcgccgccgcctgctctaccggcggcgctctggcgccgtcgtccgacctggtggtggtggtggcggcgccgcccgcgacgtcgtcggcgaagtcctccatcctgaacaccggcctccacggctggtcggcgcgcctcgcccgcttcctctccccgccgccgccggcattaccgccggtggcgctgtccgcgctggcgccgtcgccgctgctcctgtacatgcccctcatggcccgcacgttggcgaccagcgcgtagaacctctccacggcccgctgctcgtcgtcctcgtcctcctccgcctcgccggcggcggcgacaccgccgctccgatccacattcgccgccgccgccacaccatcgccactcgacgccgccgccgctgagctctgctgctctcctcccaccgccgctcgcggtgacgacggggcgtcgccggcgtcgcgcggcgccacggacgccgccttcttctcgccgccgccgccggcggcctccgccttggtttccatgggagtaggctagggctagctaggctggctgctgcggagaatggcgcagccatggtgagtaaatttatagcaacagcttgcgaaaacgaaagcgaagttaaaattgaatttgtgaagcagcgacacactatacacagcacacatctcgatcgttggattagaccggaccatttacgattaaataattaaacgttaattaggcgtcctctctagaatacgtaaatccaaaagcgccgccttcgttgccaggttgccagcatctgatcgatcgaagttagacacgtcttaattcgatcggaatcagatgcgtataaacggagaagcattattaccgtgctcaaataagtcaaatcaggagcaagagatatacaaaggtttgaactttgaacggccatggtagagagtcaaaagtagagcaatgtcaaaaatctgaggccgaatgaacaattccatatatatttccattcatgtaggattaatttggacggtttgttgagaagcacttgtgttttttcgtgtacggtgtttttctgaacgggcaaaagaattgcacgttagtataagtttttatgtgtgctaggatcagggtgtatgattctattaaggttctaatattaagatattatgtgcgcatatttttcataggattttaacggggtgatgctaaattgaatggtttctgttgcttctaaaattttattagaagaaacaaaagtggagtaactcaaaattcagagcgcaaattgtgcacgcgtacatcttccatataatccttaaaaaaatgtgagtgcgcgcgtaatagagtgtgtatatcagcgtcttcacttaatcaaaaagaaaagaaactgaacagaacttgtattaattgattctaaaattgttttagtaggaacataagtacttcctctgtttcacaatgtaagtcattctagcatttcccacatttatattgatgttaatgaatctagacatatatatctatctagattcattaacatcaatataaatatggaaaatgctagaatgacttacattgtggaacggaggaggtaactaagaattacgaagtaaatccaaagataagcaactagaattatgtactccctctgtttcatattataaatcatttgacttttttcttaatcaaacttacttaaggttgaccaaatttgttagaaaatatactaacattttcaatacaaaacaagcatattgtctaaatatatttaatgttaagtttaataaaactaattggtggtgtagatgttgatatttttctataaacttggtcaaatctaaagaattttgattaaaaaagtcaaacaactaatataagaaagtagcggttcttaaaatctagtttcatgcgaagatccacttacaatcattaatagaaatttgaaaaatagtttctttttctaaccaaaccacatgcaaacgtaattatcacatcttacccagaaaaatattcctccatcaaatcaacatcgatatgatttggtggctcactctataggaatattcctctttcttttgaccgtctgatgcgttgtagtcctccaaaaataatggagcatgtacgactgccaacactactgcttattactataaaaaatatcgacatattctcttgaaaaaaaaatctaaccagtaaggtgagcgtagcttatctggttagctagattctttgtggtgaaactaacccatagagattcaaatcctatttttgatacgagtgttcttatttacttctaactattatttcaatagtagacaatgtacgcacccgttgataagagtgtgcttctttagtagtaggtaatgtatgtacccgtcaatagcagtgtgcgcacgttatagacgtcaccctctttttttttcaaaaataaaaataaaaaaaagggaaaatagcccagctgcaaatggcgatactgttgtccttttgtctcgggccccacaacccagtcaccaaaccactaaaaaaacaaactatgaccctgatgaaaagaggcatttgccctgcccccggtcttcctctttaatcatcgctgcaaaagtgacgaaactgccctcgcccatccatccccaaaatggggacgccaagtcgctggtcggtggggacaaatcggggtaaaccaaaggacgaacagtattccattccacgtcgactgtggtttgggtcatgggtgacgtcagcggatgacgcaggcgcacacgacaaaaaagagaggcgccaacggccaacggggacgtgtgtgtgacgggaacggggggccgctgacgaccgtgccgtgacgtcagcgcgcacgggttaaaggaaaggcaaaagtggtggcttagctggtcgatctggtcagctcggtcggtcggtccagccaggccaggcgcgcgcgggtgctcgtgcccgtgtgctccacaacaaagcaggtgatcaaagcacatggaattatacggagtggtggttcgatcgatcgatcgggcccttttttttcagggcagtaacaatgcggtgagcctgggcgagcaacccaaatgtaaaagtggttgaagcttccctctccatagtgcacacgtgcgtaacccaccctcattttttttcaggccggccccaccacggaatcgctttgcaggtcgtttttctttccccctctctctctctcccgatggttttgtgcgtgctcagtcctttttcaggcatttttgcaggcttttatgacgaggaactcgttgctcaccaaggaaccgagcaaccatgtgaaggaactctggcccacaccctctctcctccacgccatcaaccatcctccgtggagctgtgaagcaactggccagctcactgcactgtgaagggcctcaggggagagcacgcgcgcgcgtgtcgcacgatgttgtaccgcctgcctgcgaaatttgtcggtttgtttgtttggcgtgaaatgtttctattgaacgagctactccattattactcatgagctattccctccgtcccataataaacgcagttgtgagtttcaatgtcgaactttgaccatctgtcctatttgaaatatttttatgattaatatctttattgttattatatgataaaataagaatagtattttattagatgataagacgggcgatcaaacgttagatacgaaaatttatggctgcacttataagagcaagtttaatagtatagccaacagttggcttcaaatcatctatagtcaacttaatagtcaattcatacaatagttacttataaacatatactgcacaattaatatttggtcacacctatcatacacacatatatcttaaaatccgtgctgcagctagctataaatctatagcccgctgctctctcctcttttatcttctcgaactgtatttatagatgtcttatagtcttttattgtacctgctctgctctaatgggagggagggagtatattactgtgtgcaagtgtgtgggcatcatttcgtagcacgccataaaaggagatgatactgccgccggatgtgttgatgtttgattctggatttgacagccaacagaagaaaccgtccgaagcatacagtatgcacttccatatcgatccaagccaagaatatgatttctcctctagaattccgaaccttttgatcgaagaatatggggacgaacatatcttttatttcttggaatgagagtttctcatggaatataatgtcaattcgatctatagcaggatgtctaacgatttcaagcctatcgacatttttaatcaggggaacctatataacaagttactgatcttatttgtctatagtaaatttcatctctacactattataaaaacttaaaatatttctgctagaattttgatacgtcatatgtgtttgaatcggttttaattctatctttcagttttaatctatatacctgataaaaaacttgtaagccttccagttctattattattattatccggatcttatctgtaagcctttcagttttatgctccgttcgtattttcgttgttttcttccgtcgcggttttattatttttcatttttttttctcatacggtttttttccgccaccgttttttcgttgcggtttttttctcgcacgcggtaagggcttctggcttttcggttttcttttcgtcaccgtcttttcccttcgctatacctatctctagctccaccaccacatcgatatatctcttcatgcgttttctcctccaattgattgcaaaaatcgatttcacactcatccctcatcatttccccatgatttgccccttaaattcggctttaattggccggatttaatctccatttaaccgtcgtcgatgatggcaggccagcaagctaacttggccatttttatcccaagttttgctcactccaattttggaaaaaaaggaaagagaagatcgagtggataaaaaccctaaaccaattttagaagatcgacaaagattcggacggatttgatggggagaatcaattatggtattgtacgagcacgacaccatcttctggaggttgaagacgtgcgacctagacctacggctccagctgtaggttggaccaaagagaggcaggccgagcggagggaggtagcagactgggctagggctgaaaaagaagaaagggattggctttcggcccaaaactaagaaaggagtataacgtatgctgatttaaaaacatcttatctgttgcaacacacatgcatttttctagtataaccctaagtaatattgattacataaaacatactccataaattttgacacatgacacattgacgagagagtactatatccacctatggtatttatagagtatgggggtagttggtgtcaccaagattgaagtaaaagagatgaaagacaaggatttttatacatggtcatgaccttaactaacaagtaatagccctgctcttcttggttgaagccggtgttgcctttatctatcaacatcacgcgagtataatatttgggatgacctaatctagtcactgttggcctagccgcatggagctctcacatgtggttgacaactagtgtaatcttatttctcgagtactatgaacttggtgaggtttgaagttgttttgtatttgtttagatctgtattggcttgtgttctgtcttggcctcccacttcttctagtgggacttgtatttatatcttcgggtgtgcctttttctaagtaaaactaagtaggcaagtattatacgatccaaatagtcctggtagtatcgagtagactctttttcctctttctttatctggaatacttttcgtatattaggattgattcagtataaaacttggtatatggtgggtcccaccgagtttaacacaaaaatatatattatatatgccttatctataacacttaaacatataatctcggatattatggttatagtgtttcatataaaccacacaccattgaccaattattcttttaccactgtacttatgaattaatctttttttttactcttttacctcatgtgatctttactgttttatttgtattcttttatatgaaaatatctccaacctctacatttaggatggaaccgttagttgaaatcctatgtatgttttttattcgattacattgaatactaaagatgcatatacacaccactacatatcatattcaaatacttttttaagtacgtggattctttaaaatcctattgaaggcattaggatttaaaacccccagtgggtgagttgtgcatcaataactactacactataccatcagtggtggatgtttttttttttgcaagtctaagactgaatttgacaattttagttaggcattatatatttttgaaaattctcatacaatttctaaagaaaattacatggagttttgaagctcaagcccaagatgtctcaggccctgtcccctacaccatcgatacttccgctgcatggtgtgtatgctactattttctttaattagcagcctacggttaaagttatttgtactctcacagtttcacttaaataattgtactagtaaattagcgggtcacggttcgttaagaaactttgtaacactattgaggaattagctttctatatattactccagtattgtctttacctctggtttcagtttgtctgttcgtgcatattgtacgctcggtgtggttgagagaagagaaaattagaaatttgagaagactgtacgtggaacccacgccgcacgctcaactacatggaaatgctgatctgaatgaactgtacgtggaaatgtcctgttctttctgcttaggggtttcggtggtcaaaattatcacatcatggtgggcgaactaaacaaactagggttagaaacttggatttcttcactggtagagaaaccatctttggtcggtcaactcaaatccacaatagtcccgattcctttaaaaaccgggactaaaaacgatttttagtcccggtttataagcgtaacaggactagatgatctttattcccagttggggttaccccaaccgggagtaaagatctttagtcccggttgtctctatgtcagaccgtgtcaggcggctaggatctttagtcccgggtggtagatctaactatattcctagttggtgttactaaccggaattaaaaatcaacacgtattatataatccctattacttatcctcttttcccgtccacacaacaaactctttctctatctcttttttcccctctaactccctatccttaccctttcttcttccttagtgccacttggatcggagcgagagcgggccgggcggcagccggcgcggcggcgcagagggacgggcggtggtggccggccgacgcggaggagaggccggcgcggcggtgggcagcggcgcggaggaccgcggcggcggcgcggcgtcaggcagcgccgcggggccggccggtgcggaggggaggcggcgcggcagcgggcgggcggcgcggtggggccgcgtggcggtggccggccggccggctcctctgtttgtttttttttaagaatttgtgatttattgcatgatcatgtgatgaatttgatttgtgtgtgatatgaacttgtgatgtatttgtgatgaattttgtagaaacttgtgatgtaatttgacttgtgtgtaattttttttaggatttgtgatatatttgatttgtgatgtaatttttttagaactttcagatttgtaatgtggacttgggatcttacttgatttgggatatgcataccacccatattcaggagaaaataaaaaaggatatgcatactacctagattcgggagaaaataaaaaaggaaaaaaacctagctatcctctttagttccggttggtaacaacaaccgggactaaagatactctatctttagtcccggttggtcccggttggtctaaagattcatctttagtcccggttatttcaaccatctttagtcctagattgctattcccggttggaaacccgagactaaagggggttcccaaccgggagtaaaaaggttttctctgccagtgctttgtaatatgagagttttgcaagatttccatacactttaattaaggggtgtttaaatcaggggtgtaaagttttggcgttgcacatcggatattatatagggtgtcgcacggggtgtttaggtactaataaaaaaactaattacagaatccatcagtaaaccgcgagacgaatttattaagcctaattaatccgttattagcaaatgtttactatagcacaacattgtcaaatcacggagcaattaagcttaaaagattcgtctcgcaaattagtcgcaatctgtgcaattagttattttttagtctatatttaatacttcatacaagtgttaaacgttcgatgtgatatggtgtaaaatttttatatgggatctaaaaagggccttagtttgatctcttcaaccttttcttttacgaaattcctgtcttgtgaagtatgttttccgtttacgttaaagtgacatgaaaactatactagtggctgcgttcgaatgtccaacaattgttggatgaaattttagattctcatggtatgcttttcaaactgctaaacggtgtatttcatacgaaaactttctatataaaggttgctctaaaatatcagattaatccatttttcaagtttgtaataattaaaactcaattaatcacacgttattaccatctcattttacgtgaaacacttaatcttcatttttaggagatacaaacaccacctaaccttgtaaactgagtgtaacttggttgggtttcttgtagtgaaactgttcatccgagtttaggttacatacttaacgttgatcatcacatttatacctaattattttctcagctggttaggttctttgtcttgtggtgaagctgttcatcatctgagtttaaatcatacacttagcatagatcatcgcatttatagcaaaatattgttttagtggtaggtcgtccgtcgacaactaaatatctatagttactttgctaatctcaagatatggctcacgttgcaaaatagaaactaccggaagatcgaacacctattcgcattaccaaatcttcagaggtgcttaactgcttaaaatactgacattcttccttaaatctcctttttgaaatgcatatattaccgcagttcaagtttaaactaattggagtgatgtgtgttagtctatctcaaacagggattgaaatttcgtttccctcgggcaagctcatatcttgcccgaaatttttagtttttcttgcaattttttgtgaatttagtcaaattttattcaaattcattgaaaataagtcaaaattttaaataatttcgaccaaaaaatttcgaaatttccgaaacttcggttccccggcaaaaaaaccaatttcgaaattaaaaaacctgatctcaaatactaatggtttacccatgcacagctgggatagtccatgatcaccaattttgataagtacattgcaatttgcaaatcaagactggcacatggattgcgtgatactactagtgctatcatacatgtgaacatttcaaactaggacatcaatcagaaaagtccaacgaaaatgccttctgtttccgaaggaccaattccaacgagatcagctagctagctaatgttcactggtcagtgggcccgtgggcctcgacgcggcggcccggtcggtgttcctccttcccttcgacgacctcgcctccctcctgctcgtcgtcgtcgtcctcggcggcggcggcggcagcctccttctccgtccgccgcttctccacggcggcgccgtgaccgccgccgcctgatctctgcttcttcgttgtcctgccggagcacgccgcgtcgtcgtcgccggcgccggcggcggcctcctcgaactcgaagtcctccatcctgaacgccggcctccacggcggctccgcgcgcctcgcccgcttcctcccgctcgccccgtcgccatcgccgccggcggcgccctcctccccgttgtaccggctgtacatgcccctcaacgcccggatgttggccagcagcgcgtagaacctctccacctgctcgtcctccccgcccaccaccgccccctcctcctcctcctcccgccgcgccgacaacgacgccgccgccgcgccgccgtcgtcgccgccgcagcctggccgcggcgccttcacgtcaactccctccatatctccaacgatgcgaggtgaagatagagagagagagaggagaagaagcgaagcgagaggtggaatggcggtggcgtcgtggcttggaggcgacgggtggtataaataccagcgagggtaggggcaggagggagggtgacgtgtcctgtggggaagccggcgcgcatgatctcgtgagagggggaactatagttttaaaaacgtgcaaacgccttgacccatcgggggcgatgagctggtctttgtattttgttttttttttactgcaaaattccatattgcttcatgcgttggacgaccaaacggtctctgcttctctggtccaatcctaaaaaaaaacccccaacaaattcgttagaataatggagagagaaacaaacaaacaaagctttagttcctccttcccgttttcatactataaattgttttgatttttattagctaaattttgttaagtttgattaaatttgtcaaaattaagaacatctaaaatactaaattagttccattaaatctaacaatgaatacattttgataatatgtttatttttatattgtaagtattaaaatattttttataagcttgaccaaatttaaagaaatttgattaactcaaaatgatatataatataaaatggatggagtaattagcatatgtttttaacttgggtttattcacggcatctgttggaaaatgcgttagaaactacgtgcgtactcctccagttgcgctagctggttcaaataatgagattctctgatactgatgtgtgtgtagacttttttttcttttttgacaaaaaatttctatgtggtatacagtggcattgttcatcgttgaaaatgtatatatatagtacaattttctgtttgacttggatcattgaataaacgggttttgttaggtctcaaaagaaacgctgagtcaacactataagaacggcgtttagggttgtcctacaattgattttgggagtggctttcaaacatgtatcataaattaaccatgacttaaataacctggtcctccaaaaacaaattcaaccagagatcgatatgccataatatatttttaatttaaacatttctggcaaaagtttagaaacaaacaatctgatgtcacagttaaattcttattacggcacgatactatcaagatatgatagaggagcatgttgaccccgtttcttaaaagtggtaggttgcacatatgtatatgagcacatgtgtttttactatgtggttcaaaaacaaaacttgtacaaacaaataagttaccggcaatttcaaagttttgtctaaatagttgaggaaaagatttcttagctaaattagtacaccttcgtctgaaaataacaacttttaaaacttaaaatttatttcaaacttaacaacaagtggtacttgacaaaaaaatatgacttttaccactaaactattcgtagtatcccaacttcaacttattcagacctatatcttaaccatgcatcccaataacacaaccaagtctttttacttttcttcttataatatctctgtcaaagaactaaaacttgctacttctacatattcgtacgaagagagtagctcgataaacctgtccaaaggaaagtgagggaaagataaaaagaagagaaagtgaaaaggctgcacacagtaaaataaagaagaagcaaaaataaaaaagactaccacccgctgcaacagggtggaatcggtggaggcacaccgatgcatgggtggtcgtccctttcaaatttttttttctgtactctgttcttcttctgacgaaaccagctgacgtcagcgacaacgtcgggtactaccctcgatcacctcctctctttgtttctttccagcgacgctccgcagcatccgcaggcggcgacggagacggattcgaagagagagaaagagagaaaaggcccaaaagatctcttctctcggtgacgtcacccgcgtgacgtcagcgtggctggtgtcaccaccgccgctgtactgtctccactacacgcacagtacgaccgcgacttggttcgttggcgccgttgggaggcaaggcaacagcgaccggtcggtcggccggtgccggtgcgggtgcgtgcgatgcgactgtgcgacgcgagtctgacctcgatggtgcccttcaggcacgcatggttcacacaaggggctacagcgaagttatgacttgttattatcgatcaatagtattatgtccgtcccataatataagatattttaggtggatgtgacacatcctatgacaatgaatttggacaaattaaccgtttatccagattcattgtactagaatgtatcacatctacctaaaatcccttatattatactccctccgtcccataatataagggatttgagtttttgcttgcaatgtttgaccaatcgtcttattcaatttttttttgaaattattatttattttatttgtgacttactttattatctacagtactttaagcacaacttttcgttttttatatttgcaaaaaaaaaattgaataagacgagtggtcaaacgttataagcaaaaactcaaaatcctttatatcgtgggacggagggagtagtaatggccggtgtggttatttcttcttcttttttttgggggggggggggggttggacaagtcatttgcaaaaattcagtagggtaaaaaaaactttttgacatggatatgcatcgggaaaaaaaagtatatctatcatgctgaatatcgagatggtaggatataaaaatgatttacgataactatttgagggacaaacgaatttggaaaaaacaatttggagaagtgctttgccaaaatctagtgaggttaacataaggatggattttggttgttgctagacgtttagagccccttattataggactgaaaaaggaaaagagtagaaaaaacgcatgattctagtaggaatgtaagtgtaaaacagtgggttgtaaaacacaagaaaaatacaagaataagcctttgattggaccgcaatgaaaacacatgaattggatgagagagatagactctaaggaatttttccaataggttgaacctcgtgctaaattttcttcaaggcttttatgcagtgagccatttcttaagaattttataggatttggaaaactctaatcctttgaatgaaagggctacattaaaaaaattactatagaatttcaattcgatgaaattcctccataattttttttattcaaagggacccttagtgatcagttgaaattattgatctgaagctaactggagtactccctccgtactcgtaaaagaagttgatgaggacatcacttcgtcggatatgctcataacttcacatgttccaatgataattccaagtccaagtccagttcggcctccggagacaacactgacttcaaacggacctagcgccttcatgccaactccgatttgggtgatcttggacttcgtggaaagcttatctcgctatctttcaaacgcatccggtctcatgtccaaattcatctcgagtcaacgggaatcgccaaaacaagacagtgctattgctgaaaccgaacttgggacttgggccttgtaatagactaggcccatctcggaagtgtctccctccacctccacgaattagcacttaaccctagctttattttcctctataaatagttttgtacatcctcaaaaacttttgggttttgtttagttgaattttgccaagtgtcattcaccttgtctctagtcctcgctcgattagtcggcgactattgatttagagcccccaatagttggtgtgttgatttgccgggtcgattagatctgccactttaatcgcaactattcctttgtgcttaatcacctattcgcaatatttagattgcatcttatcttgttcttacagtgttctctcgtttgcattgcagggatcatcaaccgcgcgtcacggttggtacgacatcgtttgtggtgtagcgattgcatggcgtcctggacttgttctggttggtagccacgtcaaaaacgtcgcactcgattaaagcgagagttatcccctcaccagaagatcgggccacgagagagagcgtcatcagaagtcgttttggacagcgacacggtctttaaaatacaactttgacttcttgtttctatgaaaatatttattgaaaaatgatatatgtatacttttatgaaagtatttttcaagacaaatctattcatataatttgtatattttcaaactcaacaacttgagagttattcatgatttatattcccaaaatttgacttaaacattgtcctaaacgacttcctttatgagtacggagggagtaccaaactaatttgaacatcaaaacaataactttgagggtagagagagatatgcctcatgttttctacacaaacattaatagtcagccaccaccattacttttgtaacttttataaatttatttatgatactttctaatattttataatagtgtaatatttatttgaatcaagtaccatatgttcaaataaacagacgaataatactaccatatttgataggaaaatattttatctatgacatagtattatatattttcttttacccatgacacaacaaagtatgtgcatttgactagttattaaacaatagaaaaattgcggtttgagccatcttttattgctaaagttttacctttgattacttttaaaccaatcatttcactttcaattaattttatcatgatttcgatcgcccaactctctttatatccatgtctagcctctattcacaaagatatggcctgcgtatagatcaatagatggaaaagttcaccggtattcccaaaccgatttgattgatgctgtcgatgtgtattgaagatgtttggaatggtccaaaccgcaaccatgacaaagtgtttcggttcatactgaaaatattagttttacggttgtccagattaaaacttgggtagtaaaatttggcccaaatcttcgaagaattgtttggtttgtggtgtgttgagcatgcgtcttgttttgggccaaatccagtccagaggtcgtgcgtccttcgcttgctccgttgctcggcccatccccggttgccgctgttcctactgggcttcaaccctgaaacggggttgcccagtacttgtgcagttcccatcaccatttctacgtcagttttagtgttttaccggccattgctgcagaagttagccgctgaaattcaatgtcatgttccaaatggatttcgcataactccaattaaaattataaatctcatcacacagcaaagcagcttagcataaattctgcatcgatcctgatgaaaattctgtcgaacattagcatatgtgatatggtatcattatttttcgatattttacacgtatattttgcaaaggtatccagaagcggagacacgtatgcttgccaatatacgtatacatacggacacgtggtcacccacagatacacgtacgtcgtcgtctagctgtataggtaaattttctacgcgtacacaggcgaggtgtgacgaagctatccagctgcctggcatcacatgtcgacggcgcaggtagggttgccgagcagcggcgcctccggaccgccacccgcgccgccgccgccgctcttgcggacgccgacgaggaggtcgcagcgggcgtacatggagtgccacccgctccggaacgggccggacacgaaccggacgcggccgagcaccaccaccctgagcgccaccacgccgtacgacacgtccgtggcgagcgccgccgcggtgtcgggggacaccgggacgggcggcgccgcggcgccggcgccgagcacgggcgccaccgccaccgcgctgtccgcgtcctgcaccagcggcggcatcggggcgggcgccgtgatgggctccccgcggtacgccacgtacgccgccagccggtcgtaccgcgccgccgaccgctcgttcgggttgcggatgacgagggtgagctggaacgacgcggccagcgtggccggcccgccggcgacggcgccggtgccggtgccggtgccgttgaggctgagggagtagacggcgacggaggtgacggcgaaggccgggcgggaggggcggtagacgaggtagagcacgagcgcggtgatgccggcgaggaggatgacgacgaggacgacgaagcagagcgtgcgggcggggtcggcagagccgtacccgtcgccatagtagtatccgtaccggcggcggcggcctccgggcttgaggtcgtcggcgtggacggccgccttcccgccatggttgtggtggtggggctcgtcggctggctccggcgggaggtggtgctcggccatgctctcgccttgctgtcgcgcgcggcgcgctctgtgtgtcagtgtggatcgagctgtgtgtaaggttgatgtgggtaggtgtaagctaggtagagtgacgtgtgcgcgccgcacgggcggtggcggtgcgtggagtttgcgcgcgtcgaggggatcgatggagcggcgttgtttggatccgatcaccgctcgatcgatcgagctgtctgcacgaacgcacccaccccgcctatgtcactcttcgaaaacggcaacgatgaaaaacatttgaattttcaataatcttatatttggagttgatttggaattttttttcagcatagtttatttttagtctttgattttatatcgttaagagcacgtatataaaagttttatttataaactattttatatttgtaaatatatcgtgttgcttttttcctctaatatgtcaaaggatgtccaggatgaattgatcagcagcggtgacatctgaaatttcactgagtgagtttaggatcaggtcgaatttctttcgagttgaaagattctggtagatgacgttgcggttaagtggtcgggctgggcatctgatgcttgcactaacctaggtggtgggttccataatctttcagctttcgattggagcatctgtgttactgtgtacacaaatgtaggtgttctatggactccaaaattcaagttaacttgggtcgtaaaaccttaagttttattcaggtggtccatgcatgtaaaaacacgcagaaatagcttcacaaaaatccacgcgcaggttgtccaaatattcaaaaccttaagcaaaatcgacctacggtgatcgagctactccgttcgatgaaacatgcagttttcaaacaagtatacaccattctcatcaaaaaaaaaaatcaacttcgacgagtacaagttcaaatttttctctagaagttatttttaacgacgtaaagagtagcttgcaaggaaattgactccaaaagtcctcaagtaaccgatccaatgaattaatcatcagaaaagaagtgaaaaagtccacttttaactcctttataatataggtaaagtccactttaactccttcataatataggtcggatttgattcatatccctcaaccttaaaaccagttattatgactccttcaaccattaaaaccgtgtaaatagactcgctcggctgttttaaaggcagttttcgctaacatgtgacatcccaatcatcacaaaaataaaaaaaaatagacacaggcccacatgtcttcttcctcctccctcttccgcctcctattcacactctcagtatcacgattctctcagtggaggagccttgggaggttagaggagatggggctcaagtgttggtgctccgacgatggaacaagagcgattgagtgtgtcctacgactcggctcatccaaaggtggaggtttccagcgaggaagatagcataagcacggcagtcaagggctcggttcggtggagagagaagagatgccaacaagctcagatatggatctcggccttccaagggtgtcatcacgcgtcccctgtgacaaggaactcgctttctatgttggagatgttgaggaggtgtgggtgaggctagtggctgtggagtggatctagagtagaggagcagccatgggctcatggcgacattaatgacgatgaaagacaacagaagattgtgagggaatcctcaccaaagtagcgcaaagccggtgtcacagtgggatggcatgagacggctcgtaacggtagatcaagatggtaggcttagcggtggtttgcatgaggaattgaggagatgggcctactttgattgcttcgggtagaagataggaggattagggaggaggggggagggggagagtcgcaacagaggaccacctctgcctcacaattcgattgtgaattgctccacggctttactggcgaccccaccaccgcccagccctaggccgtagaccacgcgagggcatggagctccacaccggacaacgccacgaagtacaagcactatggagcgcgggatgggaccaccgcctattgcaggcagcggcttgcgcggaggggacggtgttgtgaaggaggcgtcccaattgccggagaggaacgcgcggacgacctcggcgaggaggaagcgactttttcttctggcttttttcccttagcacttacatgtgggtcccactgttctttttaattttttttatgattggatagccacgtcagctaataccaacttcaatattatcctaggagtcattttgtaatggtgttaacagttggagaagttattataaccggttttgtgtttaagggatacaaatcagatccgaggtataatgagggtgtcaaagtggattttttcccaaagaagttgactagataattgggccttagttttgtggcagctgagctgaactggcccatagccgttcatcgacgttccatagccgttcatccatttatttacgggcccggcaggatgtctggatccagcaaatcaagcccaacatgtaatttccggtgtgtcgaaccgtctgtatgggccaggccggatccaaacaccgagatggaaaaccaacatgaaatttccgcgcgccacgcgcgccccttccatgtccggaacgacgcccaaaggccacgtgttaacacgacgcttcccctacacctcaccgcccgatcggaacaacggacggctcagatcacgccgctgacgcgtacgccccgccgcagagcctcccattggacgctacacgcacgcgcggcgccgcgccggcgcggccacacccaaagctatatattgagccgccccccccgcgtctcgtctctcacacacagccatggcgcgcggcgcaacgtggacgcggcggctgcacctgcacggcctcttcctcgccgtgctcctcctcctcacgttgccggcgggctccaccgcggccgccggcggcggcggcggcaccgtgatcgggatcgacctcggcaccacctactcgtgcgttggtgtctaccggaatggccacgtcgagatcatcgccaacgaccaggggaaccggatcacaccctcgtgggtcgccttcaccggcggcggcgagcggctcatcggcgaggccgccaagaaccaggcggcggcgaacccggggcggacggtgtacgacgccaagcgcctcatcggccgccggttcgccgacgccgaggtgcagcgcgacatgaggctgctgccgttcgctgtcgtcgacaagggcggcaagccgcacgtccgcgtcgaggtgaggggcggcgacgtgcggctgctcagccccgaggaggtgagcgccatggtgctcgccaggatgaaggagacggcggaggcctacctcggggaggaggtcacccgcgccgtcgtcaccgtgccggcctacttcaacgacgcgcagcggcaggccaccaaggacgccgccaccatcgccggcctcgccgtcgagcgcatcctcaacgagcccaccgccgccgcgctcgcctatggcgtcggcaaggagggcgccggcgggaagaacgtcctcgtcttcgacctcggcggcggcacgttcgacgtcagcgtcctcgccatcgacggcggcgtgtacgaggtcctcgccaccaacggcgacacccacctcggcggcgaggacttcgaccagcgcgtcatggagcacttcgtggagctcgtcaggcgcaagcacggccgcgacatcgccggcgacgcgcgcgcgctcggcaagctccgccgcgagtgcgagcgcgccaagcgcgcgctcagcatccagcaccaggtgcgcgtcgaggtggagtctctgttcgacggcgtcgacctgtcggagccgctgtccagggcgcggttcgaggagctcaacaacgacctgttccggaagacgatggcgccggtgaggaaggccatggcggacgccaggctgagcaatgccgacatcgacgagatcgtcctcgtcggcggcagcacgaggatccccaaggtgaggcagctgctcagggactacttcggcggcaagcagcccaaccagggcgtcaaccccgacgaggccgtggcctacggcgccgccatccaggccaacatcgtcggcggcgacaccgacaacaaaacccgcgacatggtcgtcctcgacgtcacgccgctcaccctcggcctcgagaccgccggcggcgtcatggccaccctgatcccgcgcaacacgccggtgccgacgaagagggcgcagctgttctccacctacaaggacaagcagaaga

SEQ ID NO: 47917 - DNA, 6112 bp, Oryza sativa
ccgacgaggaccgccgccacagggagcgcgccggcgcccggaacagcctggaagcctacgtctacggcgtcaagaacgccgtggtgggcggcgagatggcgggcgccatggacggcggcgagaaggagaaggtggaggcggcggtgatggaggcgtacgagtggctcgacggcaaccaggacgtcggcaaggaggagtacgaggagaagctccgggagctggaggacgtgtgcaacccggtcatgtcggcggtgtaccagaggtccggcggctcacggcgagatggcgacggcggcggcgacgacgatcacgatgagctttaggccgccggctagctagaatttatttttgttgttttttttctgtagaaaattataggcagataataaccctccctccatctatttttgatagtaatatttcatcttgacgcacagaccaatgataagcaattccgttctacttatcatccatttaaacatgctgctagtcattcctcgtaaacaagcgattcattacttgtgtgtaagaatggagagtcatgcattaaatccgagaaagtcattaaaatgatatgttgttccgttgttgaattgaaatatgactatcacaaataaatttttcagatttgaaaacataactattaaaaatagatgaagggagtagtgatatttactacttacttgcatttcatatatttttaagatagtggaagagtttagtctagcttctgcacatttgcaattcaatcaatgttatgaagattttctgaacatatgagggcgtataaccgacaatggtttgtgtttatgacccgattagttgtttggttactgccaatcctaacaagctattcggcacatgtagccctgaaaagcaaagcaaagcctcagtcattccgatactggcagtcttgcaatttccctttgttttcagaacagaaaggggaagaaaaggaaaacatatataacaatttgatgtatcctaattctcaaatcgaaccggatttgcattgaaaacactggtcaatccaaaatttcaaattataactcttattgaccaaattcaaacaaaacataatctgcaccaggaagctctgtccagcaggctccaaacggaacatctgcagaaactctgagtaacaaacctgagaactgtatgatgtaattttcacggacccatatgatcaactcatcattaagggtgtgttcggcaacacgtacaggttcccaacttctcccctcatattccgtgcgcacgcttttcaaaccactaaacggtgtgttttatgcaaaaagtatctatacgaaagttattaaaaaaaatcatattgatctattttttaaaaaataatttgctcatacttacttaattacgtgttaatagatcgccctgttttccatgcgtgagggatttgctcccatccagaagtctcttagcgaaaatcatcatctacatttcggcatgctaacacaatatattcaagacggattgaacatgtgaactgaattttatttaaggactgactgaaatagacaatccataaagcgagggagtcgagaatcattttaacaatagctccggcctccagagcacatatagaacatgacttggttaatcgggagaaatacagagataagcagaacttgattgtgaacagatgtctttgggaggaaaaatctgatataatcttatccatgggcaaagcctcgttcttttgatattttcacaacggatgttgcgaattcttgcgaaacaaaattaaactagtgggagagatttaggacaaataacaccgattaatgttggaaaaataaataatagcctgctacagagcatattgtacatatgaaaagaaaaaacaacctactgctggagctcgagaaacaatactaccctgctacgatctcagtgccaggtatttttctatgaaaatctccagaccaccaatctagtcccgagatactggaatatttattgggactgtctatacatgacagacaatcccacctctcatcttttaaattttggaccgttagatatgttttaggattcgtacacagctttaaccctaactttttttctcccattccccacctctttgcgcattccgccgccgccgctaccctcgcacgtcgccaccgcccgatcccctgccgccacccgcctcgccggctggccggagggcgtcaacagcgtcggcgaggcccccctagctgctagcctcctccccctcccccctccttcctcctcgagccgtcgatggggagatgcccccgccaccaacgccggcccaccaccgtccttcaaccccgcgactccggcgccgccgccggcgcctcgccgccgcccaccaccgggctgccgcctcccccagccatccctctaagcccgacgcactccccttttattcctctccccctcccacccttcccaccccaccccactccgggaccctaattcttcggcccttcgccggagttcgggttgtcgccggtgtcggagaagaggagttcatcggagttagagaagaagcagctgaagcacgaatcgcgaagcacatccagtgaaccaaaatttgcaagatttggaggtaggttttctgtcgactgaagtttagcaatttcgatatttattccattatcaaaaaagattcgtttgcaccgtgagtacaagacaatttgatcataaaggtgttaccccaactaatatcataagaaatactatgcgaatgaagtcagctgttgtgttgacactgatattggctttatgctaaaatataaataaaaataatatattaatgctttcactttgatattagcatatctgaaatacaatagataatacatcgaagaagaaaatatatatcatgtgtataaagcaggaaccaagtagaatatacaagtagtcactcttatagggaggaaacagtagaacatcaagagaaaattgaaaacgaagatatgctttattatttcggcatgagttggagatgcacggttacaatagtccgaatctgaaaaacagtgttgtacatctctaatatatgaggaatgtctaatcaggtactatgatattacaccacttggaggaggacctatggggtcacttgggcctggagcagtatgatgaccaccacggttatatatcacttggaggagggcctatgggatctatggggttactcgggcccggagcagtgtgatgaccaccacggttatatatctcatcatttggaggagggcctataggatctatggggtcactcgggcccggagtagtgtgatgaccaccacggttatatatctcatcacttggaggagggcctatgggatctatggggttacttgggcccggagcagtgtgatgaccaccacggttatatatctcatcacttggaggagggcctatgggatctatggggttactcgggcccggagcagtgtgatgaccaccatggttatatatctcatcacttggaggagggcctatgggatctatggggtcactcgggcccggagcagtgtgatgaccaccacggttatatatctcatcacttggaggaggatctatggggtcactcgggcccggtgcagtgtggtggccaccaccatgaccatatatctcatcactcggaggatgacctatggggtcactcgggcccggggtagtatggtggccaccaccatggcgatatatctcatcactcggaggacctaaggggtcactcggacctgggacggtaccaccatgatgatatatctcatcacttggaggacctagggggtcactcgaacctggaacagtacctccatggtggtagatttggtgcaaacctcccgcagataaaacttttcgaccaccaacacccgaggaggaactgctacctacaacttgagcaattggtgttgcaatgaaacccaagcaattggatatgagcatagcaacgatgaagtaggacatcgatgccatttttcttctactttgtatgtatcttcctatgtttcgttgtaagcaagaagtgctcacgcagactgatatatatagagatctcaaaggattgttatgatatcctaatcttttgcattgatttgtatcctcaaaatatgtttaggcaatacatcaatgtatgcttttactacatatactgtctagataagctattcttattaccttcttatcttagctgcccttgtttcctggtctttcggaaaatgtgatatactttaatgtggagcataatctcttactctctctgtcctgaactataataactttagggtatgtatctagacatacataagtccaaatacatagctatgactagatatataactaaatattactaaattttgggataaatgtagtagctatatttagaacttatgctgatctactttaatgtggagcataatctcttagctatatttagaaatgatttatttaaatatatagcgatgccatggtcatttttctttccttttctcttagtttcacaccattcttaatccttgagtaaaaaaggcttgaattataattaaaaaagaagggagtaaacaagaattccagatgaaaaccaaataaaaagaatttgtttggtgatatcaaagatctcgattttagaaatctacgaaaggaaatcactaatacatcactactacaaaacatcaaatagatgtcggcactatatgtgccggaagtggtaaaaccgacacctatagtgcttttcccaccttcataagatgaaaaaaaaaaattaaaaccgacacctttaaacggagataggtgtcggttttagagaaaaaccggcatctataataggtgacgcttttttttaaaaaaaaatgacacctataatatattataggtgtcgtttttaaaaaaaacggcacctaccatatattataggtgccaccgataaaatcgagccgagccagccaagggagatatttttcctcccggtggggcccacacccacacctgcaggagataaggccgagctcggcttctcccctcctctcttctcttggcttctcctctcctctctctctctatccacttctccccttctattggcttctcctctcctctctctctctctccggtgatagtgggaggggaggcgcggtggcggcggcggcgaacggtgtggagacggtggcccgaacctcccctccgccagttcggacgagagaggaggtccagcggcggcggacgacatggaggcggcgggccggacctcgcctctgccagatctagcagcgtggaggcggctacggctcagcgggggcgggagggggcggcggcccggacggcgtggaggcggccggccgggcctcgcctccgctagatctggcgacatggaggcagctgttgcccggcggagattgaaggggcgacggcgccacctctttctctctatctatctatctctctctgtgtgtgtgcgcgcgcgcgcgcgcggtgcatggcatggaggtagcggaggttcatgtgtgttcgtgtgtgttcttggttgaaagttttgttcatgtgtgttcttgatggaatcagtgtcggctcgaatcggctcgatgcattcgagccgaccttttttccaatcctggaacctcaaaggtgcccctttgattcccccacatctatgccgcctatagggtgccggttgggaaatccggcagctaagaccggttcccaaccgacaccaatatgccattctgtagtagtgtacactgtaataacaaacaacgaatgatttcaatgtttaggcatatatcatttccatcaagctatcaaccgatcgagtatccacctagccatgtccgagtacctatgcatcctggctatgccctgagtccaattcaagcaactgccttgcctacaccatatgccaccatctgcctctacgctgcaagacggctcaattcgcggaacctctcctttaccatgctgcatcttccacacgatcgagtcgccaagtgcacccaagtccatgccaccaaatacttattagtccactgctcatattgactttaatccaactcaactagctgtgctagtcctactcgtgaaccaacgtcgtagttttgccaagcctcatatgcatgcaccacta

SEQ ID NO: 47918 - DNA, 3265 bp, Oryza sativa
ccccaaattttcaaacacgcgctgcccattcaacacgccagctcgcacgaccgcgacgagcccacgactcgcaagtggcaccctccccgaccccgatcggcgcgaagccacccacttccagccctcgccgtcgccgcgccgccgccgccgccgccatggccccgaggccggccatgtccactcctccgccttcctgctgccctcgccgtccgcggcggcggcgggcgccgacgccgactgcgccgcctactcgctcctcgtgctcaaccagcgcctgccccgcttcgcgccccgcctctgggaccgcggtagtagaatgccctcgctcgccgggcttcgcgcgtggctcttctctcttctgttctcttcttctcgatgctgactgactgacgtgggcgcctgcctccgttctcgttctctctctctctctctgcagcgcaggtgcgggtgtgcgcggacggcggcgccaaccgggtgttcgacggcatgccggagctgtttcctggacaggaccccgacgaggttcgccgcaggtaacgcgatctgatcccggattttttttggggggggggggggggggatttcccgccccgcttcggtttcttggatggatcgtgcgcggcgcgcccgcgcgcgcgtgttccagtgttttttttcctcgtgttcgtgttcgtgctcctcgacggcggcggccgtgcagcgaggcgttttggattggtcgagatggcacgcaagtaactctactgcagtaattttagcttcttgcctatctgtgcgacccccccccggcgccaaaatggagtctcggttcagcaaccgatgatcctctccatcttgttcggggcttattagattgatgccattttcaatcgtactactttatattattttttagcaaagttgtataaaaaaacctacatttagtttgttacaaattttgataaatacataagaaattctgccaaaattttgataatattgctaacttgttaaaattttgtaaggtttattttattttaactacgattcgaacagcctcttcatgtcattgaggcgccagtattcgtggtcaaaagttcaggagttggattcttggagatgggagatgcgcagggggttactatgcacatggcatgacggataatttagtttttgtcttcttgggggactttgcgatgcagttcctgtgggcggtggatgtatgcctctgtttaattcattaattggttgctccctgctgcgcttcgcatgcccactatgtgctcgatggaatgccttctttgtgcttccctcatgctagagcttgacacgagtataggtatatggtagtatattcgtgtggataaaggtgtagcactagttgagataatatgctcttaagaaatgagaattcagtcgtaggatcaagctgcctttctaattgtggctcccatcggatggcctattcggtaaactgcttatgctggtgctgagattggggggttataggtagcctaatcccatcttaatggctattgggtacaccaaaggccttttttcctaatacaactgttaccggcaagtggttattctagtatgttagaacttccacttactggttgaggtgcagtggtttcagaactagtggttgatgcattaccctatttattatttattgtcatattatgtatgaatatccttgagctatgagaagcttttataccaagtttattgagaaaattcgaatcatagcacaggaaaaacaacggtaccaaaaaatagcacaaaaaattttcactttcgatctatagcacaggccaccggtttttctttgccccgtagcacttccgtcaggtttggagttgtgatggagtgtttagccgtgactaaggagttcaaaatactaatttgcccctagcatggcgcccaagtgcaaggcttccttcttcctctgcagcctcctctacttgctcctcctggtgctcgccctgtacgtcgttgccctcgccgtgtcccctttctactcgggtagctcatgcctggaggagagccttggcagtggtgccgttgcacatctcacggccgccggccatgctggcaacaggcgcaacgcctcgtcgctgccggtggcacggctgaaaccgatgccagctgatgatgccgcgtcgatcgggctgggccatattgtgttcggcattggtgcctcgtcggagctctggaagagccggagggagtacatcagaacatggtggtggccggcgctgatgcgcgggttcctgtggctggacaagccggtgtacgagttctacggcaggacgggtgaaatcgaccagtacccggcgctctacggcagcgacgaccacatccgcacgtgcatggcagagctgggcatgctgcagacggcggcgctgaggcggctgttcgaggggcccgcgaggctcggctggtgtggcgcagctgtcggtgtccacctctccgtcagcggtgacggcgagctacgcgtccacgccgttgaagagcatgcgcagcagctcgctcagcggcggcggggagacgaggcggtcgcccgatggctgccgcgccgccgtccatgagggagcgaaagaggagacctgatggggaacgaagggcaaatgagtccgacgaaaattttctccactccgatctaacgccgttacttcaaaatgtgacggaagtgctacggggcgaagaaaaatcggtgacctatgctatggattaaaagtggaaactttttgtgctattttttggtaaaggtttctttcttgtgctatggatcgaattttctcaagtttattatatccgcacagacaaaggttgaacaagaatccgtcttatgttccaaattgcttatgcggaatcagagtttgagagatggtcacatatttcagatgatcttaatgggtgataatcggaaacaaatatcgaagtattttgggtttgcctttttttacaaaaagatttctcatgtaaaattcacaagtgttttggtgcagatacaaaccagatgtaatcaaaggagatctggactcagttcgaccagaagtgaaggaatattattccaatatggtaaagtaattcaatattttccatttagtcacggttaattaaaaccagatgtaactagtttgggatatggactcaagtataaccagcaataacaggatattactctaattcataaacttctttaatatgttccatccagttttcgttagtcaaaacagtatgattatttcagccatattatctagtaatattattttca

SEQ ID NO: 47919 - DNA, 851 bp, Oryza sativa
tctcagaatagtttttctggtaggaacaaaagaacagtgttaagagttgtcttagattacttaagaacatttagtttcattcttatgtctaatatagacagctgctggtatcttctataggatatagctcacattgccacggtagtatctatttttgcaaatattcatattgatatgtttcatgcttcggtcatcagatggcatgaagtatcttggtataggacttcaaacaaaaatattcctttctcatgcttatctgatgaaacaattgtttttcttgtgaaaattgcagggtactcaaatagtcgatgagtcacatgatcaggacaccaccgatttacacaaatgtgtagcttttatcactgagaattcggccatccccaacaaatctaatgtaaacttcttaagctcgataacgtggtgtcattacccaccatcttcacaaaatttactgccatatttgtcttttaactgcagctgtgtatctttgctcttggggcccttgggggaaggtttgaccacgagatgggaaacatcaacgtacttcatctcttcccaaacaacaggatcatactcctatcggatgattgcttgatctttctgctgccaagaacacacactcataacatccatattgaacggtctattgaggggccccactgtggattgattcccatggcgcgccttcggccaccaccacaaccactgggcttcaatggaatttaggtaagcctcccacttcatcaattcgacatcgacaaataattggtgcctaaaaatctgtaaatttcatctccagataataccagcatgagctttggtggacttattagcacatcaaacattgtgag

SEQ ID NO: 47920 - DNA, 4220 bp, Oryza sativa
cattaaatatatttaacacaaagtacaaaaatatgatattgcatggacacaataaatcttgataataattaattatatataatcacttcagtatacaatataaagggaaatatacatttaaaaaatatgttaaaaagtatagatttattccattaatttgttgcgggcataaacaactaaaaaataaagtaggtaaataactatcctaatatttagcatttgcaatacacttaagaaattctcctgcaccgctagtagcatgctcgtactaacactacggtgacatttaataatatacgtgcacgttctatttttgcaagcaacatatatgtaacaaatctctacttatatatatctctcttatctactattataaaaattatatatatatctcttctctactattataaaaattgaatatgtttctaaattttggtatgtcatccgtgtttgaatcggctttaattttatatttcggttttaatctctactattatctttacctattaaaaatgttgcagatgattacatactcaactaaattttcgtccgtgcctctctactgacaacacaactaaaataaaccggactatgatgacttgtgttcactactccagtttccccacgtgcacagtaaacatgaaaaacggagcggtccattagtacgtaattaattaagtatttgctattttttaaaaaaaatagaataatttgatttttttaagcaactttcgtatagaaactttttacagaaaatataccatttagtagtttgaaaggcgtgtgcgtgaaaaacgagcaagatgggttgggaaaaagggtttgcaaacacaccccgttcggactcaaaaaagaaaaggccaatcaagaaaacactaatgactctactaatgaaccgtgactaattaacctatcaacactgtaattgaaccaacatatcttataactacctcaaaaatttgtaactttcagttcttcacatcaatttttcgtccgtgagtccaatcgaacgatggcctccgtttccatacacacgagtaactcatcacgtaagatggataaaacacaaattcaaaaatagatacaaaattcaatcagataatccaaaaaaagagaaaaagaacaggaaaaataataaaaaaaagcacaaacctatcttaatttattctaaatgctacctctgttttttaatagatgacggttttttaatagatgatgccgttgactttttctcacatgtttgaccattcgtcttattcaaaaaatttacgtaattataatttattttgttatgagttgttttatcactcatagtactttaagtgtgatttatatcttatacatttgcataaaatttttgaataagacaaatggtcaaacatgtgagaaaaaataaacagcgtcatctattaaaaaacggagggagtatgaaacaataccaacaaattttcggtatttctgaggtgaaagtgtgacattctatcgaagtctccagcactaagtgcacttctatgaaagtaccacatccaaaatgagcatgctaggcttgaatataccaattttccccgttggtaagaacattcccagtagtctgggcatagtcacaaattcagtgcgcctagctatgatgcttttgaaccatcctggacacaatacgatcaagcacattttgaactatgcaagaaggcaataaacaccatttatcacctacaattagaatcctgtctataggtgctatgaaggtgaagcaaaccagctccttcacctacaattagaacaagatattagtaagaaagaaaaatcttgagtaccaggaataaatttaaacaagaaaaccaagactaaggcttaattacatgtcaaatttattctaaattgaagggactctgcagctgaaatctaatatcagtaaaattacttatccttgccaatcattgcctaaaataatccaatcttctttattgcatttctatgtcaagaaaacaacaacaaaaaaatcacttgaaggcatctccaaccctccttcacaatttactgataagggcacatctttgagaaacataaatattacagatatgttagttgctaacttaagacaccacagctcaagttttgggatctccggagtaatttatgctgtctcttggaatgaacatccgaggtagataaataagctctttacatgatataagaagcaacaagaaactgaataatacctggatataattgtgtttccgaaaaacctacccatctcttcagcctgaatgaaaagcatgaatttgatgatgattactaatgtaattttatgaactttgtccatgttgtatctaaataaacaaaaataaaaaacagtattaagtggtggttagtctctaccaccaccatgggatcttttgtaacacattatttgaatattgagagaggagagttttttagtctaaactccagcatagaccaaaggttttcatactaaaatccagcatgaatccatgttgttgtctaaaaataaacatattaggtttatctaaaaaccaattctattcaaagcaatacaattagacaggcatatatacgcctcatcccattgcacgaaatcacattcagcagtatcatttaaaaaaatccgatcataaactcatgtttttttggtagtaaggataacctgacctgatcagtcagctaccttgtggagcagatgactactgctcttggtctccctggcttcgatgacatatccaaatattgcttcatcatgaggcaatagctacagaaatgaatgacggtgcaataaacacaaataagtaccaataattctgcataacatatttggggtgctacagacatatcaaagcagtattcaactactgacagattcaaaactcacgcatatgctcagctctgccaatcagggcaatctgaattatatttgctaaaacctcaacacaagtgagaccacatgattgcatgaatccttacatccaagtaaaggaaatgcagtactaacatttacgatttcagccgctaagttattatactgtaaagcttactaatcagtaactaaagaatgcacagttaatcatccctgaacagagccaagtgcatcttaaacagcagatgcgcacgtatcatcgagctaagatcctgcatatgtcaaaattaaccaaaatccacaccgcctagtttcgaactaagcaatagggaagattttgtagactgatgcaagcaaatcccaattcacaagtaaataacagtaaacttcaattttttgatcatgcactcaacatttgctacaggtggctacatcgatcttaaagtaacatcatgaagaatttaattattgtgctaacaagtagcatcttatttgggatgtaattgcactcctgccggatccaatgcacgacgtccagccattaatcctttgcaaagcccaaacaagcaagcatcaggcaggaatctagaggcagaccattagcaacaagaacagcaaagcagtgaggaaggaggggtgctagtgaatagtgatacattgttccaggaggcctccgagtcgtagtgccggacgagcttggagtggccggtgcctttttctgctggtgtgcctacgcgcgcaactatttcgataatggcttggccttcctcatctcggtcgacagcggcggtgcgggattcttgaggaggccggcgaagacgtcgacgacgaacgaagagatggaaacgcgtcacgtcgcgcatcgatggcgaggagtcacggtggcggcgtgatccttggcggcacgagagagtcatcggcggcgtcgcgacctgacggtggtcggcggagcagtggagggggcgcggggccgatgcgcggtcaggggcggatgggtgcgcagaggcagatccgcagatggaggcacggtgcgcagagaatccttgagggcgagggggtggcgtgattgacagagaagtgggggatggggtccatacggaggttgagggggtgcgtggtataatgtgatccgttggattggatgattctggccgttggatttgatgaatgagtaatgtaggtgtaagagtgggttggtgaattatagggtagatgaatagcatgatgatagtgatcagcctttttttcatttctcctgtagtcctgttgagctcgacattgctgtcatcagtccaacttctctgtactttttttttatgctttactgtcggcattaagctaccatagtcct

SEQ ID NO: 47921 - DNA, 2293 bp, Oryza sativa
cttttgccttatttgagttaagataggagaccctactccatttagggtctccgtcatcggcgccttacggagctccgccaccgtccttagcatcgcacggagcttagccaacgtcgtcgacgccgcggagctcagctgcgtccgtgtgtccaccgtcatcgaagacgcacggagcttgctgctgccgtcgtcgatgccgcgcgaagttcctacgcgcgtccgtgtggccgcctctgccttctccatcgccgcatgcacaccatcgtcgatgctgccatcgatcgcctgcgtctgcctccgttgatgaaagagtagagagagaagaagaaaaggataaggatgcggtttgctggaaatgagataagcgtgtgggagaccgatatttccttcccgcatcggtcgcccgataataagcattttcgtatggattaggttgtgaattgggcaatgctcactaggaaaataaggatataattcaagtagtccttatcggatccaaatcgaactctatatctctctttttcttatctaggacttctttcttatctactcatcactttatccatatgtacgagggttatttttgtataggacttagtatatgatgatcccatcgagctaagaatacatgtatagggtatcccatatctagaacactgatgtaaagatcatgcaaatatgttggatcatctacaatttattaccccctccaaaacacagggacttttaggttgtttaggaaatataaggttacatttcttttagtcgcttcagttgttaatttaaaaattttgaattgcttagattccatttgcaagcatgtgattggcttcggaattattgaaatgattagaaccgtgggaatcaatgcaagaatccttatagcaagtttaatagtatagccaactattagctttaaattatctatagtcaatttaatagccaattcattcaatagttatctataaacatatactacactattaatacttggtcccacctgtcatacacatattacatcttggagtctgtgttgtagctggctataaatctatagcccgctgctcttatctctcctcttttatctacttgaaatgtatttatagctggcttatagtctgttattgtacgtgctcttatattgtgagacagaatttgaattatagagatccttatattttaaaacgatcctcattattgtgatacaaaatttgaggtatagaaatccttatattctaaaatgagggggagtatattttaaggcccaattaatatacaagtatgtcaaaacatcatctcccacatccttttcataatattttaaaatatatccatccaccatccatttcctctaaaatatttaatatatatttattcatatatttcgtaacaaagcacgagacattattggtatttctagttttaaaacgcgattacggccctgtttgagggagtttaagattttgagaagcagttggttggggtagccagcttctgagaatctgaaaaagctggattttccggcttctaacttctagttcattttcttgattccataactacaatttttcataattcggactaaaagttagactgtctagggaattcctgattcggaaagaagctgctgtagctacaagcttcccaaatacggagtatgtcctatatgttaaacgtgcatggcacccggcacgcgtactagctagtggataaattaaatatggagtaactttaaaagagtgggttggagatagaaagagagattttttagggatcacttggagacagtgtcccttggagatagtgaacagtcatctctatcacattttacgcggttataattagttaatcgcactcttagagcaagtaaatataatatagagtaagttcaaaagagtgggttggagatataaaagagtgaatttattttagggatccatggagtcagtgagtccctcttagacagaacggtcgtcggtcaagtctatcactttttacgcggttataatttagttaatcgctctcttagagatagtactgaaagcaaaagcaagtactgaagtacttgccctaaataccttgtagagtaatactccctccatcctaaaatataaaaatattgattagatatgacatatcctaatactatgaatctagacatgatagtattagaatatgtcacatccaaccaaaatccgttatatttagggacagagtgaatatgctgatatggaaaaaaaaggagaaattggagccacctctcatgtaaggataacttaaactagaaaaaaat

SEQ ID NO: 47922 - DNA, 1831 bp, Oryza sativa
agcttagctagaatggcgcgaatgcttgagaccgtgtcggagatggagaacaccgaggcggccgatggagatggagctacagctacctggagaagatccggtgcatgtccacgggtggcgggtcgtcgtctcgctcagtgagatccagtaactacagcagcgcgtcaagcaccgcgtccagtgcgcgtcctaggtacgtcccctgctacgatgatgctgatttcgtgacctactccttccagagggcagtaggacttggagcccccggacctgctcgagatattcgtgggcagcttggtgagtgagttcagccgggcatccggatccggccctgcgctggacaggtggttctcagaactggacgtcagctgtgtactccgcaatgatcaggaggaggaggaggcgaccgggagcctggtggggaggtgggcgcgagctctcactgtgatggcgcgcgcgctgatcgccacgctccaggaccaggaggacaacctcaccggccgactctgccaactcgggcggcttatggaggcgagtttctccaagatccaacttgcacagttcgcgcaggcgactttctccaagatgcttgcctttgccaacgccctcgctgataagccttggacgcggccaacggacaagttctcggggctcatgcaactccgcatctgcatcaacgacgtctcagatatcctcgtcccgctgtacaatgaggttttcttactagctgattattcaaaagaaataattgaaagcatagtaaaggagatcgatgatgttttctgggtagagccatattgatgatgacgacggacgccttgagccccccgagtggaccatttccggacaatgcagaaatccacaaggctactctgttagctgtcaactatgcaatattgttttggggataccatagcgtgctggaggccatcctacttgataatggcgatttgtttggtaattgcagttggtattctgagaagctagtagtagaaagattgattgtgcaaattataaccaacttgcaggatgagctcgagaagaaatccaagttgttctctgaccatagcctgagatatctgttcttgcttaacaattcctacgtcgtacaatatcagtttcttgtacccagcgactacagccctccatcggaaataaagttccactatgagcagtaccaaaaagagtatatgcgtgcctcctgggaacctgttctgtcttgcctacacgataagatgccaccgtgcttccctaagctctcatcgcattcggagctgtcaagattcgagttggaatttgagaaaacatgcagtcatcagaagctgtggaaggtcccgcttccgaatcttaggcagagcctgcgagaaaccatcattaataagatcattactagatacaaaaagtacatggaggaccatccagagcaggagaaatgcggagagatccactggacatggaaggcatggtgaatgatctatttgaaggatgaaggggttgctacagtttcagaatgacaggcccgcacaaatagagtataagttttaaagcagctacgaagaggaggccaaggttaaataggtgttcttgatgtcctttttacttttaccgtattttgatgtcgggtgcaattgtgttcttatcccttgtttcttaactccagcggtgattttacccctaccattttaactttgtgattttatcatcatttttagttgaagcttgtgcctgcgcccattccattaagaggacttaaagttgtaaaagttcatgtcaaaaggggcaaacttcatgttaagcttgtactcgccctccttttttttaactgaatatg

SEQ ID NO: 47923 - DNA, 1319 bp, Oryza sativa
agggcgaatccacccaatttcccacgcacgcacattcataacgaacgacgttgtgattggaggcacacttttttccttttgggctagcccccgagtaactaccatcaggcaccagggtaacatacaaaaggagagaaggccccgtgcatggacatggcgatatctcgcaccgtaagtaccctactctcccaaaccttaactcttatcgcccaatcattagggtgctggaagggaccctaaggaccgattcaaggccttgcaggagatgcttgaaagaaaccgatctgcaaattgatcaccggtgacctctcatggtcagccgatgcccgctgatctatcaccaagaaccacctcgatcgtcgtcaacctagtggcctcgattttcctattaaatggattatactccgtaatataacaagtcaaccatgaatattttttttcacaaaaaaaaactagttctaactgaagttgattaatgaaacaatgaaatgtatgcaagttaaagttacttctaactgagtactacatccatcccaattctcaaaatataagaatctaaaactaaaaccagacaagacatatacttcatccattccaaaatataaggcacagtggtaaactctattagataacatgagatgtatgcaagcatgcaattaattatgacatcttctctaattaattatgacatcttctctatacttttttaaatcctacactctcatgttatctaatagagaagatgtcataattaattgcatgcttgcatgcatgtcttagagcaagttcaatagtatactccaattcatctatagccaatctaatagctcattcatacaatagttatatactacactattaatatctggtcccacctgtcatacacacactgcgtcttggagttcgtgctacagctggctacaaatctgtagcccgctacccttctctctcctcagttatctccttaaaatatatttgcagctggcttatagcctgctattgtacctgctcttatattatggaacatctgagaaaagtggttgtacattatattatgaaatggatggagtatatcctaataagacgaatctagacagaaaacctatctaaattctgtctaatccgatcttatgttcttatattttgggataaagggaggtagtcgatagaaatactacatctcttaaaacaaaacagaaagcgacaccgtatgtaaacaacggaagttgcacaaaacagaaaacaccacgtaaacaattcacaagtcataactcataagtagctaggcaactaaacattgctacccttgacttccagat

SEQ ID NO: 47924 - DNA, 10080 bp, Oryza sativa
cagtagagctagaattaatggcggcgctgtcggagttggatgccaccgaggccagcctctccctgccgtcgtggagatggagctacagctacctggagaagatccggagcatgtccgtcgtcgggtcatcgtcgtcgtcgtcgtcgtctcgctcggcaagatccagtaactacagcagcaccgtctccagcaccgagtccggcgccggctctcaccgtcgtcgctgcaaaaccggcgctgcctccggcggctccttcctgagagtggtagggttccaagtcccaggccctcgcgatatcgccagccaaatggtccgtgacggcttcgtgcttgccctgatcggagcgttcggccgcgcgccgggacccgtgctggagaggtggttctccgagctcgacgtcggctgggtgctccggccaactgatcagcagcagcaggaggaggaggaggaggaggaggccgagcggctggtatggcggtggacgcgagcgctcaccgtgatggcccatgcgctgagcgccacgcagggccacctccacgacgagaggtcagccgccgccgccgccgccgccgccgtcgccgtcgttggaggtgtggaattcgcaatctcccagccgccacatcacacggcgcccgcggtagcttcttcctccgatcatgaactgctgctacgcggcgtcgtcggcggcggcgatgacctctgcctcgtgcggttcactgacacgaccatctccaagatgatcgccttcgccgccgccctcgccgccgccggtaaggccgggacttgcccaactccaaccgcggatagcttctttgggctcatggaggtgcacacctgcatctccgacgtgtcagagatcctcatgcccgccttgaaacaggaggctctcgatctccggctacctgattcagaacaaatgcaaagcctagtcaacaagatcggtgaagccatggcgaacacacaggacagcttgggtgaagccatacggaagacggccaaggatgctgaagctgttactcctgtcttgagcgccatggattcctgggaaaaattcacacagactgaaggaatccacagggctactcggttaatcgtggactatgcaagtttgttctggggataccgtagagtgctggagtccatcctatgttgttacaggagtgaaagtagccagaattgttgggagatagtacaaagcctgattgagcaaatgatcatcaccttcctggaccagctcgagaagaaatccgagtcattctctgaccctagcctgaggtacatcttcttgattaacaactcctacttcatacaggaccagtttcttgccaccaacaccgattacagcttcccatcgagcaaagggatcagatattggcactaccagaattgttacctcgatgtctcatgggagcccgtgctgtctttagtttacctatacaataagatgccaaagttcttccccaaacactccccgcagctgctggccagattccagtcggaatttcagaaagcgtgcaggcatcagaagctgtggaaagtcccgaacaccgagcacaggaactcgctgcgaaaagccattagtgacaaggtcatcactgcatacagaaagtacctggagggccatctggagccagagaaaagtagcagcgatctgctggccatggaagacatggtgaacgagctatttgaaggatgaaggagtactaattcctgttttagaattacatggcctaattggccatgcgtataggataaattttgaagcagctaacaggacaaggggctaaggttaaacaagttcattcgatgcctcttttttctagtgttctgattttttttaaggaaatcttcattctaccttgacaaggaataatatgtacttcagtcttgctgtgccagatttgttggcacattgcaatgcgtgcttcctcttgtattagatcctcctttccttgttcatggcttgtcccgctcggcctcaggggctccgacagatatgggagaacagagacaggcagttcatgttcagtgtgatgtttatctagttcagtttgctaacctaccaaaacttggtagtgctagaattttggtatggtctccatcacaatgccaccctgcaaaaattatagcaaattggcaatgccatatattcacaattttagcactaaatcaaacatattcttcatctctatcctaacaaatttaacaatgccaatgttttggctccatcaactttgggtagggtacataaccaaaccaacgcagagctagctctcacaaactcaagagaacaagaagactcatgtaggggatgtggaatatctgaaaccaacgagtatatgtagtaaaacattctccatatcctaaataatagaacaattttaccatgaaataccaccttttctattataaatttggtatctcttgatacctacttcaaggactgtaaaaatattatgtttggagtctagaactatagatgttgttgtgcccttgtctatcagtctcttccattttaaacagataaatattgaatattatcatgttagtgatgtctcaggaaatttatcagatatgaaatcagaaaagtgcaaagttgaatgaattattatgacagattgatagcgaacttacctttttatggctttaacatttcttcacctgcaaattttcttatttgtttaccatatcctctaaaggtttcttcctccatttacatggatacgccatatgatcaacaagtctgcagaccacaaccatgacttttcaaaaaaaaatcattcgaacagaaattgcttaacgaaaagcaatttacaagtaccgagatttgctccggtccaacaaaaagtacctcgaggtaccggtacctcacggtatcaaatcatttccgatctttggatctagctgggcaggatgtgcattgctagatccaacgatcagaaatgatttggtaccgtgaggtactggtactactagaaaaacgatttttcatggcgttggcctattattttcgctggcggaaaaatgtgaaaaccaccgcaaagtcgtaacgagtggatgaggggcaccgaccgccagagaaaatgaattttcactggcggcctgtctaacgcggccgccagcgaaaatatgtctatttttactggcggtcacttaggtgcgctgccagcaaaaatagataatcttcgttagcggtcgaatttttcctggcggctaataaacaaaaccgccagagaaaacccagctcagtgatccaaaaatatctggtcacattaaaaccacccacctacctcatcctcttctccttctctccatatcccctcctcttctctccatatccagtcacattatccactcctcttctctcctcctcactctcctcctccctcccggccttcccaccggcgacggtggcggcggctctggcggcggtgaccggcggctccctgcactgcccctgccgtcccatcccctctcccaaatctgtccgaggggaggaggccgccgccggcggcgcaacaaaggcggcggtggggaggacggatctgcctcagcggcggcgcggggagcacgcggcgcgggcgacagcggagctgacgacgacgaccgcgaccgcggcaacaacgacgatgacaacgacgctgcctgccgggctcagtgaccttgaccacgcgcgacccttctggaggaggcctgcagcggtggcaccactgccctcccctcccctccccccctcccctcccctcttccagatctggctggaggggaggcagccaacagatggcagcggcggcggctcgtccccgatggcttcagcggctagggttctcttgtgtgttttggtttgtaaggatgttaggttaatctgtgtgttgttaatctgttttgttgataatgccaatgtgttgtgtttgaattgatgccaatattatgtatttgtgatgctctggatttggattgatgcttgaatgatgtttatgtccattttcagatatggactgttttgaatttggccgggcagagaattttgaatttgggcttggggatttttggtggggtaggttgattttcactagcagttctctttaggcaaccaccagtgaaaatgggttttcgctagtggacctcaactgccagcaaaaatcgtttgtccgctggcgaaaatagattttcgcaagcggaataaaaccgccagcgaaaatcttagatcttcactggcctttgctttgtggcggctccaaattccaccagcaaaaatacaaaatgaccgccacgaaagatgatttccgtagtagtgggtacctcaagttactttttattggaccggagcaaatctctttcgatagtagggtacatacggtgcgaaatatcgccatgtctccatgcacggggccttctctacttttgtatgtagcgctggtgcctggtgatagttacacgggggctagcccagaagggaaagtgtgcctccagtcacaacgtcgttcgttatgaatgtgcgtgcgtgggaaatggggtggattcgccctacactactaattaagtctccgtgtggttagtcaagaagaaccaacaataattttatagttaatttcactttggaccatattttattgccaaagtttcactttgaactaccctttgtccagtattttcactttggactaggtaactttacctttgttacacaatggaccaccctaaaccacgccttcagttcttcgatgacttcgagcaaattattaacgacatgccagcaaattttcatacctatatacatgccatacctttgtcgaatgagacgctaggcatcactagcgaaaagagttattgttgaaagagacgctagacatcactagcgaaaagagttagggtggtcgtccattatgcaacaaaagtaaagttacctagtccaaagtaaaaagattgtgtacaggatggttcaaagtgaaactttagcaataaaacatggtctaaagtgtaattcactcataattttataatgttaatgccgaacatgcctttcaagctatggctctcaatttactccacaatagaaagctaacaactaacaataattgattcagtactagcacttagcaagtctcaaacataatatcacaagatagagagggaccttttttgtcacaaataaggacactcccaactatacagaagcctagcaaagcatgacaaagtcacggttccagagaaacaattatctgccacctagccacctgtccacggatatatatatacgacaccactatggtatatctactgctcaacaaatttgaggcctaagagaagcagcacagtaacgccaagggacgtacgtgcagcacgcgcgggccacgcaaacacgcgagttgagacgaacaagatatagcagatcatggaaatcaccagccgctccagcaacacgcgcacaactaattgttgcagattttgcaacactgccgcacccacgggagaacaggcaaggcgaccaatgcaatttgctgctgccgccgctaaccactggtgattatggaggggattagaggagaaaatagcaattgccctgtagtgtctctctccccaaccgttggaggctgtgaggcctgagcaagttattagcggtatggtgaagaatcaaagggtggagccgtggaggaaataatgtaggaagaagatctgtattgttatctgtcaacagatctggcgtaaaaaaaaataaactgcccatatattttattcatagtaaggtagaatgaggatttcctaggaaaaaagtagaatgaggtgggaacatatcaaaatacagttgaacttatttaaccttagcctcgccctctcttatcgtcgtaactgatttaaagtttacactccatacgcatggccatgtcagtctaaaactggaacaatccttattcatccttcaaatagctcgttgaccatgtcttccatgtcctgtagatcactgctgcatttctccagctccggatggtcctccaggtaccttttgtatccagtaatgaccttatcaatgatggcttctcgcagtttctgcctgagccttgggttggggaccttccatagcttctgatgtctaaatgttttctgaaattctgacttgaatcttgccagctgcgaggagtgtttaggaaaccacagtggcatcttttcgtgtaggcaatacagaacgggttcccaggaggcaagcatgtacttctcttggtactgcataaatttgagcgttgtgcctgacggaaggatgaacacgtaattgctgggctcaagaaactcttctcttacgaagtaggaattgttaagcaggaacaggtacctcaggctagggtcagagaatgactctgagatcttctccagctgatcttcaaagttgatgagcatttgtggaatcatggtgatcggaatttgaacccatttaagataccgcatgttactccgcaagctctggtatccccaaaacaatcttacatagtcaacaattagcctagtagcttcgtggatttctgcattctgcttaaaattttcacaggaatcccaaccaattaagacaggggtaacagcttcggcgaccatcgccatactctctatcgcattgcacaaggttgtcgttgtaattatgaaagcaccaaccactttgcggcctaggcattgcaattctgaatcaactatttcttctgaatcagttattactactacattgcacttgtagaagcagctgtagatgcagctgcacaggcccacgagtctcgagaggttgtctattgacagccgagtgttttcagcggcgagggcatcaacaaaggcaagcatcttggatactgtcgcctcaacgaaccgcgcgaattgaagtcggaggtcgtcttccagctcttgatcacacataatattgttatggtcccgctgggcctgcggaagtattatggcgggtacacctgcaaccttagtctgcgtggcgctgagtgcttcggccatcacggtatatcctcgcgtccaccgccgcacgagatcagccaagccgagctcggattgctccttatccgccgccgccgccgaccggagtaaccagccgacgtcgagctcggagaaccacctctccagcgctggcccgggcgctcggtcgaactctctgatcaagttcaccatgaacccgtcgtggaccatctgccgcgcaatgtcctgagcaccgtggaggtcaatgtcacccggcgacgagtttgagtaaggggcgtaccgatgattatgagggccacccgacgcgttgcttgacatgctgctgctgtagtaactggatctcgccgaccgagacgacgacgccgacgccgacgacgaccacccggcgacctcgcccgagacgacggacaggctacggatcttctccaggtagctgtatctccgtgacggctgcgtgaaattggccggctcggagctatccagctccatcacggtcggcagctgtgtctccatgctcgcttgcgcgatatctgcagtaggtgctaagctagctctaggcagtggatccgatctgagtgatgctgttctttaccagatttggtgagaactgactaatgaggggaggtcaaagctggatttttatattttgatccttttaaaataattattctacaaatagatcctaaaaacttattttaaaatgattattttcacacttaaatatgtgatctgaattttaggcctacaatatatttgtattagttttttaaataggacttcatatctttttctactagatgtcttttttttttacatatactcttgtaagccgaacagagagggatgacgttccattgttattcctctacgtttataatcaattcctcaacggtgatcattgccggtcggcgctcatagttttttctataaatgttttccgcgtaaaatttgtgtctccgttatacatctattttcataataagtgatatccattgaaaatctgatctactattccggttaccggcgtgtttctccgttcgaagaaatccatctcatcggctgcagcggcgttacgcgtagttctcgtcgcaggccgaaccggagtcatctgttgactcatcacgcgtttctcaaaaaaaaaaaaaaagaatgatcacgcgtagcaggagaaaaagcagagcagcaaggaaaaccatccagcagcatgcgcatcgagaaagagaaaaggcagggctgaattaattttcacggttagaaattgctacgcacacacagcctgcttaacatgaggattccagatctacagtacgtgcacatgacaagtgcaccagaggttcacgttttgctaggtttacattaatttcttagtagcaaattcaggatcaattcccatggcgagtttgaaatatgatctaccgctcctggaccgaaacacaagattctcactatggcaagtgaagatgcgaaccgttcttgcacagcaagacctcgatgatgtgttatctggatttaacaagaggactcaggattagtccgacaataagaagaaaatggacataaggctatgtcacatattcatcttcatctatctaacaatattttgttggaggtgctcaaggagaagacaaccgttgggttgtggttgaagctagaagatatgcatgacaaacgatttgaccaataagatgcacctaaagcaaaagtttttttttttgcacaagttgcaatatgatgaatatgtgatggattatctctccacttaattgttgttgaccttgactccatggaggtaaagtatgatgaagaggatttaggtcttattctgttgtgttcgttgcttagctcatatgcaaattttagagatactattctttatagtcgttatactctaactttgaaagaagtttatgaagctttgaattcaaaagaaaggaagatgttaccctctgaaagttcaagttcacaagcagaaggtttggttgttcggggcaggcaataggagaagaacataaagaaccaatcaagagatgaaagttcaagtagctatcgtgggagatcaaagtctaaatgcatgtataagtcatgcaaatactacaagagatatggacataatatctctgagtgttggaagctacagaacaaggacaaaagaaccggaaagtacataccaaaaagtaataaagaagtggaaggtaaagccgcggttgttattaatgagaagtctaatgcagaattgcttattgcttatgctggttgtgcataaagtagtgaccaatggatttttgatactgcttgcacctatcacatgtgctcgaatagggattggtttgccaactatgaagttgtgcaaggtggtactattttgatgggtgatatatgccttactaaggatcagatatttcatgagagaacaaagcacattaatgtgagatatcactttattcgaggtgtgattgctgaaggtgatgtcaagttatgcaagataagtaatcatgataacctatctgatatgatgacaaagctaattcatgctactaagtttgagctttgctcaagtttggttcgtgttgcattatagtcctacagattatttggtgcacggtgattttacctacatgaggtattctggtgattgatgatttttatgttacaagaggaaattcgtctcaaggtgcagattgttaaatacggtatgtgatacaaattttaggcctacaatgtattcgaattagtttcctaataggactctatgtcttttcttattatgtgactttcttttatctcctatatatactcttgtaagttgtatgggaaggggtgggttctcattgttattcccctacgtttaaaatcaactgctcaatagtgatcattgccgatcgccacccatggttttttctcgtaaggtttttccacgtaaaattcgtgtctccattatgcatctattttcataacattcactgcaccaatatcattggtgtcgtagtccaataagacagcgccctccacttctaggtgaaagctaagtcactaatgtaaaggataaccaaatcgcacttttttatataaaaaagatctatttgtaacaaaaatggtcctatttgcaataaaataat

SEQ ID NO: 47925 - DNA, 12885 bp, Oryza sativa
attgcatttaatgaataatttaaattgaaaaatgattttaaaagtctcttttggctttgggccgaaagtcggcccaaaaccttctctctctcccccggcccaagtcggcccagtccgccgcagccgcgcgcgcgctttcgctcgctgacaggtggggcccgcctgtcggggtcgtcgtcttcctccggccgcccgtcgcccgaaaccctagcgccgtgccgccgccgtctccttccaaattcggccgatcctttccgtttccagtgaaatcaatagaggggaaatgatcttcgggatctcctctatcttttctcttttggaatcaccggctaaaatcgtttggaaatccgtggattcgatctcgagtcggattcgtctctttcctccggatcctcacctttccttcgcgttgccggtcgccgtgggccttcgccgccgcctccttgcccctataaaaggatccccggtgtctcctctacccgccgccaccctcgccttcgtctctcgccgtcgggagcgccctagcgccgtgaaacctcgagccgccgtcgtcgccgccgctccagccgtgcgccgccgccgttccggtcgtcgtcgtcgttcgggaagatcgccatcgtggtcgccaagtcgtcgccgtcctcgtccgccccttcgccgtcgctgtcaaccgccggagcaccgtcgccgccgtcgacccgaccttctccgccgcttcgacctcgtcgccgacgtcgttcgttgctcctccgccgttgctttggtcaccggtgagttcgccgcgatgcccgcaccgttttggtgtcctccgtttgcaccgccgtgccgtcgttcgccagcgagcatgcgcgctcgagccgccgagccgtcgccggtggtgacgtcatcgccgacgtcatcgtcgtcgtttttccgtgagccgccgtagacccgatcgatctcggccgtccgttttggatggattgatctcggccgtccgttcccgtgaaccgctgccgtgcgcccggtccaccgcaaaccctagccgctgacgcaataaatcccttttccttttctaaaataattcattattgcgtcataattcaattaaaatccatataagtgttttaatccgatttaatcttctaaaattcataactaattcatcttagctcggatttagttggttcaagtctctaaatttttctaaaattgagatctacattttaaaaatatccacatatactgttcatgcttgtttatgtgctgttttggtgattttgcttctttctgcttagattccgacgtttccggagagtccgttttcgcaggagaagaatttgaagagttccaaggccagcaaggcaagtcacacagattccaaacaaccctttgagcatgttgatcccgtttaaagctattgtttctattcaactattgcatttattttcgaatgtcattgggtggaattaacctattatttgttatagcccttttgttcttgattactttattccttgataccttgggttattataacttgactagttgagctttatatatattggttcagctagatattagatgtgattgcttagtcatgcttagaaacattagcacactattgggataacttatgactcactattatttaatgatggcttaatgatagttcgcgatggtcaatcgtgattggttaattaattaattgccaactaaaacttgataatggtgggttgtgagcacatggttttgagagtcgtgctcatgacaattaaggaccagttcacgagtttcggttgtgaaacgttaatcgtgccaaccacaagccagcgtgggcaacggctttaccttttgtatagcatggttcattgcggggcaccagactgagaagtggcggagataagcccacgggggtcgctggggagtccatgccttgtttataagggggtgattatgatccaggaatggtgcgctgtggtggattgtgttgtgcgaggggtactgtcacagctcctttccaaggtaccgtggtggtattgaggcacatggtgacatgatgtggggctgtgtcttgtgggtacagtggtacacctctgatcagagtaaaactattcgaatagccgtgcccgcagttatgggcgggtcaaacaatgtctttcgtgattagtttcacacttctcatcataatagaagatgttataactggtattaatttgtttagctcctggtttggaatggtatattccttgtttggagatagaattgtgcagccgggatggttgttcagaatggttgggcctatgcaacagggtatgttgtatagtgttggattaatattgtttaattattacttaactgttttataattctcaaatgtttgctaaatgctgcttttgcaaatgagccctatattatgccattctttggtatccttgtgcacttgcatatttgctgcgtggcttgctgagtatgtcatatactcaccttgcaatcattcatcagaggaagagttctacaatgatgctgatggtgtggaggattaggcgtagccctggtcaagctgccagtggagtggagtcgtctgcgccgtttattttattttccgctgcttagatatttattgattgagaggaactatctacctctgtaatgacattttattcgcttattaattagagtaataattgtactctattatcaatttgttattgtgtgtctcggctgattcctggacgagggttcacacacatgtaagcgtttggaattttggatagaaattccgggcgtgacatctatttatagaataagttttttaaaaataatgagtttttctaaaagaactaaaaggtgaaaaatccaggatatcaaatcctaaaaaatattgggatagccagaagaagctagccatccaatgataataagataggagaagccatcagttaatccagatgaaatatgagaaggttgaaaggccgaacctaggtctcttaagggggtatttggatggggctaaattttctttttgtccctgtcacatcggatgtttgacgctaatttagagtattcaatatagactaattacaaaacccattttataaccctgcacttattcgcgagacgaatctattgagcctaattaatctatgattagcctatgtgatgctacagtaaacatctgctaattatggattaattaggcttaaagaattcgtctcgcgaattagctctcatttgtgaaattagttttattattagtctatgtttaatactctaaataggtgtccaaatatttaatgtgacaaggactaaagtttagtatctagatcgaaacaccccctaagtatcataatttctgtatagaccacactttttaattgctcagttcaacggtccatataaataggttgttcagattaatatcattttaaactataccattttctaataaagttactaaaaatatacatatatttagttttttatcaaactttagtagatacataagcaaacatgccaaaacttagtaatattggcaacttaccccaagaactatctagtttgctgtggtccatatgctcgtacgatgtgtcactcctaagacccgaacaatgcataactgttaacacctgaaaatgctaggctcctctaacatactacggccgccctgtttgggggagttttagattctgagaatctggaaaagctctgaaacccagcttctccagcttctgtcttcttagttcatttttcagaatctgtaactacagattctcagaagctgtggaccgtttgtggcagcttcaagcagaagcagcttttagaaaaagctacagctaggagaagctctcccaaacagggcctacgtcagagtaacatcggtcactcgggaatggatctatattggtgaatctcatctatcagggatctatattcctatgactttacgtcagagtagctgcatccctgaaaattaatggttttagatccaacacaatttattagattataccaccactgggaaaaccgtttttactcctgattgagaacctctataatcccggttttctaaccaggactaaaatacccatcattagttccaggtgaaataaccgagagtaaagttgaatctttagtcccggttagtattaccaaccgggagtaaagagagggtaggacagtcccggttggtccccttttctttttttttcattatttctttgctaattgacagagttaatccctatattttctcccaaatcgagtgccagtcatatcttcaaatcaaacctcaaatccccaaatcagagtaacatcacaaaccattcacatcacaaatcctaagttacttatacacacaaatcaaatacatcacaaatcctacaaaaattacacacaaatcaaatacatctcagatctatgcaatgaataacaaattctaaaaaaaaagaaattatacatctcagtgaatcacaaattatctaaaaaaaaagagaatcgacgctattgcccaccacggctgccgcctgccgccgctcatcacgcccgcgcgcggccttgcctgccgccgctcgccacgcccgtgcgcggtcccgccagccgccgccgcgcggccctgcctacctgccgccgccgaccgccggatgggaggggaggagggggaggagagggggaggaggagatgagggaggaggaggaggaaggggatctgaggagttaggtggagagggaatgagatcgatctaatcttatctaaatatcttggtgaggagaaaagtctcgtctaggacttaaccgatcagagataggagagaaatatttactcccggttggagttactaaagatagatttttaaactgggattaaattggtaatctttagtcccggttagtagtatcaaccaggactaaagattctcggtcccctgacaggcctctgacaggggatgaaccaggactaaagatgtctttagtcccagttgataaagatcaacaaatttttaaccgggactaaataaaattttttagtcccagcttatattagaaccgacctaataaagattatttctccggtagtttactttcattacaacacactatagttatttatcgtttcgtgtaaaaggtccaaattattcatcctctttaaaccactcctccgagcaattatcaaggtgccactacatgtgcatgcatctgctgcttgctgccgtgtcgcacttctcctgctatgcatcaatgcatgctgctcgctggttgcccaaatggctacttaactcttggttgaatacttgaatctcatctctcaaccgtaaaatcagatataagagctcccctatctttaaaaaccggtataaatagacttttttaatggtttgctaacataaaatgtgggtcctatatatcaatgactctcctcttttcccctcactatcttcctctctcctctcttttccatcagccgacgatgttggcagtggaaatagcagcaccatcgtctcagctaggccaaaccgccatgttcgtgagccaacccaccaaggctgcgcgaggatctgatcggcggccatgatgagttcttctatatatgtcccactcccaggaatcgcggtgcgcaggtgatcatggttcagtggcggcgcgacctcgccggcgccggcgaggagaaggagcgttgcagggtcaacgacatgtccattgtcaactggtacaagcccggcagcaagagccccctcaggggcggctgctggagcctacctcgccggaaggtggtgtcctccgatcaccgcctccacgcaagatcacacaaggtgatcaatcaatcaaacaagcaaattaatcgagtcactctaagaatcaatctttgcaaactacttctccattgatgcaacattttgcactttgcaaccaataattaatcttttgaaatcccttctccactaacccaactgcaatctgaatgaaggtgagcaagaaggtgcaccgacgagatcaggaccaagaacagcagctacaaagggatcatgctgtggcagagacctatgacattgacggcaaccaaccaccgacggattactgagatgcctgaccatgagaggagcagagcagatcgatgatgacggattgttgtgctttgtgttgtttactaaaattgcgatgaactttgccatggttggccttgccaccgacccagctatggcgatgcacctcttcttgatgaacccacacagcagcagcaatcccggtcatcgacgtcaccgccgcagtcggacacgctgtcggctatccaccagcaccacgaagcattccctgcgttcggcggcgccggtgcagctcggcgccggtgcggacagcgtggtgaagaccaggggctctctccctctcgcattcgccatcgctgcaacagcttgagtcctagagatggcgaagcaggcggaggagctacgcgtccgcgacgacatgatcaacttcaaccggcaacagcagcagtagcagcaggcagcggcggcggtgtcggtgcaacatctcccgatggaattgcatggccaggtcggcacgctggggcagccgctcccatcccgcattgcggaatgcttgggatgacggggacggctacggcgctggccagctagatcagggagggcagcatctttggtcccacctttttttttttactacgttgccatgtaggtgctacgtcaaataaagacttggtcaacgtctcacgtaggataaaaccaccgttcaaacagctcgaggagacaaattgatcctgtttttatagttgagggagcctctatagggtgttgctaatgtgagcgatcacccgcactcccctccccctatacgcaatacgctccttcctcttctcccccttcctcctccccttcttctctttctactacagtacatcacatttttttaaaagaaaaacaaaagttagaaaatttatgtatagaaatactatatataaaaaatttaaatttaaattcaaatttgaatcgggtatgtaaacttttgacttataaactttggatctataaactataggtgtataaactttatatgtatagaaatactatatatagaaaatatttgaattcaaattcaaatttgaaacgggtatataaacttttgacttataaactttaggtctataaactttaggtgtataaacattagatgtatagaaactagccgggtggcccgcgcaattgcgcacctagcacccaaacaaaatcatacatttttcagtataattttccttaaaatttattaaatagctatctcgttgtcttaagactttgaaagaccaaaccttatcatttgcgtatttctaattatatagtttttaaaagtcacaccagctgctaccccttacttctgtcatattcttctttatttgcttgctcgatctaccactagttctattcattctccttgaaacctttaaaaattggacttgtagtttttagagtttattgtcttgttgggtttcgtttttataatttctagaagtcccgtcaaacgctgccattatacccctatacggaccgtacactgtcttttctctttattgccattgtgattttataaatcgaacataattatcgttcgggtttaattttttactttctagaagtcccgccaaactgtcagcgactttgccattgtactcctttatggctcgcccgctgtctctcttctttattgtcattgagattttaaaatcgaacatgattattattgtattttttttttactttttagtagttcccaacctttaacaattggatcttgtagttttgtagtttttagagtttattgtcttgttaggttccattttttataatttttacaagtcccgtcaaacgatgccacaatacttctctacggtccatccgccgcctactctttattgtcattgggattctaaaaatcaaatataactatcgttgaaattcattttttattttctataagtcccgctaaccgtccacggctctacaactatactcctatacaccccgcccactgcttctcctttttattgccactgagattttaaaaattgaatatgattatcaatgaggtttatttttttactttctagaagtcccggcaactgtcttgcccatttgcttcacggcttgcctgtcgtcgctccttttaatcgtcattaggattctatttggtgttttattaacaatttttatatgtcgtatcaatcgtcaccactctactcctttctaagcatgttacttaatttatcttgtcatgtgtttcagatggtcttttttttcagtagtctttattttttttatcaccaattttagttatttataaattctattcctaattgaaatatttttttctttttctaattttagattttttttcaaattttaattaataccgtatagtgttcttataatatttttatttttgaatttcagttgtttcaaaatatattgctacttgaactctcttttaatttttctaattttagatattattttatttttaattttgaattttaattaatctcgtattgggttcttatatgtattcttttttcaatattgcttatttttaattccgaatttcggtttattttaaatattatttctacttgaactcttcttttttttttgctaattttggattttatttttatttttattctgaatattattaatctcgtcttgggttcttatatggactcttctctcaatattccttatctttaatttcgaatttcagttattttttaattgtattcttacatggactctcctattcttttctaattttggattttattttatttttattccaaattttgattaatctcgtattgggttcttatatggactcttctttcaatattgcttatttttaattctgaatttcagctatttttaaattgtatttctacttggactctccttttctttttctccgattaatttgggaatttctagccctcacggcgaacgtggtgactcctttcaaagctgttttaataatataatagatagatagatactatatataaaaaatatttgaatttaaattcaaatttgaatcggatatataaacttttgacttataaacttttggtctctaaactttagatatgtaaacttgaggtctataaactttaggtgcataaatttactaaaataggaaagtaatacggtgccaaaaaaggaaactaggtggaaagagggaggggagacgggggcgaatcctgatctccatggcgatcgatcgaccattagaagtttcggcctgtatgccctgttttatggttgagggatacgattcaaccaaggacaataattcagggactacaaatagacttattcctagctcttccttctcaagagtgggctgggcctatggtcatctaggcctcaacacagcccactagcttttctctcctctatttccttttctttttcatcaattttttagggtatcacacggtgctaaagggaactagccgtgaaagagtccatttgtagaacaaatttagagcaaaaccgaagggaatacaatatttacgaagccactttttttactaaaaaatagtcaaatcatttttacagtgtaaagtacgtacacttatattataaagccactgtaaattttaaagagctgaggagataataatacaggaagaagcttgtattaaactgtcgatacattttattctttttttatattgatacattttattcctagtaaggtagaatgaggatttcctagaaaaaagtagaatgaggatagaacatcaaaatacaataaaaaaggcatcaagtgtgaacttgtttgtctcttctcgtcgtagctgatttaaagtttacactccatatacgcatggccatgtcagtctaaaactggaataatccttattcatccttcaaatagctcgttgaccatgtcttccatgtcctgtagatcactgctgcatttctccagctccggatggtcctccaggtaccttttgtatccagtaatgaccttatcagtgatggcttctcgcagtttctgcctgagccttgggttggggaccttccatagcttctgatgtggagtacatgttttctgaaattctgacttgaatcttgacagctgtgaggagtgtttaggaaaccacagcggcatcttatcctgtaggcaatacagaacaggttcccaggaggcaagcatgtacttctcttggtactgcataaatttgagcgttgtgcctgacggaaggatgtacactaattgctgggctcaagaaactcttctcttacgaagtaggaattgttaagcaggaactggtacctcaggctagggtcagagaatgactctgagttcttctccagctgatcttcaaagttgatgagcatttgctgaatcatggtgatcggaagttgagagcatcggtcgtccgagtgaggatcccatttggaaagcaggatgtgacgcaacaagccctcgtatccccaaaacaatcttgcatagtccacaattagccgagtagctttgtggatttatccactatgctgaaaattttccaaggaatccctattcaagactctagtgatgtgaaaccatgtgtggttatagttcttttgtgatgggaaattgacaagtaccggaagtgcaagaagtgtgtgcgtagactaacattggtcaggttgcgacatctgtgccaagacaacggttgtttgattcatgtgtgtgcaggtgatcggggtcgatcttagtcaacgacggatcggtactagactcagggaggagttgaggtccagagcgatcaaggatgctgggtgacaagattggacacaaggttgcacacggtggacggacaccatgtgaggaggtcttcgcaacggagttcgcaaggtcaagtgcaagtgccgggttcgcgaagaaaatggagaatggaagaggagcttgtatacatgcactggtatgtgcatatgcaagcatgggcagtggtgcttcggttatgcatgcgtgcacatggccgaatgccatgcacgggctcaagacatgcatgtgtgcatgaggagcttgctagcccatgggtgcatgtgtgttgtgattggttggcagggaggccaagccaatccagcccttcttcgtggctcaagatgatggatggatcagctggcagggaggccaggccgagcaggcccaagacaagacgacggcccatggcatcgacaccatgcatgggcaagcgcgggaaatcgcgcgaggcatgcgcgcgcagtggacacgcggcggcaaggaattcggtgcgcacgggggtgggacccacgcggttttcgcgagcgcgcgcggagcggctcggcgagacgcgtggcggctccggacagggcgcgggcatgcgcgcgcgctgaggaaaaggagacaggacgcgcatggcacggctgggcaacgtggcaagtttcgattcggcaagacggagacgacgcggatcgatctcccgatcggtgcatgctgattggctcagaggagccttctcacagatcacggggcccacgttgaggagcacgcgggcacgcacatgggaggaatttggtgcagactctttgtgaaaagaggatcccgatgtggcaagcgacgtggcttcaatccaggctacttccttaggatgtaaggaacaacctaaggcccagattgcatctgagttagggtttcgccctaaagacatttgtgacaatgtcttacgaggtcttaggctataaatggagaggtggatgcaagggtgaaggttgcttcttttgtaatccttttgagatgctcggtgagagagtttcggtgtgagtttggagtgtgtttgcccgagaggcttttgtattaggattagtttggagtgtgtttgtccgagagattttaaagtttgtgttaatgttcctctaaaggtgtatgtttgctcctagttgagcggttattttgcaacaccgatgaataaaatgatttgaagcatttcgttttgtcttcgccttttaaattccgcaatttaaattccgcttgcgatttgaatttcgcgatgacgagttttgctatcttctcctcacctcacttctagattcgagaattccatctctcttcttttctagatccggcttctctaatagccgcggttctagtaagaattttgagaaatccggcttgatgagtatttttggggacaagttttgaattgctatattcaccccccactctatagccgttcttggtctttcaattggtatcagagcccggttaagttcgttgtaacctaaccgtggcaacgaatgccgctatggaggaaaaatactctgcgaaaccatttgttttcgatggacacaattttgtcatttggaaggcacgaatggaggcctacctccagtcgcaagggaataatgtgtggaataaggttaaatctccttacactgtgcccgatgatgatgacatcacgcctgcaaatgtggctcaggttgattttaattatcgtgcaagaaatgcaatcattggtggaatttcttttggtgaatttaatcgtgtttaacaccacaagtccgctcatgacatgtggactgctctgtgaaatttccatgagggaaacaatgatattcaattggttcgtcagaatcaatttcataaagaatatcaaagatttgagatgcacccaggagagtccattgattcttatttcaagcgttttggagaaattgtttcgaagttgtgatctgttggaaaagaattttctgataatgataatgctcgccatcttttgaattgtcttgattatggtgtttgggaaatgaaagttacttccatcacagatagtgcacctctgagtgaccttaccatggacaagctttactcaaagctaaaaacccatgagatggatgt

SEQ ID NO: 47926 - DNA, 1322 bp, Oryza sativa
tctagtgctagtgctgcttgctctacttgctataaaatgaaagttgatatgggtttgcttgagatggaattgaaagaattaaaagaaaaatttgttcatgataggattggtaggtgtgaaaattgtcccattttcactagtgacaatgatgaattaagacaacaagttgccatgcttaggaccaataatgatttgttagaatcttttgctactaaggaacctgttcattcttcatgtgctaattgtgctatcctggatactgaactaaaagatgctaaaactgtcatttattctatcaaatctattgattcttgttcatcatgcatttctctgaaagttgatcttgagtctgctaagagagagaactcatacctacaacaatctttagagaggtttgctcaaggaaagaaaaagttgaacatgatcctagaccaatccaaagtgtccataaacaatcaaggtataggctataattttgctgagtctttgaggataagtacccatgaaattttaggtgtcacagatgggatgatataactagctcaaaaacctataaccttcaagtctgcaggtttcattggaaacactagttctagttcacccaaaacctcagaaccaaagatggtacctatgactagcaagtctaagcctatagagttacctagacccaaaaatccaaaacaagttgagcacaagcaaaaccagaaacaaaccaagcctgtagagaaaaccaagtatgagtgcacctattgtgggaaagctggtcatttggtaggtttctgctttagaaaggctagaaaagagcgacaagaacgtcttaggactagaagagctactagagtccctgagaggttcgagtgtgcgtgtcattgtcgttcaagtggtgtatctcgctttcctcgccgagatgcgcaccctcgacgtggcctagcagggttggggcaaaacagacatggtcatcttgcatataattatgctcataacactaaagatgcttgtactcctcgcatggttcagtactggattcctatgtcatttctcactaaccccagtactgaatcatcaagatctgctttgtctttcttgtaggattttggagtggggagaagtaattcttggcttgtggactccggttgctcacgccacatgaccagtgaagccaagtggtttacttctctcactcgtgcatccggtgatgagaccatcacttttggggatgcgagcagtggacgcgtgatggctaaaggaacaatcaaggtcaatgacaaattcatgctgaaggatgtcgcgcttgtaagtaagcttaagtgggctgcaggaat

SEQ ID NO: 47927 - DNA, 18541 bp, Oryza sativa
gagctcgagcaatgacttgacgacgtcgtcgttgcaatgttgaatggcatagctcgatggcggccctcaccctaactagcttgacacttgagaggctcgatgtcgcatacgccagatgcccggatcttgttgttgcaatcggcggagaggccagagcgccggatcttgttatcacagacggcgggaggcggcggagggagcagggagctcgttccccggtgagggcgccgtgccggtggaggtgaggactggggttagggcgtttaggtgccgtgccgttgaccgctgtccccccgctcgatctcgtcgacgtcggcgtcagcgttgccgtcctctcccgcctccttgccggccatcgagctgcctgttgccgctctggaacccgccgttagctctagcccgccgccaccaccgcttcagcttccgctggccgccaccactctagccctcgcccgtgagaaaattgggattatactatcgcaaaagtgtggttttgctgaaatgctatcgcttcaaactgattcactaaaatgctatcctaaactgagaggtgttcaccaaaatactatttttgctcttttgggtgaatagaaatgtttttcttaattttaactttttcccggaccaaaatacccttaatgcggggcccacctgtcatactctctaacgtcttttgttcttgttcccctctttctctctctcgaggatgacgtcgggagcggggtggccggcggccagcggcggcgtggcgagggcgtggtagagcggggcctgcagaggagcggctcggccagccgcctcagccggagttcatgccatggaccgccgccccccagccacagccgccgccgccgccggtgagccgcgtgtttgcgcggcgcctcccccgctgtgggtggccttcttcgcgccgccgccgcatcgtcgccgccgaggagcaggaggcgaaagtggacccggatgcgacggaggcggcagagccactggtcgacgggcggggcggcgctaaccgagggacggtggacgcgaatggtggcggcggcgcgactggattggaggaggagcaggagagggagcagcgggggccgccggtgccggacccggacccgatgcttaggcgcggagtgaggggcggcagtggcagcggacgcgaatggaggcggcggcgcgagtggactggggcaggagggaggggaggagtaggtaggagagtggcgggggccggcgctggcgccggagccggacccaatgtggaggcgcgacggtgtcgccggtgccgatgtcgctccgcactcctcagttagcgccgattccatctggtaaacctatctgagaccaggtattttggtcagaacaaaaatgaaaatagagcaaaatcatttctagcaaccaaaaagacccaaaatagcattttagtgaacaccccttagtttaggatagcattttaaagaatcactttgaagggatagtattccagcgaaaccatccttttgcgatagtaaaatcacaattttctccctgcccgctgccgctccagccgtgctccccgcggccggccgaaggggagaaaaagagaaagaaagagagaagggaataagaggggaggaagaagaaagagagagagaggggatgacatgtggggccacatgtcagtgggccccataattttttatgtgtgtgaatgacaaacgggtcccatgtatatgtttttaattcaaatgccacctaaacgccacgtcaaccccatagactagttcaacactgccacatcagcgccacgtcaccaaaaccgctctccaaaaccaccaagggagtcaaattgcaccggtttcaatagtttgggggtcgagatatccggttttgcggtttagggttatggattagattcgggtcacttttaagggagtcaaagtggacttattcctatgcgtgcgaattctactcgcgatatatttctcccgattaggcccagcccatcaggaaccaaaccagccagtcgggccacggcctctttttacgcgaccacgaagcgggcccggtccgtgagagcctacacttgtgctgggccgcgagccagcccagatgagcccaagtactccgccacatccaaatctgcaccgttaacgccgcatcccacggctgtaagctcccctccgggagataaaacaccctccccccgatccagccaccatcgccattctctagggtttattccacgcctcccgtcgccgccgccgccgccgtcgttgtcctcgcccgcgcgcgaggagaacgctaaactccggtcaagatggtgagatccgaacgccctttactctctcttcttcgcgtcgttcagttattttctttttgtttttttttccagttcgttcggtgccttgtatggtcagtccagttcttgatttaaaccaggatatgtgatcgtctagttggcgtagaattacgtgcattgtaccggtggaatcttgttgcctgtgttagatcacgcggtgagttgatttgttcggttggttagttcttactagatcggtctcttctttaggttcatgtctttttgatctacctgtaattctttgtagagcgagttctttgtcaaatatgttattttggatcagagatcattttgggtaagtgctctgtgggtgacaacctggtcaagttgttagtaaatggctcaacacccgttctattagacatccttttggtaattaggagttactttctgtaaaactgtgattcccaatcataaaacatcctttgatagttatgagccattccatctcaacattaaatgtttgatgaacgcatagaatcccaaggaatgatggcatagattgtaagtgcttatttggtgaatcttgtttttactgtattgcccccttttcatttctctcatttggattggttaaacgctatcaatatgtatttatcttgttaaaagaatctccttttctgcttaataggcgaggggtttgaagaagcatctgaagaggctcaatgcccccagccattggatgcttgacaagcttggtggagcatttgtaagtacattgtatagccgcaagttatatcacgcagttcaaatgcattctgtataatgctaatgtagtgtttggcaaatgggaaagggaaatgatttcccacccatctttaaatcctaaccattcattctccctcttccatttaatcctaacccttcattcatttcccaatcccaatcccaccccccatttcccattatccaaacacatcctaagtgtttgctcgaattttttctgatgtttatttcctgggcaggcacccaagccttcttctggtccccacaaagctcgggagtgcttgcctttgatccttatcctcaggaacaggttgaagtatgctctgacctaccgtgaggttatttccatcttgatgcagcggcatgttatggttgatggaaaggtcaggactgacaagacttatccggctggattcatgggtgcgtgccctgatttgctgcatcattgtacgagaagtcaatgtctaattaattccatggaatcccttattagtttcttgtatcatgcagacgttgtgtcaattgcaaagactggggagaatttccgccttctgtatgacaccaagggtcgcttccgtctccacagcatcaaggatgaggacgctaaggtttatattaaattatccatcactatatggttcataatagtaggaacttttgctttgtattcttctgtgcaatacaaaaacaaacaactaaaaatatccttatcaagtgaaatcctacgccttgcctaatatcaagcaaacttcttgatctttaaattctactagtcatgtttgcctcctatggctggtttcatcctccatcggtactgttgacccacaaatgtgtacgccagtgggcccgttccaccagatgtagcttcatatcatgttgttctgtttagttctttatgtttgtgtgatgtaggaattgaagacagatcctattaatatcctactaatatgtgttccttttataggattcttatctttatagatttactttgaggttctctttcttgtgccaatgtggtttgcttggtttgtgctttttttgcttgacaaaattctattgagtcctacacttttgctttaaaatatttactgaaatacttctgttaataatgcagttcaagctctgcaaggtccggtctgtacagtttggacagaagggtattcctttcctgaacaccaacgacgggcgcacgatccgctacccagacccactcatcaaggccaacgacaccatcaagattgacttggagaccaacaagatcgtggacttcatcaagtttgatgttggaaacatcgtgatggtgaccggtgggaggaacacggggcgcgtcggggtgatcaagagcagggagaagcacaagggcagctttgagaccatccatgtcgaggatgccctcggccaccagttcgcgactcgcatgggcaacgtcttcaccatcggcaaggagaggaagccgtgggtatctctccccaagggcaagggcatcaagctcagcatcatggaggaggcgaggaagcgcaatgccgaggctgccgctgaggcttgatttctgaaaatctccatgaatgaaactgttgatttgagcagtctatttatatagattatttagctcttaagatcatatgtccattggagaccgtcaattggcgcttcattgttcgatacttgtcgagctgttttgaaactatgaattcatcatctgttaccttcagcataatagatccagaatccttttttagcttgtgtaatctttcccaaatgagaagctaccttgcatactgaaatgaattccacatgatgtttggatttgcaagttcgtatttttgggccctcttttatgggttgtgatggtcaacgttaccctgatacggctacaaagcgacgtatctgtatctgatacggcaacggatacgttccggtacggacggatacggatacgttccgatacgtattcggtatgtatcccatatatttgtgatttcaaaaaaacaaaataaattgagatacgccagcgatacggccgcgacgtgcctccgtctacgctcgcatcagggatgcgccgccccatacgctcccatcctgatggctgtctctcgtgcgtgcccggcaatgccaccggagacgccggctgcagccgcgcgcttggttgccgtgcgcgggccacaacgtcctctccgcgagacggaagagctgccgcggctgggcggcggcgcacctccttcgccgccaacctcggaggccacgaccgttgccgggcatagcggaggccggtggcaggctggccgctggcagcatcaaagcagggagctttttctttgtttgcttgactgcctggccgggtaaatccatgctctttgaacgtttcttgcttgaatctgttgtgcctttcatgtttttcttaggacaaagtaccgtttttgttagatacaagtgctagtgcatccagcaattctagtggttactggttagtgcggctgctaatgttgatgcaaagtcatcaagagttatatgattgaactattaatacgtggtttttgggatcttaatcgtttgttaatttgaattgcttatagaaaagaaaattgcaaaatattgatatggaatcggctactattagtattatatcgctatttctttataaaagctccttattttttttttgtatttttaatatatattaatgtaatttccttaattttttgtgtgttttcaatatatatatagacgtatccccgtatccttggtttttggaaaatgtcgtatctccttatcgacgtatcgcgtatccgtattcctgtatctgggtaacgtaggtgatggttgaacagcaaactgtgcatccaagtgaattccacatgatgtgcatccaagtgaattccacatgatgttttggatttgcaagttccacatgatgttttggatttgcaagttcgtatttggccctcttttatggattgagatggttgaacagcaaaatctatgcatccaagtgctggctcgagctttgggatcttggtttgggcaaagtttgaagaacaggatgcgctgaaaatttcataaactcctttatccagtgcatattcagagttatggattctatgtattcagtgcacattcagaatttgcacgagctgcgtgtaaaaagaaaaaaaattccgttgccgggactcgaacccgggtctctcgggtgagagccgagtatcctaaccagctagactacaacggatgttgtgctgtagttgatccctgggaatatatattaatgttttttgatcacataaacagtattttcgacgcgtattgtcgtagatacagcgtacaaataaatgaatgtattggttgggtcgcgttggatacgtacaggacacagcagcctaggctagtaggcttgattgacatgttaccgagaaaggcctatacggcgataatgtccatggatgaccgaccactcatctgcatgcgccgctgcctagctgcaccttcccttattattagccgaagcacctgccatggcctccctgttgctagtatatactacctcaatctcttctctactacttaaaaaataagaaataagagatgctttcatcgtccgtcaaaaaagccagacaaaaaaacaaaatttgtccgatccaaaaaaaaaaccgggcgaaaaaaacgtgcggaaaaaaaaaagaaaagaaaaaccaaatctgccctatccagaaaaaagaggcgaaaaaaactggcaaaaaaaaccaaaattgtctgatctaaaaaaaccggcgaaagaaaacgtctagaaaaaaagaggcgaaagaaaaccaaaattgtcttgatccaaaaaaaccgggcgaaagaaaacgtgcaaaaaaaagaaaagaaaaaccaaatctgcaaatctgtccgagccggaaaaaaggggcaaaaaaagaccgggcgaaaaaaaaaacaaaattgtccgatccaaaaaaaaccgggcgaaagaaaacgtgcgaaaaaaggaaaagaaaaaccaaatctgacgcggtaaaagaaaattcgggggaaaaaacgaatctgtctgattccccaaaaataattgtctgatctctactattataaaaactagcattgtggcccgcgcagattgcgcggctagcatcattatattttctctcatataatagcatatatgttttctcattatattattcaaatatattaaaatgacaatataattttaaattttgcaataactctacaaaactactaatgtgtaatgttcatattatattttatatacgtgttagttattaattatttttaatattaaattttagttattcgtaaattatatatattcctatatggattctagaatcgtcttttaatatttctttttttagttccgaattttctgtaaattgtatttctatatagactctatgctcttcttccaatattatttatttttatttcttaattttcatattatattttatatacgtgttagttattaattatttttaatattaaattttagttatttgtaaattatatatattcctatatggactctagacttgtgtcagggttatggataccacattcctaatagtagttgactaaatctcggcaggacccaccgcataccatgtcctatatggaaacaacctgcggatataggaggagttccggataaggaaagacaaccagagttctacattgaaacgacaaggactactcggattgtatccatattggtttccttagttctacttggacaagggaacacctatgggtataaatacaaggctccctaggaggagaggggacacaatacacacccgccatggaagagacccacaatcaacatacatggaacatagatcaagacagaagatcaacatacaagccaacatacgccaagacaagacgtcgggtatcgacttcagggataagcacggctagtcccttacgttgtctccggatactgtcaggagagacgaaagcgctatctttgatctcgccgggcacgaactcgaggaggaagactaccctgttgtcgactatgagtcagaattacagaccgctatgtcgacaacagttagataggctaccccaaatattgtactggtgtgattatgatgaataagagcaataccggcttcggccaacaggatgtagggttattacctgacaattcaggggcccgaacctgtataaaaatcctcgtccccgtctcttttacctcagtcttatgtatatcctagtaccaacgattcccataccatgcaaatactggaatcgcgacatcaaacgtcgacaacttgtcttttaatacttcttttttttaataccaaattttctgtaaattgtatttctatgtagactccatgctcttctttcaatattatttatttttatttcttatatttcatattatattttatatacgtgttagttattaattatttttaaaatcaaattttagttatttgtaaattatatatattcctatatggactctagacttgtcttttaatatttctttttttaattccaaattttctataaattgtatttctatatagactctatgcttttcttccaatattatttatttttatttcttaatttttattatttctaattgtatttctatgtggactctaaactcatctttcaatattctttattttttaatttttgaatttcagttactttgacggagcttgggctcctcaccgggagaccgcgcaggcccctctttgccggttcggccgggggcgctatgtgaggttcttcgccctcgatctaaggaacgtcagcgagaagaatcgcacaagacacgggcgacatagacaggttcgggccgctgagaagcgtaataccctactcctgtgttctggtggatctgagtgtgaaggaatacagagagctggagagcgagagagagttcaggctttcgcctctattcgccagcctccctcctctcctaggcctgggcctcctttttatctagttaggggtcaccacatgggcctcaagctgcctaaaaaaagaaacattccttttacaatgagggctaatctacagccggaagtgacctctgacaagcacagcacacgccttctgctccgctcgtcagctctcccggtggacgcccctttcaaccttcattcaatggccagcgactttcttgccatgcttgcgctgaagcctggcatggatctgaccgggactgacataccaactccaggagtcagcacgccggctccggctagggacgagagccaggaagctctcatcattccgacgggacggggcgaggcgtgtgacaggccgcctgttgccacctaacccgcaatctgaccggtctgtgaccggtcacataccgcgactggtcacggaccggataagcatgcgctgcgccgtattgaatacggcgcggcgcgctcgtctaacccgctataaatgcggttaggtgagcgccgctgtgctcacctaacccacacacgtggcgccaacaccacagggggtcggggcgccccagccctcggggccgaaacgggagcggcccgacccctcggggagacagagggaggggtggccacgtcaccctcgggcccgacccccccgagggggtcgggccacgtgggtgatcgcggctacccaagcctctagtcacgatacccccgcccctatgtcaccgacagtagcccccggcgttacgccagggcgaccgcccccctcgagggaggcgctcgggcgtgacgccactccttaggcccggtgacaggtggggccggtccccgcaggcgggcagaaacccaacggtcgcaaatcgcgcgcatcgggacgagccggtttgtttcgcctggggacatgatgatggcgttttttgcggttggcgagcgcagttaatgcgcgcacgatctgccccatctcaaacgtcacggctgcacatctgccgcgtgcgccgcaaacgggcgagtggggttagtggtggcgtgggtgcgagaaacgagggggcgaggtagtgggcgcgggaaacgaggagccgggcatagcgttggcaagggtacaaagacgccaaggaagggatttgtttccttcctctcgccactcttccccttgccttcgccacttgcgctctgactctttgtttcctgcgccctacccttgccgtactcgctcgctctcaagctcctcctccgccggcgtcatggcacggggctccgcaccgctcgacggtagcgtgctgccgccttcccgcatcgtgagcgagaggcaggccgggctgccgcgccgattcatgccggaatctgccaccggccgggaggtggtcgcgctgggcgagggacacccggcgccacactacccagggcggtccgtcttcttcctctctttcgcaatggcggggctggtcccgccattctctatttttttcatggatattctggagttttatgatctccagatggcgcacctcacccccaacgcgataatgacgttggccatcttcgcgcacctgtgcgagatgtttatcggggtgcgcccatctctccggctgttccggtggttcttcaccgtacagccggtgtcgccgccgacggtagtcggtggctgctacttccagccgcgggggcaggtgttgaaccgctacattccttgcgtcctccgcaaaaagtgggacgactggaagagcgattggttctacacccccctcgccgacgaagcgcgcctccgacttcagagccagcctccggcgcaggcctccagctggcgggcggcggtagatctgggagacggctacgacgccgttcttgaccgcctggcgggtctgcgatcccaggggctcacgggggccatggtgttcggcgactaccttcgtcgccggatcgcgccgctccagcggcgcgcccggggcgcctgggagtacaccgggcccgaggactacatgaggacccaccaggggcgcaaatgggactgggaccctgaggacttcaggatggtggtccaacgggtgctgaatctcagctccgtggaggcatccctcatcccccaaggggtcctccccctctgctgcgatccagagcgcgccaacatcctgaccatcatgcaggaggtcggggcgtcgggggagcgggtcccccgtggccacgatggcgcgggagggagccgcaggggggaacaatctaccccgggagggggtcgtgcttctgggccccgcgacgggggcccggggggcagccgccctgccgacgcccgggggaagaggaagcaggagggtacccctcccccatctcctccccgagggggcggggcggtgcgtgccagcagcaggcgcccggagggtgccgtgccgacgccgcagcccgagggggagcgaaagaagaaacggccccgcaagatgggggggaccgagccatgccgggggaacctcatctcacccctgaggtggtcgtttagccgacctccccgcaggttcgtccccgcgctcgccgcggccgtattcattctcccatctcccaaggcgagttttcactcacccgtttctttttgtcttcttgtttttcttctgcctcagcgagatcccgtcacgccccccccgccattccaagtccggccggtctgaggccgaggagacggtgaccgcggaggcccagaggcgggaagctgaccggcgagaagccgtggaccgcctccgggaagccgaggaggctgcccaggaggccgtccgggttcgccaggctgaggaggccgctcgggaggaggccagactccgccgggccggggagtccgtccgggaggcagaggcggcgcgcgcatgccaggcggcctgccaagcccccgacccgactccgcccgaggcgacgacgacttccgaggccacccacgatgaggccgcgggcgcgccgctcgggcccgacccctcgggcgacgcttgggacgagccagcttcgggggacgcccccaagtccggcacgtcgatcggcgggccgagccgcgcggcacccacatcgaggcgactctcccctctgccttccgctgccccactgagcacggagcccctcctgcaggtcttggccaccgcgaacagcacggtgctggacgggttaactgcccagatggaggccctgcaggcggagcgggcgcagctcgacgcggcgtgggcgcgcgtcgaggaggggcggcgctcggtggaggccatggtggaggcgggccgcaaggcacaccgccggcacgcctcacagctcgaggcccgtcgtagggacctggcggagatcgccagggaggtggaggaggagcgggagactgccctcatcaccaccgccgtgctcgacgaggcgcggagagaccttcgcctaccatacgggagccgggcggcggagctagaggagaagctcgacaccgcccggggagtccttgacgccgccgcttcccgggaacggcgggcggcggagaacgaggcggcgtcccggcagcgcgatgaggcccttgagactagcgccacggcgctggaggagcgcgcccgcgccctggacgcgaaggagagagacttggcggaccgtgaggcccccgttgccacccgggaggcaacactggcggcgcacgaggccacctgcgccgaagaggagtccgcactccgcctccgtgaggacgcggtcaccgagcgggggtgagctctcgaggaggccgaggccgcggcgcagcgggtggcggacagcctgttcctccgcgaggcagcgcgggaggagcaggcgcgccgcaatctggaaggcgtccgcgccgagagggccacactggatcagcgggccgctgagctcgaggcgtgggcgaaggagctggacgcgagagcgcacagcggcggggcggccacgggccacggcgacctagccgcccgcctcgcagccgccgaacacaccatcgccgagctgcagggcgcgctggactcgtccgccggggaggtcgaggccctccgcttggcgagcgaggtagggcccggcatgcttcgggacaccgtctcccgtctagaccgcgccgggcggcaggtgggcctctggggcgggcggtacgcgaagtacgccgccaaccaggggggcctcgcccagcgcctctcagagatggccggggtcctcaagcggctccccgaggagctcgaggagacgatcaagtcatcctcgagggacctcgcccggggggcagtggagctcgtactagcaagctaccaggccagggaccctaacttctccccgtgggcagcgctggaagagttccctcccgaaaccgaggacggcgcgcgcgcaggtccgggacgccgccgaccacatcgtctacagcttcgagggtacggcccctcggctcgcgttcgccctcgactccgacgaggagggcggtgacgacggtgcggacgacagcgacgacgaggccggcgacccgggcgcatcggagtgatcccccaggcccccgccaatcttaataacttttccttctttttccgaggccttcgggcccccttcttgtatagactgatttaatctgtaatcaaataaagaggaaatttctacgtcagttatgtttgttgtgtgtatgagacgaggatggtctgtgccgcggtccttctgtgtcttggcttgaacgagggctcgtgcctaggtcccagcctcaagcggcgcgggtcggggctagtgcctggggagatccgcgtgtcgagactggccaggccgggagcgtggtgatcgagggttatggatgaccctattgtgggcctttgccgatttccccccggagttcaccacgccccggggcacggctcggttctgggccccgtttggcgattttagccggcccgggccactgagggcagggttgagcacgagcgtgctaattcaagccaagattcttcaaaaggaaacgatggcacagacacagtcctcaggaaatcgaaagtgcttttattgaaatacggaagggagaaaggattagtatatgcatgtggtagcccccggccaaccctgcacgcccggggggggtgcggggttggcccgagcccgagacatgacacccgacccccactaggggtagaagcgacgaaggtgttcgatgttccacgggttaggcagctctgtgccgtcgcccgtggccagccgaacggagcccggccgggggacgccgatcactcgatacggaccctcccacattggtgagagcttgctcagtccagcacgcgtttggacgtggcgtaggacgaggtcgtcgacgcagagtgatcgggcccggacgtggcgctgatgatagcgccgcaggctctgctggtagcgcgcggctcggagggccgcgcgccgcctttgctcttccaaatagtcgaggtcgtctcggcgaagctgatcttgatcagcctcgcaatacatggtgacccgaggggacctcagggtgagctcagatgggaggaccgcctccgcgccgtagacgaggaagaaaggcgtttccccggttgctcggcttggcgtggttcggttcgccctgagcaccgctggcagctcctcgatccacgagtcgccgtgcttcttgaggatgttgaaggtcttggttttgaggcccttgaggatttccgcgttggcgcgctccacttggccattgcttctggggtgggcgggggaggcgaagcagagcttgatgcccatgtcttcgcagtagtcaccgaagagctcactagtgaactgggtgccgttatccgtaatgatacggttaggcaccccaaaccgagcagtgatgcccctgatgaacttaagcgcggagtgcttatcgatcttgatgaccggataagcctcgggccacttagtgaacttgttgacagcgacatacagatactcgaacccgcccggggcccgcctgaacggacccaggatatcgagcccccagacagcaaacggccacgaaagaggtatggtctgcagggcctgggccggctggtgggtttgcctggcgtggaactggcacgccctgcaccgccggaccaggtcgaccgcatcgttgagagccgtcggccaatagaaaccctgacgaaaggccttgccaaccaaggtgcgtgaggcggagtgggctccgcactcgccttcatggacatcggcgagaagctcgacgccttgttcccgaggaatgcacttcaggaggactccgttagccgcgcgccgatagagggtcccttccaccagcacgtagcgcttggagatgcgccggacgcgttcactcccttcgcggtcctcgggtagagtcttatctgcgaggtacgcctggatctcagtgatccaagcaatcaatctaggggaactgggagcgctcccctcgggtcccgaggcctggactccgacgggcctcgagggccgttcaggcgcgtccgtctcccctagggggtcgggtcgcgccgacggctgggcaagcctttcttcaaaggcgcccggtggggtctgggctcgcgaggaagcgagccttgagagttcgtcggcgaccgcgttatcccgtctgggcacgtgccgaagctctatcccgtcgaaatggcgctccatacgccgcacctggcgtacgtaagcgtccatctgcgggtcagagcactggtactccttacagacctggttaacgaccaactgggagtcgcctaacaccaggaggcggcggatccccagtccagctgccactctgagtcccgcaaggagtccctcgtactccgccatattgttggtcgcccgaaagtcgaggcggaccaggtatctgaggacgtctccgctcggcgaggtcaacgtgacccccgcaccggcgccctgaaaagacagggagccgtcgaactgcatcacccagtaggcggtgtgaggcagctgcgaggggcccgagctggcctcgagggcggagacgggctcgggagctggggtccactccgccacaaagtcggcgagggcctggctcttgatcgcgtggcgtggttcaaagcgcaaatcaaattcagagagttcgattgcccatcccgccaccctggagcgcgcaggagcgcgcccgcagcctggagcgcgccctggggcgtgccgccattgccgtagacgaggcggcgacgcgccccgtctcgccgtcctcccccgtcgcccgcgggcggcgaagtcacggatcctccgacctccccgagcgcctccccacgcccaagatttcggcgagagggggacggtggggtgcgagcccgacggcgcgggttctgctccccgtcgtcaccgctagcgctcggagagaggctgtgggccactgcccgttcggccattgggctgagcggaagaagcttggcgcacacgaaagaggacgagggctcagaaagacacgcgcgccccctacctggcgcgccagatgacggagcttggggctcctcaccgggagaccgcgcaggcccccctttgccggttcggccgggggcgctatgtgaggttcttcgccctcgatctaaggaacgtcagcgagaagaatcgcacaagacacgtgcgacgtagacaggttcgggccgctgagaagcgtaataccctactcctgtgttctggtggatctgagtgtgaaggaatacagagagctggagagcgagagagagttcaggctttcgcctccattcgccagcctccctcctctcctaggcctgggcctcctttttatctggttaggggtcaccacatgggcctcaagctgcctaaaaaaagaaacattccttttacaatgagggctaatctacagccggaagtgacctctgacaagcacagcacacgccttctgctccgctcgtcagctctcccggtggacacccctttcaaccttcattcaatggccagcgactttcttgccatgcttgcgctgaagcctggcatggatctgaccgggactgacataccaactccaggagtcagcacgccggctccggctagggacgagagccaggaagctctcatcattccgacgggacggggcgaggcgtgtgacaggccgcctgttgccacctaacccacgatctgaccggtctgtgaccggtcacataccgcgactggtcacggaccggataagcatgcgctgcgccgcattgaatacggcgcggcgcgctcgtctaacccgctataaatgcggttaggtgagcgccgctgtgctcacctaacccacacacgtggcgcccacaccacaggggatcggggcgccccagccctcggggccgaaacgggagcggcccgacccctcggggagacagagggaggggtggccacgtgggtgatcgcggttacccaagcctcttgtcacgatacccccggccctatgtcaccgacatacttctaaattgtatttctatatttgtatttctatattgaccttaaatttttcttcccatgtttttcttaatttcgaattttagttatttgaaaattatatttttatacggactctaaactcttcttttaattttattatgtttattccaaattttagttagttttaaattcctatatggactctatactctacttctaatattccttattttttaattccgaatttctttttttttcttaattgtatttctatacggactctatactctacttctaatattccttatttttaattctgaatttcagttatttcctaattgtatttctatatggactctatactctacttctaatattccttattttcaattccgaatttcagttatttcctaattatatttctatacagactctagtctactattctaatattccttattttttaattccgaatttcaactatttctaaattgtatttctatatagactctagtcttctcttctagtattccttattttttaattccgaatttcagctatttctaaattatatttctatatggactctgttttttcttttttctaattaatgtgagaatatctaggccatgagagcgatcgtggagactcctttttctattcctttaataatataatagattaaagatgcttccgccgtccgtcatccgtgtttgaatcagttataaaaactaaagatatttccacggtttgtcatccatgtttgagtcagttttgcaaaaaaaaaaaagctaaaaaaacaaccgagaaaaaaagtccgactcccctacgaaagcggtgaaaaaaaagaaaaagaataaacgtagatccaattccaaaactggaaaactaaacaacgaaaagtcgggaaaaaaagcgcggcctctactaccagtccaaataaaaaacaacctagaaaaaaagagtccgattaaaaaaagaaaaggaaaaccgtagatacgattgcccttaaaaacagggaaaaagaaaagagaaaagtcggaaaaagagcgcggcaaaaaggaccgattttaatttgttttagtagtatgtatatactattctctatctctaatctaatctaatcttactatgtacaaaaataagttttcatcgtacatttaaaaagaaaaatacgtgacaaaatgaaagcggt

SEQ ID NO: 47928 - DNA, 2581 bp, Oryza sativa
ctattcttgataacatattatatggaaataatattaaaaaataaacatatttttaattgttatttagagaagagtgctcaatgactctattttgtgtagacttggtcatgcgagacagggtaggatttaattggtcctattattggtgcaggaatgagattgaaagagtattttagattatatgtatgttgccacatgaataatccaattattttagataaagcaaacatcggtaaagttgccatcgtcgaggttgggctattatattgaagatgttccaattttctgattgtcttagctacaaacgatctatacaaacattgccattgacatggttatgcatgaaaaatgtatattatcattagaaatttttcacctgttgcaacgcacgggtatttttgctagtctaaaaaaacgaacctagaacttgatgtgccacatcatactataacgaatctggataaatatatgttcaaattcatagtactagaaaatgtcacatctagtactggggtgtagtactggggtgtatttagttcacgcaaaattagaagtctagttgaaattggaacgatgtgacgaaaaagttgaagtttgtgtgtgtaggaaagttttgatgtgatggaaaagttggaagtttaaaaataaaagtttggacctaaacaaggactaggttggtttttttaataggacggagggagtactctgtaggtttcaaaataagtttatttttcgccaattcaacacataccaatataaaactatacgaaccaaaatattcttactttatcaaatcgtattgcaataatcttttaatttatttacttcctgatatatttatctccaaattttataaacttcgatgtaatgattacttaaaacaaatttattttataacaaacgagagagagaaaaaaattaaacttagggcccctttgaatcaaaagatttatgtgcgaatttcataggattcaaatcctataggaaatttttctatttagccctttgattcaaaggattgaagatgtccaaatcctataaaattcctatgaaatgacacattgcatgtggattttagagaaaatgtagcaagaacttcaacctcttggaaaatttcctttgagtctatcgctctcctccgatttctacatttttcccgcgctccaatcaaatgacccgttcatgtgttttgcaattctctgttttgcacttcaattcttattagaattctgtattttttttctatttctctattttttcgaccctatgattcaaatggccccttattatgatacgaagggagtactaccagcttccttacatttgacatgaccattcttgccctgcttggagtgcagcacaactgcacaaggcaaatactactggggctctattggagtatagacttctactcctacttgagttaaatctaccacattattcttttctctgtggttctgatcacagatcaaatttaacattgttcgctactactaatgtatcagaatcctgttgagctcatggattcagtacgatttcaagtctgggtattaatttgattgtagataaaattcatcacaagaatacaagataatgcaggactctggaagggtggatcgttgagggaaaaaaaaggctgagaataaagtatgagggcgttcacagcgcaagtacgtggtgtttagccccacatcaagaaaccgaatattcgatgtcatatcgctaatatgtggagccaaaacaagacactcgttcttcgccttgctcgagggcttgcgagttgcaacacagggaggaacgcgcgcagccgcgttgtgaagggcggagccttacgcagcatggctttgcacatgcgtcggcgagtgacccctccccccggctcaccgacgtggaacctgtattttagacccgtatctctagcctatgtggcactgtgaggctcctcaaactaatgtgactgtactgtgaacatcgtctagttaaatatatacaaacatatatatttttttcagaaacttttgggtattcacgtgatacccaagaaccctctggatctgcccaagcagcttgccaaggagctgatttgattgattttgccaacgtaatcttcatcgctacctaggaaaaaccgacttcttcgctggaaagaagcagcagctttgctcaacaaatggcaccaaactcaagaaaagtttcattctgaagacaatttttgaccgacgaaaatgcagcaagcaaagcataattaagcatcctctagtcatcagtcaaacgtatgctaccatgctgtcaggaaacttcggagttttgtaagtaaaccaacaactttggatcataacaggaagatggagtatgaaagagtactaaacagatgaagcatatcctcttcagtgatacttttcttgtgtctgaaacaacttggaattagacgaatggcccacaaattcccttttttttacttgatttgctagtcttactcgatcataataaatatagcaacatcaactacaaccggtcaatcgaggtttttgggcactgatcataataaacataatgtcaatcgagtaacatttagtttaaa

SEQ ID NO: 47929 - DNA, 15607 bp, Oryza sativa
cctagacagggtttcaaaaaccgccgggggcccggttaccgccacccggcggtacggcggttaccggcggtaaccgcggtaaccgcgcaaaaccgcgacaaatttacaaatcgaaatttgaattcaaaaattcgggcaaaccgcgcggtttgacgcggtaaccacgcggtttggcgcggttaccgcgcgatgtgtaatgggttgcacagtaacgggccggcccatttttttttctttttccaattttcaaatttattctccgttttgctctcaaatttgaataaatattactcttttttgagaaatttcttcaccataaaacactataaatcaagcactaccttcactattttttttgatttttttctttttttttaaatttttgaatttggacgaattttattaaaccgtaccgcgcggtacgggtaaccgtacccccgcggtacgggcggtaaccgcggtaaccgcgcggttaccggcggtttttcacaccctggtcctagacaactgagacacaacttatcttccttggctgttcatgttcttgcagtttgcttcgtcagatacagtcatacagaacttaaatctttttttcttcacaagctgtgagtgttgtctttagctgtggatgcaagctttgtctgaaccttgtgtcctccttggtcattcatccattcattcatggtcatgcactatattccaagcttcaagctggtcttgtcagtggcctgcaacattaaatgcactttgccatgttagcttcagcatatccctgctgggagagaaaggtgaatccaccattgctgcctgcaccttcttgttgcttgctgcttgcattggccatgttcattcagtgagaaaatcagaaagagaaaaataagggacagttgaaagttgaaacccagttagttcattcatggcttcttttgttctcttctccgaatggaaacaaacggcaaaagggtttaccaacttgtgtgttcataatcaaggttaataatggaagttgcatagcattttggtggcaattagcatcacaagggatctgaatgcacttgtctgaaggaaaactgtatactacaggaatggatgcaggtttcttgcaagacctgcactgcattcagttgagttagatttgactataacagtacaacctcttgaatggatctggtaattagcacataattgataattgcatcgagttcgacagtttcaattggttaacttgaccagaactataattgcatatcattccatctctttcggagtttcggtctttcctagccaaatgattattgtcctccagtcttctctgaaatgatctcatatgcagtatttttttctgctgaacttcactcaaatctcatatgaagtataggctgtgtttagatccaaagtttagatccaaactttactccttttccatcacatcaacctttcatacaaacacaacttttcaatcacatcatatctaattttaaccaaaatccaaactttgcgctgaactaaatacagccaaagcataactgtattacccaaatctacataaagtgataaaagatcatgaatcgaaaaataattcaagaacctgttgttctagttgcaaatagtcatcaaaagctcaggcatgtcaccttacaaaatgttactacaacaagacctgccttttgctcaacatctcaagtgagagaatcatctgacaacaactaatacaacagctacctttgaaattaatttctacattagtagcaatacgacttaaacctgcttataatactagataagtttagcaagtctaaacatgtaatctgaattaattttttcgagcttggtttcacatgacgctgcaagagttggcgttgtcgtcgctgaaaaggtcgccgtaggagttcctcgccggcgaggccgcgctcctctgcggcgtcctctggccgccgccaccgccgccgccgccgccgccgtagtagtagtagctgtagtagccgccgtagcggtaaggcgacggctgagactgcgagtagtacggcgagtacgcgtacgagtgctcctgcggcggcgccggcggcaatggaggtggaggcctcgcggcggatgcaggacgcgcggcggcgtagtacgccgcgctcgagctcggccgcgccacgttgtagctcatgacgtgcaccggctgctgctgcaatggcgccgccgggaagtggtggctcgtgtggttgccctgcgttgatgccgccgccgccgccgccgtggccatggtggcttcacctgccttctcctctttctgctgctgcggcggctgctgcttccttctcctcttgggctcactgggctgctgcgccttgaccgtctcgacgccgccgccgccgccgccgccgtcgccggcgctctcactgacattggcgtcggtgatctccgtgccaccgtcttcagccggcgccacggcggcggcgccctcgccggcgaccttcttgggttcttcatgcgtcacctttgggtcgcttggctccgcggcgtcgccggacgccggcttctccggctcagccggctcgccggacatgcccggctcggcagcttggttcttggtttcttcttggcactgaccaccattgggttgctgctgctgctgctcctccggccattgctcggcgtgcttcccggccctcctcagcttccttacgagagtgtcggcgctgaccttgccggtgacggtgaccgtcgccttgttgctccggccatcgacgtcgcatctgtacacgccttcggaatcaacagagcacattattctgtcagttttagtcacgtttttctctgcttttttgaagtgaaaagagaagggaaaaaaaatctgtttccacagatgcttcgccgatgaaactactaactgcagcatcaaaaaatggggagctaaaaatgcatcaaaatgcaggtgatttgatttgatttgatacaaacgcacacaccttcaactctctggagcaccttcttcaccttcttcttgcatccctcgcagtggatggacactctgagagccaaaacctgcagcatgaatcaaatcataatcaatcatttaaaatatctctgattgagatgaaaaataaatgttctctctcattctcaacctcccagtggatgtgaatgcatgcagaaggaagacaaagtagtgagattgtgagtgagaatgtgtcgatgttggtagtctggtaattggtaccttgcattgcagagattctgaagccatggaggaagggaaggtatagcggtggaagaagggaaagtggccaatgagtgtgtactgcactgtcaacggcgcatggacgagggaggagaggttttatagcggcacggagtacctacctgtagttcagaacgccataaagaatcaccactgtttcatgtaaaattcgtggtacaaattttgtaagaaacttctttttttttattttacatattacgtgaaagacacgtacacaacaaaaaacaatgctgttttaaatggactctttgccgataaccgattatgtaacactagtttatatagcggttaactttataactcttttgaaacacattcatatgaaaatataggaatgtgccgcgtgtgtaaaatagaaacacgaaaaggtataaaaaacatttgactgattttttaatggttggtagggaaaaaataggaatactgagtattaagttaatagtagatctcaatgccttgatccatacaacttgaggccaaatatacttttagagaatgctgttgatcgggcgctcgggggagcgcagcaaaaatcgtcccccccccccacccgacgcgcgtggacgcccctaggaccccaccacccacactgccacgtgtccccaccacatactctattgtaataaatcacccacatattttagaaaaacctctattaggagatttcgtttaattttttgtttcgcctagtgtactcacaatgtttcactatgtatagatctaatgttgcaatgaactgaaatattttttttcaacaaatcactcacatattttggaaaccctctattaagggaattcgttttattttttgttccacaaaaaatgtttcatctagtgtactcacaatgtttcattatgtatagattaatgttgcagtgaactgaaatatttttttgctatttgctgaaacattgtttttatataaggtgaaacaacgtccgatttaaacgattaaaacattttcgatctacttagtgaaacaattccgatatacttagtagaacattgtgcaatattttaaaataattcaataataagctaaaaaaatcgtcggaatatatccttgtgtggtcttgtcttgaagatttaattgtaacgaatttaatggtgcaatcggatcataatttggataaataatttaagagaaaaattaatttaaagcggttttgtatgtatgcgtggcgctgatgtcatgctaatattagcgtccgatttttgccaatccggatcgggcgaccgatccgtagtctcctcctatatttatgtcatgacaacctattcctatattttttttagttcccacgtgtttttaaatcatgtgttctaaaagaaccctaaagaatttggcaatttccaaccttagtattccaaacaaccctcataggaaaataaatcctccatatttctcataataataatatttgcctccacccaacacgagctgggaaaaacatgagcgtggagtgggtttaacgggtctggatcccctggagttgagtataactctaccgggtggagttggccaaatctgtgacatccattgtttcctacagctgagatcattcctcatcaatttcacctaataaattaactccttaaattaatggttatgactttcgaggaaactttttttcatgcattttctctataaatagcgatttgattaaattctcaccaaaaaaaaaataatagaccagtgttttgttattgcccaaacaatagatataatcgatcaactctaaagcttcaagcagtctataccaacatgtatagtgctttcacatacagtgaaccatatcaatattaatgtgtgtgattttttatataatagatgaagcattaaattttttgctaattatacagtaaaactgatctcatgacaagttgttgatgcaagtttatttgttgcatggtcagttactggtttttaagtacaaattaatgtggcttaatctcaacccttgaagtataccgaatggcacatgtttaaccaactacaaattaatgtggcttaatctcaacccttgaagtataccgaatggcacatgtttaaccaactccaccctgtagagttatatctaactctagggaatctggactcgggtttaacatttcctttatttttcctccggaatcacagggaaaggaaaattttatagcttttcttgtgttcattcctacgagaccagacagtcagacaatgccaacaaaaaaaaaagaagactaagaatgttggttatgtttcctgggattgttttatattccagagtttccattaagattgtgttagctgtagtgaatttcctcggtgtttcattatctgtcttccgcgtcatgccgttttgtctgtcatcacgggaaccggaatatccaactgtacaccaaaatatttaactatttatcacttttacacgtgatgtttaacaaatttacgactgaacttacatgtcatatacagtacataaaaccaatgccatatgaatgataaattattaaacatcaaatctaaaaagtgataattagttaatgctccgtccaagataggagatgatatatagggctgcagtgtggagcgtttccagcccacggacttgtttgctttgggaagcccatgaaatgtacaggcttctcctttggtgaatgcgcactctttctaagctggtagagttttgattttatataaaaaactaacatattaatttttaaatactttttgaaataatctttgaactttgtaataatttattccttttttactctcaaataattatcacaaatcattgtcttaaaaaacaaaaagaactcatcagaacctagtatttacgtacttctcatggagtttcctaaaacagaacagcttttcattcgattacccataagacattgattaattaatattgttgtaaccagctttgatatagtgatagttccagaagcttacccgaatattctttttttttttgcttatatactttctccgtttcacaatgtaagtcattctaactttttccacattcatattgatgttaatgaatctagatagagatatatgtctaggttcattaacatcgatgttaatgaatctagatagagatatatgtctaggttcattaacatcgatatgaatgtgagaaatgtaagaatgacttacattgtgaaatggagggagtagttcactaatccgttcgacaataagaccagcagtaggataagaaatccagacctccaaacgaaaattgctatacatatacgacctaactgttcgacttatatattactaaatttgatcaacggttgtaaatgactacagtgtatatggatatgctattctttcattaatctatggttacatgtttcgttgtatatgagttgtacaactagatcctatgtaattaccaaaataaacgaacaatgaaaatgaaaaaggttggaacttgttgctgattgctcataggatcatccataactaagtcagtctgattctttatactcttttttcaggccttgaggggagtcagagaccaacagcagcttctcatttcaagaatgcctacagataatgctgccattatctgttgagagtgggaggtgaactgaaacattgagtagcgatttggcgcatcaaaggaaagaataaatctaaacaagtgcttatcggattcattctcagaagctggttttttcttcggatttgatataaatgtgttgccatatttttcatgaaaaaaaatactccatcctttccaaattgatcatcatataatggaatccaaaatttctcaaattgattatcatataaccacatgaacacggatttcattaaaatacaattaatgccgcataagagaatatgtgcatgctagggtgtaattgacatgatgttttaattgatgcatgtattgcaggagaatgtgtgcatggtgtcttgattgatgtgatttaaattatccttagtcttgatgcataaacatatattccctccgtctctaaatatttgacgccgttgacttttttaaacatgtttgattgtttatcttattcaaaaacttttgtgaaatatgtaaaactatatgtatacataaaagtatatttaacaatgaatacaatgataggaaaagaattaataattacttaaattttttgaataaaacgaacggtcaaacatgtttaaaaagtcaacggtgttaaatatttagggacggagggagtatgattatcattttgggatggagggagtagtcagtatgtatttatattgtactaagtccctaaattatatatgtaattattaattatagtgtatctagaatataagttcctaaattatatgtgtaagttccaaaattacgtatgtaactctctaaattacatatatgtaattaattacacttgatttataatataattatatttgacatatttttacaaaaacctgtggccgtagatagttttctttgaaggagggtacacaagcatatggcacacacataccaaacctaacagatgcagttactgatatgatccatccacaccttctgcaagttcacgatttcaaggatgcatctcccatgtatcctgggatcacgcatactttgcagggccatgtatattcctgtagcaaaaaacaaaataatccaaccaaattacaggtttaatttcgagagcatatataaacatgggatcactcacgctaaattaatttttgtgctgtgcacgtacacgattgcattgctactgccatggctcacatgatgacgtcatcacccactgcctgcgttgtccttgctcttgcctttgtcctcctcgcagtgacgccgacgctctgctacgtcactgacggcgcgacgcggcggcgaggcgcgagcacgagccggcgccatggcgaagctcggacttacatcgtgctcgtcgagccaccggatgccgacggcgatgacgacgaggccgcgcaccgccggtggcacgagtcattcttgcctggcggtggcggtggcggtggcggcgaggagcgggcgtcgccgacgcgcatccgccactcgtacacgggggtggtgtctggcttcgccgcgacgctgacgcgcggcgaggtcgccgccgtgtcgaggaggcgcgggttcgtgcgcgcgttcccggagcggaggttgccgctcctgacgacgcgctcgccggggttcctcgggctgacgccggagcggggcgtgtggaaggcggccgggtacggcgagggcgtggtcgtcggcctgctcgacaccggcatcgacgcggcgcacccgtcgttccgcggcgagggcatgccgccgccgccggccaggtggaagggcgcgtgcacgcctcccgcgcggtgcaacaacaagctcgtcggcgcggcgtcgttcgtctacggcaacgagaccggcgacgaggtggggcacgggacgcacacggcggccacggcggccgggcgcttcgtcgacggcgtctcggcgttcggcctcgccgcgggcaccgcctccgggatggcccccggtgcgcacctcgccatgtacaaggtctgcaacgaccaggggtgcttcgagtccgacgtgctcgccgggatggacgcggcggtgaaggacggcgtcgacgtgctgtccatctccctcggtggcccgtccttgccgttcgacaaggacccgatcgccatcggcgcgttaggggcgatgtccaagggcatcgccgtcgtgtgcgccggcggcaacagcgggccgacgcacttcacgctgtccaacgaggcgccgtggatgctcaccgtggcggccgggtcggtggaccggagcttccgcgccacagtgcggctcggcgacggcgaggcgttcgacggcgagtcgctcagccaggacaagcgcttcagctccaaggagtacccactgtactactcccagggcaccaactactgcgacttcttcgacgtcaacgtcaccggcgcggtggtcgtgtgcgacaccgagacgccgctgcctccgacgagctcaatcaacgcggtcaaggaggccggcggcgccggcgtggtgttcatcaacgaggcggacttcgggtacaccatcgtcgtcgagaagtactacggcctccccatgtcgcaggtgaccgccggcgacggcgccaagatcatgggatacgccgcggtggggtcgccggccgcgtcccacaacgcgacgatcgtgttcaacagcacggtggtcggcgtcaagccggctccggtggtcgccgccttctcgtcgcgcgggccgagcgcggcgagccccggcgtgccgaagccggacatcatggcgccggggctgaacatcctctccgcgtggccgtcgcaggtgcccgtcggcgagggcggcggcgagtcctacgacttcaacgtcgtctccggcacgtccatggcgacgccgcacgtcaccggcgtcgtggcgctcatcaagaagctccacccggactggtcgccggcgatgatcaagtcggcgatcatgacgacgtccagcgccgtggacaacgacggccacgccatcatggacgaggagcaccggaaggcgaggctctactccgtcggcgccggccacgtcgacccggcgaaggccatcgacccgggcctggtctacgacctcgccgccggcgactacgccgcctacatctgcgcgctcctcggcgaggcgtcgctgcgggtcatcaccggggacgccgccgcgacgtgcgcggcggcgggctccgtcgcggaggcgcagctgaactacccggcgatactggtgccgctgcgcggcccgggggtggaggtgacggtgaaccggacggtgacgaacgtcgggccggcgagggcgaggtacgcggcgcacgtggacgcgccggggtcggggacgacgacgacgacgacggtgaaggtggagccggcggagctggtgttcgaggaggcgatggagaggaagacgttcgcggtgacggtcacggcgagcggcggcggcggcgcgggcggcggcgggcatgtggtggcggaggggagcctccggtgggtgtcgcgacgtcacgtggtgcggagcccgatcgtggcggacagtagcgtcggcggccccagccgcaggtcggcacaagatgcttaattagttgccgccttcggtttgatcaacactacatttatatactatcgtcaattaacccatgtcatcgatatttatacatttcaagaggtaaagtttacagcaaattgtctcgaagtttacggtcgacggtagttcgtttacagtgatatggtgccttgaatttttttttttcacaagacggtttgaagttccattgatagagcatgaaaatccttgaagaccgtaaccaggaaaaacgaaaaaatataccacctcccacacaccgatagcgctaacacacaagtctagaagaaggctagcactggaccagccgatgctgagcatgaccgaccaccgctaggccaacaacagaacacagtcgagatcgtccaaaactcgacccttaaatccaacacacagcctaactctatccatgtattcaggatttagggagagagggtgagagagaagttagaacacctcgaccccctaggccctccgacgtggttaacttgtagaaattaggacgctgccacaggaggatgagaatctagagtgtgcttgcatcaattgtttgggtggtttcggcaaggggatgcctggacgacctctccaaggagagaagcgacggaaaaccgccgtcgccatccgtcaaggtctcaatagagccgagactgggttttctcccggcaaccacccttgagggggtgagacggcacaacaacgccctcaggagggaggaatgacactcgagcgccattgttgtcggtccgaccaaggttgggctgggttttcacccgccatccaccacctgccaatctactacaaatgcaccaatgctccatctccatctaatcctccgccaccaatgttgcaccggcaccccccgccggcccgtcgtcacgtgttgccacctcaccgggctccaactccagtgacatcacctcccgctgcggcctcgatgctgctggccgcaactcctccgccgtgccagatgccggccgagtctcccagcctcaccggccatccacagccaccggcgcccgcgcatgccgccacctccgccactcacccaacacctcgaggaccatgggcagatgaaacacaacgaagaactttattgatttttgctatacaggacatgagctattggaagggaagatggtcatcacgggctcacagacaaatcaggagagaaaggaagagagaaaggaagagagagaaccagatgaatggggaataaaatattagtatttacattagctgatgttagaggctgtttattgtactactatgagcaggtacaatagcaggctataagccagctacaaacatattttaaggagataaatgaggagagagaagagaagcgggctacagatttgtagccagctgtagcacagactttaagacacagtgtgtgtatgacaggtgggatcaagtattaatagtgtagtatgtaactattgtatgaatgagctattagattggctatagataaattggagctagtagttgactatactattgaacttgctctacatgttaactactctgttgcctgttggcggtaaatgaggggtccatgcataggattgcaagtgggatgggttgtgggccgtcccgccccaccccacaccagccgcaaactgcatgtgcgggcaaacggcagcccgccccgcacggcttggcgggattgctcagcccgacgggcaccgctggacagcccacaatgtgcacatctctgtttaattaggttcatcaatcacacaagcacataactactccatatcccaaatttagcacatgaaaactgtattattttcatgtgaaagtattctttttcaatgacataacaagtatagtactgaataagaacaccattcttttccttcaacatcatgactaaagttagagtgatgatgatgcattttctcttcatgataaaccaactgtcccaattgacaaagtgacaaacaactgcttccagctccatgagctcttccggtctttttctatattaccttcaacacattaaatttaataaagttggagtggagaaactactaatcgaaaattagaaatgaattcatcaaccgactgatcacaacgttattccatattgtagaatggagtaaatatgtactaagtttcatcaattaagaatgcatccaaaatatgaattaaaggacataattgacaataacaagcagttatcgaggatagtgagatatataacctgctgctggttgttgtgctggtactgcatgttactagaggtgtataggcattttcacctgtataggaagaaacaatggagttaataaaaaagagtacatgctggactgttggatgttaataaaaaagaaacaatgatgttagtggtgtagtatacaactatacaaaaatatagaatagccaagttaattcaaacgaatctcaatttaaatacctgaatgttgcacattttggtcatcactctcagcaagatcacgtgcaaagaaatcacccaaaccttctgccctcatccaatcttgaaggcaaatcaatgcctctacagtactgcttgaaagtctacttctatagtcactaatgatcctttctccagttgaaaatgctgcctctgatgccactgatgttgctggaatagccaaaacatcacgtgccattcgtgaaatcacagggtactttgttttgtttaccatccaccagttcaagatatcaaaatcatacccatcttggaaatcaccttcctgaggcatatcagcaagatatcgaataagctcactctttactttgctcctgcttttgtcatgtagaaactgtctccaatcagcgaattgattacttgcatcaacattctgctcaacacttgtttcgggctgagaattgatgttgtttgagcccccatacttggcagaatattcatcaaacaatttctgcatattactcttgatttccttaaggtaaggagttacagcagctccaaatgcagacttcaaacgaaactcaatgaatttgtacttataccttggatcaaaaataatcgggaaacatatttgcaagtattgagcgtcccagtacttcttaaatttttctttcatttccttgacaatagatgcaatggtgacatcttcatttgtagcctccttgtccaaaaccatctttatcttccaaagttcatgaaaatagcaagttgaagttgggtacaacgtaccagatactgcaacagtagcttcatagaaaactttcaacaaagcacaaagcttctcagccattgtccattgataatcgaagggttgatgcaaataatttatgtcatgccgatccaaggcttcaaaggccattctgtgtcatgcatgtggttcgactttttgtgctcctagatggttgaagggaggcggcgctgcgggcgttgcaggaggaatgtgcgagcgtgctgctagctggccatggcggtcaatttgttggactaatcagcatagcacacaccaaatccgagaagaggaggagcagcactgcgtaaaaaaaatactccatctgcgaagaagagctagcacctaacgcagataggagcatctcgcaagcgatcgagacttcgagagcatggagccacagctgccgaccgtgatatcgatggagtgggatagcaccaccgagccggccaaatcgtcgccgccgtcacagaggtacggctacctggagaggatccgtaacttgtccgtcgtctcggccgaggccggccggtggtggtggccatgctcgtcgtcgtcgacggcgagatccagctactacagcagcagcatgtcaagcagcgtgtccggtactggctctcagaatcaacggtacgtctcttactcttcgccgaggatggtaagactcgacgtccatggtcctcgagacattgcgaggcagatggtgcacgatgcatgggttcatggtgaacttgatcagagacttcgaccgggagcccgaccatgcgctggagaggtggttctccgagctcgacgtcggttgggtactccggtcggcggcggagaaggagctagccgccaagctcggcttggatgatcttgtgcagcggtggacgcgaggatatgccgtgatggtcgaagcactcgtagctacgcagcaaaatatgaaatttcaggatcataccaatatggagctagaagacgacctccgacctctccaagtcactcggttcgtggaggcgaccgtatccaagatgcttgcctttgctgatgccctcgccgctgataacacttggcggccaattgacaagctctcgcggtcgcggctcatgtgcctgtgcacctcgatcaacgagtgcggcatacgaatcttgtcagaaataatagtatttgagtttgattgcatattcagcaaaatgaatggtgctttctcagccatatacaggatggccaaggatgctgaagccatcacttgaaagaccaagaacgactatagagggggggggggtgaatatagcaattcaaaacttgtccccaaaaatactcatcaagccggatttctcaaaattcttactagaactgtggctattagagaagccggatctagaaaagaagagagatggaattcccgaaactagaagtgaggtgaggagaagatagcaaaacttgtcatcgcaaaattcaaatcgcaagcgaaatttaaattgcggaatttaaaaggcgaagacaaaacgaaatgcttcaaatcatttcattcatcagtgttgcaaaataacagctcaactaggagcaaacatacaccttcagaggaacattaacacaaacttaaaaatcactcggacaaacacactccaaactaatcctaatacaaaagcctctcgggcaaacacactccaaactcacaccgaaactctctcaccgagcatctcaaaaggattacaaaaggagcaacctccacccttgcatccacctctctatttatagcctaagaccccctaaaacattgtcacaaatgcccttagggcgaaatcctaactcacatgcaatctgggccatacgttgttccttacatcctaaggaagtagcctggatggaagccacgtcgcttgccacaccaggatcctcttttcacaaagaatccgcaccaaattcctcccatgtgcgtgcccgcgtgctcctcaacgtgagccccgtgatccgtgagaaggctcctccgagccaatcagcatgcaccgatcgggagatcgatccgcgtcgtctccgtcttgccgaatcaaaacttgccacgttgctcagtagtgctgtgcacg

SEQ ID NO: 47930 - DNA, 3001 bp, Oryza sativa
cgaggaagggatagattgggttggcctccctgccaaccaatcacaacacacatgcacccatgggctagcaagctcctcatgcacacatgcatgtcttgagcccgtgcatggcattcggccatgtgcacgcatgcataaccgaagcaccactccccatgcttgcatatgcacatgccagtgcatgtatgcaagctcctcttctattctccattttcttcgcgaacccggcacttgcacttgaccttgcgaactccgttgcgaagacctcctcacacggtgtccgtccaccgtgtgcaaccttgtgtccaatcttgtcacccagcatccttgatcgctctggacctcaacttctccctgagtctagtcccgatccgccgttgaccaagatcgaccccgatcacctgcacacacatgaaccaaacaaccgttgtcttggcacatatgtcgcaacctgaccaatgttagtccacacacatacttcttgcacttccggtacttgtcaatttcccatcactaaagaactataaccacacatggtttcacaatctccccgttgatgagaacaatgacaatctcaagcaacattttgaaaatttaattttgattcacaaagcaaaccattttgcaaaagtcgaactttggtcattttgaaatcgcgaaaaatcaagaccaagtgacaagaagaaaagggatgcaaatgcaaatgcaaaaatgctcccccttgtgccaaaactccccctttcaccaagatctaaagcaagttttaattttcaataagtgcaaatttctctccctctttgtcaatgatgccatcaagatcaaaagagacaaaaatgagatgaaacttgcaaattttagtgttttgagagctttgagagttatctaaaggcatcaaaaggtagacatggatcacacagatataaacatgtgctcaagcctagctaagcatgtgcataagaagtatgaaacatgtcatggatatcaagatagtatcggcagcaagcaaaaagctttcaagtgaattagtaatttagtgtgcaaagctatttctagaagaagcttaaaaggaagcaaaccagctcataatcaagcaagatttacataaccaaagcaatgaacccatgctaatgtgctaatgcccagttcataaagagtatcaacatgataacaaaacatagaacatgagcttttaaacttttctcataacttttatttttatgtttttttaatttctttaaagacaatagcacaatcacgacggtccacctgatcttatcagtcagcaagtcatggttgtgccaaacactgccgtctgacctcaatcaagttttccagctagagttcccattacaggctgtctcagtgctatcttcggtactactcatgcgtaaacgcactcagtagcccgaacaaaaacagagataaagcttgtaaaacatgattgatacaaagtatgaacacataagcatgagcattcatgagcatgtactgacagttattgcaaaaagaatgtaaacatggcatgagtatgagatggatactttaacttaaacaaacttctagagcaaccattgcacattgattaagttcaaatgaatagtcaatttaagcaggtttcaacaagcttgaacagcataacatgatcacacaagctacttaagaaaatgaaagctagacaagagatcaaactagcataagagtgatacatgcatagcatagtgatgaccaagagataacaagcaaagctcaattgaagagtgtataatacaatgcataaagtaaacatgatgcaatatgttacaaatgcatgcaaaagaaaaacaattccccctcaaatcaagccataggggtggatcacccctaactcactccgcaagaactcaaaacgagagcgatcaagtggttttgtaaaaatgtctgccaattgttttcacattcaacaaactctagcacaatggtacctttctcaacattgtctcggagaaagtggtaccgtatctcaatgtgcttggtcttggagtgttgaactggattttttgcaatattgattgcacttgtattatcacaaagcagaggaacaccagagaaagacagaccataatctttcagagttaaaatcatccaaagaacttgactacatgcactagcagcagctacgtactcagcctcagctgttgattgagcaacagaagactgcttacgagaggaccaagaaatcaaagaagtgccaagaaaatgacaagtgccagaagtactttttcgatcaatcttacacccagcaaaatcagcatatgaaaaagctcgaactgaaagggcagaagagcaggagtaccaaataccgtactcaagtgtagacttgatgtagcggaagatgcgcggaagatgcgcttgactgcttggcgatgtgatgctcttggagaagcctgaaacctcgcgcataggcacacggagaagtggatgtctggccttgacgcggtcaggtagaggagggagccgatcatgcttctgtactcgcgttggtcaacttcttcaccgtcctcatcaggaccaagcgatgaagtagttgccatgggagtggcgattggcttgcagtcggccatgtcgaacttcttcaggagctctttggagtacttggtctgaggtacaaagattccttccttagtttgcttgatttgaagtccaaggaagaaagtcagctctcccatcatgctcatttcgaattccctactcatcacatcagaaaactgggcaacaagtgcacgagaagagccaccaaatatgatgtcatcaacatatatctggacaagaagaaaatcaatgccactatgaagagtaaagagagttttatcaatggcccccatttcaaaaccattttgaagcaaaaaggttttcaatctttcataccaggctctgggagcttgttttaaaccataaagagctttatcaagtttgaacacatgatttggaaattttggattttcaaaaccaggaggttgtttga

SEQ ID NO: 47931 - DNA, 1901 bp, Oryza sativa
aatcagcggtggtggagttgaggcgacgtgatcgttagacgcgggttttgttcctggacctgtggacggcggaggccgatgcagcgaaaggaggcgcggaggtcaacgtggcgcgaggaggcacggccggcagtgatggaggccggctcggtgtgaggaggcgcagccatcgaagaggcccatcgactatgggagaccagtgcggagagcggatggccgcatggtggcacacgcaggctaaccggtggggggcgccggtgcaacagtgcccacacaccgatgaaggatggatggtggtggagcaatggagcatcaattgttgataggcaggtggcggccagcggagcaatggagcatcaatatgttctatcactttctttgggagtttgagtgtgcacatataaaaggttggcggcgaagagaggacaaaattgacaagggtaacaagggtaagtctttggccatgattaagaaacatggtgattgccataagtcttctttcaactctatcaattaggggggagggggggaattcaacaattcttggctttgttgttccaaccggaagacccaaataagtgaagggcatcgaaacaatattacatcgaaaagtaccagtaaggatttctagtttttcttcattgacatgaattggcatcgtacaagatttatggaaattctcaaatactccctccgtttacaatgtaagtcattctagcatttcccacattcatattgatgttaatgaatctagacataatgtgggaaatgcttgtctagattcattaacatcaatataaatgtgggaaatactagaatgacttacattatgaaacggagggagtagtagagtaagcaaatggttgggtaatacctttgagacaaaaagctctttttgacaagctttcagaatgatgagaatatcatctgcatattggataattgggaattttcccttccacttgtgggattggcatagataagattccctgagaatgagctttgtttatccttgaagtgttttctttgttggtcaacataaactgtgggagtactagtagtggctttccgttgtttctattcccatctaaagtgctgacatcgcaggtaaacaattacctcatgagaaaacccaacctatagggtggggaaagaaggattttggtcttcaccatcctcactaatgtcctgtttggatccaagggatattttttagtccaccctcaaatagcccaaatagccccaaaaaaatccaaaagggtgagctttttgagggctatttggaaataacccacccagaaaaactatcccatccaaggggtgttaattggggctatttcgggtgggacccactgaaaaagtgtcttctctctatctctctccatgtgaaggtacattaaaggccaaatagctctcaaaataacccttggatccaaatgattagagttattttattgaagggctatttccttatgctaaaaaaatagctctcaaaataactcttggctagttttccaaacaaagcctgatattgcaggtgaataattacctcatgagcaaatactagcctagggtagggacacatggatgatttttttttaaccacccttgcaatgtcattctgcaaaatgtaaagtcgtacaagacaagaaaaatcaccagtagtctttgcatgaacattttccatccttgaagtgatgaaatcggttcgtatctctaatatatatctccctcccctcgaaagatgatatgaacttcattgcttcatggcagtcaccacaaatccggagattctttatcacctgaatcaaatatcccttgcatctcagcatcctcacttcaccatccttcaccatcctcacttcattgcttctcagttattgcagccatcgggctgcagg

SEQ ID NO: 47932 - DNA, 3172 bp, Oryza sativa
acacctctccgtgggttgttgatcttgccggtgcagatcaaccttattcctgcaagcaatcgagaacaagcaagaacaagatataaagcaactgaattgctagatagacaagacttacaaagataaattgatacacgataaagtggggttccgaacaagcagacggacggtctagccgacacgcgcgctgcaagcgaagtagcaatggctaaacttacaattaatcaaaacccgagaaaccctgaaggggtaactagctatatataggggtgggagcacgacctaggggtgcctaggtcatgctccaccagcttggggcgcaccccacatgggccccacctgggccggggtcccaaatgaagttacaagcccataggcccattataggtgacgcagcaccttgttcctgtgattccggccacacgagatggaattcagagaagaggctggatccgttggaaagagggctccgagagctttccatcaagtactcacaggccgaaaacggaggtcgtatgcagattcggtggccgtttgaagtcagagtgtagtaggtggccgaatcggattctagcacttggaggacttgatcttgatatcttcttgttcatccatgatgtgagcaatggttgcatccgtggtagccatggtcacatcatctctttcagccataacacgttttcaagatgtctatcagcaaattacacaaattttcggtgtcctgtagcaaattttgcctaacataaaaagtgttatattgatcactttcacaatgttaaggcatgctatatagaccaataataaccaatttttctatatatttaatcgtggtgtattacgtgtttacttctaccttaaaatatgcctaaatattttttatttaccttataacaaagggactaccacaacgatattacgttttccaagttgaaatacgcttatatatttttgtcaaaaaaataaatacatctatatttcattttgatttgtatttaacttctgactactctctctgtcaaaaataaaagattttggttggataagacattgctaatattatgggcatattcagattgtagccaaaattttggcaggatttcttatgtattgatcaaatttggtaacaaactaaagacattcttttgacaattttacttagaaaaataatatggttgaaaatgacatcaaagtgaacatgccctacgaatcatatagcgaggaacggaagactacgacctgttgtgtcagttctcagttgtgatcaccacatgaacaggcccacgtgaatggcccatagaacggcggtccacttctactccggcgagccacctccctcgaactactagtcctttcgccttcctcgtcgtgtccactccccacgcacgcacgcggcggcggcgagccgccaccccccctcccgtcggctttccgatctccgggaacgtcgcgacggcggcgccaatgcgtatgctatgccgcgcgcgctggttctctccctccccccctctgccgccgcaggcgtcatcattgccctcatgtcaggtgccggcagtggggactggggaggctgttgcccttgcaggggcgagaaacgaggtaaagctgttcatcttccctgctggttaagtcgcatccatgtcgtgttcaccacttggcatcgcgctctccttcaagcttccagtgtgccttgagcgacgcagaagccatgggctcaagcagaattgttcggtgcaatgcaacttatccggtggccatcacgcctagaagagatctgcccttcgcaatccattacaaggtgcgtatttctgaggtgagggcatggtttccttgtaaactatgcacgctgcagataattttattttgctctgcatatattgaattaatatggagtagtttctggttatttgggtggggttatggattcgatgcttgtgaaaatgacggttaaagtttgtaggcttgtagagataattgagagaaaacgaacaaaccaatcaattctggaatagccctgcatactattcattcactcatttcatctacagaacaaaacttgttacattatgcaatataatcattccaatgtcataaacaataagcccttgtcaccatatctagctatgcctataattacatcatctaggatatcctattacgtacacatctcaaaatttatgcagtagctgcaggctaatatgaataggcaggatggtagtcgtcttcgtcatcacataacatgagagccttcagaatttcatccattgttggcctcttgcttctttcttccaggcatgaaagagctaccttcaccattgtaattacttgctctggatcaaagtgtccatgcagtctgtcatccactaaatcggtgacattccctgtagcctgaatctttttggcctcctggacaaactctggaaactccacttgcctttcatctaccactatgccgcttgaaaccctgattcctgtcacaatctcaaggagcactactccatagctgtagacatcaacctttgcattgatcggcaaattcaacgcccattctggtgccatgtagcccattgtgcccctcatatgggtgaaattgaaactagtgctgtctcgctttgcaagtttggctagtccaaagtctgctatcttggcatcgaaatctctacttagaagtatgttttctggtttcacatcacaatgcacgacccactcaaggcattcgtgatgaagataagcaagacccctggctgtgcccagggcaatcctgtacctttggctccaacttagcaggctttcgtggcatctctcaccaaagaggtacttgtccaatgactcgttctccacatactcatataccaatagtctgtttgtcccttctgagcaaaacccccacatccttaccaaatttatgtgattgatcctcccaattagagtcacttctgcccagaattcctcctctccttgccgaacgtctgtaagcttctttactgccactattttcttatcttcaagtactcctctataaacaattccagccccacccctcccaagctcttctttgaattttccagtcgcttccttcaattctcggtatgtaaatcgcctgaactggtttgttatcatcttgtatccatcctccatggacttgggtatgttatgcttcttgaaaaaaaggtac

SEQ ID NO: 47933 - DNA, 9048 bp, Oryza sativa
  unsure (1)..(9048): unsure at all n locations
aaatatttggtgattgataaatactactagcaaaagtggtttattgattaaacaaagagagcnattcacttcgcccctaatgtagctcgagtttggctcgatactgcctcgcacgattttagatgtactctgacgtcttttgtggaccaaaaccatgcgttctatcttcacgcaactctattttaaggctccttagaacaacagatttttaaacaaattttagaggaatttattcttatagaaactttttgtttgatcatttggattaaagaaatagctatccaaaaatcctatgaaatttctttgaattggctcaaaacatagaatttttgtaggaattctgacatgggcttcaacctctcgaaaaaaaatcctttgcatctgtctttattttgattcctaccttttctcttcatccaaacaaccatttctacagttttctcatgtttttcaaaatcatactcccttcgttaaaaaaagaaaatctaggactggatgtgacatattatattacaatgaatttggagagagatatgtccagattcgtggtaataagatacattatattcaatactagattaattttttatgggactaagggaataaaatgtaaagtattagcctgtctagattcgtaatgtagacaaattcatagtattagaacgtgtgccttatcatctaaaatcgaaagtatgacacatcgatccttatgtattactatgtattttggaaatccactaccacggactcttgctgtcactatcggacagaagatatcaaaacagtttatttcagcaagtggttatcagaaaggcgattcaacgcatccatctagtctacgcacgcatgcgttgcacgcatccgattttcacatcgatgtttcgtattagacccacttttagtttatactttcactttaattcattttcttcttttttatgttttaacaaaactgatataaaaatatttggtgattgataaatactgctagcaaaagtcgtttattgattaaaacaaagagagcaattcacttcgcccctaatgcagctcgagtttggctcgatactccctcgcacgattttagatgtactctgacgtcttctgtggaccaaaaccgtacgttctatcatcacgcaactctattttaaggctccttagaacaacagatttttaaacaaattatagaggaatttattcttatagaaactttttgtttgatcatttggattaaagaaatagctatccaaaaatcctatgaaatttctttgaattagctcaaaacagagaaattttgtaggaattttgacgtgagtttcaacctcttgaaaaaaaaatcctttgcatctatctttattttgattcctacttttttctctccatccaaacacatttgttaaatagtcccacattggttgtggaagggcaaatgacctaaaatataagtgggggagcccctcacctcaatggagcttttggggtgggaaaggccctttacgatcctacaattggtatcagagcctggctaggttaacatctctggcccgatggacacgtgtgaaggcctgatggaccgtgggtacctgcggggcccgtatacctgatggaccgtgggccggtggggtctatacacggtgaaggggcggtgaagggctgagggacaccaatgtgtgaagggggagattgttgaatagtcccacattagttgtggaagggcaaatgacctaagatataagtgggggagcccctcacctcaatgtctagcttttggggtgggaaaggccctttacgatcctacaccatttctacaatgttgtcgtgttttcaaaatcatactcccttcgtccaaagaaagatgaatttagaactggatatgacatattacattataatacaatgtatctggacaaagatatgtccagatttgtattactaagatgtgtcacatccaatattatatcggttttaaatttgacggagagagtaagattgaaggtgttagtctgtttaaattcgtagtactaaaatgtagacagattcgtagtatttgattatgtgtcttatcatctaaaatcgaaagtatgacttatcgatccttatgtactttggaaatccactaccacggactcttgctgtcactatcggacagaagatatcaaaacagtttattttaaagtaataataaaaaaagcaagtggttatcagaaaggcgattcaacgcatccatctaattcatagtctacgtacgcatgcgttgcaggacccccttgctgtaccaaataattgcaagcaagtgacagtcagaaccctcgagcgtcatcaatttctcatgtgcgatatgattatctaaactctatcgaacgtgccaacttccatgcttttttttttttgaaggaatacaacttccatgcttaattgaggagtagttttgtccggctaatttgctagtctcggccaacccacatacagctagccaccatattttaagagctttatcatgcatatatgcgatttgccaaccaattgattcgagtccaactcaagactcgtagacgaaatcgatcatgtacacaggaagtacccagctaaaagtgaaatcaaaaccagcgtgtgctctgggtcttgccaatggacaaatgttccttttgtgattattactcaagaggaatttcccttcacgaacgaaaacggtcatatcaaatcggcatagcactagtgacggccacgactagttgaggactgaagaccagcaataatgacaatcgtaaactgatgaaatatcaaagtgattgtcagacaaagcgccattatcctgtcgcttacggctgcgtatgtccaaatcaagaatactacccgtactttgatttgcataatgattgcgttgaacgttggttgcttgatcatcttttatacactttgtcccataattttctttgcctttgtagaccgtagttcaaccaatgaaccaaacagcgagctgaaacgatggctggattggtcatcggctgcctggccgtgcagctctcgctggcgtctctgctgctgtgctcgtccgcgtcgacggcgcagcacacgctcggcaccggctcctccctgtcggtggcggaccggtcgcggccgttcctggtgtcgccggacggcaccttctcctgcggcttcattcaggccggcgacgacggcgacaacgccttctccttctccgtatggttcaccgccgccagggacggcgccgtcgtctggacggccaaccccgacgcccccgtgaacggcaggggctcgacgatctcgttccgccacgacggcgagctggccctcgccgacaccaacgggaccacggtgtgggcgagccggacgggcggcggcgggcggggcctgaccgtctccctccgcgacaccgggaacctcgtcatcgaggacccgtcgaccggccgcgccgtgtggcagagcttcgactggccgacggacacgctgctcccgtcgcagcggttcaccaaggacaccaagctcgtcgccggctacttcagcctctactacgacaacgacaacgtgctgcgcatgctctacgatggcccggagatcgccagcatctactggccgttgccgggggtgagcattttcgacttcggccggacaaactacaacagctcgaggatcgccatcctcgacgacgccggcgtcttccgctcctccgacaggctgcaagcccaggcctccgacatgggcgtcggcgtcaagaggcggctcaccatcgagcaggacggcaacctgagaatatacagcctgaacgcgtccaccggaggttgggcggtgacatgggcggcgctcagccagccgtgccaagctcacgggctgtgcggcaagaacggcctctgcgtgtacctgccgagcctccggtgctcgtgcccgccagggtacgagatgatcgaccgccgggactggaggaaaggctgccagccgatgttctccgtcggcaactgcagccagccggcggcgcctgagcggttcaagtctgtggtggtgccccaaaccgatttctacggctacgacctgatgttcaacgggtcctcgataacattcgagctatgcaggaaccagtgcctgagcgatggccagtgcgtcgccttctcctacaggttcgacggcgtcggcagatgcttcacgaaaggcaggcttttcaacggctacacgtcggcgaatttcccggggaacatctacctcaaggtgtccatcgacttcgacgaatcgtcgccattggtcagcgcgcggagcgccgccggcctcacgtgcaatcccaacgtctccatcgtgacagtgcccgctgccgtgtacgggatggctccaagaaacagcgggaagtggacctacctgtttgtgttcgccggtgtgctcggtgtcctggacctcctcttcatcgcgacagggtggtggttcctgtccagcaagcagagcatccccagctcgctggaggcagggtacaggagggtgatgacgagccagttcaggcggttcacgtaccgggagctcaaggacgtgacggccaacttcaaggaggagctcggccgcggcggctccggcgtggtgtaccgcggcgtgctcgacggcggtaaggtggtggccgtgaagaggctggcggtcgacgtgacgatgcagggggacgaggagttctgggccgagatgacggtgctcgggcggatcaaccatatgaaccttgtgaggatttggggattctgctccgagcgcaagcacaagctgctggtgtacgagtacgtggagaaccagtcgctggaccggcacctgttcgacacggccgaaggcggcggcggcatgtcgacgacgacgctggcgtggaaagatcggtacaagatcgcgctgggcacggcgaggggcctcgcctacctccaccacgagtgcctcgagtgggtcatccactgcgacatgaagccggagaacatcctcctgacgagggacttcgacgccaagatcgccgacttcgggctggccaagctgtcgaagcgggacggcggcgccggcgtggagctcacccacatgagggggacgtcggggtacatggcgccggagtgggcgctgaacgtgcccatcaacgccaaggtggacgtgtacagcttcggcattgtgctgctggagatcgtggtcgggagccgggtggcggaccagaggacggaagccggcgagcggctgcagctgccgcagatcgcgcaggcgctgaggcatgtgctggacagtggcgatgtgaggtctctagttgatgccaggctgcaggggcagttcaaccctcgtcaggccatggagatggtgaggatttctctggcgtgtatggaggacaggaacagcaggccgaccatggacgacatcgccaaggctctcacggcgttcgatgacgaggacgaacaccccgcttaccggtcatgatcatcaccaggctaaccgttagcatagttcagcttagagcagcagtcagctgtgagtttaattcagcacttgaatttcaaatttaaggattatgaaattccgaaaaattgtagttaagacttcaaatcgagtatactcagtagaagtactatagtcagtattgagctcctccccaaatattaagcaatcagttgactgaaaaaaaaaagaaaaaaaaaagaaaagcactcccagaattctttgaaacaaaggtcccatcggttgcatacggctgattaaaaaccattacggcttattagtgataaaaaagatttatgagtaaaacttttatatatgtgtacttagcgtgtcggtgatatggctcggggtatgcgaagtgcgggggagttacctcctgatccagccacgtggccctacagcttggccctccccccgcgcctcggaagacccagaggcagccagggagcctcgggtgccacgtcacacccctcgggccctcgcgctgcctcgccctgaggccctcgctcaactgccatgtggcgaggggagcgagcggggaggagactcagactgaaccaccatcaatgcgcgccgccccaactgtccctcaccgcatttaatgcggtaagggcggacgtgcggtggggcccgtttgactcacgtcaatcaggcgtgaccaaactgtgactggcctgtcgccggtcacgtccgatcggacgggcggccgtgcccccacactcgcccctgtacccagcggagtggaggcaggtatgccccgtcccatcgaagtatcatccggagctccctccacgtgagaaggaccgccacaagtcttcatccatttaagacggaatgacacggctgtcccccgtgtcaggtggggggcggcgctgtgtcccactcaaggacggactgccgcttagcttccgggcgaagacacggatcgtggtccggtcaaggtaaagtggatccccctcccgtgaaagagtaggtagaagcggtgcatgtggtatccccttgaactataaaaggaggaccttgcccaccgagaaaagggacgacgctcagtaggcctgaactctaggaggagaagagcgagagtactctccggagtttaggaacctttgtaacactcaaccataaatcccacacacaggagtagggtattacgctccacaacggcccgaacctgtataatcttggcgcccgtacgcgatctagaaaccctcagggcggatacacgatctcgacaagcgagccttttcccccggccgaactcacaaaaggggatctcacgatctcccgctagagaggatcactcctcgacatagcgacttaaaagctaaagctaaaaaagaaaatctttgaaaaaacatcaaaatcaaatattaaaattcaaattttagcattggcttataactttatatgctataaggcaaacgatgaggctcaaacatcatcatataccttagcagaactgaattacaaatagtgtttttattccttcaaatttcagaacggtatggcatcccagcgcgctcacgctgccgatcgcgcccgtcgtgcctctctccatctctcatgcgcttcctcggtgcacgctaagccaattttgttatatatttgttgataagtgtttttctaaaaatttaacaaatgaaattatagtataatcgtaatataattacattggaacttgcatataaccgtaatataacctacacgtaactttcatataattttaaactattagatttgtttcaagattcatgtaagtgaggaaggaaaaaaatcacagcacacacatatgtgagaggattcagggtgtgttcggttgggcttttcaacttgcttttgcttttgtaaaagccaaaagccaaccaaatggtccaaaagtcacagctacttttgcccaaagtcagcttttggtatagtacaaatcaaaagcacctctactccctcattcatctgcttttgggggaaaaattagccacctcggccattacacaaaaaacgcttcacttcttctttcttttttctcccatccttccccccgtgcgtccctcctcctcacttcaccttcgccgtcgccgccgctcctcctcccccccgggcgccgccgctcctccttgccgtcgaggccgactccatcaccgttgaggccgactccgccgccgcatgcgtctacctcccctccgccgccgttgcacgttctgcctccccgccgccgccgtcgaggccagctccgacgccgccgaggtcgactcccgcgtctgcctcctgcgcgttcgattccgccgccgacaccgtcgaggcctcctccgccgccacgcgcgtctgccgccgccgaggccctcctccgcgacacgccgccaccgccgctgaggtctccttcgccgccgcgcgtgtctgtcgccgccaccgccgctaaggccgacgccgcgcacgttatgtgttttttctttcctcttttttttccttcattttcccctcttttccaatgggtgtatgacatgtggagcccgcttgtaagtgggactagttatttcaaaagtcacaactgttgaaccaaacgagcttttccaaaagccacaccaatattccacagctacttttcgaaaagccacagcccacagctattttttcaaaagccacagctcaaccaaacacacctcagtccccacaaccttcatttcatagaaataacatgttttggagaaaattttttaaagttgaagatacatttacattgtaattacataaaaattacaatctaattgtattgtgattgtactataattacacaataaaggtacaggcaatccccgttgagctagttggcctgatagactggagggtggggagcgtggggctgggtgctgaggattcaattggaccgataatgagaggagatatatcctaatgggctgcacactgattggatcagcccaatagatgcatatctttcatgatcgtttatattagaaataagttcactttaactcccttaaagtgacccgaatctaatccgtaaccctgaaccgtaaaaccagaaatcttgacccctaaactattaaaaccggtgcaattttgactccccgggtggtttggagggcggtttcgctgacatggcggtgttgacttagtctccgtccgacgtggtgttgacgtggcgtttgtatggcattagaattaaaaaaaatgcaggacccatttgttattcgccaaaagaaatattgtgggacccacatgtcagcatctctctttgaccccttcttcctccctctctcccccttttctctctccctctctcctcgacaggggcgcgccgttgcagccgcgggcggtgaaggcagccgtggactcggcgttggtgctcacggcaaggggacaattgaggcaaagccgcgccatcctactgcggcgccagcgggatgacgacagggagcggcactgaggagactacaggcgacgagcttcatggttggtgagttatgaggaggaaggagagcccggagcagggggcggcatcctcctcgcccgccgctccgccccacttcggtcgatgggacaggagtcggagacggcgacgtcggcagagaggtcaacaccgacgccgca

SEQ ID NO: 47934 - DNA, 2366 bp, Oryza sativa
atatcctaggtctatcttctattattgtcgaggatttcgacgagatggtggtcagatgtccgccggaggttgaactcctcatgctgttcgcagatattattagggctcgtttagtttttttttttcagttgcttatctttcgtttcgttgttcccctttctcctcttaattttagccctctcttggagtcgtgtactacccataggactcattgtattctaggagaccttgcatagagatattcttggtagtctctaatttaatcctagtcgagttcgagtatgtctcctacagtattttcaaagtagttctttattccttacgtgattggaatgtgatttctaagggaaaccatcccataaatatgtaggtattctatacggtattatttctaatgctataggtgtatgtcatgctttatacaccgacatcggtaataaaaattatatttgatatttgaaaaccaaacatgttcaaacttttgacattttgaccaataattttgtggttgattgatatagttgtattaccatcaaaaatttataaaattgtgatgcccagtaagtaattggagaaaaaaaagaaagaaagagagagagggaaaaaaaaaagcaaagctagcaacctattaacttaaggagcaaacagcagcagcagcaaaaaagcagcccagtactgtgctgtaagtgtaacatcgtgagtaaccgtagtaaaatttagtcccaatcgtccagccatgagagattgtgggcatcaccaatgtatatttaccaactactccctccgtcccataatataagagattttgagtttttcttgcactgtttgaccactcatcttattcaaaaaatttgtgcaaatataaaaaacgaaaagctgtacttaaagtactttgaataataaagtaagtaacaaaaaacataattacaaattttttttgaataagacaagtggttaaatagtgcaaacaaaaactcaaaatcccttatattatgagacggatggagtagtaaataaggtgtgacctagtaaaagtaggtatttattgttaaaagttccacaatgtataaccagtaataaggtaggttccaagataatgtaaagtttatcaccagccaatcgcatgaaggaagagggatgaggatcaatacatgccaaaagaataaatgttttttttactccttactacttggttgtagtgctcttacttgatagtagctatttactggttacacaatgcttactacttggtatgaagattaaaatattgcctattacctggtttgggagcacattgtggatgccgattaatgcccggtgactatttacttcagtttgaattgtctgtgtgaagcgagaacgaaaacgtaagagagttaaaagcgtatgtatgattcaactagatgagttggatccaaaaaccaatttcaggtcctaggcattacaaaaatctaataagctcatcatattatgctaccatttctaatgcatattacacatgcctatcaaagcttatgatattatgataccatttttattgcatacctacatatgctgtgtagaaccaagcatttgaggtattgatgatcaaagttccttttttttttataaattctatcatagacatcaaatactataagatttcgggtgtagttcacaccaaaattggaagtttggttgaaattagaacgatgtgatggaaaagttggaagtttgtgtgtgtaggaaagttttgatgtgatggaaaagttggaagtttgaagaaaaagtttggaactaaactcggggtgtgtttagttcacgccaaaattagaaatttggttgaaattgaaacgatgtacggaaaagttgtaagtttgtatgtgtagaaaagttttgatgtgatggaaaagttgaaagtttgaagaaaaagttgggaagtaaactcggagtcggccttacaaacagatgtaatatatccaatcaagaaaatagaaattaggttgttctgttcattctcgtccaagaatcgacgcctccgcccgttgttatgctcatcgtcttccaaaacttcacatctccaacttgtcacgctagctgttgaaaaagacctctattgtggcgattggtgatgcttcttcttctcttttactccctccgtttcactatgtaagtcattctagcatttctcacattcatattaatattaatgaatctagacatatgtatctatctagattcattaacatcaatatgaatatgggaaatgctagaatggcttacattgtgaaacatatgaaatatctctttggctggattgtataaagagagagagagaggaaggcatctatttggtgaggcattttatctgaaaaaaacatttatat

SEQ ID NO: 47935 - DNA, 20817 bp, Oryza sativa
gcctggcaccctcgggggacgttcgggcccgaaggtggtgtgttcgccctcctcttagtcccccgagggggtcgggctgcacccccctcggccccgagggccgaggcgccccgacccctcgtgggttttcgctccgcgtgtatggggtaggtgagcacagtggggctcacctaaccacatttattgcggtttggctgagcgtgtcacgacgcatgtaacgtagtgcattgcactcatttatccggtctgtgaccagtcacagaccggtcagatcgcgggattaggtggcgacaggcggtctgacgcacgcctcgccccatcccgtcaggacgagggcttctaggcgctcgtccccagctggagctagcgtgttacctcccagagatgacacgttagtcctgatcagatatatgccaggcttcatcctaaccattacaggcaaaatgtagtgtgaaggagggccaacgtgcagattgctaagctgacacgtggtggacaagaatgatcgatttgtgaccattctgacaccggtcatgtcgccagcagacagccatgattctacgtcgcacctgctcccggcgaaagtggaggtaggtgcgggccgtcccatcagaaggtgactcgaacggcaaccatgcagatctccgtccatttgtgaaaaggtagggtaagtccccataaaaaagggggggatggtgcatgtggtatccccttaagatataaaaggaggaccttgcccacggagagaaggggatagattttagagagagctttttcttggactggacctttccagattaggggcccagaacaagggagaggctggctgatactttgtagctctttcatacacagatctcccaaaaacacaggaatagggtattacgcttctcagcggcccgaacctgtatacatcgccggtgtcttctgtgcttcctgtctcgcgaaccttccacatacagattgggagtttagagtctcacccagggtccccggccgaatctgcaaaggggggccagcgcggtctcccggtgaggagccccacgctccgtcatcctagtaccaacgatcctcatactatacaaacaccggaatcgcgacatcaaacatcgacatcatgaatttttaatttttatttttacagggatacatgaatttttaatttgggatgtatacttacgaggagggttagagtctcatacatggataagtctaaattttgcgttatattaaataatgagaaaatggggattataccatcctcaaaacagggcttcgctgaaatgccatcctacaattgggattcgcccaaataccactttcaactgagcccaacccgctgaaatgccatcccaaatcattttcatcaaaaataaaagattttactctacttttcacatgagttgacgaaattacccctcagtcaatttcatccttagaaatcaatcggctgggagagcgagacgcatagggttagggttttgtccgcggcgccgatctgggcgccgccgcacgacctccctaccgccgccgcgccgccttgcccttccctccagccgccgctccgtcgtgccctcccctcgcgacgacgcggcgcgcctcccctcgcgccgccgctccgtgtcgtcgtccttcaccagcgccaccgcgccgcgttgcggccgtcccgtggcgccgacgaggtcgccgccctcccctcacgccgcggctctcccctggcgccgacgaggtctcccctcgcgccgcggctcggccggcgccctcccctcgcgccgacgcttggccggcgcgccctcccctcgcaccgcggctcggccggcgccctcccctagcgtcgcggctcggctggcagcctcccctcacgccgccctgcgctcggttgtactgcggcccctctccacgccggtctgtcgccgtctcagatctacttgcaggagtgatgcagatggattccaatgtttatgatatatgaactcagtttgagtgattatgcattttgtggttgggagtgatctgcgaatgatctgggaagcatgctcttaatgatgcttaactggtgttgtttgaatgctgttaatgatgcttaatgagtgattcttacgtggtgttgtttaaggcacgctcggtgtggtagttcctaggatgtaaaggtccttttttcatatgttcatcacatcctgtgtatatggtactctatatcctctaaatcgaatgaaccaggggtattttggtcatcaaagttgtgagaaaagagagaaaatgattttgatttactacaaatgaagagaatggcatttcagcgggttgggctcagttgaaagtggtatttgggcgaatcccaattgtaggatggcatttcagcgaagccctgttttgaggatggtataatccccattttctcattaaataatatagggtagaattggctcaaagttttgcaaatccgaacataaaatgcaactcaatacaaagacttacttgcatgctagtaattataagagcaagtttattagtatagtcaattgctagctctaaaatcatttacaaccaatctaatagtctactccatatacaatattgtcggtgacatgggaccgggagtatcatgactagaggcttgaggcagacacaatcgcccacgtggcctggcaccctcgggggacgtcgggcccgagggtgatgtgtgcgcccacctcttggtctccccgaggggggtcggaccactcctgcctcgcccccgagggccgaggcgccccgacccctcgcgggttctactccgcgtgtatgggttaggtgagcacagcggggctcaccgaaccgcatttattgcggctcgcctaaacgtgtcacgccgcacgaaatgcagtgcagtgcactcgtttatccggtctgtgaccagtcacagaccggtcagatcgcgggttaggtggcaacaggcggtctgacgcgcgcttcgccccatcccgtcaagacgagagcttctaggcactcgtccccagctggagctagcgtgttacctcccagagatggcacgttagccccggtcggatatatgccaggcttcatcctaaccattacaagcaagatgttgtgtgaagaagggcaaacatgcacgttgctaagctgacgcgtggtggacaagaatgaccgatttgtgaccggtctgacactgatcatgccgtcagcagacagccacgttcccacgacgcgcctgcctccggcagaagtggaggtaggtatgtgccgtcccgtcagaaggatgttcggagggcaaccgtgcaaatctccgtccatttatgaagagaagaaaagtccagtttggaaaggggggggtgcatgtggtatccccttgaaatataaaaggaggaccttgcccattgagaagaggggatttttctccagattcggaacctagaacaagggagaggttggctcacactttgtagctccttcatacacagatccaccaaaacacaggagtagggtattacgcttctcagcggcccgaacctgtatacatcgcctgtgcctcatgctctttcgataggtcgcgatctttccacatacagagagagcttgggatttcaccctgagcccccgaccgaaccggcaaagggggggcctgtgcggtctcccggtgaggagccccacgctccgtcatctggcgcgccaggtagggggcctcagcgtgtgtcttctgagctctcgcactctgccctgtgcaccaagcttttcctgttcagcctgatggccgagcaagcaaaggcgcacgacctctctccgagtgtgagtggcgacgacggggagccgaacccacgccgtcgagctcgtactccaccgccccctccacgccaaagtcctaagcggggggaggcgctcgagagggtcgaaagatccgcgacttcaccgatcgcgggcgatggaaaagaacggcgagatggggagcgtcgcctcctcgtctacggcgacggcagcacgccccagggcgcgctccaagctgcgggcgcgctcttacgccacccgcctgtcgtccctgacccggagtctccagcccaacgatggctggacgacgtggccaaattggtcatgacggcgcggcagtgtcacgcccggaaattcactagtaatttccgaacttatttgtgcataaaatcctcgtccaggaatcagccgaggtacacaaactgacaatttaatatacagattcatcaaattaactaaaacgataaatacttacttaagaggcactaagtcctcaccaagaagaaaactgcagcggaaaataaaatctagcgaagctccagctccactcccacaggcagctcaactggggtataagccaaacgtcttctccttcgcaacttgtcttcaactgaggttgattgattattgcaaggtgagcatatgacatactcagcaagccacacagcaaatatgcaagtgcacaaggataccaaaggatggcataatattggctcatttgcaaaagcagcatttagcaaaacatttaagagaagtaaaacagtggagtaattaatcaggaattttaatcaacattgaacagcacacccatgctgcacaggcccaaccatcctgaacaaccatacccggctgtacagatctaatctccaaaccaagagctaagcaaattattatcaggtataacatccataattattgtgagaggtgtgggactaatcacgaaaaacattgctcaactcgcccataaccgcgggcacggctattcgaatagttttactctggccagaggtgtaccactgtacccacaagacacagcctcaacatcatgtctaccatgcgtcgcgatactggaaagtacccgaatagaggctgtgacaataccctctgcataacacaactcaccacagtgcaccattcctggatcataatcacccccttataaaacaaggcatggactccccagcgacccccgtgggcttatctccgccacttctcagtctggtgccccgcaatgaaccatgctatacaaaaggtaaagccgttgcccacgctggcttgtggttggcacggttaatgtttcacaacagtagctcgcgaaccggtccttaattgccatgagcacgactctcaaaaccatgtgctcacaacccaccattatcaagttttagttggcaagaaattaattaaccaatcacgattgaccatcgtgagctaccattaaaccatcattaaataataatgaatcataagttatcccaatagtgtgctaatgtttctaagcatggctaagcaatcacatctaatatctagctgaaccaatatataaagctcaactagtcaaattataataacccaaggtatcaaggattaaagtaatcaatgcaaacaggccataacaaaggaataggttcacaccacccagtgacattcgaaaataaatgcacagttgaaataaatagagaatttaaatataggatcaacatgctcaaaggattgtgtttaggatctgtgtgacttgccttgcaataatcggtcttcaattaatcttcttgaacactcccgacgcactcacgaaccttcgcaacgacggaaacgacaagctaacacgcaaaacgaagaaaaagactaataaaaaccaaataaacagtacataaaaagtaaacaaacatgtagatcatatttttagatgaattatgagacttgaacggcctcattctgacttcaaatgaatttattaagaattttacaagattaaatctaattaaagcccatttaaaaagaattaaataaatttaattcaatttatggacaattttaatatgtagatctttattttatacaacttttgcaacttgaaccacattaaactgagttaagatgaattagttatgaatttttaaagattaaatcggattaaaacctttatatggattttaattgaattatgacgcaataatgaattatttttgaaaaggaaaagaaggattattgcgtcagcggctagggtttcggtggaccgggcgcacgggcgacggttcacgggaacggacggccgagatcaaccctatccaaaacggacggctgagatcgatcggtccacgaccggctcacgggaaaagggacgatgacgccagcgatgacgtcaccgacagcggcggcagctcggcggagcggatagctcgggcggcgcacgctcgccggcgaacggcggcacttcggcacaaacggagggcaccagcacgtagaggacgacgcggcgaactcaccggtgaccaaaacggcggcggaagaccaacggacggcggcggcgacgaggaggaagcggcgaagctcttcgggtcgacgacggcgatggcgctccgacggtcttcggcggcggcgaagcggtggacggggacggcgacgacttggcgaacccgatggtggcgacggcgaccgacgacggcgactgcaacggcggcgcggcgcggctgaaccgacggcaacgacggcggcgactagggctacgcggaggcggcgctagacgcgacggcaggctaaggcaaaggaggcgacgggtagaggggagctcgggggtccttatataggtgcaaggaggcggcggcaaaggcccacggcggccggcgacgagaaggaaagctcgcggcttgaaggaaagaggccgatccgaatcgaactctattccacgaacttccaaaacgatttagccgatgtttccaaaggagaaaaggtagaggagatcccggagattgtttcccctcaatcaattcggccggagaaggaaaggagcggccggatttggaaggaaacggcgacggcggcgcgctagggtttcgggcggcagcggcggctcgaggaagacgaacctgacacgtgggacccacctgtcagcgacaccgagagagagaagagtggcggctcggcggactgggccggctgggccgagggaaagagagagaagggttttgggccggctttcggcccaaagccaaaagaagactttttaaaacctttttcaattaaattatttcttaaatgcaattccatttattaaaaatacttccttagctcaaataaatcccagaaaaatctaggaattatagaattaagcaaagtatttaatgaaattttatctggcccctttttatattgagatttagcaaattaaaattagatcttctcttttaggcttttaaaatcatttctaataattccttttaaacaaccatttataagttaaggatttttaaacaagaaaagatcttaacaattatacttagatcattaatgatcaaataattactgaactattctttgtattatttaagaattgagctctgaaaaatccgagaaaatttcagagagttgacttaaccatggagaatttaacaaaaattaaatccatccatgctttagatttagaaaattttatttcccacattttacttcacttgaaagttaaagatcatttaatataaattctattaataatttattaaataatttataaatcctgaaacgaaaatcaggatgtgacaggcagcgcctagatgctggtggacggtcctccgccaccaaggcctctggtgctgctaccaccggctccgcgtcgtcaagacggagggcacgacgagcggcagccgctgttcgccgttcggctgccactccttcgtcgactccttcgacccgggaagatctgcgtggggagcaggacgcccacaccagcatcgagcgccggcgtaatgaccgaagtgctgcccacgcaacggagggcgcttcctcgtccagagtgtcacctcgacacggacgtgggaatcagccctccgtgcccccggttggtggtgtcggctgtagagcctttgtggcgagtcttcggaatgtccgttggcccccaaggttccggcccaccatcgctgaaaaatatgatggcagcatcaaccccgccgagtttctccaggtctacacgaccgggattgaggccgccgggggtgatgacagggtcatggcgaatttctttcccatggccctgaaggggcaagcgcggggttggctaatgaacttgccacccgcgtctgtccactcctgggaggatttgtgccagcagttcactatgaactttcagggcacatatccgcgcccaggtgaagaagcggacttacacgcagtacagcgaagggatgatgagtcgcttcgctcgtacattcagcggttctgtcaagtccgcaacaccataccgtgcatccctgcacacgcggtaatttacgcgttcaggggggggcgtgcggcacaaccgcatgctcgaaaagatcgcctccaaggagccccagactaccgcggagctttttcagctcgcggaccgagtggctcgcaaggaggaggcctggacttggaacccctccggttccggtgtggcagcttcggccgcccccggatccgctgctcaaacagggcggcgtgacaggaggaggaaaaagaggtcagtccattccgacgacgagggtcatgtcctcgccgtcgagggcgcttcgtgggccacccgaaaggggaggcctgcgagcgacaaaaagaaggaggccagcgctcccagcagggagcgccccaccggcaagtggtgcaccgtccacaacacctccctccatgaccttgcggactgtcgcgcagtcaaaagcttggctgagcggacaaggaagtgggaggaggagaggaggcaggggcgccgggaaggcaagtccccggcggttccttccggcaatcggcgaagtgaggccaagcagagggcccccgccgaggacatcgatgatggcgatgatgacctaggtttccaagagcctggggccaccattgccaccgtcgatgggggagcgtgtgctcacgtttctcgccggagcttcaaggctatgaagcgagagcttctggccgcggcccctactcatgaggcgacgcgtcgggcgcggtggtcggaggttgccctcacctttgaccagaccgaccacccaccgtgcgttgcccggggagggcagattgcgatggtggtttcccccaccgtttgcaatgtgaagttggggcgagtcctcattgatggaggagcagccctcaacatcctttcccccgcgacctttgacgccatcaaggccccggggatggtgctccggccgtcccagccgattatcggtgtgacgtcgggacacacttggccgctaggtcatatcgacctcccggtcaccttcggtggatccgccaatttccgtacggagcgggtgaacttcgatgtggcggacctcagtctgccctacaacgcggtcctggggaggcccgcgttggtgaagttcatggcggcggtccactacgcctacctacagatgaagatgccgggccccggtggccccatctctgtccatggtgacctcaaagtcgcgcttgcttgcatggagcagcgcgtagaccatctcgccgccgcgtccaagcccgagggtggcgatgagaggcttggcgcctccgcccccgctaccccgaggcagcggatgatcacatgcgacgaggtcccggtcaaggaggttgccctgggcgacggcccgtccaagaccacgcggatcggtggtcttctgaacggcaaataggaagacgcgctcgtctccttcctgcgggcaaatgctgacgtcttcgcatggagaccggcggatatgcccggggtccccagggaagtgattgagcaccgtctcgccgtacggccgggcgcaaggccggtccggcagaaagtgcggcgacaggccccggaacgtcaagccttcatccgcgaggaggtggcgcgacttctggaggccggattcatccgagaggtcatccatccggactggctggcgaacccggtggtcgttcccaaggtgaacggcaagcttcggatgtgcatcgactacaccgaccttaacaaggcatgtcctaaggatccttaccccctgcctcgcatagatcagattgtcgactccactgcggggtgcgaccttttgtgttttctagatgcatactctggttaccatcagattcgcatggctagggaggatgaggaaaaaactgcgttcattacccccataggaacctattgttatacgacaatgcccttcgggttaaagaatgcaggtcctacttttcagcgtactactcgaatttctttgggtagccaattaggacgtaatgttgaggcttatgtcgatgacttggttgtaaagacgcgcaaccaagaaacgttactctcagatctagcggaaacctttgagggtctccgctccgcccgcataaaactgaaccccgataagtgtgtgttcggtgtacctgcgggcaagcttctcgggttcttggtctctgcccgaggcattgaggctaaccccgagaagatacgagctatagagcggatgcgcccccccagcaaacttagggatgtgcaatgcgtcaccggttgcatggccgccctaagtcggttcatatcgaggctgggagagaaggcgctacccttatttaagctcctcaaacgctccgggccgtttacttggacggaggaagctgaacgtgccctcactcagttgaaggcgtatctcagctctcccccagttctagtcgccccggagccaaatgagcccttgctactctacttagcggcgaccccgcaagtagttagtgcagcattggttgtggagcgcgatgaggacaatcctcactccacgcatcccaaccctgtgctgactcagcccgggagagggcagggaggagaggcccccgagccgaacggtggcccaaggcccccgacgaccggagttggctctctgcccgcttgtcagatggtgctaggagcccccgacccacaggaaggccctgaggccactatgggaaggccgcacctatcaccctttgaccccgaggctcaccctgtgctgactcaacccgggaaagagcagggagaagaggcccccgagccgaacggaggcctaaggcccctgacgaccggagttggccctttgcccgcttgtccgacgacaacaggagcccccgacccccaggatggccccgaagccactgaggtaaggccgcccctgttatcctccgaccccgaggtcatcagcaccgaagacaagtgtgccccgcgaggctgcttggacgaagagtgccccagggatgcggcccctagcgaagaggatcggccccaccgaaaggtgcagcggcccgtctactttgttagtgaggccctccgggacgccaaaacccgataccctcaggcccagaagatgctttacgctattctgactttgtggcagagtggaccccggctcccgagcccgtctcgatccctgaggccagcacggacccctcgcagttgcctcacaccgcccattgggtgatgcagttcgatggctccctgtctcttcagggcgccggtgcgggggtcacattgacctctccgagcagagacgtcctcagatacttggtccgcctcgactttcgagcgaccaataatatggcagagtacgagggactccttgccggactcagagtggcagctggactggggatccgccgcctcctggtattaggcgactcccagctggtcgttaaccaagtctgtaaggagtaccggtgctctgatccgcagatggacgcctacgtgcgccaagtacggcgcatggagcgccattttgacgggatagagcttcggcacgtgcccagacgggataatatgatagccgacgaactctcacgactcgcgtcctcgcgagcccagaccccaccgggcgtctttgaagaaaggcttgcccagccgtcggcgcgacccgaccccttaggggagatggacgcgcctgatcggcccccgaggcccgtcggagcccaggcctcgggacccgaggggagcgctcctagctcccttagattgattgcttggatcgctgagattcaagcatacctcacagataagactctacccgaggaccgcgaagggagtgaacgcgtccaacgtatctccaaacgctatgtgctggtagaagggaccctctatcggcgcgcggctaatggagttctcctgaagtgcattcctcgggaacaaggcgttgtgcttcttgccgatatccatgaaggcgaatgcggagcacactccgcctcgcgcaccttggttggtaaagcttttcgccagggtttctattggccgacagctctcagtgatgcggtcgacctggtccggcgatgtagagcgtgtcaattccacgccaagcaaatccatcagccggcccaggctctgcagaccataccactttcgtggccatttgctgtctgggggctcgatatcctgggaccgtttaggcgggccccgggcgggtttgagtatctgtatgtcgcgatcgacaagttcactaagtggcccgaggcttatccggtcatcaagatcgataagtactccgcacttaaattcattaagggcatcacggcccggtttggagtgcccaaccgtattattacagataatggcacctaattcactagtgaactcttcggcgactactgcgaagacatgggcatcaagctctgcttcgcctcacctgcccaccccagaagcaatggccaagtggagcgcgccaatttggaaatcctcaaaggccttaaaaccaagacttacaacatactcaagaagcacggcgattcatgggtcgaggagttgccagcggtgctctgggcaaaccgaactacaccaagccgagcgactggagaaacgcctttcttcctcgtctacggcgcggaagcagttctcccatccgagctcaccctgaggtctcctcgggccaccatgtactgcgaggctgatcaagatcagcttcgtagagatgacctcgactacttggaagaacgaaggcggcgcgcggccctccgagccgcgcgttaccagcagagcctgcggcgctaccatcagcgccaagtccgggcccgatcactctgcgtcgacgaccttgtcctacgccgcgtccaaacgcgtgctggattgagcaagctctcaccaatgtgggagggtccgtatcgagtgatcggtgtcccccggccgggttccgtgcggctggccacgggcgacggcacagagctgcctaacccgtggaacatcgaacaccttcgtcgcttctacccctgagagggggggtcgggtgtcaggtttcgggctcgggccaaccccgcacccccttgggcgtgcagggttggccgggggctgccacacatgcacattcttatttctcttgtttcagtatttcaataaaagaagtttcattctcctaaaggccgtatctgtgctattttttccttttgaagaatcttgacttgaaataggtcacttgtgctcaatcctgccctcgggggctcgggtcggctaaaaccgccaaacggggcccagaaccgagccgtgccccggggcgtggtgaactccgggggggaatcggcaaaaacccacaatcgggtcacccataaccctcggtcaccacgtttccgccctggccagtctcgacatgtggatctccccaggcactagccccgacccgcgccttttgaggattgggacttggacacgagcccttaatcaagctaagacacaaaaggaccatggcacagatcgtcctcatctcatgcacatagcaaaatgaaattaacacaaaaaatttctgcatttttgattacagattaagttggtctatacaaaaaagaggcccgaaggccttagaagaaggaaaaaaaaggaaaaactaaagactgggggcgccctgggggctcagtccgatgctcccgggtcgccggcctcgtcgtcactatcgtctgcacctccggcatcgtcctcctcgtcggagttgggggcaaacgcgagccgaggggccgagccctcgaagctgtggacgatatgttcggcggcatcccgaacccgcgcgcgcgcgtcgtcctcggtcccgggagggaactcatccagcgccatccatggggagaagttggggtccctggcctggtaactcgctagtacgagttccaccgctccttgggcgaggtccctcgaggatgacttgatggtcttctcgagctcctcggggagctgctggagagccccggccatcttcgagaggtgctgagcgaggcctccctggttggtggagtacttcattgtctggcctttccagaggcccacttgccgaccggcgcgatccagacgggagactgcatcccaaagcatgccgggccctatctcgctcgccaagcggagggcctcggcttccccggcggatgagtctagcgcgcgctgcatgtcggcgatggtgagttcggtagctgcgaggcgggtggctaagtcactttcgcccgcagccgccccgccgctgcgtgccctcgagtccagctccttttcccgcgcctcgaggtcagcggcccgctggtccagtgcggccctctcggcgcggacacattctagattgcggcgtgcctgctccgccagcgctgcctcacggagggacaggctgtcatccaaccgttgcgccgcggcctcggcctcttcgagagctcgctcccgctcggtaagcgcgtcctcgcggaggcggagtgcggactcctcttcggcgcaggcagactcgtgcgccgccagcgttgcctcccggatggcgacggcggcctcgcggtccgccaggtccttctccacgacgcaggcgcgctcttccagcgccatggcgcgcgcctcaagggtctcttcgcgctgtcgggacgccgcttcggtctccgccgcccgctgctcttgggcagcggcagtgtcaagcaccctttgggcggcgtcgagctttttccctagtgtcacgtcctgataaattcatcccgaaataaaaatcattcgctaaaaggaataatagaattaattaaaattcgaaaagaaattggcaaacactaaaatacgtgcaagaaaaattcaaatgtggcccagagaatttttgttaaattctccttggtctaaaaggagccctcaaattttacttgaattttcagagcaccggaaataattattaagcaacaaaaacaattaacaaagtttattaaaaagaaaatctaaaaataattctcctcctcctttgggccaagcccagcccgaagtccttctctcctccctctctttctctccctccccttctctccctctctctcccgggcctctcttcccctcccgggcagcccactccctcctctcctcctccttctgggccgcccctccctcctctccttcccggcccaccttctccccctcctctcctcctgggccgtgtcccggcccagctgagccgccccccccctcccgcgcacgtgcgctgaccgcgcgccgcgcgcgcgctgacgccgcccgaccgcgtggggcccacgcgtcaggccgccgtcgcccccaacctccagccgcccggccccttcctctctctccctcccgtgcgaaccctactcccttcctccctcaaatccgcgcgaatcaagcatgggattcccaaattgattgaggggaattaatcccctttcccttctctctatttcccccttaatttccccttgaatggtgcccccaatcgccgggaacggccgcgccaagtccggccgccttcctttgccgccggccaccattcccgtcgccgttccgccctctcccgtgctcggctcgcttccctcagctataaaatgcaacccactcgctccgttctatcgctttagccccctcccgcggtctcccgtggtctctagccacctccccaccgtcgccctctctctcccacgttgccggccgcctccagccgcctgtgccgcctcgaccgtgcgccggccggccgcgccgtcgcctcctccagcgtcgccgccacctcctccaccccggcctgccctccgtttcgcgcggtgaccgccggaggcgcactcccgccgtcgcccttctcattcctccttgccggccacctccagccgcacctcccgcctcgcccgtgcaccctccggccgcgccgccacctctcccggcgtcgcagccgcctcctctttcccggcttcgcctccgtttcgcggggaaatcaccggagacgcgtcctcgccggcgtccagtggcgtcgccaccacttctccgcctccggccgcctctgccgcgtccccggtgcaccggccgacgtcgccaccacctctcccggcaccggagtgccgtcctctctcccggccaggccacggcgtcgcccgaatttcgccggaacgccgtcatctccgcgccggcctctccttcctcctcgtcggctcgtcgccccgctgcaccaccaccttcaccaacatcgcagcggcgtgttccacgccgtcccctcctccactcagccgctgctgcctgccatcatcgtttcatcgtcgtctccgatcgttctcgtcgtcgacgtcccgtcggtcgcccggctcgtcgtctcgcggcgccgcctccgtcatcgtcatcgtagcggcgtgttccacgtcatcctcgtccccgtgcagccgctgccggctgtcctcgtcgcctcctcgccggtcccggtcgtcgtcgtcgtcgtcgtcctctcgtcgttcccggtcgtcgtggcgttcgtccctccgtcgagccgttctcgtccgtcgtccgcattcgtcaagcgcgccgctgcagccccgtcctcgtcttcgtcctcggctccgcgtcgtcaagccccgtgccggccgcgtctcgccttcgtccaaggatcgccgccgaagccgtcccctcgccgttcgtctccgttgtgcccgtctgtctccgccgcgcccgttcgtcgttgtcgttcctacgcctcgtcgcgtggtggtaaggatccgtcctctcgctgccccgttctcgtcctttcggtgtcgcccgtgcccgttgtgcggttgacgaccccggtacccgtgtaccggtgtcggtagtcgttcacgcgtgcgggtggtgaccgtgtagtgtccgcgttagtgtgcccgctcggtagccgcgtggtttccacgtgtgcaggccgtgtggtgtctagtggagtccgtttgtcggccactcgcctcggttgacacacgggatccgcttccgtcgacccgtggaccgactctgtgtactcggtctaccgcggtcctttaggttgacatgtggggtccgcatgtcaacggcgcagccttcctgtcttttccaggctagcgcttgcacatgttttataattgcaaagcttgattataataatccgcaaatctccatataacagcattaaacctcggatgatcatatcttggtcatacgaactccgaatcgacccgttcaagtctcttaatgtttgttataacctaaagaaccctgtgctttctttttatgtattgttattgcttctttataggcttgtagctttgcttgtgtgcttcgcgtagcttctgtcgttccggaggttcccgaagcgtggttcgtggtcgtcgccgaaggttcggaaggccgttctctctgagcaaggcaagtcacatcatccttgagcatattgaatcccagtttacaaaattatttttaatttaaattaatgcattatcgctttatttaaattcccgcgttatcactgttttatttagccatgcctatttacctttgttatgaccttaatattattgttattgatattattaccttgttcaccctagattaaacaaaaccccaactagtgggtactctatttatggttccactagtatgaacttaggtagatgcttcgctggttaattaggcaacattaggtgattttataactttagactttgggaactctcatatcatttggacactatggaatggttggcttatgttggaattggacacacacctccccctcttttcaaaacccccaaaatggtttaggctgggctcgaggtgcgtggttgggttttgttagtcgtacctcgggtactataaggattaagcttgggcctctgttgcaaagcactaccgtacttccacatgtctagtgggtaaggcttagtttgtggctcagcctggttataaacaaaagtacacggattggagatggatgaagtcgggggtcgatggacattctccagggcaaatgaaggctacacgagctgcggcccggtagtcgagatgtcatggcagagggttggtgccctgctgctagggggctcagtcctgcctgcctgtcccgggtgtcccggccgtagggggattgggtcggtactcttgtttatggctaggatgggttgggaactatgtcacgtcttccgtccgtataccgtggtggtatgtggcacgtggttgcacgtgaggaagatgtgtcttgtgggtaaagatgtacgcctctgatcagagtataatctattcgaatagccgcgccctcggttatgggcaagccgagcaatgtacccaagtcagtgttttaattcttaaaatttgctcaacaactaaaatgtggaatggttggcctgggttggcttgggacgagctgggacccagggtcgggttgccagttcggtctgaatcatcgtaggccttgggttaaggcaggttcgtgagggttcacggccttgtttaataatactgtgtagctctaggatcgtctttataaaatggctttgggcaactaagtgacttttaaaggctgttactgcaaaacttaacccctatattattatccccttgtactcccttgcattaattatgcatctccggtgtggcttgctgagtactgtggttgtactcattcttgctctatctttctccccccttcagtaagagaagctttggagaagaagtcttaggtggagtcctggcttataccccagttgagcgcctgtgaagatggagctgtaggcccgctagtccgctgctgtttatttttgattgtcaggccttaagtgcctttgtaataatgtaaatattatcgatataataaagatgtgtcttttatatcatgtttgtgtggtgtaccccggcttttcctgggacggggattaatacactagcgttcgggaaaaggcaattttcccggtcgcgacaagctggtatcagagccatctcgactgtaggataagccaagtggataaaacctaaggacatattttataaataaaactatttgcgaaagttcctctttttctccttcccctaatgctatttgcaaagggtttacccttttcttccttcttcaaatttcaactagtactagatggtcagctttgcgaagaagaagatgtcgtcagttgtttgccgaagctccggaagaatgcaggatccgctagcgaagtggaggaagcagtgaagccagctgtgaagcaggagtgaagatcttagaaaacccgtcgcagaacctaagccgccctatagggtagtgttgttagtcgtgtgttccttgcttgtgtgtgtagcgcgtggtttgcatcggtgggtggtgatgtaaccatgctaggttgtttgcttaatcaacttgcagaataagcaaaacaaacaacacatcaacaaaaagagttagttcctttaaggtcctgtccctagctctggtctattctttccttgtatgcttcctctctcaacccctaccttgtgacagatggataacactggtaacaaaggctatgggaatgatggatccgatgactcaagaacccaagccaatgggaatgagaaaagcatcaacgaaacctcaccagagctaatccaaattgtggttaaccaaaccaacatgttggcaacagcctttcaactattacagaatcggaacaacccagcaggggcaaccaacgttcaagtacctacagtccagcaacagtgcaagttatcagaatttctcaaaacggggcctccaacctttgccatggccgtcgatcctatggaagccagtgattggttgcgcacaatcgagaagaagctagggttgattcagtgcaccgaccaggagcgggttggcttcgcaactcatcagctggttggaccggcttcagagtggtgggatagctacgaagcatcacggccagaaggacataccatcacctggaacgagttttcatctgtattcaagagatcacatgttcccgcaggaatgatcacactaagaaaacgagagttccgctacctgaagcaaggagatttgaccgtcacagagtacctgcacgagttctatcgtttggctcactatgcaccagaagatgtggaaacggatgaagacaaacaagagaagtttctccaggggttaaaagatgagcttgcagtgcaactacttctagaggattatgaagattttgagaaacttgtggacaaagccatgcaactcgaaagtgagcataatcggatgacgaactgcaagagaaggattgtcaacatcccagtatttccaggtggtaaccaaagacagcgcactgagccacttcagatcaccggatcttctgttgcgcatcaagagtttccgccccaagaagatggacgcaatacagacaacaacactagcaatactaatgatgatgataccaccaacaaccatggttcttgccccattagtgaccactcgaataaagcgtgcaatgtcagtagcattcaccaagatgtcaacgatagtatcaatgttggaacccagaatgacaaccttagcaatttcgacactgagaaagactccaatggtgatagcaactatggtaccactgatgccatgttagcaaggattcccaaccaccaattccaactccaagtcaaaatgatcgtccccagatggacagctcagtaaagaagacgttgatttgttacaactgcaaagaaccagggcattactcgagggactgcctgca

SEQ ID NO: 47936 - DNA, 3510 bp, Oryza sativa
gtgcctttgtaataatgtaaatattatcgatataataaagatgtgtcttttatatcatgtttgtgtggtgtaccccggcttttcctgggacggggattaatacactagcgttcgggaaaaggcaattttccctgtcgcgacacctagctccgcctcccagctcccgtattgaaggcggagggtgtcctgcgcctcgttcatcacggtggtggcaatgagggcagccccccgctcctcctccacttccttggcgatttccgccaacaccttctttcgggcttcaagctccgaaacgtgccggcggtgtgccttgcggcccacctccaccatggcctccactgagcgccgcccctcctcgacacgcgcccacgcggcgtcgagctccgcccgctctgcttgcagggcctccacctgggcattaaacccgtccaacaccgcggtgtttgcggcggccaaggccagcagaaggggctctgcgctcagcggggcgatagaaggcgcggggaagagccgccttggagaggatgccgcgcggctcgggccgccgatggaagtgccggactcggggatgtcccctggacctagttggtcctgggtgtcgcccgagggagtgggcccaggcgacgcgcctgcagcctcgtcgccagctgccccggaagttgtcgcctgagcgtcgcctgagggagtgggcccaagcgatgcgcccgcgacctcgtcgcgagctgcctcggaagtcgccattgcctcgtcctggcgaaatccggctttctcccgagcggcttcctcggcctggtgggctcgggcggcctcctcccgagcggcttcctcggcctggcgggcccgggcggcctcctcccgagcggtttcctcggcctggcgggcccgggcggcctcctcccgagcggtttcctcggcctgacgagcccgggcggcctcctgggcggcctcctcggcttcccgtaggcgatccgcggccactcgccggtcagattcccgcctccgggcctctgcggccgccggatcctcggcctcagattggccagacttggaatgacgggagggacgcgacgggatctcgctaaaacagaagaaaagaccagaagacgaacaaagatgggtgagtgaaaactcgcgttgaagagaatgaatacagccacgatgggtgagagacgaacctgcgagggggtcggttgaaagaccactttggaggggagatgaggtttccccgagatggttctgtctcccccatcttgcggagccgtttcttcttgtgctccccctcgggctgcgatgtcggcgcggccccctccgggcgcctgctgctggcacgtaccgccccgccccctcggggaggagattggggaggtgttcctccctgtttcctcttcccccgggcgtcggcagggcggctgctccccgggtctccgtcgcgagacccagaagcacgaccccctcccggggtagattgatcccccttgcggctcccgcctgcgccgtcgtggccctttggagctccctcctctgaggccccgaccgccgtcataatggtcaagatggaggcgcggtctggatcgctgcagagggggaggattccgtggggaatgagggacgcctccacggagttgagattcagcacccgttggaccactatcttgaagtcctcaggagcccagtcccatctgactccctggtggatcctcatgtagtcttcggacccggtgtactcccaggcgccccgagcgcgccgctggagcggcgcaatccgacgacggaggtagtcaccgtacaccatggcccctgtgagcccctgggatcgcaggcccgccaggcggtcgaggacggcgtcatagccatcccccagatctaccggcgcccgccagctggaggcctgcgccgggggctggctcggaagtcggaggcgcgcttcgtcggcgaggggggtgtagaaccagtcgctcttccagtcatcccacttcttgcggaggacgcaggggatgtagcggttcaacaccggcccccgcggcaggaagtagcagccaccgaccaccgacggcggcgacaccgactgcacggtgaagaaccaccggaacagccgaagagatgggcgcaccccaatgaacatctcgcacaggtgcgcgaagatggctaatgtcatcactgcgttgggggtaaggtgcgccatctggagatcgtagaactccaggacatccatgaagaaagaagaaaatggcggaaccagccctgccattgcaaaggggagaaagaagacggaccgccccgggtagtctggcgccgggcgtccctcgcccagcatgactatctcccggccggtggcagattccggcatgaagcggcgcggcagcccagcctgcctctcgctcacgatgcgggaaggcggcaacacgctaccatcgagcagagcggagccccgtgccatggcgccggacgaagagaagatggagagcgagcgcgtgtggcgaaagaagggcgcaggaaagaaggagttagggcgcaagcggcgaagacaaggggaatgatggcgaaaggaaggaaacaaatcctctcctcagtgcctttatactcttgccaatgctgtgcccggctcctcgtttctcgcacccaccgtttcgccccctcgtttctcgcgcccacacctccactaatcccattcgcccgcttgcggcgcgtgaggtggatatgcggttgtggcagtcgagatagatcatttcgtgcgcgcgttgattacgctcgccgaccgaagcgccatcacatatctcctggcaaagcgaatcggctcgtccagattcgtgtactactcgagtaatgtggcagtctggaagagaccgctcattactgacagccgagttaccattgccgatgtgcgtagtttgtgaccgttgggtttctgcctaattgtagagaccggtcccacttgtcaccaggctttaggggtggcgtcacgcccgaccgcttcccttgaaaagggcgatcgccctggcataacgccgggggctactgtcggtgacatgggaccgggagtatcatgactagaggcttgaggcagacacaatcgcccacgtggcctggcaccctcgggggacgtcgggcccgagggtgatgtgtgcgcccacctcttggtctccccgaggggggtcggaccactcctgcctcgcccccgagggccgaggcgccccgacccctcgcgggttctactccgcgtgtatgggttaggtgagcacagcggggctcacctaaccgcatttattgcggctcggctaaacgtgtcacgccgcacgaaatgcagtgcagtgcactcgtttatccggtctgtgaccagtcacagaccggtcagatcgcgggttaggtggcaacaggcggtctgacgcacgcttcgccccatcccgtcaagacgagagcttctaggcactcgtccccagctggagctagcgtgttacctcccagagatggcacgttagccccggtcggatatatgccaggcttcatcctaac

SEQ ID NO: 47937 - DNA, 5984 bp, Oryza sativa
cacactttgtagctccttcatacacagatccaccaaaacacaggagtagggtattacgcttctcagcggcccgaacctgtatacatcgcctgtgcctcatgctctttcgataggtcgcgatctttccacatacagagagagcttgggatttcaccctgagcccccggccgaaccggcaaagggggggcctgtgcggtctcccggtgaggagccccacgctccgtcaaatatttttatataaatatacactatactattagtacttggcgcatctctcatacacatataatatcttatagctcgtgttaaagttggctacaaatatataacccgtttttttctccctcctctcctctacgtatgtctgtagctagctagcttagctaccttataacttgctattgtacctgctctaactatatatatagtcccaacccaccacataagagcaagtttaatagtatagttaaccactagcttcaaattatctataatcaatttaatagccaattcatacaatagttatatactctattaatacctgatcccacttatcatacacacactgcgtcttggagtccgtgctacagttggctacaaatttgtagcccgctgctcttctctttttttttatcttcttaaaatatatttatagctagcttatagcttactattgtatttgctctaagctggtgtctatggaatttattaggatgccacctaataaaaatttgatgtgacatggtaattaaagaaggaagagaaggaaaaagagaaaatgatgtggcaagcaccaaaccggatcgccgtgtgcatcaaggccctggaaagtagcaaaatcagcgttggggttgattaattgtttcttccccgacacatctatctatctattatattattaagacagctcgaaaaaaagacaccacgttcactgtggaggctagaaattcccatattaatggaagaaaaagaaaaaaagagttcaagtagaaatacaatctaaaaaataactgaaattcggaattaaaaataagtaatatttaaagaggagtccatataagaacctaatacgtgattaattaaaattcagaataataaataaataaatttctgaaattaaaaaaaagaaaaaaaagagagttcaagtagaaatacaaatttgaaattattaaaagaataatggtctagatttactgtataaaagataatcatatcaatctaattatagatcatacaatccgtactaggagtccttgtccatttagaaaaatcaattgcaaaactatacagtatatagagttatgattctaaaccaacatacattgccgcacatatatatatatagggtggagataccagaccagcacgttaggctgcagcagcagaaaaataatatagtgccctcatttcatacaagtctacgaacccaatacgagattaattaaaatttgaaatgaaaaacaaaataaaatccgaaattagaaataagaaaataaaagaagagttcaacttggaatgcgatttaaaaataactgaaattcgtaataaaaaataaagactatttaaagaatacaccatctagaacacataacgaaattaattaaaattccgaataattaataaaataaattctgaaaatagaataaaacaactaggaatataatttataaataaaatctatcggaacgaaaaatatggaaatttcaaaaaaaaaacatctagaacacaacgatgataaatgacaataaatatcggagaagcaacgaggcagggagtagagtggtgacagctgatgggatatctaaaaaactattaacaaaaccccaaatagaatctcaatgacaattaaaaagagtgatgacggacaggccgttaagcagcacggacactgactgttagcgggattcctaaaaaagtaaaaaaataaacctcaatgataatcatgttcgattttaaaatttcaaatataataaagagtgggaggaagcgggcgagccatagagtagtacagtggcaaagccactaacggtttggtgggactctagagtaaaaaattaaactcaaacgatgattatatttgatttttaaaatcccaatgacaataaagagaggaagcaactgtagcacccgtattttatttgcttttattttaaaaaaaaagcttgtcatttaaaaattggagttaatttggttcttagatgattttgtgccaaatggatctcaaatcctctcttagaattgcctttcaaattcctgtgaaactctaggtcaaattcaaattcaaatcccttcaaattctcctcaaaattcaactctataaatccctgggaaaatgtgaaatatcactgttcatattgggcctccttcccttccctctctctcggcccaactctcctccacctctcctctcttctttcccctgagcaggccggcccagcgcagcccatttctgctcatcgtccccttccttgagccagccagtgcatgcacacaaggtgttcgacgaaataccgacccgagtcgctgcaccgttccgccctcgttcccgtaccgcgttgcaccataccaccctcccgtgcgccccacaacgtgccagggccacgtagcgccgccccgcacgccgcgccaaagccgcatcgcgccaaactccacgaaaaccgccgcgccctctccgggagacacggagccacgtcgccccgcgtcacccccgtctcgtcgccgttccatcccgagctctcgcggacgcgcgtcccttcgctgtcgcccgtcgtcttgtcgtctgtctcctcccgggaagccgccgagctcgcgcctccctctcactcgcgttccatcgccaccaccgtgtgacgtcgctcgcgtcgcatcgatctgagaaccctaccacccaaatcccggccgtagccgccgtcggccgcgcgtcatcgatgtcccgtcgcctttcccgctctccgcgcgtcacttcgtgtcgcgtcgccgtcgttttcaccgtcgagtcaccaccggtgcatgacgccaagccatcgcgtcgccatctcgtccaccccggaatcccgccctagccgctagccagctacccccggagctccgcgtctagaccgccagctcgccaccgcgccgcttgcctataaaaggggaagcagcccgagctccttctccccacaccatcaccatctctccccatctctctctcctctctctttctctcgttttgctctctgttgctgccagccagagccgccgcgctattctcccggcgccgccgtcgccggtggagcctcgccggagttctccgccgccctccctcagccgccggtcgcctcgccgcgccccatcgccgagacgcatcgctatcccagaccgagccgagcaaaagagcgagaggaggaagaagcaggcctcctcaagcctctgccaagccggccccaccttcctttattccttcctgccactgacgagcagggcccgtgtgccttttcctctctagcagccaccgacaggtgggcccctcccttttcctttttttaagtcaatttccaacattccagaaaatcctttattctttgaaaattcatagtaaatcaaccgtaactccgattgaccccgttcaagttcctaaattttttataaaattgagatctacacatggcaccattgttctctctgatttgagctagttttattgccttttcttagttagttttatttttcgcgtttagagcccgagttcgaggaagctccggacgccgctttcgaaggagaagaccccaacgctgtgcaaggcaagcccctttgatcacattgcccctatattttcaatgatatgttgtttgcaaagatgcattgttagttcacacgattaacatgtttaggcctcggattgtttatacaaccgacggaccaacccagtagtcgcacttatattacataggttgatgtttccataccattgatagctccacaaatatttgcgccggtatcattattcgattaccgaggtagtttcgcttagccatgcttacgttgttgccgtgtgggaaacttgggttattccaaatccatgtttaaaaaaaatccggtatgttgtaccgaggaattgtgaaataaaatgtgttgtgaaagtggtgatgatgcggagtcatgcctttgtggtttggctacgtattgtcgttaaggaccgattcctttgggaaatccatccaaacacgttacagtgcgaccacacgggtatttatgggatgcctctggctaagtaaattgttttcacatgggagttggtgtgccgatggttgtggaatgccgaggatgaggagacgaagtgttacacatttttgcccatcatgggtgtcttttgcctctattgtggcgtggtaccggtaggagtaggaggcatcctcggtatttcctgagtggatgacggctgtcattgcctgatacttggctatggatcttagcccaactaggtggcatgcggttttcatgggttagctttggaaaggccttatcacgaactttcattgccgacgggtaaacgatgtcagtttcgtgtcgtgtgggtaaagcgtgcaacctctgcagagattaatgaactgttcgaacagccgtgcccacggtcaagggcgagtgtaaggtgtttctcatagcgtagatttgtttgacaaatgtttgtgaagaagtggttacagggaagggtaacgttaccagagtccgcctgtgtggcagacggctaacctgggtggttaggaacgggtctgtgtgacctggggtgtcgtctgacaccgaggtgttgttagggccatgaagatggcgttgttgtgctgagataactgtgtggactatgtgttgttgtgagaagaaactaatagaggaacaaattaatttgctgttcgttaatcgtgacaagttgttgcaaagcaacttgtggaatgggtcgaggcgtgagcctcctcccgacaactaaaacttgactcactcactaggagttttgtgaaataaatcactttgccaaaaaggcagctttcgcaaataaaaccttagcctccttgtttaaaccaaacatgtcattctttcccctggcttgctgagtacgttaagtactcacccttgccccttataatattatatagagtatggagatgaagacatcgacccgaccgccgaggagtatctccaggagcaagccgagtatgaagacttctagatgtttcgtgcctagccccaagcctcgcctgtggaataagatagatgcctaggttattcgcctagtgcatagttgcttagtcgcttagtgctccgcgctgttcgcttctgcgccgttgcttttatggttttctgtaatgttgtgttgctcatctatgggcctgtccatgatagcaacttatgtaaggactactacccagtgatgtaataaagcagtttactttgattccacatttattctgtgtgtaccagctagttgtaacatcctgaaaattcccaacaataaaaatcactaaaatttcgaactttttaaaactttttgcatcatgctggatgttatggttgcttttacttgccaaactataaattgtcacaatggaaaattaaactaaagttatacagctaagtaataattataataataagatatttattatgaaccccataaatatttacgcacgagaaaacgaagccagacaaagggaaggttaattaccaatttaatttatggatcaaatattaaatacttgaaccatgtgatgcgtgccatgaaatataaacacttaggaaatgataatcattcaaataaatggaactctatctatagaatagttttactgggaaaaattaattagatattatataatttgaattgaatcacaaatgctaaattatagaaatccatgtggtggtaaaaccaatccaaacagataaaccaatatatgtgaaaacatataaataccaaaatcccaaacataggaaattataaaaatcggggtgcagga

SEQ ID NO: 47938 - DNA, 824 bp, Oryza sativa
tggaaggatcaatcacatgaacttagttaggatgtggggtttttgctccgagggtcaacaaaaactactggtgtatgagtatgtggacaatgaatcactggacaagtatttatttggtgatgtaagtgctgagcgattgcttgcatggagccaacggttcaaaatagcgttgggtacagctagaggtttggcctatctccatcacgagtgcctagagtgggttgtccattgtgatgtaaaaccagagaacatacttctgaccagagattttgaagtgaagatagcagactttggactggccaaactctcaaagagagacagtaccagtttaaacttcacgcatatgaggggtacaatgggctacatggcaccagaatgggcgttgaactcaccaatcaatgcaaaggttgatgtctacagttatggtgttgttcttcttgagattgtaactggaagcaggatatcaagcgggataaaagtggatgggagggaggtggagctcagagattttgtgcaggtcatgaaacatattctggctactggggacgtcaaggatgtaattgatactagactgaatgggcatttcaattctgagcaagcaaaggtaatggtggaagttgctatatcttgtcttgaagaaagaaacagcaggcctacaatggatgaaattgcaaaagccttcctggcatgtgatgacgaagacaatcacccagcctactcatggtgacctgcaaagcaatagtgttttgatttgaaggatcaaaaactagttattcagtttagcatgcacaatacttgaagtaaacagttcttgttagagaaaa

SEQ ID NO: 47939 - DNA, 2324 bp, Oryza sativa
acgaaggaagtatgcggtaactgtacatcaccgtagatctataaatttgaatatattaaatctggatatagatatatgtccatattcataattctaaaatacttctaatcttattctaaatactaatctatctatctatctatctatctattatattattaaaacagctcgaaaagaaggcatcacgttcgttgtggggctagaaattcccacattaatcgaagaaaaagaaaagaagagtccaaatagaaatataatttaaaaatagctgaaattcggaattataaataagcaatattgaaagaagagttcgtataagaatccaatacgagattaattaaaattcggaataaaaataaaataaaatctgaaattggaaaaagaagagtctatgtaggaatataatctagaaataattggaattcggaattaaaaataaagaatattaaaagaagagtccatataagaatccaatacgagattaattaaaattcggaataaaaataaaataaaatccgaaattagagaaataaaaaagatagtttgagtaggatgaaacaactataaaattgaaaataaaaaacattaaaaaataattcatataagacataatacgatattaaccaaaattctaaataaaaattaaaataaattccaaaaatagaaaaaggaaaaataatagttcacctaggaataaaatttataaataacttaaatttgtcataaaaaaataaaaactattgaaataagagaccatctagaacatatcacaagattaactaaaatttgaaataacaaaaaaataaattctgaaaatagaaaaataattataagagtttaagtaggaatataatttgtaaataaaaatatcggaatgaaaaatatggacttctaaaaaaaactccatctagaacacaaatgatgacaaacaacaataaagagggggagaagcaacaagtttataaagaagtagaacggtggcggttgacaggacatctaaaaacaattaacaaaacctcaaatagaatcccaatgatgattaaaaggagggacgacggatgggccgttaagcagccggtcatggcagttggcgggacttatagaaagtaaaatatgaatccaaataataattatgttcgatttttaaaatcccaatgacaataaagagaagaggcagtggataggccgaagagaagtacggtgacagggtttgatatgacttctaaaaattataaaaagatgacaaatgacaacaaatataggagaagcaacatgcatgtaaaggattagagtggtggcggttgatggaatatctaaaaactataaacaaaccccaaatagaatcccaatgatgattaaaaggagggacgatggacgggtcataaagtagcatggttacaacggttggcgggacttctaaaaagtaaaaaaaaaaacccaatgataatcatgttcgaattttaaaatctcaaagacaataaagagggaggcagcgggagagcagtacatgtgtacaatggtaaaggtgctgacagtttggtggaacttctagaaagtaaaaaaagaacccaaatggtaattacgtttgatttttaaaatcccaatgaaaataaagagaagaggcagtggatggaccgtagagtagtatggtggcagcatttgacgagacttctgaaaattataaaaacaaaacccaaacgagacaataaactctaaaaactataagtctaatttttagaggtttttagtgagaccaaattgtcggagatatgggcccgggggtatgtggagtaaaggagagctacttccctttccagccacgtggctctgcgagctggtcccacccacatacctcgtgagtcactaaggtgatggggagagcctcgggggtcgacgacatcccctcgggggtgacgtcaccccctcgggctctcccgtcgttttagcccgaggccctccctcggggggaagggtgagaggggagtctaggctgggcggccataaatgtgcagcgccccaaccgtccctcgctgcgttcaatgcggcgagggcagacgtgcggcgtgcccgaccgacccctgtcagtcggatacgaccggtctgtgaccagtctattgccggtcacggccgattgaatggatggtcgtgcccccacgtcgcctctgtctccgcggagtggcggtaggtacgccccgtcacatccggacgtcgttcgatatagggctgccgcaagtcctcactcatttatgagggaatgacagggctgccccccgtgtcaggcgggagacggcgctgggccccactcagggacgaccgatgcttag

SEQ ID NO: 47940 - DNA, 6236 bp, Oryza sativa
acgagtctctgccctcggccgaactcacgaaaggggggtcacgcgacttccgcgatcggggggtcttccctcgacagctggcgcgccaggtagggggcagttgcgcgtttgagaagaagtcgcttccttccgctccaagtcggaccaggccctagaccgccatggcgaggtcctgaagcgggggaagcggtggcgtttacccccaccccgtctgggagtggggattcgggcgaaaaccgtgaccctcatcaccatcgccgtggctctcgaagtcctccccgccgcgagccttcgcggagggaggatccaacccgttcaagtggtacggccctctcccgcccccaggcggagggaggtcgcgacgcgtcggagcacgtcatcgtctcgactacggagacggtggttcgccccaaggcgcgcttcaggcggtgggcgcccttctgcggcatcccccggtgaacccggagccggagacccccgtacggcgctggctggacgacgtggccaacttggtcaccgctgcccagcggcagttggccacgggtggccaatccaccgccacaggtacatcaagtgccccggctaccctttcctcgtcggcgaggagaagggcccgtcgatcggccacaacctcgaggcgatccacggctccaacgacatcggaggtctcgggaaggcggaggcgtcacgatgacctctacggggcgcaggacgctcgggtcaacatcgagcgacgccgggacgagcgccgggctacccgcatgggggaaggcgcctcctcatctggagtgccacgctcttcttcgcgaggcgccctcccctcacgctcacccctggggggggcaggttgtagggctttcgttcgagtctccggaatgtccggtggcccccgaagtttcgccccaacctcacggagaagtatgatggcagcatcaacccctccgagttcctccaaatctacaacacgatcatcgtggcggcagggggtgacgaccgggttatggcgaactactttcccatggcccttaagggtcaggcgcgtggctggttgatgacccagccccccgactccattcactcttgggaggatctgtgccagcagttcgtcacgaacttccaggggacatatccccgcccgggggaagaagcggacctgcatgctgtgcggcggaaggacgacgagtccctccgttcgtatatacagcgcttctgccaggtccgccacaccataccgtgcattccagcccacgcagtagtgtatgcattccggaacggcgtgcggcataaccgcatgctggagaagatcgcctccaaggagcccaagactaccgccgagctcttcgagctggcggacaaggtggcccggaaggaggaggcgtgggcctggaactctcctggcaccggtgcggcggctgcggctgcccccgagtctgccccccgctctaagcggcgagataggagaggcaagaggaaaccggcccgttccgacgacgagggccatgtccttgcggcagacgggcccacgcgggccccgcgcaaaggaaagattaccggcgataagccgagctccaccgccccctccggcgaaggccggtcggcggacaagtggtgttcggtgcacaacacttaccgccacagtctcgccgactgccgctcggtcaagaacttggccgagcggttccgaaaggccgatgaggaaaagcggcagggtcgacgggagggcaaggctcccgtgacctcaaccagtgaccagcgagaggaggccaagaacaaggcccctgctgacgatggcggaggtagtgaggatctggatttccagataccccaagggaccgtcgccacattcgatgggggggcttgcgctcgcatttctcgtcgagggttcaaggccatgaggcgggaacttctggccgctgttcccacccacgaggcgatccggaaggcgcgctagtcggaggtaaagctcaccttcgaccagagcgaccatccgacggtactcgctcggggagggaagttggccctggtggtctccccgactatccacaacgtcaagatgaagcgtgtgctggtggacggtggggccagtctgaacatcatctccccggctgcctttgacgcgctcaaggccccggggatgaagctccaaccgtcgctgccaatcattggcgttactctgggacacacgtggccgcttggtcacgtcgagctcccagtaaccttcggcgactccaccaatttctgcaccgagcggatcgacttcgatgtggcggatctcaatctgccctacaacgcggtcctgggcagacccgcgttggtgaagttcatggccgccacccattacgcctacctccagatgaagatgccaggtcctgccggtcccatcaccatctttggtgatgtcaaagtcgccctcgcctgtgcagaacagcgcgcggacaacttggcgatggccacggggccgcaggccccggaggcccccgcgtcccgcgcccccaagaagcgcctcaccttggccgacgaggttcccgtcaaggagattccccttggcgacgatccgtccaaaaccgctaagattggcggaaccttggacgccaaataggaaggcgcgctcgtctccttcctgcgggcgaattctgacgttttcgcatggaagccgtcggatatgcccagggtccccagggaggtgattgagcaccgcctcgccgtgcgaccggatgcgcgacctgtccggcaaaaagtgcggcgtcaagccccggagcgacaagccttcatcagggaggaggtggaggaggtggcgcggctcctggaggctgatttcatccgctaggtgattcatccggagtggctggcgaacccggtggtcgtcccgaaggccaacggcaagctgcggatgtgcatcgactacacagacctcaataaggcatgccctaaagatcccttccctctaccacgtatagatcagatagtcgactccactacggggtgcgaccttttgtgctttctagatgcatactctgggtaccatcagattggcatggctagggaagatgaagaaaaaactgccttcattactcctgtaggcaccttttgttatacaaccatgccttttgggttaaaaaatgccggtcctacctttcagcgcatgactcgaattactttaagtaatcagatagggcgcaatgtagaggcgtatgtcgatgacttagtggtaaaaacgcgccgccgggacacattgctgcaggacctggccgagactttcgatagtcttaggtccacgcgcgtaaagctgaaccccgataagtgtgtgttcggcgttccggcgggcaagcttctcggttttctagtctcttcccgaggcatagaagcaaatcccgagaaaatacgcgcgatagagaggatgcgccccccaacaagctcagggatgtgcaatgtgtcgctggatgcatggccgccctgggtcgatttatatcaagactggacgagagagtgctgcccctattcaagctcctcaagcgccccgggccgtttgtatggacggaggaagctgagcaagccctcaatcagctgaaagcttacctcacttctccccctatcctggtggccccggggccggaggagccattgctactctacttggctacgaccccccacgtggtgagtgccgccctagtagttgaacgcgaggagaccgagcgggaggtccctccggctcgtgatggcccctcgtcccccaaagcccccagcccccgggaggaccccgaggcccccggaggagaaggcgaggctttggcaggaggccccgagccctgtgatcccaagataatccggaatcccctggggcccccgagcaggcgcgccccgggtcatccgcccctaacaacacgaaccggccccgccgaacggtgcagcggcccgtctactttgtcagcgaggcgcttcgggatgcgaaaacccggtacccgcaggcccagaaaatgctttacgccgtattgatggcctcgaggaagttgcgccattacttccaagcacatcgggtttccgtggtaacatcgtaccctctcggccaaatcttgcacaaccgagagggcaccggacgggtggtaaaatgggccatcgagctagctgagttcgacctgcacttcgaaccgcggcacgcgatcaaaagtcaagtcctggctgacttcatcgcggaatgggccccagtggacgaccatgttccgtccgaacccccttcctcccccgaagagaaagaggacccaaacgctgacattcgtggcggacactggattatgcatttcgacggctccctcacccttcaaggcgcgggtgctggagtcacactaacctcgccaagcggagacgtcctcaaatacgtcgttcggctcgacttccgagccacgaacaacatggcagaatacgaagggctcctcgcagggttgagggcggtagccggaatggtcatccgccgtctcctggtcctaggtgactcccagctggtcgtaaatcaagtatccaaagagtatcaatgcaccgaccctcaaatggatgcatatgtccgcgaagtacggcgcatggaacgccacttcgacggaatcgagctccggcacgtgccccggcgcgacaacatgctcgctgatgagctgtcgcgtgttgcgtcggcgcgagccccacttcccccggggacctttgaagaaaggcttgtccaaccatcagcacgaccgaacccctcgaggggctccaacgacataccctccgccccgactcctgccgacccgcgccccccggagcccgagggggtcgaccccgaccctcctccgcgccccccggagcccgagggggtcgaccccgacccccctcgccaagtcgcatggatgactgacatccgggcgtatctcgacggcaatactcatcctgaggaccgcgcagaagctgaaaagcttgcgcgcatctctaagcggtacgtcctcgtagaagggaccctctaccggcgtgccgccaacgggatactcttgaagtgtgtttctcgagagcagggcatcgagctcatagccgacacccatcagggcgagtgcggggcccatccggcctcacgaactttagtcgggaaagccttccgtcaaggcttttattggccgactgcattacaagatgcccaagaatgggtccggcggtgtaaagcgtgccagttccacgccaagcagaaccaccagccggcccaagccttgcaggtcatccccctctcttggccttttgcggtctgggggctagacatccttggacctttcaaagcggctcgaggcgggtatcagcacctgtacgtcgccatcgacaagttcaccaagtggcccgaggcttaccctgtcgtcaagatcgacaagcattctgccctcaaattcatcaggggcatcacctctcggttcggagtgcccaaccgcattatcacagataacggcacccagttcaccagtgagctgttcggcgattactgtgacaacatgggcatcaagttatgctttgcctcgcccgcccaccccaagagcaacggccaagtcgagcgagccaatgccgaaatcctcaaaggcctaaaaaccaagacatacaacgtcttgaagaggcacggggattcatggctcgaggagttgcccgccgtgttgtgggcaaatcggaccaccccaagccgcgccaccggggaaacgccgttttttctggtgtacggcgccgaagcggtcctaccctccgagctctccctgggatcgcctcgcgtcgcactgtacagcgagaccaaccaggatgaccttcgccgcgatgatctcgattatcttgaggaacggagaaggcgagcggccttgcgtgccgcccgctaccagcagagcctgcgacgctaccatcagcgtaacgtccgggcccgatcactgcaaattggcgacctcgtcctacgccgcgttcagtcgcgcctagggctgagcaagctttcgccaatgtgggaaggcccatacaaagtgatcggcgtgccccggccaggctccgttcggttaatgtaacgccccgattttcgttcgggattaaaaatcattaataatacattttctagaaattaaataaaagataaatcaatttaatcaagtgaaataatgggagaattaaaattttcccttaaaaatcattggccgggaatattttgtaatattctttgtgccctaatgtactatccggaatttccgtgaattttcggagct

SEQ ID NO: 47941 - DNA, 12794 bp, Oryza sativa
ttgtctgcttaagcaacttaaaccataaaaatctactcacaacagatcaataggcaagtggtttagtaccttatctttagcaacccctctcttccacctctcttccgttctggcggcagatggtcagtgtcagagagaagagcaacgacggtgtattaaagccacagatcaatggtttagttgaaagctgcaaggtgccccaatgccagatgaaccctgctcatgatcaacttttggtgtccaagatcagaagatgggtgtattcgatgtgggagatgcaggttcgatacctggtcaaatgtagcggaaataactccaacagtagtgtgttgcagtcagagtcagtggatcagttcaagacaacaagctaccagctgagtcagagcaccttgctctggttagccaagattggaagatggatgtgccagatattgatgtagcaaccgcagagtccgatgcagcagatgcaacaacagtgtctccaacaacatgcacaagcctagatgcaagctggaattaggatcagagccaaagccagtttgttttcaaagaggaagcacctgcaacctcagacagtacgccaccaagtcttcagcagaccagcacagctaagtcaccaccaatcccagaggcaacaaatgctacctacagtggttatggttttcaagagcagtttttgcaaagtgtccaactatccatggaagatgtacgacagggcacctctcagagggttgttccacagtaaggcgtcagcgtcatcacatcaagagctttgttagtgacaccccaactcctcaagttgtgtcagttccaatgcagagtcggtcagttcagttttgaggaatcaactatgcaactcgacaccgaagtcaagctagaagcaggacagtcatgccagtagttagaacttatgggaaagttagtcaagagtcaatgtgtccatgagctaaatgagagtcacctttatgtggaatttcctatcatcaactaaggcttaagttccaaatcttgtcgggatgaaagtgcatcgccattgcttcaatttgatggaccgatgaagtttcagtcttcaaagtcagggcatctgtaaatccgagaaatgttggtcattttttcaaggacaacagttcaaaggttctcagtcaggcgaaagtaagactacccactgtaaggggggtaggtctcacagatgagttttggctaacctcgttgccgtttcagttgtaggttcaacccggtgcggcaaattggttcgtaattaaaggagtcagttgcgaaccattagcagagtcaccccaatctcaggtcgacaggttcgattctaaggtacacctgtgaagcatgtcaacagttcagcttagagaagcaacagcgaggacagttgtagtacagacgaaagacaggtcaagcaggttttcctggaattacttgtcatttgagttgggaccagtccaagcggacatagggtaaatgatttacaaatgccagattccattttcatcctcttatagccagcgtggtgaattctcaggttaccaaaattgccaatctcaacagttcagtccaagataagtaagtttcaggagcatccacagttctggcctaggtcagttcaagcataaccagtcggtccagttttggcaaaacaaaggaacagaaaggttgaatccagccagttcaatcgtgcaggtttgatcaaccagtcaatcaatcagttcgaagcagaatgtggcagttcaatgtgcagatcagtcaaaccgcccaccagcaccagctttctttctagccatcccagaatctcgggacgagattcctgtaaggggggtagatttgtaacgccccgattttcgttcgggattaaaaatcattaataatacattttctagaaattaaataaaagataaatcaatttaatcaagtgaaataatgggagaattaaaattttcccttaaaaatcattggccgggaatattttgtaatattctttgtgccctaatgtactctccggaattttccgtgaattttcggagctcgagaaatagttttaaagtcacaaagttcattaaactaatttaaataaaaagaaaacaaataaatttcccccttcctctctttgggccattttcggcccaagtcttctttcctctcccgcggcccgcgcgccttctcccctctctcttggcccgctcgcaaaagtctattttgcgtccctccttctctcccttcgccgacaggtgggaccagcggtcccacccgtcagctcctcctcctacctctcgccggccgaccccaaccgccattgccgtccacgtcgccgcaaaatccggcgccctcccgcacccgagctcacatccaaccacgtggacacaaccccctccacgtcctccaccttttcccccactcaccccgcaagaaacagcgccggtttgacctccccacgagctccacttcacctccccactccgccggccgttgccgctcgtccggccacgatttctcctccccgagcccataaaaagcatccccgtgctcccctcgtccgtttccccatttttcccgagcccggcatactctccctcgctctccccacgccgcacccacgcgctgccacactccggcgagctccggtcgccgtttcccgccgccacagccgtcgccgcgccgagcaccaccaccgccagcttcgccaccgcaaggggaagtccggccgcctcttatttccccctctccacccctcgagcaccactcccaccgcacacccgaggccgccgcccctttcaccgcctccagccgcgtcgcgccgccgcttcggtcgacgtcgactcgcgccgttgcctccctcagctccgcaaggacgaggaggacctcggccgccgcccctcttcgccggaaatccgccggagctcctccttcctcggtcgccggtgagctctacctcttgtcatcgccatcggtcttcgtttccagtcaccccgcatcggtcctcctctccctaactccctcttctccttcggaaggtcaagggcgaccccgtccgccctccgtcctcgcaagccgccattgggcaatcgtcgtcgccgtcctcttcctccgcgtcggccgccgcttccggtgaggatctctcctcccttcctttttttccggtcccctttcttgccgaccgccgcctcttggggtgcgtcgccgtccccgtgcgcgccgctgtcctccggccacccgccgccgttccacgtcgccggctgctgcagccggttgccgcctcccccttgcccccttgccgcctcccccttgccgccgccgcgccatgtctcggccgagccggcttcatgccgtgcccgtgccccagccgcgccgcctcgtggccgtccgatcggctttgggccgatccgggccgtcggatcccgtggaccggcggtggaccgcctcggtggtcccggtccacggtggaccggcgcctttgtgccgctgaccggtggggcccgcttgccggcgccgcccctcccctttgatgacctcagcacagccttttcctttgagaaaataaataataattgcgcaataattcgtgaataattctagaaattcattaaaatggctcaaaaccttctaaaattcatatctaattcattcgaactccgaattgagccattcaacttgcaaaattcatctaaaattgagctctacatgtttgtttactttttatgtactatttccttggtttttattagagtttttcctcgttttgcgtgccagcgtgtagaatccgttgtttcggaagtctgcggtcgcaaggaaaagagttcggaagattgttttgaagaagcaaggcaagtcacacattccccttgagcatgttgatcccaatttataaatgttttaccgtttacaaataaatatgcatgttttgctaattacatgggatctgggtattacctatctgctcgcttgtgccatgtttacttgatatctgttctttgtcaaccttgggtaatgaatcgactagctcaggttacttatgtgacctagctagaactatatgcttagccatgcttaattactactagctcagttgatgggataattacagtattagaccttttagtatcagaatgagctgcgtgctcgagacatctggccatgcttcatggtcgtaattatccaactaaaatgcaactgaatggtgggctgtgggtgcatggttttgctagacgtgcccatggcgattaaggaccggttcgcgggatgccctggaagaacttatcgtacttaccacaagccagcgtgggcaacggctgggcttgtagtgtagcttttctctagccgacgtacccaggcgagggtgggcgtgatggagttgggtcggccggggtgtccggttgatcggcttccggattcaccgcggcacgaaaggggggctgcccgttgcctgctggggacgggggcgaaccctaaggtgtggtgcgatcggttagagggggttatgcgaagggtcctgtcacggcctctttccggtatgtcgtggtggcatgtcggcgcacggaaacgtgtcgtggggctgtgttttgtgggtacagttgtacacctctgatcagagtaaaactattcgaatagccgtgcccgcggttatgggcggtcgaccagattcaccgtgattagtcccatcttaataaatcgacccaatacactgtagtccaggtgggttggttgggcctgttcaacgtggtgtagcgttgatcagtggagatttaatgttactttaattactcaactgttttactgttttgctcaataaaatgttttacaaccgcctttatgcaaatagccacaaaccgtccttgtgttccccttgcacgtctgcatcgttggtgtggcttgctgagtacggtggttgtactcagccttgctattattcccccttttcagaagtgtagtgcttctgagctgaagacgaagttagaggaccaaggctcagaccccagttgagttttgcctgtggagtggagctgaagccccgctaggatcgcctttttccgctgctgctgcttttgtttcggtgtgaggactaagtgcctcttctgtaagtattttacgctttatttacgtttggaactgtatattatttgtcgttttgtgtaccctggctggtcctggacagggatttaatacacaaaatagtctggaaatttgggctaaatttctgggcgtgacagttaaccacggaggacggcacagaattgcctaacccctggaatatcgaacacctccatcgcttctatccataatatcgagacttttttgctttcttggagctcgggccagcccccgcacaacccctcggtttgtgcgcgcctggccgggggctaccactgtgtatccttttttcctcttacaagcaatgaattcttgtgtacttttacccaaagaccgtttcttttttcccttcctctggcttgtcctggtttaaggggtaatctgcgtttgctctgaatcctaagtgctgtgaggcggcctagaaaccccgaaagggagcacgaacgcgggccgtgccctgggttgcgccgaaccccggaggatcggaagggcctacacacggccgtccccgacccccggtcgacgcggcctcggtctggccagtcccgctaggcggctccctcggagcggtgggtttgtccatcaccacttaggtgccctggaccaaacgcggattcaccatctcgctagaacaagcccgagggggggtggggtcaaagcggcgtctcgatcacggactgattatcccctttttcccttgttttttgtttgttgttctctctgtttcaaagacattcagtggaaggagcaatgaatagaagaagcgaaaggggaaaaggagctaagcaagtttcaattgcaaaacaaggcaggatggcacgacggcctaaatacaagaggtgcccgctacgggcgcacaacaagagggaattgaaggcgcggatagtcacggggtgcccggccctccgaggccggcgccgctgacgatgtcgtcctagtcttcgtcgctatcgtcacccccgctcccgctttcttcgtccgaggcgagcccggaggtgaagcggggggccgatccctcgaagcccgagaaaatcgcgtcggctgcctcccgaacttgctcccgggccctcgcttcagttcctgggggaaaatcttcaagtgcgcaccacggcatgaagtcggggtcgcgcgcttggtggcttgcaagaaccagctccaccgcggcccgtgccaaagaagctgacgaggactttatggtctcgccgacctcctcttccagtctctccaggcccgccgctagcccgtccaaccggaacgcgagcgctggttgtgtgggcggaagttggctatgctggcgcatgggaacgccgactcggcgcgccgcgcgctccagccgagcgacggcgtcggagagctgcccgggcccgagttcgttggtgaggcgaagggccgcgatctccccagcctgatcttgcaccaggcgccccaggtcggcaagggtactctgagccttagcgagctcgctcgccaaccccgcgccgccgggcggcccgccggctgccaggtgcttctcccgggcctccagttcggaagccctcgccgctatcgccgcgcgctcagcgcaagcgctctccagatgccgggcctcgcgcccagcagcagcctcctcgcgcttcgcaagctgctcgcccagccggcgcaaggctacctcgcggcggtttacctcggcttcgcgctcggcgagtgcggcgtcccgttcccggcacgcctcctcccgcagccgtagctcttccgcgcggcggcccgcggaagcttccgcggcgagagtgatccggtcgtgctcagccgcggcctcttcacgaaggtgaagggaggcctccgtttccgccgccgttctctcatgggcggccaaggtggactcccgctgatccagcaggcgtgcttgctcctccagctcctgggcccgctgcgcctgttcctggccgcgcgcgttttgttcgcgctggctccgatcaaggacctcaatccgccgacggatcgtggcttcaaactcctgcacggagcgggcacgatcgtccaaggccttgcgttcagcctcgagtgccgcagtccgggcctgcaacgaggtgtcggcctccgctgctcgccgctcgtgggcagcggctgcgtcgagggtgccacgcgcattcctgaccctctccgccaggtcctcggcatgggcctcgtactaaaggcgaatatcgcccagcgcttcgtccagggcgctcgaggcgatcagcgccgcctgccgctcctcctccgcctcccgcatgacggagtccagcacctcctcgcgcgcctggattttagctaggtgggcttggtgttttttgcgccccaccctcaccatgtcctccacggcacggtgcccctcgtcgactcgcgcgcggtccgccacaagctgagcccattcggcatccagggccgtccgctcttccgccagggcttgaacttgggtgttgagcccctcccggacagtggagtcggcggcggcgagcacctgcagaagtggctccatgctcgccggggatggggaagaaaagcccgcggttcgcccccgggacgacggagtgctgctggaccccccgcgagacggggcctgctctcggccccccttctgcgaggccagccccgagggtgccccaaacgcaagggggagcggctgttcttttcgtcccccgctcccagtcctcgggtggattcggcctcggcctcgggctcaggaccgcccccagcctcgacctcaacctcgggcccggtacgtgtcctgtggaccccaccgcgaggttgcgaagaccccgtggccttggattggccaggcccggaccgctccggttgtgcggatttcgtcctccgcgaggggtccgaccccgaggtcccctgagaaggaatatcgctacaagggaacccagatcgcgttaacaaaagaaaaagaaagggagggaacaagaggccgagctaggtaagagcaccgaagtgggcgccagcgtttgtacctgcggggaggatggttgaaggtccacttcgggggctcgatgaagctccctcggcacggctccgtttgccctattttccgaagccgtttcttcttccgaccggcctcgggcccggcaggtcgcttgtgacccgccggtggaaggtctgtcgcgcgctctgcaccccttccacgcgggggagagggcggccaagatttggccgccttccgcttccccttcgggtcacttgctgggtcgtctccgggcccgagccgggcgcccgtgagtcgccaccaccgcccggaccgcttggccggctcccgcccacggacgcgccgccaccaccggcgctggcggcgctaccgctggcgccccctcggccaggccggcccctgccggcgccgacgaccgacatcacggccaagatgctctcccggtcgcggtcgcagcagagggggaggatcccatccgggatcagtgtttgctcggcggagtccaggcccagcacccgccgaatcaccatcttggcgtcctcctcgccccagtcccagcgctcgcccgcgtgcttgcgcatggggtcgttggggccggtatactcccacgcgccacgggatcgttcctggagaggggcgatacggcggcgaaagtagtcgccgaagaccattgctcctgtgaggcccaagcttcgcaggcccctgagacgatcccacaccgcgtcatattcctcgcccagctccgaagccgtcagccatgcggcggatctctcgggaggaccggcgggaactcgaagtcgtgggtgatccggcagcgcggtgtagaaccagtctttcttccagtcctcccatttcttgcggaggtggctctcgatgtactgccccgccgtgcctggtcggggctggaagtaacatccccccaccaccgcaccctgtagcagctgcgggacgaagaaggcctggaacaaccgcatcgtcggtcgcacctcgatgaacatctcgcacaggtgcgcaaagatgctcattgtcatcacggcgttgggcgcgagatgcaaggcatggatttcgtagaaatccagaacctcgtggaaaaatcgggagaaaggcggaatcaatcccgccatggcgaaggacaagaggtgcacggaccgctccggatatcgcggccgcggccgtgactcccccgccctcacgacggcgccgtccggcatgattttgcgggggaggctaaggtgtctgtctgccgagatgcggggagaagggagcactgtgtcgccggtgtcttgagccatggtggccggcgaggcagtggcagaaggcgtggcgcgcaaagctgcgtggagtggcgagagtgttagggttcgagaggcgagaggacgagtcggcggttggcgaaaggaaggaggagaggtccctgcctccactcccttttaattcttgtctcatccgcgctcgcctcctcgtttcgcaccctcataattgcccccacgtccgcagttgtctctccgtttcccgcgcccgttcaccacgtcgcccgtcgtgtccgcgtcccacctttagtgcgcctatcagcggcgcactcgaggtggaatgcgcaacggctataagcgcaagctgagtgaaccgtcaccacaaccgccgtaggaatagcgggcgaggtaatcgaggcgtggtctaaccgatcccccgattatcgcgtcccaagcatcctcgtctttagcgcgatcagaggcgaccgaaccgccgctatggctggcccgctaatctgccgctcggcaatactccttaaactccccgccgggcccacaaccccagctagggaggtcgtgaggcaccatgtcagaccgatcccaggaacccgcgtctgacatggcgccgggggctactgtcggagatatgggcccgggggtatgtggagtaaaggagagctacttccctttccagccacgtggctctgcgagctggtcccacccacatacctcgtgagtcactaaggtgatggggagagcctcgggggtcgacgacatcccctcgggggtgacgtcaccccctcgggctctcccgtcgttttagcccgaggccctccctcggggggaagggtgagaggagagtctaggctgggcggccataaatgtgcagcgccccaaccgtccctcgctgcattcaatgcggcgagggcagacgtgcggcgtgcccgaccgacccctgtcagtcggatgcgaccggtctgtgaccagtctattgccggtcacggccgattgaacggatggtcgtgcccccacgtcgcctctgtctccgcggagtggcggtaggtacgccccgtcacatccggacgtcgttcgatgcagggctgccgcaagtcctcactcatttatgagggaatgacagggctgccccccgtgtcaggcgggagacggcgctgggccccactcaaggaccgaccgatgcttagcttccagcaaaaggcacaggttgaaacccggtgggaagagggagaagggccccctcccctccctccgatggagggggagggtagaggcggcgcatgtggtatccccttaagctataaaaggaggaccttgcccaccggagagcggagaggagcaaggagaaccttgtaaaaatccactgataatcccaaacgcaggaggagggtattacgctccaaagcggcttgaacctgggtaatcgaattgtgtgctatctaaacggggatcggagggacgaacacgcgacttcggagagacgagtctctgccctcggccgaactcacgaaaggggggtcacgcgacccgcgatcagggggtcttccctcgacacaaatagacgtagtggtagatcgagaaagcaaataaatgacaggtgacaaagaatttaggagtagcaactgacataacttttaaaaaaataaaattagaaacacagggatgataaggtttggtttttcaaagtcttaagacaacgagatatctatttaacaaaattttaagtaaaactatattaaaaattagataattttatatcggtgctagccgcgcaattgcgcaggccacccagctagttattatattattaaaggaatataaaaaggagcctccacgtttgctctcatggcctagaaattctcacattaatcggagaaaaagaaaaaacagagtccatatagaaatacaatttagaaatagctgaaattcggaattaaaaaataaggaatattagaagaggagactagagtccatatagaaatacaatttagaaatagttaaaattcggaattaaaaaataaggaatattagaataggagactagagtccatatagaaatacaattaagaaataactgaaattcggaattaaaaataaggaatattagaagtagagtatagagttcatatagaaatacaattagaaaataactgaaattcggaattaaaaataagaaatattagaagtagagtatagagtccatatataaaaacaattaagaaaaaaaatagaaattcggaattaaaaagtaaggaatattataagtagagtgtagagtctatatagaaatttaaaactaactaaaatttggaataaacataataaaattaaaagtagagtttatagtccgtataaaaatacaatttacaaataactaaaattcgaaattaagaaaaacatgggaagaagagttcaaagtcaatataggaatacaatttagaagtaactgaaattcgaaattaaaaattaaagaatattgaaagatgagtttagagtccagaaatacaattagaaataataaaaatttagaaagaaaaataaataatattggaagaagagcatagagtctatatagaaatacaatttacgaagtaaatgaaattcgaaattcgaaattaaaaattaaagaatattgaaagatgagtttagagtccagaaatacaattagaaataataaaaatttagaaagaaaaataaataatattggaagaagagcatagagtctatatagaaatacaacttacgaagtaactgaaattcaaaatttgaaatgaaaaattaaagaatattgaaagatgaatttagagtcgacatagaaatacaattagaaataataaaaattcagatataaaataaataatattggaagaagagcatagagtactctatatagaaatacaattttcagaaaattcagaattaaaaaaatattaaagatgagtctagagtccatataggaatatatataatttacaaataactaaaatttgatattaaaaataattaataactaacacgtatataaaatataatataaatattacacattagtagttttgtaaagttattgcaaaatttaaaattatgttgtcattttaatatatttgaataatataatgagaaaacatatatgctattatataagagaaaatataatgatgctaaccgtacaatctgcacgggccaccatgctagttacatattaaaacagagatagtagcaaaatagtaaaaaaaaaaacaaggaaagaaagatcatcccgcacgtcattccttgccattttattcctttgtttctttttctccctacacacgatgatggcactgtttggctattatccaactattatccatattccttaccgaaaaccacccgtcattgttctagatgtttcctgtgctccaaggccctacattttttttaatgaattatctacttcgttatatatagagatgatttaaaaattttaaaaactgaacaaacaacacaaa

SEQ ID NO: 47942 - DNA, 10508 bp, Oryza sativa
ttttagaggcatggagcaaataatcaactacactattcacattcaaatttgtttttttttatgctatataggttaaatttgatttgtatgtttgtgccacatattgatctatcttattttttatgactttttacgcgacttgcacaaaacaaataaatgtcctctcgagacaaatatatttcagtacgaattgtctgtagtattacacctctaatagctactactgacatatgagatcggatctgctaatgcatgtgttgtactgcagagaggatccatgtccaatagaattccctggagaaaattccaatatgctatgaccgtagtcaccacaatattgagctcaatgatcggccattgtagctgtgacttgacttccttggctctaccaacgagggaaagatagatattccctcagttcctaaatacgtacaaggaattataggttttcttgtataaattaataataaagataaagactataacaccccccattatatggtgagtgaaaatgttattcggaaagtgaaaagaaaatttgaatggtaagatgattgattggacaaattgtacataaatattttatattttgaaataaattttaaatgcttatgtcccttatatttgagaacggatggagtttcagccctaggcaaagagaggcaaaacatgtggcaatttaaccaaaaccatatattggattcctgtttcaagaaaataacatatattggattgtagcattgtactaagagaactaatttgtctagcattaaaaagatttggcgcagttctatcttttatttgagttgagagataaaatgaagtttttcttttcaaaaacttcatacaaaattagtatgctctgaggagcttaaaaagaaattctgaactctgaactctgaactaagtacggatgtacttctatagttaatccagcgtgccatttgcctggtggtcatgagtactgatcaagagtggtaggcagggtgttcgtcctcgtcgtcgaacgcggtgagagacttggcaatgtcgtccatggtcggcctgcagctcctctcctccatacacgccagagaaatcctcaccatttccatggcctgccgagggttgaactgcccctgcagcctggcatccactagggacatcacatcgccgctgtccaccacatgcctcagcgcctgcgtgatctgcggcagctgcagcggctcgccggcctccgtcctctggtccgcgaccctgcttcctaccaccatctccagtagcacaatgccgaagctgtacacgtccaccttagcattgatcggcaggttcagcgcccactccggcgccatgtaccccgacgtccctctcatgtgggtgagctccacgccggcgccgccgtcccgcttggacagcttcgccagcccgaagtcggcgatcttggcttcaaactctcgcgtcaagaggatgttctccggcttcacgtcgcagtggatgacccactcgaggcactcgtggtggaggtaggcgaggcccctcgccgtgcccagcgcgatcttgtaccgatcgctccacgccagcgtcgtcgccttgccgccgctgccgtcggacgcgtcgaacaggtgccggtccagcgactggttctccacgtactcgtacaccagcagcttgtgcttgcgctcggagcagaatccccagatcctgacaagattgatgtggttgatccgcccgagcaccgtcatctccgaccagaactcctcgtccccctgcatcgtcacgtcgaccgccagcctcttcaccgccaccaccttaccgccgtcgagcacgccgcggtacaccgcgccggagccgccgcggccgagctcctccttgaagttggccgtcgcgcccttgagctcccggtacgtgaaccgcctgaactggctcgtcatcaccatcttgtaccctgcctgcagcgagctggggatgctctgcttgctggagaggaaccaccagcccgtcgcgatgaagaggatgtccaggactccgagcacgccggcgaagacgaagaagtaggtccactgcccgttgcttcctggcgccatcccgtacacgtcagcggacacggtcacgacggtgacgttggcaccgcaggcgaggccggcggcgcgctgcgcggagacccgcggcgacgaggcgttgaagtcgaggggcaccttgaggtagatgctcccggggaaattcgccgacgtgaagccgttgaacagcgtgcctttcgggtagcattttccccggccgtcgagcctgtacgagaaggcggtgcactggcagttgttcatgcactggtccctgcactgcttgaacgtgatggactcggtgtaccccaggtcgaagccgaaaaaatcagtctgggccacctcgatgaacttgaactgcggcggcgccgtcgccggcgacggcggcggcgccgatccctggctgcagttgccgactgggaacgtcggcttgcagcctctcctccagtcccggcggtcgaccatctcgtacccaggtaggcacgagcaccggagactcggcaggtactcgcagaggccgtttttgccgcacagcccgtgagcttggcatggctgcttgagcgccgaccatgtcaccgcccagcctccggtggacgcgttcaggctgtacattctcaggttgccgtcctgttcgatggttatccgcctcttgatgccgaggcccagatcggtggcctcggctttcgtctggtcggaggacaggaacacgccggcgtcgtcgaggatggcgatcctcgtgctgttgtagttcgtccggccgttttcgaacacggtcaaccccggcagcggccagtagatgctggcgatctccgggccgtcgtagagcatgcgcagcacgttgtcgttgtcgaagtagaggctgaagtagccggcgacgagcttggtctgcttggtgaaccgctgcgacgggagcagcgtgtccgtcggccactcgaagctctgccacacggcgaggccggtcgacgggtccccgacgacgaggttcccggtgtcgcggagggagacggtcaggccccttctgttcccggtgccagccgtcgttttgctcgaccacaccgtggtcccgttggtgtcggcgagggccagctcgccgtcgcggctgaacgagaccctggagcccctgccgttcacgggggcgtcgcggttggccgaccagacggcggtcctgttcgggtcggcggtgaaccagacggagaaggtgaaggcgttgtcgccggcctcgaggaagccgcaggagaagctgccgtccgtcgacaccaggaacggccgcgcgtggtcttccaccgacatggaggatctgcccagcgtgtgctgcgccgtcgacgaggacgggcagagcagcagagacatcagcgagagctgcacggccaggtagccgatgaccaatccagccatcgtttcaactatagcagtttggcaattggttgtacacttgtactacatagggcaaagaaattatgagcgcatataaggcgatatcaagcagccaatgcagtcatgtgttgaaaagtctaattattgatgacttggacatacgccgtgaggcgtgtgccacaggaaacgatgcttcgtttgatgatgattaggagtaagcacctctctacgttttatttttgttttcgtactccctgtgttagttaattagtgagctgaggtcaagatttcttgtgagggtcgtggatcgtttttcgcaaggttttgtgtggacgcgtgcatttgctagcttcaattctgatctcggttgttgctggtcttcgttcgtcgactcgtcgtgacagtacgatcactttttttttaactactcgcacagacagtacgatcaccaatgccatgcaaaataaattgctgttcatacagggaatttatgtcgagtaataaaaaaagagatcaaactgttcgtccgcgaaggttctgttttcctcttacatggtctgcggaagaggataattatatcaaggccatcccagaaaatttcatggctccgggcgaaactctaagcagggtgataaaataaaaataacaatgcgaatacaatgtattacatcgagtcatcgactaaacagtaatttagaaaagacattgcaagttggagcgatgtccttttttttttcattggcattccttataaaagttttttaatttacttttgagcttttcctttttttcttaccgggatgaccaaagaaggttatccaaatgttattaagatagatgaaaaaaatgttgcaaaaaaatttttcatcgacaactgactgtcgagaaagaatatgaactagagcacacgccccgaaccatgtgccaaccgcacagacacatgttacagagagggaagcggagcaccaagccgaccgtcgctacgagagaccggtcaccaccgggtttacaacaccaccacgaagcggagactctaaaaaacgacgccctcacgaaggttgtggtgccgaaagacgccgttgtcatccgtccaaagaactagacaggttttcactcagagctccttactgttggaggaggggtatcccaacagcgtcctcaggatgattaccacgcccaaaagcgtagttgacccaataaatcattgggctaagttttcgcttggaaccctctgcaaccctgccgccatgctctgttagccaatccgaaaccaccatccgaacattggcagcacatggacttttgagctttctaatatttaattattcgtttgtgtataattgttacacaaactgagtttcaacaagcatcatctatatcaaactgggatgacatatgtatgataagctctttaaaaaatggcacaaagcttggatgaaggcgttggccaatgccaactgctagaaatttgtttagttgtttttttgaggggggtcaactactcaactagcaaattaggaaaaaaaaaacaaagctaattaattaagtgtgacgcgtttagttcggattaattatgcacaaaatgcgcatgaagtctcgatcgagtttctcgctcgtgaacaatttggcgcaatcggcagggccggcacatagactgtaattctcggatgcgttgaatacccgtttctgatgttatgagagaaaaaaaaacgaaccacttgctgaattattaaactattgatagtgtctcatttgtccgagagtgccagcaattaaagagagtatatatgtggtcgtggtctagggaatttcttatcttagtccaaactttaagagtcgcttgaacatatgcagggttttcgatcgtccacttggacacttggcacgtacgtctgaaatcgcgaaagggaatgtagagctagacccaagctgcattttgggccggatttgcacgacaaggcaattctaccctggtactgtgtatttgctacaaattacacggagttacaactaacggatttatttgggaccacctatacatttgtcgacaaattttctcctaaaaatttgacggatgtaattatagtacaatcgtagagtaattacactgtaacttgcatgtaaatacaatataacttgtatgtaagtttaacgtaattttgaatcgttagatctattacaagatttgttttggtaaggaagagaaaaaaatcacagcacacacatatgtgaaaggatttgttcccacgacctccattgtaccgaaaataacattttacggagatatttttgaaagttacatacaagttatatttatagttacagtgtaattacatgcaagttatagtgtaattacactacgattgtactgtaattacatccgttaaatttttaggagaaaatttatcgataaatatatagcaaaattggatttatttatataaactacaagggttggctctgaatctaggcgggctgtgtgacggcctggggcctaagccggcaggggtcccatgaccaacttcccatcgtcccccatgcgacttggaatgctagccgtgctctctacagccattcttgtttctcataaatgaggattaagagccactggttgctctaataatctaaaacaaattttaaaattgatttgaagatattttcaacgtagtttatttctcagtattgacttttaagtcattaaaatcatatataaaagttttacctctaaatttatttttattttctaataacaagttaaaaagatttattagagaatattggcaaccgatgaaacggtaatggtagtgtttatatgcttggtgttataggattctagtatttattccattctataatgttcggaaggctcatacatatacgatggtgtcgtaactcatggtattgttcaatttaccgctttatattattataatggaggtttcctggtcacgaccagctctcgcgtcgccctccccacgggcgacacgagaggcgacgccgccgccgtcgtcttcctcctcccccctccttctctgcctcgccgccgcctgagcgggcgctggcaaagccgcgcggccgcggggatggtggcggcggggcttcgcctcagcgcgcgctcggcggcccggggagctgtccgggcggcgacggtggcaaaccgtccggatccgcacccgcccggccggatccggcggggtggcgcttggtggcggggcggagtggtggcggtggcgactggcggtgcgtggtggcggcgtaccgggccggcggcggcggaaacccccgcccaaatccgcgccgttttggccggatctggcggggctgacgccgggcgacggcgggcggcggggaagcaggcatgctggcggcggggaagaggcggtggcggtgcagctgaggtcgcgggcgacgcggtcgggcgcgtgtgagtgcccggaggccggcgaggatggcgacgcggggcaagctcgtggcggtggcggcaccgcggagctcgcgggcgacgtcggcggcggcaacagcacgggaccacggggcgacggcggcggtggaaacggcgcggattccatggcgatggtggcagcagcggcttgtcggcggcgacagcacggtggctggtcgacggcattggcggttgttggctgctgtggcattggggctctcgcgacggaggcagcgacgcggaactcgtggcgacggttgcggtagcggctggacgacgtcgatggggctgcggctggctggcggcgaggtggccgtcggcagcagcggccctggtggtggtgggaggtggcatggtggcctcggtcggctagccgaggacgtggccgacggctgcatctagccggcgcgggagagtacggaggaggggtcggagatcggtttggcgcagagaggcgcagccgatggcagcggaggccggctcggcgcgagaggcgcgggcggcggagatggaggccggcttggcgcgagaggcgcggccgagggagggaggccggattggcgcgagaggcgcgtccggtggaggaggccggttcggcgcgagatgcgcggccggcagaggaagaggcgaccctggtgcgaggaggagatgccggtgggcgtggcacgattttcggcgctcgaaggctggccggcggggggcgccggtgcgggggtcccacatgtcggtagaggttgtgtggtggtggagcatcggtgcgttagccgtggattcgcaggtggtgtgcggcgggtgaaaacccagtccggccatgccgggccgacaacgatggttaattccccctcctgagggcgttgtcgtgctgtctcacccctcaagggtggttgccgggcgaaagcccagtcctggctcctttgagcccggatggacggcggcggcggtttttccgtcgcttctcttcttgaagacgtcgttttggcaccccctagctgtagggcgatctcgtctgtgttcctttgttggtttagcggcggccggtccggtgctagcctcctcctggtcgtgtgtgttggcactgtcggtgtgtggggggtggtatattttttctttttccttttactggttatgaccctccagggttataatcttgtaattttttcctgctctatcaatagaacttcgcaccgtctcgtgcgagtcgttcgaaaaaatatattattataatgcacgaaatgcgaatgatgtcggtcgagggttgttctctagctcgtgtgcaattttccacaggctgtgccggcatatgcccgcatgcatacgtcgactgaacttccggggtgcgttgaatcgcctttctgatgttaggagaaaaatggatcactttctaatgaattgaactgttgatgtctcttctgtccgagggcaaccgcagagtccaaacatgtggatatttcttagtccaaaactccaaattaacagtcccgtgaaggcgtgaacagagttaagtcttggtccacttgtttccacaaaaaaatatcgttcaaaatttggcccacaaaatttttgtttcatcttatggtcaacggagttaagacatacgtatttatttggagcctagaaaatacaatcaagagtattactaaggtgcactacagtacgtaatttctccttactactaatttgttttagacagtcccaacccagaatatccataggtagtgtatagagaagagagagggcaacaaatacccatttagacgtaatcttctccaatgcatattgtccatggtaatgcctaccgagaaaatgaattaaataccttcatgcgtgtgcaaggatcagctacggcaaaaatcctaaagatcagctatggggcaaagggaggccgacgcagaggatcgggatatttataaaaaactagctgggtggcccgtgcaattgcgcggttagcacccatacaaaattatctatttttaatatgattttacttataatttattcaatagatatctcattgtcttaagattttgaaagaccaaaccatatcatcccatgtttctaattttataacttttataaaagtcacatcaattgctaccctttactttttttttcaccctttctttatttgttttctcgatctaccatggcttatgttcattctccttgtaacctttaaaaattggatcttatagtttttgagtttattatctcattgggtttcattttttttatttttagaagtcatgttaaaagctgccaatatacttctctacggcctatccgttgctgtaacgccccgacattcattagcctttaacacagctaaatcacaccagggtgttatgcattacctgtgatatagtaccagtcccaggatacactagtgtagacccccgattttggaaatcggaaatcttctgtgtttatccgtaccaatccctggatcagtagttggtacacacatacatagttggatcacaacatatcacgaatgaatttaggctaaaagagttaaatacttacattagggccaggtaggccaacaactatcagagaacaacagcggaagacaaaataatataagggcccggttaacatgccacaggcagtcgactggggaacgagacctagaacaagaccgcactccgatcatcttgtgggatacgcaagcgtaccgacaagggcttctcttcaacactctcctaaaagatatataaatagcaagggtgagtactaaccgtactcagcaagccaccacaacaacaatgcatatgatagcgggtatttcaaggaatggcttcaggttcttttgcataaagctaattttacaattcttttcacaagcctaaaacctagcatagactgatcaaattttagtaccagtgttcactttaaacaacgacggttctgtccaccatccattgtgatcccaaggatagcttcccgccattgaatcgtcatggttttctgaggatgtccaccttccctcctctcgggatgtggctccatcagcataaaattcatcatgcaatatcccatcccacacaagttaagaatttagagtctagccaagtgtaatacatgtcccggtgctcaataaccgcgagcacggctattcgaatagatttggtttactcacactgcagtggatgtacactttacccgcactccgcgactgcccaacacatgagcctcgtcccaacacatgagacgcgtcacggcaaagcttttcgataacctcgcattggcagtacccgctccatgaacttttcatcctcatgcactctaggcgtacacggtttctagcagtgagaggagttctggcgcacccgggaagggaagactcacacatgcattaagttataattatgttttagattctcacatggcagtcctaccgatggcgacaccactgtagacacccgcctcgcggtcctaccaatggctgccccaccgtagagcccctgcctcacacatcaagaaaccactatgcatggatactgcctccgctcagctatctactccgctaggtctatacccatacgagaagtgcggttgtacgggggtcgtttcatgcttaacttcatggctcggtccttaattgaccagggacgcactagccttttccggacaccacccaagtcctccagccgccccag

SEQ ID NO: 47943 - DNA, 718 bp, Oryza sativa
tcttcttagggcaataatatatcaacttgttcttaattgtaatgaatctgttgaatattctagtgtctgtatgaactcttgcatgaaactaagtaggttcatttagaaagaagtacgataccagtacctttatttgatggcaagctgcgttcagttattcagaagggcccaagtaaggatatgatatacacaatatcaatttagtgcacatttctcttgatcctttggcgcatgatttacactaccacagtaccatgtgatctcgtaagcagtaagcttactttccttaaaaaatatacacatacacaaagccataaaggatacgctctccgctatgcacagccgcattcagttctagggatggctcatcgcctcatctatctactgctgcgacatcacctgtggggtaccaattgacggcaaaaatgtcagttttctaataccatcacgagactagtaataacataaccgagccatcaagagggaggggcccgcgatatgtcctcaatcatccgagtcatccccgattccccattctcgtggttgccgccaaggtgttcgatagaattccgcaaagacaatagaggtctgcacggggcagggacaagggcggaagagggagggggggggggggggataacattcacctgcgcagagagcacgccggacgcggccggggacacggagagagctgcagatctgatggctccgctggtgg

SEQ ID NO: 47944 - DNA, 2116 bp, Oryza sativa
  unsure (1)..(2116): unsure at all n locations
nnnnnnnnnnnnnnnnnnnnnnnnnnnnnnnnnnnnnnnnnnnnnaacaggttcgctgtcaatcttttttccaaacgttgtcggtgacaaaaatttcaaagtcaaaattccgtgtccatgtgaatgcatgcatctacagacttacggttataccaggtcatagagattccatttttccatagaccaacactgtgtttagttccacgccaaaattgaaagtttgaaaaaattgaaacggtgtgacagaaaaattgaaagtttgtgtgtgtaggaaagttcgatgtgacggaaaagttgaaagttcgaagaaaaaagttagaatcaaaacagggccactcaggtatcttcttttctttaggactacactcaggtatcgagtcctgaattctagaacaagggggaatttttaaaaatctcacacattagagttcagttcctataaaagacaaggaaaaagaacaattcttgcatcacaaatggtattgcaataggaaattatttcttctgtaagagtcaatacaatccactcatccagtaccaccatacttagacgagctttccataatcatcagtaaccagaaaaagaaaagggagaacctaggcttccccttttcaaaataaactttacgcggattcagaaagatattttcgctagtatttagtcctagacaaagctcgttccacaccacagtccacacaatcaaaacaaggaccgttctcattgaaaaaaaggataaagaaaattatcaaatgatcagtaagaaacaaatggataaacttttggccatttaccagtcttcagaagcaaaaatgcttgtggaggaagacttaaatgatccttgaccccagattagaatagcgctcttctagtgctacataaatacagaacaaatgcatcattcccttccttcttccatctctgaagccaatcatatatctcatacacttatgcacctgatgtaatggaaacaattccctgcctcatcctcttttcgtcactacagattctggcattctcttctgcatcaccagagcatacactgggtaccggctcattcttatcggtagaagaatatgagaaaccatttctcatctcacccagcaatactttctcctttggtttctacgaaacaggtgacaacgccttctccctctccatctggttcaccaatacagtcgaaaaaaccgttgtttgggcagcaaactcagaatcaccagtgaatggtcatggctccaagctatcctttactcaggagggtagcttagtcctcagcgatgagaagggcttcgttgtgtgggatagcaagacaatgctaggacaggattctcgagttgctctacttgatacaggcaatcttgtcatcactgattccaagggtagtgttgtgtggcaaagctttgattcacccactgataccttgctacctttgcagctccttaccaaggacaaaaggttggtgtctggttactatagcctctactatgacactgataatgtcctccggctcatatataatggaccagagatttcaagtccctattggccaaacccatctgagtcaatttttgattttggacgaactaactacaacagctccaggattggagtcctcgacaatactggtcatttcacgtcaagtgatggcctaaacatcattgcttctgactcaggtcttggaataaacagaaggctcacaattgatcaagatggcaatctcaagttgtacagcttaaataaagtggaaaaaagctggatagtcacatgggaggccatgccgcagcactgtgacgttcatggactatgtgggagaaatagcatatgtgagtattctcctggtcctcggtgttcctgtcttccaggttatgagatggctgatctagagaattggagcaaaggttgtcagccaatgttcacaaacaactacggccaagccatagggcaagtcatatttgtcgagatgcgtcatgttgaattttatggatatgatacgggatttaatatatccgtttcactggaagattgtgaggaattttgttctcaacaacgttcctgtgttgcctattcataccatgccggaagtggttattgctatactaaaggtatgctctacaacgg

SEQ ID NO: 47945 - DNA, 4031 bp, Oryza sativa
tttggcctagcgaagctatccaaaagggattgctcttgtttgcaattatcccatatgagaggaacagtaggatacatggctcctgaatgggcgttgaatttgcccattaacgcaaaggttgatgtttttagctatggaattgtgcttcttgaaattgtgatgggagctaggatttctagtcagacaacaacagaaggggagaaactggatttgacacaaattgtggaagcactaaagcaagttgtagcttgtggagatgttacacacatagtggatgctaagctgcatggacaatttaaccatctccaggccatggaaatggtgaagatttccttatcatgcataggagaaaggacaaagaggccaacaatggatgaaattaccaaagctctgatggcatgtggtgatgaagacaagtatgctgactgcacagaatagtatgtaacacataaatgcaaaccagtctcatcgaattaatcaaatgttacttcaaaagtataaaggcgaagcaaaaggaccattcaagagtcagggatgtaaaaagtagcacaagccaacttacaacttgttcatgccaatgaatgctattactacctctgtttcaggtataagactttttagcattgcccacattcatatagatattaatgaatctaggcacacatatatatctagattcattaacatatatatgaatgtgggcaatgctagaaagtcttataatatgaaatggagaaagtagtatttacgaatgatgtatgtttgtagattaagaattctctttaattatctttttccagttagttcccaagttctatataattcacagcctgatggttcctctttctgttaccacaccacttgttttcagaaaaaaaaaagattcatttactatctttgtttcatattataagactttttagcattaaccacattcatatatatatgttaatgaatctaaacatatatgtgtgcatagattcattaacatctacatgaatgtgggcaatgctagaaagtcttataacctgaaacggaagtaagttatagcaaatcagttcttcatgttaccagatttccttgttctcagctatatgaaagtgattgggacagggagatttgctcaaatgtagaacaaaggtaatggtacagagaaaaggataattaactaaaaagagcttccctacacgttcctgtggcttttcaatgaactattaataacctatactcctatagattcaagattactgcattttatctaaaagttctcgtcccgatctcttagagcagggtaaatttgttatttcaatttctagtaaccaaagctgctaatgctgccctctcagtaaccaaatgcagcaatgatccagagcaaaaccacgcgtcggtcagagcattgcataacagcgaagagaaagagggaggcgtcacctcgacgaacaagagccagcgccgtcaacctggccggcgagacggtggccggctgggaccgcgaagggggtccaaactgctcatcccccattccccctgcgcccaagcctcgccggatggccagccccctctccgcctcttccgtcgccggtacagcgtgggggtcccgtctcgcctgccaagccctccaccaccacctgcctcgtcggcatgtcgcggaggtaggcaggggcggggattcacgcggaggcctctcgtagcgtagttggctagcggcagcagcaggccgcttctcgttcgcgcgccgccgctcggcggaggtcgccaccgtcattatcgggcgcagccgataattcgaggggttttatgggaataacaacatcccgcacctacgtttctaaatcaaagctaccaatatcagatcggacagttcaaagttagcaagccttgaaccgctaccattggttgcggaacaaaaaaaattggtggagccgggccgccgggggtgcaggcgtgcagcgcgcctcctccgtgctccctccgtctcagaaaaaaaaaggacttaattcttaggttttttatccaatgtttgaccgttcatcttatataaatttattttatgattagtatttttttttgttagatgataaaacataaataatacattatgtatgacttatcttcctgaacagagaacagtgaaggcggattagtgaggacgacgctttgtcaagtaggtgctacaaggtaatcaatatcaacatattagatatagtattttttttatttgtcatatcatataatcgagatacaatcataaaatcaggatactatcaaatttataaataacacattttatatataatcggtcgtggctgttctgatccaattgatgaatttcaagatgacttggtggtcacgaccgatcggagtggttcttttctggctgctcttctggttggaggcagtcatgttcttttctggctgctcttctggttggaggcagtcatcagttgcacctgttgtacccagtgagctttctttgatcatggaagaatgtatggaattcttggcaattaatgatatcacccggaggggggggggggtaaagtcatgtattatttttttgaaaaataataatgtcggtatttgtttgtcgattcttttctatggtgtcgcgtcttagagttgtctttgaagggaagtctagaattgactttttagcatggcttgagcgacattggtagacaaatgattattccttcttgaattcgatgttttggagggtgttatattcctagcgttctcctgattgtagttgaacacactgtcacagaaacaaatgatatgttaatttatgtgttcttttcttccttagttagtgtaagtggataggtcggatgatttcgttgttcagtttcattactaagaaaatattatgaaggtaaatatatttgtagttgcaaagccaggtagtttagtagtaattaactagtattgttaactaactcgtactcactggcacgtgcaattcacgtgtaggcgttgaccatataaaggaaaaggttgcgatattgtgggtggaagtatatccaatcaagataactaaggttacgtttagttctctttaaacttttaattttttcgtcacatcaaatgttttggacacatgtatggagtataaagctggacgaaaaaacaattgcacagtttgcatgtaaattacgagacgaatcttttgagcctaattacgccatgatttgacaatgtggtgctacagtaaatatttgctaatgatagattaattaggcttaatagatttgtaacgcagtttacagacataatctgtaatttattttgttattagtctacatttaatacttcaaatgtgtatccgtatacttaaaaaaaattaaaatggaactaacacggcctaacgctttgttctgctcattctcttccaagacttcacagttcacacccccacccgtagaaaaatgacttcctaccctccaacttgtcacgctagctgttgaaaaagacctccattgctgcgattggtgatacttctgcttctcttatgctacctccgttctaaattaaattaagtgtaaccatgggttttcgtatttagcatttaaccatccgtcttatttaaaagttttataaaaaaactattttaaaaattagtcacacataaaatattatttatattttatcatctaataataataaaaatattaatcataaaaaaatttcaattaaaatggacggtcaaacgttgaatataaacagtgcaaaactgtatttattttggacagaaggtagtatctctttggctacataaaataaaaaaaatagtttgaatttcaatttggacggagttcattaatcatccttgacgacataccctcgtttattctaacctgtcaaatataaatcaaatgcttaaaaaaaatctgaaatttttttttgctaagattgatacgacagtcgtttattattcctccaaaaagataattttgagctcaactgatctacaaattgataaacaaaataacaaactaacctttaagtttcacgagcactatccacggtta

SEQ ID NO: 47946 - DNA, 2927 bp, Oryza sativa
cctatccggacagtccaacaaggggtacaaggcttgcactcactgtatggatagaacagaaagtacgtattttatccactgtaggaaggttgtgtacatgggtcatcgtcgattccttgcagcaaaccacccggtacggaagaaaggcaagcactttgaacatacggcggaccaccgtacgcagcgggaaaacagtgtttgctatggttaaagatcttaaagtagtgtttggaaaggagcctggcagccagcctatagagagtgaagatggtcacgcggcgatgtggaaaaaaaactccatattttgggagttaccctagtgggaattcttggacgtccgccacgcaatcgacgtgatgcacctcactaagaaccttttcgtaaaccttcttggcttcctaggtgtatatggaaagttgaaagatacactggaagcacgtaatgatctgaagcatatgaaacaacgcggcgaccttcacccggaaccacaggagaaaggcagccattacttgagtccagccagctacactcttagcaaggcagagaaggaaagtatgtttcaatgcttggagagcatcaaggtaccgtctggatactccacgaatataaagcgaataataagcacgaaggagaagaagttcacaaacctaaagtctcatgactatcacgtgttgatgacacagctgctaccagttataataaggagtatcctcccagacaatgtccgggtaacaataacaaagctatgttctttcatgaacgcaatttcgcagaaggtcatcgatccggataggttagaagcccttcagaatgatgtggtgcaatgtcttgtcagctttgagttgatatttccaccttcatttttcaatataatgacgcatctgatttgtcacctagtgaaagagatcggtattctcgggcctgtgttcctacacaacatgtttcctttcgagaggtacatgggcgttctgaagaagtatattcgtaaccgtgctcttccagaggcaagcatcgccaaggggtatggaacatgggcgtagaatttattgaagaccttcgcccaatcggggtacctgaatcacgccacgaagggagactacggggaaaggggactctcggaaggaaagcaataatgacggtagacaacaatttatttcataaagcccatttcacggttttacaacaatcttcattggtggctccttacatcgaggagcacttggctctagttcgcgccagaaacatcggtaagtccgatgcatggattacacggcatcacattgatactttccccgcatggctgcaacaacatctcatgggtaacgagacgattaaccagtaactggccttcctggcaaggggttcatctgagtcgatcgcgatattccagggatatgagatcaatgggtacacattctacacaagagcccaagacatgaagagcacgaaccagaacagtgctattcgtatcaatgccatgggacacgatggtacaactggcacatattacggagccatcgaggagatataggaacttgactatggacctctcaaggtccctctgttccggtgccaatgggttaggttgactggtggaggcgtaacgattaatgacagtgggatgacaacggttgaccttaacaaggttggatactcggacgaaccttttgtccttgccaatgatgtaacgcaagttttttatgtgaaggacatgtctagcaaaggaaagaatggcaaagggcctgacgagccgaagcgccacgtggttctcccaggcaaaagaaaaatcgtcggagtagaggataagactgacgaggattacgatcagtttgatgggcaaccccctttcacggggacgggtgaccctagcatcctcctatcaaacgaagacaccccttactcatgtagcgatcacaaggaaggaacaatagtgaggagaaagtacgtgcggacaaccgtcaccgctgatctattgccgtaattgttgtaaactaatttggatgtattgaatatgctagttatatatgattaattacaatttttaacaatttaatatcatgcatatactaattatatatgattattagaatttttaaaagttttaaatcatgcatatgggatttacatatgttagttacaatttttaacaatttaatatcatgcatatgctaattatatacaattattagaatttttaaaagttttaaatcatgcatgtgggatttacatatgtttgttacaatttttaacaatttaatatcatgcatatgctaattatatataattattagaatttttaaaagttttaaatcaagcatgtgggatttacatatgttaattagaatttttaatgcattatttactattttagaaacacatatgcaacgaaattcaatattcagtgctattaactttagtcctgtttcttaaccctaaccaggtttaaaaaagaatttgaaaatagcgggaaaatatctttactcccggttgttgttacgaaccgggagtaaagatatctttactatctttactcccggttcttctcaccaaccgggagtaaagatccgggggtatatatattcccggtgcgccctcgtcttctccaccaacacttagacgttttccatcgagatcgagcatcggcttctccttcgtcgccactgcctagcgctaccccgcgccgacgccgccgttgtctctcaccgtcgcctggtggtcctcgccacctccgccgcagacgccgtcgccgcgtctcttgggtgagagccctcgccctctctctctctttctcgatgtagctctctgtctctctctctttcgccgacggacaccgacgacgccgacgccgacgtatgccgccgggccgctacgttacgctgccgccgcgcccccatgccgccgggcccccatgccgccgccgcggcccg

SEQ ID NO: 47947 - DNA, 2770 bp, Oryza sativa
gcccccaccgccgcaagacgccgccgccgcgaacgaacgcttaacaaacgtgactgaacgcgaacgaacgcgaacgaacgtgaacgaacgcgaacgaacgcttaacgaatgcgaacgaacgtgaacgaacgcgaacgaaacgttaaagaaacgtgaacgaacgcgaacgaaacgtgaatgaacgtgaacgaacgcgaatgaacgtgactgaaatgtgaacgaacgtgagtgttagtgaacgaacacgaatgaacgtgaacgaacgcgaacgaacgcttaacgaacgcgaacgaacgtgaacgaacgcgaacgaaacgttaaagaaacgtgacgaacgcgaacgaaacgtgaacgaacgtgaacaaacgtgactgaaacggaacgaacgtgagtgttagtgaacgaacgcgaacgaacgcgaatgaaacgcgaacgaacgtgattgaaacgttaacgaacattaatgcacttgaactaaaagtgtgagaacgaacgcgagcgaaacgtgtacgaacgagataattaaactattgttgaacttagcatatatatatgattatatatacttgaaaacatgaaatacatttttttgcatgttgcagagaagacgtcgtcgtcgtcgtccctcaagccgaagtggtagctagccctcgaaggaattcgcgcaggcaagtgatgtaaagatgtgattgttagagatataatataagattgttagatttctaatataagattattagattattagagttaccatatgtgagtgttagaaattattagattattagacttagcatatttgagtgttagagatagttagagatttaatataagattattagaggtttaatatacgaaacttaattagacttagcatatgtgagtgttagagatttaatataagattattagagatgtaatattcgaaatatatttgattgttagagatttaatataagattattagagatgtaatattcgaaacttaattagacttagcatatatgattatctaccgtacaaatacacgacacttagacttagcatatttgagtgttagagatagttagagatttaatataagattattagaggtttaatatacgaaacttaattagacttagcatatgtgagtgttagagatttaatataagattattagagatgtaatattcgaaacatatttgattgttagaaatttaatataagattattagagatgtaatattcgaaacttaaatagacttagcatatatgattatttgagttttaatacaagattagtagagtgttaatattacgcttagcaaatatttcttctatgaacagatggctgatcgtgatgaggaacagatactgtacgatacaatcgcatcgggaagcagctagtactggaacgaagaagaggggaacgaggatccaaaccagtacttgaacgaggaggggaacacggagagggatgcagaggggaacgaggaggggaacgtggagagggatgcggaggggaacgaggaggaggctagtggaagtcatccctccgctggacagaagagggcatgcggaaaacgaggtgccgcgaagaagatagagggtcggcacatcataactgaggtggacgcagatggccgacgtagtgccccggcacaagcagccaagaattttgtacgccacagcggttgggttgtgagggataacgtgcctgtcagcaaggtgtactggcgcagaacaagggcacgcaggggtgatgacagctttgtcccggaatcagagaaagagatgctgtggaccacaatgctcgagacgttcacgctccctgcaggtacagagaacatagtgaaatagtggactcttaagaaaatggcagaacagttccagaccttcaagggagatctgtaccagaaatacatcctgaaggggcagacaccgaacttcgacgtattcctgaagctatgggatcactgggacgagttcgttgcttacaagacaggtcaacaagggcaggcgatgatggaaagaaacaaagaaaatgccgctaagaagaagtaccatcaccacttggtgtcaggcggctatagcgtcgcgatgccgaagtgggaggagatggaggcaagcttgcttgagaagggtatcgaaccggccaccgctaaagggcctgatcgatcgaagttctggtactatgctcacggtggaatgctcaacccagttgatggctccttggtcttcagcgatcagatacgcgaggctgcgaatcgactaacggacgcagtggaagcctcttctcagggcatgttctgacccgacagagagaaggacgagctgtcactcgccctacagactcccgagcatctaggacgaacacgagggaaaggcgtgattccctggaagatgggattcaaggaggacatccacacgtacaagagtcggatgaggagcaagagagataccgaggcgaagattgcagatcttgagtacagggtatcgagctacgagctcagcatgcaagaggaggtggcccggaaggtggatgaacgcatggcagcacatcggtcacacgatccccagccgtacatacctcctccaatggtcagcccatcaggcaatcatagcagctgcgcctcaatggggcaggtagtatcacatagcatggacgccatgcaaacccaggacgaaaccacctgccccgttgatgagatcacgcaacggacaccatgtgagctgcatattcccttcaagaacttatcaatcaaagtatactcgatgtaatatatga

SEQ ID NO: 47948 - DNA, 4530 bp, Oryza sativa
ctgcagccccttaggttgattactaatagataacctctcatcacgtgaaggtggcgttgggaatggccatcccaagggacatttcagggacttaccactgcaggccgattccagcaggatactcgagggttaaagttgagctggtggaagccgtgtacgaggacctcgagttggactacccagagagacggtgagacgcatctacgagacacaagccacaccattatactatggcgcaagcggtacatcatcctccctgggcgacaagcggcgtctcgtgcaccatctcttctggctccgccgtctcctcctgcaccatctcctccggctcctccgccacctcctcctgcaccatctcctccggctcctccgcctcctcctgcaacaggctcctccgcctcctcctgcaccatctcctccggctcctccgccacctcctcctgcaccatctcctccgcctcctccgcctcctccaccgtgtccgcctacacctcccaagacaaggtctcgccaagctccacctcctgccagcacaagggcaacgaagaaggccaaagttgacaccaccaaaaacaaggagccaccgtacggttgcagtcaagaggagcttgacgcttatgtggcaggagaagtgaagaggcaactcaagtctcggagtcttgaaaagaagatacatattgacccgagcatgaagaatttcttcaagggaatgtccaccacaaacaaggaggccttaaagctatcagactatgaccgaacacttaggaaagcctattacaagaagtccaaaccagttcctcagcttggagaacaaccacaccaagtggtagagccgttggtgaccggcgaagactttggcataacggatttcatttcggacaccggtctaaccatcgctcagtaggttggaggcgcaccaatcccgaaggcggaagtggcatacaagtttgaactcagtaaaccgcttgtcaggcctgagcagctgcagtccctaccgacacaaatgtacaaattccatgcacggtacatggaaatgagcgccaatggtagagagatgttcggagcgaggatcagaaaccccgacttcttgcaaggagaagatgttctatggatccatttcaaggatgtcttcgatctgtaccatcgggacgccctcgacgtctctcttcttagcgcatggattttgtaagtatctttgagttcgatttgtttcattcaataattagctcctggcatatatgtaagcaataataatttcctttcattgttgtagaatggagattcaaagggcccgacagcgggggttttatgatactgggttcatcgtccctcggaaaatcaacaccgaaatgctcgacaagtacgagaaagacacagaggacaatctcgtccatctcctaacgcagcagcatttcaagacgttcatactattgccgtacaacacagagtgagtttttgttgtcgtttgaacaaatttcattcccatacatataacatgtatattctgatatttatctcatctcacgcatattctagattccactggtcctgttctttttcgacttggacgcatgcagagtcactgtgtacgactcaatgaataaaaaggagaaggtttttgacaaggtcttccaactgatagacaggtaatataatgccatctattccaaagtcgcgggactctgttgctattatgttgatctcgggtaatatttaattaatcatagcttgcaactgcacatgtagggcttgggatcggttccgtcaattggtccgcgggacttggaaagaaaaacttggacgaaggtttcattttctagtgagtacatgcatgatccaaaattatattgaattgaatctctagttacagttaatataaagagtatattaaatctctcatcgtttctcatgtagtgtgcaaagcaggacaagggaactaacttatgcggctactacgtatgcgagtatgcccactgcctatcaaaccaaatatacaccacacgagagctcgatgtacgtatacataaaccattcaaaatttcattgcgtatcgatttgttaagttgtttattaatttcatatattgatatgtcattatttttcgaatgatagcgtattcacatgagggaaaaactcccacacaaggattttatcatggctgttcaagaacaactgatggggttcatcaacgaagaagtccttaatcccgatgatgaattctactatgacggatcgataattcgtaacgtctgtccttcctcttctaacgtaacgcaagcgtcgaagtcgtagctatagctagcgagcaaatgaattgtactatacatgcatgtatatatatatatttatatatgtacgtatatttactttagtgtcaatatatattttggtaacatatatgtacacaaaatgttaagtgctttaaattataaatatgtgtgtaatatatgtatttatacatatatacataggcatatatatatatatatatgtatatatatacatgcataatatatatattacaatgcatatatatgtattgtaatatatatatatatatatatatatatatatatatatatatatatatatatatatatatatatataatcaaccatgtagcaaacagggccatgcaaataaaaaaaatggtacatatatctttagtccaccaaccgggactaaagatggatcagccggccacgtggctgaccgatctttagtcccggttatttcacccgggactaaagatcgctatctttagtcccggattcgtagtcccggttggacaagcgggactaaaggggggttacgaaccaggagtacaaacgatttctccactagtggtatctgcatattgatcagtgatttgagagagagatgagaagagtaataccattataatgtgagatcagtagtagttgagttgcacacagctcttgcgctaagatcccggtcttgaaataccttgggtactctcgttaacctttagttagtgttgttcacttgctaagatcccggccggccggacatcgcttaaatatacaatgcagaacgatttccagtgtccaattaattaatacgtgttatgttctccattacaatataatgttctgcttttttggacggattcgtcctcagccctttccaacaataatatctagttttataaaatgcatgcactctaacatataatcgttataacagaaaggtaatatacgtatcatacatacatatatacaagttttacatactcatggtcggcgcacagatgtcaaaaaaaatataaaaaagttctactgctactctcagtcaagaattgattgtattttacccgtaataagaaagaaaaaatgacaattctatgagtacaaattcattagaattttctattccccgctgctctttatgtgatgaattactacatctgtctacacatataaaggattccggggttcagatttaatccacaaatatatataagaaattctataatactagttccccccaactaatcacccctcatttaatttccacccaatataccccaaccatatatccttccatcccacatccttaatcctaatctctcaaaaattcctaggtccatatatgtatgtatatatatgtatatgtatgtatgtatgtatatatgtgtatatatgtatatatatgtatatatgtatatatatatacgtatatacatatacatgtatatatgtatatgtatatacatatacatgtatatatgtatatgtatatgtatataggaaaattatatactactactgggagtagctactccctccctgtccgccaccaattcaattcgtttgcctagataacgataatgactattaacgggtttattgaatcgaatacttttacccgtattttttttccctcagggtcaacaagattgtttctgttctgtagcagattcgaaaattgaatcaagaatcctgagtttgttgtagatagaattttgttcggagacagctaaccagagatatttcagggtggttttttcgctctttagtttgcttatccaaagcgagaaatcaggatgattatcccatcgagcagaacattatcgatctaaaatcgttctctgcgttttgagagttcttaacccatctcaactcagattagtagcctcgccggcggctgcgttgcagataacgttgaaagctctagcatggagaactccagttccaaggtttgttgccatattcatctgttattttgcagtgaatgcggcgccggccatggcgacgatgaacagcaccaacccgacattggtacggtatagcagtgtcaagctgcaggctgccggagtggagcgccccaatcttaccggagaggagcgccccaatgtgccgcgtgcacgccgagcgccccaacgccggcgccgtcaaagctcgcggtagccatggatggattttttttcctaatctttgagtctttttttgatcgtatctcttaatagtttgttttgtttatgtttttgcatttgcagcacctttgcag

SEQ ID NO: 47949 - DNA, 970 bp, Oryza sativa
ttcacgaacaaattgtattcaagactgcttttataatcttcgttgtaaccaaattcttggctcctcaatctgttaacaatcacatatctataaggtatatgaaggctttggttgatgtaaaaaatattcacaagtacaactgggcggaatttgttttgcatgacatcaaagatgcagcagcagcattgcaacacaaaatacgccatcggaaaagcattggttacatcaatggctgcattatactacctcaggtgaaattatcctattattcgttcgaattatttgccttttactttctaatatactcgcaacatctttcacatgctataatttatactgctcagcttttttatttggacaatctggatttcgggacggacactcccgagcaggaaaacattccacggattggcatgtacaatgactccatgatagcggaattcattgagaaggatgtaattctcaagaaccggaatcctttccccgcgtatggaaagatgaaggtaaaatcaactctcctgccggtagtatattcttgttgaaatttctcttctgcagaaacttcagactattgacatttttattgggtttcagctgcgaaacaaacatgatgaaaaatacaatattggccatcatacgggtgcaatagaggtgcaatctcatgtagtttgtcaatctattcaatatgaaaaaaatccatttttctataagaattgttgatatatctgtacacaggctatccatgtggatcatacctacgatgccaggtctgacatcgagcccccaagctttaatctaggaataacacaagatatcgaagaagtaaacatgtggcatgtaccccaggtcatgacatatccaatgtggctgaagactctgacaaagaacaagaactcaactttttagcacgtaccccagatcagccaatctcaaagtcagtagatgcctctgacaaatccggagaaggtaa

SEQ ID NO: 47950 - DNA, 2506 bp, Oryza sativa
acggtggtacccatatgtattaggcctggtacaattggtatcaagagatggtagataccaaaccttgttcttgctagatataaatcatgataccaacatgataccacctagtttaatggaagataccttctgacatagtaagatatcttggtgataccttgaggtttcatctcacgatatcttctcggtagcatgaaaatacgcgggtactaaatctgataactatgggtattagcaatgtctggtgcctataaagtttgatacctatgagtaacatgtatgatacccggtacaaggttcaatacctacgagtattgcactaggtatgtatctggtttggtacctgatatcttggtaccttgatgtgtttctatgaaacctcgaagtatcatggtaccactatatagtatacaaccgagatgtcaaatatacaatataaaactgaggttcataggtggtactaatatgcaggtgtcacttagattgcatggtagtattatatatgaagttatatctacaattttactacgtctaaagaagtagtagtactagtgtattgcttttttctaattgcttccagtggcctactgtagtcaatacttagactgctagcagctaaccggcacccatgcatggtgtagttagcaacaagaggtgcacaaactaaggccataaatccatggcatgttatgtggggcacggctggctcatccctttccatgcataggacatgtgggagcacgttatactttctagaggacgagtgggcccacaagtagatgacggtaatacccacatggtcagatggacatgtgccatgtgaatgagctacctgctggcgacttaatgtttcgctcataacttgtaccgttcctacgacaggatgttgccccctagttttcctctttatatacagagcctaaatcatgggtggttcactaaacgcctatacaagtcggtcatcacccgcctcttgaaacactttcagtactagcatttctgaccttttatgttgtttaatatgtctatgtttttttatatagcatgcgttgatatagtcttctctgccagtgatattctgttttttttaagtatggtagcataacatttttttaattcttacctcttcaatttttatataccccctaatatcaattgtattaatgcatcgttagcatgtccattttagtccttttttggatttatatattcaatagcatgccattttgtttcaacttatttctcctgtcaaattctgctgttttgttctctcctctgtgtgaaaaaagacacaccattatgcaccattgtgaaaatatgccacattacatgttaaacataccaataagtgtttacatccttttttaacgaactgtttgcatcttttgataattctgtaactaagatccctttagtctctcaagcacaatgtagaaaattaaagtgcctttctatgagcacaattaccaatatatgatgctcttaagatcgacattgcgctttactactatacaaaaccggatcacaaccggctaaagaaaaaaccgatgacgggcttccgaggctatcaccaccggttgccaaaccagcagtacacactacctaatatgaatatcactgtcggttcacccgggaggacaaatataaccaacacgacaaggctgcatggctgccatagctcgaacatatgatattgttaacagtgaaatttagtaatcccttaagagaattatcacatcgccaatagtcagattctttggacctgcactagagttaagcggatctctcaggccagtgtatgttttttcatcaacagatatttatgaaatatcagacgctggtcctctgcctgctgccttctgcatgctgaaaaaaaatactgattccctcccctgacagctgcaccttgcttctgcatgcgatatgcgttgatctaatagcgctgcatgcaagccctctctctttcttaaatacaaaaatattttaaagaaaacattaaactattttttcttctctacgatttgattttaccattatatttattacaattaaatctatacaacatgttctttctttcttatatttaaaataaagtactccctctatcccagtttagagggcgtgaaatatttttttgctaataccaaggaatagatgcatgcaagaagtttgttctattaaactgtagttaatcgtattcatgagtatttaatcacattgtttgaagcaaaactgacggtctgactacctcgccacccaacgaaattgcatgtataccccgttccccgtgcaaccgcccatgcagatgaagcaatttatgcatgcatgcaacaattagttgggttgatgggctagaattaaagatgcgccctgtgttatcagacaacggtgaaaaaaattacaccctctaaactgggacagagggagtatataaataagattatattccttgttgaaacaatgtttatattatacatgaaataacgagttgtaattcttgaaacat

SEQ ID NO: 47951 - DNA, 4138 bp, Oryza sativa
ctgcagcccacagaaaaaagaccatgggatagacattatcactatctctttcccactgaccatacgagtgacctctgctttagggctatgtgcatcaaatgatgcaaacattaagtaatttgattctagcatcttaaaaataacataatcgtgtggtcttcttttctgcaggctacccaatcaatttcgaatttgactttggccctgtaatagaattcctaaacatgcgcctaaataatgctggtgacccttttatggagtgcaactatggtatccattcaaaaaagtttgaaattgcagtgttagattggttcgctcggttgtgggaactccccaaagaccaatactggggctatgtcactagcggtggaacggaagggaacatgcacggacttcttgttgggttagttcttaattatttcatgtacatatattttaatatattttaatgcttgtaattttatgaatgttttacgaacaaatccctttggacttgaattttttggataattatctccaaaagatttcaacgaaaacaaaaacaggtcattgttttgtaaaatttcaggcataacattttatttgattcccaacttatgatggtgtgtactctaaaagaaatgcatgactttttttgttttgtggggaaaaagaaatgcatgacttcaatacaaagttaacaatgcagtccaaaactcaaaagttacgatttaatttatagtattacaatgaaactgattggagcaatgcatgctatatcatatatacttgcagccacaaaaaaaaagtattacacagggctggcttggaacctaccaccagatcgacatagttccatcaccctcaacttcctttttgaaagaggaaacataaattaacactgaaaagtttggtaacttctgatagctgtaaaataaccgtaaactcttctagcaattatagaagggtaagattgcaatataaatgtttgacctactgtaccttttgtaattattggctctccagtgttgaggaacggaaaggacaaaaaaaaaaataaacgaaaatgctgccgctcggtcgctcgggggagggggagaaaatcgggcgctcccccctccacaacgtgtcgacgtgcttctactggggccccaccatgtgtccctactacttgccacatatcttcaccatatactctattacaacaaaaaaaaatcacatattttagaaaccccctattaagggaattcggtttattttttgtttcacaaaaaatgtttcacccagtgtactcacgatatttcactatgtataaatctaatgttgccgtgaactgaaatactccattgcaaccaaaaaacccacatattttggaaaccccctattaagggaattcgttttattttttgttccaccgaaaaatgtttcacctagtgtacttataatgtttcactatgtatggatcaaatgttgcagtgaactgaaacattgtttcgctatttgctgaaacattgtttttatataaggtgaaacaacacccgatttaaacgagtgaaacattttcgatctacttagtgaaacaattccgatatacccggtggaacattgtgcaacattttaaaataattcaataataagctaaaaaaaattttcgtcggaatatatccatgtgtggtcttgttttgaagatttaattgcaacgaatttaatggtgcaatcggatcatgatttggataagtaatttaagtaaaaaatcagtttaaagtagtttctgcccgtaaatcaggcgctgacgtccctatgccgccagcgcccgatttttcctccaaagcatcgggcgcccgacgcatagggccttccaaaaataaatactagaaagtatgcacctcgtcgaggagtggaaaatcatttcctatcatatttctagatgggtagcctgtaaattacataattaactagattatttgttgccctctttataattacattggctacacttgtacaggagagaactttttccggaggggattatctatacatcatgtgattcacattattctattttcaaggctgctaaaatgtatagagtccagtgcatcaaaattgacactttgttttctggtgagatggattatgctgatttcagacgaaaactactacagaacactaggagccctgccattgtgaatgtcaatattggtacttactccatctccagatgtaaccatttcatcaattgtactccactatttttctctgtttgcatgtgacagatcatgtttgctgtgttgttttaggtactactatgaaaggcgcagttgatgatcttgatgaggttgtaatgattcttgaaaactgtggttttgcaaacagattttatatccattgtgacagtgctctagtaggccttatgatgccatttatcaaacaagtaagttttatttttcaaatagtgaggtaatgcatatggaatatttagcaccagctgattggtttgaaacatttgcatttggaaattctcctaaacagtctagcatttgaacaatagtagattgtatttcttttgcactgtcgaaagcaaacgatctgaatataggttgaagaaatagcacaggcaattcatatatatggattgaacttgcttgatctttttctttaatttccatacataaataatttgtagtaaaaaagaaaatagaccagcataaataaatatgtcatgtcatatagaatgattttggttactttttggatggacaagattgcattaagagtcgtgcgtgaacagtaaccttgttgtttcctctttcttcttctcctcgtctttcccacgtgaatgtgaccgcatagagaagaccgagcttgttcggcgagcgtcctcctgtaacaccatataggtatatatatccgcatattagagtgccacacacaaaagcactaactcctaaaattattaaaaatttgacatattctaactaataaatacaaacattcatgatagacagttacaagacaattcaataatgataacgtccacaaattcgaaaccaccagtagctttaaaaaaaccataaaactacacataaccaaacctttaaaacaacatttacaagttctatacaaaatttattctaagcagaactaagaactaaagctaaagttgagtagtgtgcagtaaagtgtgtatactagggccatgtagatccattgttattttgtacctaaaaactaagtagaacacaatagtaagtacaaatactcaggaggtgcaatatggaactaggaaaaatgtatatatatgaatttgcattaagtagtcaacaagtagttgttctcctccagggcaaatgtgaatatctttaagcattacctgtacggtgagtaagcagggcaaacgcttaattactactagcatcgtcaattaagaaccatatgatacattcggtatgtatgcatggtattttaatggaacagcataataagttgatacatgaattatagcataaaaagatcaaagaattaatgaatcacatgaataataatggcacaatgaaagtaaggcaaattatgcctatatcattcccaaatactgaaaatgaattgctatctagttttggacccggtcaggaatattgtttccatttttgtgtaacaccccagccactaatttcgccttagtctactctacacactaaatgagcccacattcatatagcaacttacttacacttttgtcctccttcatgtaaaaggttaacccaaaggtaatttggttagagtaacctgggtatataagctggctcaaatctatcaagattctcgtaaattgagcacttgggcctaacagggctaaactggaacaacaaaacacatgccaaaacaaacgaaacgagctggggtattataatttcttctaacctatttattgaaattgagtgaattaaccctattaattagaaagataacaacgatgactacaacctttaatttatttaggacacctaaccttaatactacctccgtccgataatataagggatattcactaatttctttgtgattttgttctctctggtcgctcaagtagcaacagcagcagaacatgcattagccgcagcaaaggcaagcaggtctgcactctggagcagatcttaattat

SEQ ID NO: 47952 - DNA, 5668 bp, Oryza sativa
  unsure (1)..(5668): unsure at all n locations
ttggttgggcctgttgcaacgtggtgtagcgttggacagtgtttggttaatattgattaattactacaactgttttaccgctttcaactactgcttttaaatgctagctttatgcaaaagaacctctagcctcctttggttatatcctgcatcatacctcctcttccggtatgacttgctgagtacagtgggtagtactcagtcttgctctcttctcccccacaccagagctgaagatcttcctagttggagctgttttgtcaaagttggtttcgtcgctgccgtcaaggattgcctgtggagtggagtcgctcgctgctgaagtcaagcttcctggtttagctcgcttttatcttttccgctgcatttgtaatcttttctatttttgtaagacgtggatctgtatgtcaacaattgtcgtttgtgtaccctggctggtcctggacaggggtttaatgcacattcagcttagaaattctggtccgagaatttctgggcgtgacaagttggtatcagagccgaccttgaccgtaggacaagccaactggaaaccctaagagccctctgaaccccttttcatatgcatatgcccttttgcacttggaatttgttttgggaaaatttggagttttgcctctttggtttgcgggaaaaatcttggtcgttcattcggatcggatttttttttaaaaaaaaaaattagctcagtctagggctttagaaaaattttagttggagtttattcgacagtcagtcgggaatttattgggggttatgcattaggtcgtgtctatgttcgatgggggcaatgttatgcgcatcattttccatgcaactagtctatgcattaatttattgcctagttgcattagtgtctttattttgagttcatgaaaaatgttctatgcataaaaatcatcatgctcggttatttatttgggtcttcttttgctttgtttaatttggatttgagcatgaattggttcctatcccttgtctactttagatgtcagtcctatccctcgtttgcaagcgccgcccgagcttcagagtcgccgcccttagctttatcgccttcttagtctgtttgcttgctagttttcgtgtttaggtttgttgcttgtgggttagtcagcggtcgatatcatgtgtcagtggtatgactgcctcaattaggagttgcgtgcctctttttcagtgttttaatcaagattaagataattgcacttaaattcataaacaagattagtttctgagccccctgtttttcttcattttctcatatttctacctatccccttcagatggagataaggaatggttcacgcgactccaacaacgtcagtggcagcgaagagccgatcaatggagcacgtgccaatggtgcatctgactacagtctgtccccaccgcccgagaacccaacaattgctcaggtgttgaacaatcagactcagatgatgacaatgatgatgcaacagatgcagcaacagtaccatcaggtgttgcaacaggtgcagcagcaagcacagcagcagcaacagaacctgcagtttggtcctccacctcctcagtccaaattgttagaatttcttcgtgtcaagccgcccattttctcaagcaccaccaacccaatcgaggcccacgactggcttcatgccattgagaagaagctgaatcttttgcaatgcaacgagcaggagaaggttgcttttgctatacaccagctacaaggtcccgcttctatttggtgggacaactacatggtgacccgtccagctggggcagaggttacttggacagagttttgtcatagtttcaataaagcacaggttcccgagggaattgtggcacaaaagaagagagagttccgttccctgcaacaaggaaccagaacagttatagagtatttgcatgagctcaaccgcctcgcgcgctacgcccctgaggacgtgcgtaccgatgccgagaggcaggagaagtttctgtctggtcttgatgatgaattgactaaccagttgatctctagagattatgaggactttgagaagctggtggataaggctatccgtcaggaggagcactataacgaaataaaccgtaagaggaaggcagctcagttcaggactccccaggggaagagtcagaagcctcgtttcacgatgggacatcagggtggaccttcaccatgattatccggcagtaccgtccctaccacccgggtagcttcaacaagacccaccatagtggcagtcacaacaacagtgagcagcacaggctcaagcctactccaagtccattaatgattccagctcagccagctctgccagctcagccagaacagcccaagaagtttggagaaaagcccgaactctgcttcaattgtaacgagcccggacacacggtcggaaggtgcccgaagccaagacgtgctggacccaagtttgttcaggcccgtgtcaatcatgcgtcagcagaggaggcgcagtcagcaccagaggttatattgggcacatttcctgtcgactcgacaccggcaaaaatattgtttgattctggtgcaacccattccttcatttccaagcgtgttgctggtgcacatgggttatctttagtgaagcttaagataccaatgcgagtgcatactcctggaggtggcatgaccacaactcactactgcccatctgtgacagttgaaattcaagggatgatttttccagccaacctcattcttctcgaatccaaggacctagacgtcatacttggaatggattggttgacaaggcacagaggagtgattgattgcgccagccgcaccatcaagttgaccaatgcaaaaggagaggtggtaactttccagtctcaagtgccgcggaagctagggattagtttaaaccaggctgctggtgaagaacaagaggtagcagtggagaaaaccactaagaagctggaggatattcccatagtcagagagtatccggaggtttttccggacgatctgacaacaatgccaccaaaaagggatatcgagttccggattgacttggtacctggaactgcaccgatccacaagaggccttacagaatgggagccagcgagttggcggaagtcaagaagcaagtcgatgaacagttacagaagggatacatccgcccgagcacgtcgccttggggtgctccggttatctttgtggagaagaaagacaaaaccaagaggatgtgcgttgactaccgcgcactcaatgaggtcactattaagaacaagtatccgttgccaagaattgatgatctgtttgatcagttgaaaggagctacggtgttctctaagatagacctgcgatcaggttatccccagttgaggatccgcgaagaggatattccaaagacagcattcatcactcggtacgggttgttcgaatgcacagttatgtctttcggactcactaatgcacctgccttcttcatgaatttgatgaacaaggtgtttatggaatttctggacaagtttgtcgtggttttcatcgatgatatactgatttactccaagtccgaggaagagcatgagcagcatcttcggctggtacttgaaaagttaaaagagcaccaactatatgccaagttcagcaagtgcgacttctggcttaaggaagttcagtttctcggtcacatcgtgaatgctcaaggagtagctgtggatccagcaaatgtggagtcagttaccaaatggaccccaccaaggacagtcactcatgttcggagtttcttaggacttgcgggctattaccgccggttcattgagaacttctctaaaattgctaagccaatgacacagctattgaagaaggaagaaaagtttatctggtctgctgaatgcaataggagttttgaagaactcaaacgacggttggtgtctgcaccagtcttaatcctgcctgatcagacgaaaggtttccagatctattgtgatgcatctcgccaggggctaggatgtgtgttgatgcaggatggcaaagtggtttcttatgcttcacggcagttgcgtcctcatgaaggcaactacccgacgcatgatctggaattggccgcagttgttcatgctttaaagatttggcggcactatctcatcggtaaccgttgtgaggtatatacagatcacaaaagtctaaagtacatctttactcaacctgatntaaatctcagacagcgaagatggttggagctgatcaaggattatgatatgggaatacattatcatcccggcaaggctaatgtggttgcagatgccttgagcaggaagagctactgcaatgttgcatgggtagagcaactatgttgtgaggttcacgcggtctggaacatctgaaccttggtatagtgagcacggattcgtggttgccctagaggcacagcccacactggtggagcaggttcgcatagctcaagcaagtgatcctgaaatagcagagctcaaaaagaacatgagggttggaaaagcccgaggttttgttgaggacgaacaaggaacaatctggatgggagaaagattgtgtgtacccgaaaacaaggaattaaaagacctgatactaatcgaggctcatcaaactcaatattccattcatcccggcagtaccaaaatgtaccaagacctcaaagaaaagttctggtgggtcagcatgagaagggaaatagctgagttcgtagcactctatgacgtctgtcaacgagtaaaggcagaacaccaaaggccagcaggtttgctacagccacttcagattccagaatggaagtgggaagaaatcggaatggatttcatcaccggtttgcccaggacgtcatcggggcatgattctatttgggtagtcgttgaccgactcaccaaagtggctcacttcattccggtgcacactacctactcagggaagaaattagcataactctatctggcaagaattatgtgtttacatggtgtacctaagaagatcgtgtctgatcgaggaagccaattcacttcaaagttctggcagaaattacaagaaggattgggaacccggttgaatttcagcactgcttaccatccacaaacagatggccagactgagcgagtcaatcaaatgctagaggatatgttgagagcatgtgcgcttgactttggtggagcatgggacaaaagcttgccgtatgcttagttctcgtacaacaacagttaccaggctagtctgcagatggcaccgtttgaagcactgtatggacgaaggtgtcgtactccgctcttctgggatcagacaggggaacgccaattgtttggtacagaagttttaaatgaggcagaagagaaagtcagagctgttagggaaagattgagaatcgcacagtctcggcagaaaagctatgcagacaaccgccgaagggagctcgctttcgaaacaggggattatgtgtatctccgtgtcactccgctcaggggagtacatcgcttccaaaccaaaggaaagttggcaccacgctttgtgggaccatacaggatcttggaacgtagaggtgaagttgcttaccagctcgagcttccctccaacatgcttggcatccacaacgtgttccacgtctctcagttgaagaaatgtttgagagttcctgaggaacaggcaagtccggatcacctcgaaattca

SEQ ID NO: 47953 - DNA, 1545 bp, Oryza sativa
tccctactttacaattcagcaagtcaacaacccccatcacataagctgataagaacattactaggtcggatatgaccatggataccttatgtattcaacaatcaaaggtgcatactttctacaaacgatttacatgttatatatttaaagaaaggatattgtaccatgagttttgtgtgctttcatttgcagaggtacttacttgggtgaaggaaaagagaccgagcgcaaggaatcttggggcctatgagtacttgttagaagcttatggaatctattacagatggatttggtctcacatcaaaattcatcttagggtatcaggaatctgtaaaacaagccatgtgcctcatctagtccgagtctgatttggcccttgggccttggtacttgtgggctaagcccaagtgggtggtgccctagcgcaaccctaggacgtcccaaatcatatttattcagtagctatcatagtttagggtctgcgttgcagtttcgccacttgttcgatttgtggaacccaaattcaagtacttaatcattcatatgtaattgagttgcaatctaacttgttcttgctagtgtttttcgattcatatgcagagattagccttctcggcaagatcaaccaggtttcagcacggttgataaccaaaggagacgtggtgttgcgattgcagggttcggatcgtgctgattggaagcccaatcgtgtgtgtcaagtttccactaaatctagagttatcaatgcatattggaagatcaggacctagttcctcatgataaacttcactcttctggtagttaattttcatgcctgacatttcttagaaataaaataagaggaatttcaccaccaacacattatcccttgttgccctagtgaatacgatggtatcatcagcatgttgaagatgagtcaagcctcgttccactaaattaggaactatcccttccaacactccatttttacaagcttcctctagtatagcttaaagtgcatcccctactagatcgaaaagaataggtgacagtgggtctccctgcctaagcccactataggttttaaagaaaggtcctgcctctccattgatgttcatccctacgttacccccctcattgatgttcttaggctgagttcggatgggggagatgggaacctaactctgtgcacggaaaacggagcggtccattaacacgtgattaattaagtattagctaatttttttttcaaaaatggattaatttgatttttttaagcaactttcgtatagaaactttttgcaaaaaacacaccgtttagtagtttgaaaagcgtgcgcgcggaaaacgaaggagaggggatgggaaaaggtgcatgcgaacacagccttaatccacttgacaaaagtgtcattaaagttcttcctctgcaacacctcatacaggtaatgtcagattactctgtcataggtcttctcaaaatctattttaaaatttacaccagtcttgtggtctctctaattgatgcataacttcatgcaggatcacaaacgcatccggaatata

SEQ ID NO: 47954 - DNA, 2018 bp, Oryza sativa
agtgtctggaggtgttctcaagtcatggtacgtttatgcgatgttttcacaccccgaagttctcctccgaagccaaaaatttaatttataagcgactcctaagaaaaaaaaaccggtgcaaagcaagagtaaacccttttaaatcaatgcaaataataatcggaagtggcatgtggaatttttcttgagttctacatgtcgaaatccactaacaggattttttagtggaattttcagagccctagaaataattttaaccaattaaaattgagcaagcaatattttaattccaggaaaatccttttctctttttctttttctttttcccttcccttccgaatgggccgccggcccattctctcctttttctccccctcctccctgctgggccggccgcaggccgaggcccagccaggccgccccgcctccctcctctcccggggtcgccgacaggtggggcccacttgtcgggtccttccccaacctcccgccatccgtgccggtcaccacccccgaaaccgcccgccgcgcccacgcctccgcctcctccgggccacgtcgcccacgctcgcgtgtgcgccgcgttccccgcgcccactcccctctctctcccgctcgtgcccgcgcccgagatggccgggattcgattttcgaatcccgcctctctctcctcccccacttccccacgttggccggcgattcccgcctctcccggccacgtccggccctctctctccctatttaagcttccccgtcgctccctctcgctttttccccatttcgccgaactctcccgagctccccatcgctcccgcgccgtgcaaccacccgccgccgccgtttccgctactccggccgccgctagccgccgctagggtcgccgccgcaccgcgctgtcgccgccgtcgggttcgcgaggctaagctccaccccggccgccccttgcccgtcgagtttcgtcgccgggattcgcatcccctcgcgctccggtgagttcaacccctaccgcggccttcggccatgaacgccggtcgctgtggttcatctccctccctctaatctctctcttctccttccttagggcaccccgaatcccgtccgccggtggccgtcgtcctcccgtggctcgcagtcgccgttcgccatgtcttcctccgcgtcggccaccctcggtgaggcatcctctcccttctattcccctccctctccctcttagccgccgctttagcgccgccgcccgttagccgtagctttagcaccaccgcccgtcggcgccgcctttgcgccgccgtctccgccgccggttgccattcccggcaacgtgtgtgcgcgcgccgtcgccgtcgccatggccgcttggccggtcttgagccgagccgggtcgccagcgcccgtccgatcggccccgagggcgatctgggccgtcgatcccgtggaccggcggtggaccacccgcgtggtcccggtccacggtgaaccgcccccccctgagccgctgctgagtgggcccgcttgccggcgccccttcctccctctcccgagccactgactggtggggcccgcttgccggcgccgcgccccgccttgatgacgtcagccctgggatttattgcgcaataaatgatttaaggtttttcttttatagtaataaacacagtgaatcttctaaaattcataactaattcatccgagctccgtttaagcccattcaagtctcaataaatcaagaaaaatgtgtagaatccattaaaaatggttttgttccctgtttcagtagtcttatagcctgtttgcaatgtttgctttgtatgtcgctagattccggttcctccgacgctccggtgtacttcgaaatagtcaccgaggttcctccagcagcagagcaaggcaagtcatgcttgtcacttgaacatgttgatcctatattgcaaatgctctattgtttttcttcaaatattgcattgttttataatgttactatggggtgtttacctattgtcatagccatgctattattg

SEQ ID NO: 47955 - DNA, 6254 bp, Oryza sativa
  unsure (1)..(6254): unsure at all n locations
gccgacgcatccaggcaagggtgggcgtgatggagtttggatggaccctgcgacggcctatgcggcttccggattcacctaggcacgagaggggactgcccgctgccttgcgaggagtgggggtgaaacctgaggtgtggtgtgcttggttagagggggttatgcgaagggtcctgtcacggcctctttccggtatgtagtggtgacatgtcggcgcacggaaacgtgtcgtggggctgtgtcttgtgggtacagttgtacacctctgatcagagtaaaactattcgaatagccgtgcccgcggttatggctggtcaaccaaattcgccgtgattagtctcaccctagtgtaatcttttgaatttggatagtttaggtgcatggttgggcctgtcgcaacgtgggatagcgttggacagtggatagttaatattaatcaattgttacaactgtttaaatctttccacttctgtttttaaatgctcgctttatgcaaacgaaccactttagctcttctttgataattccctgcatcatgcctctattccggtatgacttgctgagtacagtgggtagtactcagtcttgctctattttttcccaaccccagagcacgagtatgtgtcagatgaaggtttctccgaggagtaggcttcgtccgtgccgtcgaggatgcctgtggagtggtgttcccgctgcagatctagtcaaggcttagctcctgttgtctttcgtttttccgctgcatttatgtaagacttttaagatgtttgtaagacgtggacctgaatgtctaacattgtcgtttgtgtaccccggccagtcctggacgggaaatttaatgcacattctgcttggaattctattcgggaatttctgggcgtgacagatgtccatcagtaaattatataaattttgagtaacttgtagtaaaaatttgcctataatttaacggatattagaaggatagcatattaaatactgcatgtaatatttttttgcaaaaacctctccatatattggatcggcagtttagtgaaattagaatttaatacatattagaagtcacctgtaatatttttgtatgatgaaatagcacttgtaaatttcaatttataccagtgacagatatgtgttttttcgtgggggtggggggggggtaatggtgtggcattctaccaaaagaaatataatagttctagttagatagtttttactatcttctttccaaaatatagcaatttaggagcggataagatatatttatcatagaactaggatatatgagtaaattacattcacggtgcatcaacttggcatgtgggtgcaatttaatgcaagaacttgagaaatgagctttatagtgtaaacacttggcatgtgggttcaatttagtatatgaactttataagtgaacatgcaattgcaacaactagcaaggtgggtgcgattttggtacaataagttaagaagtgttgtggtaacttatttatctcaaatattttctgttatacatattcaagaagcccaaacctggtgatgtaaattggatgtgcaatgtaattcttaaagattaaactcaattttataaggtaatatccgtaagattgctatgtcatgacatattgacatcttgaaaaaaaaactcaactagtacatgcttagccaagttgatgtaccaaaacacttaattgtcaaattcctgtattcagccacctaattgtcaagttgttgcactcggacgttcaattcgtaagttcctgcactatatcgcacctacgcgctaaattgttataccgtaggtgcaatttattctttttgaaacaagttagtaattaacttcctgagaggagcttattactgcggatagagagctaccaaattaactttgttccgttcaacgtatgtgtccccagtgaggagcaacagcgaaaaagaggaatggaataaaaaatacgtggacagtactacggaggcaattgatgaaagctatcaacaagagagggcattcaatttttaggcagagtgtacgacagtccattcatcttcatgtaccggctttgaagatgtgccagcttcgaagaagccgtgcatgctagcctggtcaaggaggcaaggatagtactgcctaacaattaacaaaggatggttaggctgtgttctagctctctcatttcttacacgtatgttttctaaactattcaaccttttagaaaaaaatatataaaagttactgtaaaatatcacattaatctatttttataaatttttaagtactccctccgtttcatattataagtcattgaacttttttcttagtacaggttctataggtttgatcaaatttatagaaaaaatagcaacatctattacacaacaattagttttattaaatataatattgaataaattttataatatgtttgttttgtattaaaatgttagtatgtttttctataaacattgtaaaagttaaagaagtttgaacaatagaaaattcaaacgacttataatatgaaacggatagagtaattaatcatatattaattcatcgctccattttacatgcggaggggaggtattcctaacacctcccaatgaactcagcctactgcagtggcttcgagtattggggttgcctttttttttcttcataatggaatttattccgattttgctttaaaaaaagctgtagctaatcactccctctatcccaatttgatcattacctaagacttttgaggttttctctaacaaagtgtatttttgtttatttgtgtaaagagtaaatagcatcgtgaaatgccacagcatatatggttgcaaccaataatcaatttttgtaaatgaattattgttggatacgaatcgacagaacaccttgatcattgacaattaatttcagaataatggatatgtaacatcccgattttcgcttcttttaaaacctaatttaaatacaaacctattttcaaaatttggctcttattcatatttttatttgtggcattaaagatctcatatctcttattccaagtccacatacaaactcctagaacaattaaagtccacaatccatttacaattccaaccaataccctattcagttgggcttccctttcaatccctcggcccaacttttcctctctacggccatgacaatgccctattcatccttcacacgccacggcaatgccggtgctccaagtccaccgcctcgcgtcctcgcgctccatctcccacagccgagcgttcacgctaaaagtgtgagccgagctcaccggcgccgcgtcgccgtcctcgcgcccctgtcgccgccttctccttccttctcctttcgccaaaaccatggccacaagagtcgccatgcccgccatccccacctttcactcctctaatcgctaccacccttgctcccctcccgagcgactcattgccatcagctccaccaacgatgagggcgccgccgtgttcggccatgccggcccgcgcgggcgccgcctccgcttagccggactgccgccgtcgccgccgtcttcatcttcctccaggccaccgacgcgccgcgtcgagagccgcctctctttcctcgcgcgctgaccgtcggcccacgcctacccctccctccgaatcctccgctgagtggcgcttgcttgaaggagaaaggggaattgagtgagaggagaaatcgagagagaagaaaagagatggacaggaggacgtatgggacccatgtttgaacagaaatcaccatgttgaaccctctaattgtctctgacaagtgggccccactgtacctaataattaaataaacctcttcttaacccatgagttgtttacctgtgggccccacactatccattcgtccgcgcacacggtccatgcgcacacggtcactgcccatcgggccccacactcgcaagctatggaccatgggccgggtctgccacctcgctacatccgcgcgctcggtagacccagtctactgtgcgccgacccctctcggccgctgacagcgggctccgcaaggaatattccgagcaattaaagaaactcattttccgagcttcaaaaatccatatcttgcaaaccgtaactccgactgactccttatgcattaacctatatattcaactaatgatagttacaagggatattactaaaatcgaaaccaagaacatataattttttttaccgatttgtattaaacaatatatagcagttccattactgtttaatgcgtaacttgcaaaccgtctaacggaatctggaaaataatacaacttagatcatctagacaaaattatctacaacttttatgttgggcaaaaaatcgggttatgcttctgtaggtctcagattaaggaaaaacaaattgctgtctctatttttggtcccggcagcagcactgttttcgttgtttctcctaaaccgttcatcagaatcgagcgaaaccagcgcctttataaagatatcgacgatgactacaaacttactttatttaggacaactaacctgaatcctgatgatttaataccagatttgaaaatactattgtcagcccataatcagcgactaagaaaacactcaaccggcgatttaagcgattcccacgtgaaaattgtatttgtatggactaagggtagttacccttgtagagcagaaaaatcaaatttgagatcaatttatgaaaacacagaaaatccccaacttttgcctctcttccctttttccttcttttctcctcctgttttccctgcttcctgaaactcctcctcctctctgttcgttctagaagcacagcagcagactagcatcagcagcagtagcgaggaacgttaactgaaacagccgcaacatggaaacatatcagatcgatggcagcagcagtagcaaggattggcggcagcactcaccaagaaggagctgagcaggagtggcgttggacggcgatggctgaacttgcggcgacggcagcagcgattggggtgatggcggctagggcttgtagcagctgcagggttatggatctcttccccttttcttttttttctttttttttcagttggttaaatagatatcctgatgaagatcgaacggcccacattgatttaatccccgggagtttgtccggactccgattactataaacttatagtctattttgcactactcgacgagctctacgtatccactattcctgatcacctattccaacaaccgtcaaaaagttaaatttttgcgcatttgttctaatatttcccaaatacgctaattcgaaactcgtgatattacagttgccacaatattttctcataaattaaagaccacacggtttaaataattttagtttatagtttatatgttgaagggtaattagatgaaaatcaaaaccaacattcaaagcaatcccacacaaattattgacaaagacaagttcagaactgagtagaagaatatttcaagaaagagtggcgcgcctcctcatagctatatattggcagtagaagcaccggaggcatcatggtctgatgaggctaaagcagagttggtgatgaagttatggtcaggcaacggtgcattacactctaggacatccattgctttctgcatggtcggccgatgctgagtctcaaaggcagagcaccagagccccaagatgatgagacgctccatctccctcctttcaaagtcagcaccaatctctagccttgtgtctgcagcctcgacgacatcacctttgtttcggtacaggccgcaggtctcctccctgcgcttgcctctgcacgcgatctccagcagaacaatgccaaagctgtacacatttgaggggcagttgaacctgaccttgccacctttcttgcactgtggatctatgtacccttccgtgcctacagcagttgtctgtacatctacatgctcttctgcgctgcctactacagttgtttgcaacactgcgttgttgtccgggttcgcaatccttgacaaaccaaaatcannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 47956 - DNA, 8728 bp, Oryza sativa
cggatccaagtaaaggccaagacccgcaagactttgagtaaggcaagtcatcactattctttgaacatgttgatcccaattgcgaaattgttttgtttacaaataaaattgcatgcaatgatgaacatcctacttgcgattatgccatgccttgattattgtttaccccttattccttcgtaaccatgtttacgtatgagtccctagtcaactatgacaaatgcttagaaatgctattctagaatcatgcatactcatatttatcaaatgctatatgcttgggcaattacctttgggaaggtaattgagatgcggcatgtggagacatgagcaccacattgccatgatattgatgacatgatttgcgacaggagaaataaaactaaacaactattttcgactggggcggacggaggatttgggtggtatctggaaaacgctagtaccgtccctggtcaattaaggaccgagccatgaagttaagcatgaaacgacccccgcagttctcgtatgggtatagacctagcagattagatagccgagcggaggcagtatccctgcatagatggttcacccctgagcgaggcaggtgcgctacggtgggacagccgttgaggtagggccgagaggcgtgccctacatcggtgtcgccattggtaggactgccatgagtgtgtgtgagagagaacttaacttgaaccataatttaagatgtgtgtgagacttctctttcccgggagcgccagaactcctctcactgctagaaatatggacgcctagagtgcatgaggatttaagttcatggagcaggtactgccaatgcgaggttatcgaaaaggtttgccgtgacgtgtctcatgtgttgggacgaggctcatgtgttaagcagtcgcggagtgcgggtaaagtgtatccactgcagtgtgagtaaaccaaatctattcgaatagccgtgctcgtggttattgagcaccgggacatgtattatacttggctagactctaaattcttaacttgtatgggatgggatattgcataatgatttctatgctgatggagccacttcctgagaggtgggcaggtggacgttctcagaaaaccatgacgactcaatggcgagaatccatccttgggatcataatggatggtggacagaaccgtcattgtttaaatatgaacactggtactaaaatttgatcagtttgtgctaggtcttagggctcgtgaaaagaattacaaaacttgctttgcgcaaaagaactatagccacactttgaatacccctatcatgtgcattgttgctgtggtggcttgctgagtacggttggtactcacccttgcaatatataaacttaatcagaggtcggagatgaagcttcggaggatccctatgcttactaccaggagggtgatgaagacgatggcgctcagtaggtcttagttacggtcgttgcctgtggcaatggcgtgccgctgccttgactccgctgtcttacttacttctgtttttggaatgaattccggaccgcccggtccgatgatttaaaactatgtctgcgggcttatgatgtaataattcataccagacactcgtgtatgtgcactaggtatttcagctatgaattcgtgtgtaccagactacttgatccaggaaatggtactgtttacacgattaattcctgttataaaaacgggggtctacatatgacaagctacaagatattaatgtcgctacacctctgttgttgacatggcgcgccactatcgacgtttgatgtcgcgattccggtatttgcatagtatagggattgttggtactaggatatatgcgagactaacactacagcaaaaacctcgtatagaggcacttttgtagaggcgttttgcaaattgcttttaaaatcagaagttttatagtgtagagacactttatagaggcactttcaaaaattgcctagaaaacttttactctagagacatttttagatcagtttgttagattttatctcgtagagggattcttttggcactataaaatgcgtctaatatgtaaaggcattttgttgagacattttaaactatgtagagactttttagaatgataatgtatactaaaggactaaatataagtaactaaaggaacaagcatatataagtaatgtcatggagttgagttggttagtgtactgaagattaaaatgatttaaccaagagatcatgagttaaagacttgtcaaaagcaaggaaactattttattctcttttttggactggttttatatgtttgcggtacaatttaatgtctctagaaaatgtctctaccatcttatagacattttataaaatatctcttgtttgtagagacaattcaccataagacactaactagacattttttaaaatgcctctacattgttgtaaacgcatttgataagtgcctctacagtactagaaaaatgtctctacaaagcatttttcttgtaatgtgaagtaaaagagatagagacgatgatttttatacaggttcgggcccctgaattgtcaggtaataaccctacatcctattgactgaagccggttgttgctcttattcatcataatcacatcagtacaatatttggggtagcctatctaactgttgtcgacatggcggtctgaaggtctgactcgtagtcaacaacagggtagtcttcctcctcgaatccgtgcccggcgagatcagagatagcgctttcgtctctcctgacagtatccggagacaccgtaggggactagccatgcttatccctgaagtctatgtccggcgacttgtcttggcgcatgttggcttgtatattgtagcttctattgttccgtgtatgttgattgtgggtctcttcctctcctcctagggggccttgtatttatacccatagatatctccttgtccaagtagaattagggaaaccaatatggatacaatccgagtagtccttgtcatttctatgtagaactctattcatccttccttatacggaactcctcctatatccgaaggttgtttccgtataagacatagtatgcggttagttcttggcggggtcgggtgggattgcggctcaatccccatggattaacccggcgaggaaacaatcccggcccatgagaaaatttgcgctcggttaagcccagtcgctgattttaacccggcccaccacggggttcccctattatcaggcccaggaaaaaatcatctagtttgtaggtgaggaaaaaaatacttgagaggaggcggcacagcgagaggcgctgccgcgggggcagcacgcggagcgtggcatgacccggaagcgacggcgacgacacgctttctcctccggcagctgtctcctccggtgagttcctccccttcccttctcccctcctgttctagggttagggtttctcggccacgcggcactgctgcgtggcggcgacggcgcacggtggtggcaggcatggtggggccttggggaagccgccacatcacactccctcgccaaggcgccgttgaagctccgccgttgcggcatggagaagcatgaggacacggacacagcttctttctttcactggtttcttgatttgttcttctttctaccccatctgccacctagctagatttcctcctaccttggttcttggaggttaatcctcggtatgcttcttgttccaacgcatggctgagaatgctagtctgttgaataattagttggagaatttataggttggagatcatctcataaactagttgaccaatggcagtagtaactagttgtagattaaacaaagcacaagatggctttatgagaaaccaagaactaacaggcttaccttttgcttagttttttgtttgtgaaacagtcagtcagtgaagtttctgcaattgatcttcctgttagatttcttgtcttgtagggaaggttgtagaggatgttctctcaaggtaaggattgattgtcagtttgctcaattagtcctttctttttatcaccaagtcgggatttagttaatatggatagataaactgcaaagtttagttatttgtcagcaacaacttagaatagactggtaggtttaagaaaaaaattcttattattcctctcactttcccatcaatctttaaatatgcttcactagcaaaaatgtccgtgcgttgcaacgggtgaaaaaattctaataataatatatgtttgtattttgatgagtggcttgtttttttataaacggtatttcttttcttgcgcgattttctcaaactatttttcagaaatggcgcatttctttctaatagttttttcctagcattttttttattttgctttttttactgacgatgaaaaccatatttttctcccttttttttgcttttattttctcgtgtgttttttgcatgttttttctaacaataattttctcgcgcgtttttttcttgttttgtttcaaatgttattttttgcttttttccaatacaggagaatatgtgacgaaataaaagccgtgtagtagatggcaaaaaatcgatggattctatccgactcaagcgtccattaatttagtgttttatctgacagttttgccagagcgatttgttttttaatagatggtgttctttttccttgcgcggttttttcaaaccattttttttagaaatggcgtgtttttttacagttttttcctcacatgttttttttaaattttttttccagcgatggaaataatttttctcgcacttttttttatggaagatgtaaaacctttttagtgtgttttttgcgcttttttctcacgcatttttttaagcagtttttattttctcgtgcattttctatttttatatagttagattagattagagatagagaagagatatatacttattagaaatcggactttgtttcgccctttctattttttttcaaaattatagggacttaaatgtaaatataaaaattaccaggactcgaatgcaaaagtacaaatccaaaaattaaaatcatataaaatggaatgctctcgacctataggttttatttttgcaaacagatctttaatccggcatattaatttttttcaccaagatgtatgggatatcatggtatagattgaaacgaaaggagagtgcctgggatctcgatctcggacttaaacagagaggagtggtgccttttatttttcctttttaagggggaatcagatagagccggatttttttttgtttctgataggaataggagtcggaccttttttttttattttttcgcttatttttttgacggacggactttttttttctgagaggaataggagttggaccagaggaataggagtcggatcttttttttatttttcgctattttttttatttttgacggatgaaggaatcttctctttttttttttaaagtagtagagataacttggatctgcttaagattaattctcagagtttagtgattttcttttgtgcttatctctctagatcttttgttgttgtgctaagtgcaaaattgtaaataatttgtgtgctacctatagtactactctcatatccataactcactagaaagaggagggaaggggaggacaatgatatgatgctatttattttccctccaccacatttgttgagttgtaggggaggtagtggaggaagcgaaaagaagcggcgtcatgcatcaaagctaacgggcgaggagtgcgttcggaagctgcttcaagggcatgtgaaaaattgccgagtagcatttaggatggagccagatatatttagttactgttctttccaaagcttaaacaaatgtgcagaccaagttgatagaatgttcaagtagcaattattaaatcatgataaagatatattttgtttaaattttgataatatgctaacaatatttttttgagaattacacagtacaacatagacactcataacgcacgtgcactcacccatatgaacgcacacacgcacacaaaccctacccctatgagcatttcgaagactgtgctggcaaatccttgagattgacgaagtcaccacaggcgcctcgctgtcgacgggtacgccgccaaccacagaaagcacaatgcaattaaatcctgaaaaattcgctcctatgaggagtcgaaccaaggacctcaggtgctactgaagctcttgtaaccagtcctttcgcgctaataataaattttgttaagacaggccatggtggtactggcctgcatgcatggatgtattacatttatttatcattcatcatgtgggatatataaatgaaacaaatatggagaaagtggctagttaattttctagaggaatctaagtcctgttgaactacttgctgtcctttcacatgagagtactgtttcttggatacaataattttgtgtgcttaacttgaactgttactaatacaataatatttgttcaccctatacagttattactttatttcacatgatagtacaaccgtgggcgacaagatgagagggatagaggatgggaggggacaagaggtgtgagggtgtcaggaacctgacgttgccgggagagctacaggatgctgacaactcgagggaggaagaacagacctatgctgggagaggagcaagagtccgtaagtgtaatacgcgtgtgtgtgggccggattgtaccaaatgagtaccaaccgagcccactagtaagtctagagtgagagagagttgaactgtaataagaacaaagcaccctgtctttctttcgtatcgatgaagtaagaactggaggcgaaggcggcggcggcaccaatcctgttggatttggtgaaactatcttgtttcttgcttgttcttactgttattgaggagttgggttagggttctaacaatctggtatcagagccttgccattctctcgcttcctggattttgctgcaaaatttttcccggaagaggtgggaattgttgcctcggcgactgattccgcaaaagcttcggctccctcgactgggttagcgagatccagaacgagatttcaaccacgggtacctacaagaaacctcgctacgtcaccaagcagggcgtgaagatcatggaccaagatgggaagctggacctcctcaagaaaatggaggaggtggagaagaagcgcgaggaaagtgagaagaagagggagcggtcagaggagaagagcagggctgagctcatggctctcaaggcggcggtagaatctcgtttcccagctgtgaagaagagggtggatgctctggaaggttcggtgaaggatttgcaaggcaaggtggagcagctccgtcagatgtagcaaatttttgttggtgtgatgggtttgggtagtagcgttccaccgatgtcttgtcgaaagttttatggtgtttaatcctcaaatgtggaagtgtaactgtgaagaatactttgagatctatggagtacatgctaagaattgggtcaggatagctggtttgaattttgttggtaacacagctttctggcttcaatctatgagatccaaactgtcgggggttagctggccagtttttgttgaacaagtgtgtatcagatttgctcaagatgactagaaaattcttattagacagtggattcttattgtgcaagatactactttgtctgactatgtcgaaaaatttgacagcattatgcaccaactgttggcctacaataattcactgcctctcaattattttgtgaccaagtttgtggagagttgaaacaggaaatcaggtcagcagttctgatgcagaaaccacaggatctggattcagcttgctcattggccttcttgcaggacgaaatcttggaaggttccaagtctgtcagtcataaaaagtctgataagcctattttagtcaagaactctttgaagtctctctctcctcaaagccattctaattctgttgttaagggcaatgcatcacctccatcagaggacaggagagggtctgacaataccagggctagagatgacaggctagccgctctgagatcatatagaagatccaaggtgctgtgttttacttgtggggagcgttggagtaaggaacacaaatgtgccaactctgttcaacttcatatttgtcacgcccggaagtttccccctctccttgctttaaaaattggctaaataaatcgtccgaagaaattatcttaaataacctagagctaattccctaattaataaatgcaattaataattgaattcggcgtggtggaatttttcttgagttccccatgctccaatgcattaacaagatttttagtggaattttcagagccttggaaataatttttaaccaattaaaaatgagcaagtgcaatttttaatcccaggaaaatcctttcttctttttctttttcctttttcctcctttttcctcttcttgggccgtcggcccactccctcccgcgctcggcctcttttcctttgggccggcccgttcccctttcccctccccgaagtcctccctccctccctctctccttcgggcgccgacaggtggggcccacctgccggtcgtcttcctcctctagccggttggagccgagccccaaccgccggcgccccacctccccacgccgcccgccttctccgtccctctccgcgcccgcacctcgcgcccacgtcgccgctcttccccccccccacacatctcccgcgcgcgcgcgcccgcaagtggtgggggatttgaatccccctc

SEQ ID NO: 47957 - DNA, 12150 bp, Oryza sativa
  unsure (1)..(12150): unsure at all n locations
ctataaatcgctccccgcgtcttcctctctcgtttttcgcactcgccgcgctctcccgtgccgtctaccgcgcccgcgccgtcacacccgagctccgccgcttgccgccgccttcggccgcgagccgccgccgctagagccgccgccgcgccgcaccatcgccgccgtcgcgctcaccgagcccgcccgcacctcggccgccgcttcattgccgcgaatcaccgccggagccattttctcctcgcgcgccggtgagaccctctctcccctccgtctccggccggcaattcaagccgccatggtcgccttcccttccctaacccctctatgctctctcctagcgtgctgccgccgcccgtccgcacctcggcatcgccggtcgtcgccgccgctttcttccttcgcgccggccgtcgtgctcgccggtgaggaatcccctctcctccttcctttcctctctctcccatgagcgccgccgtcctccgcgcgtgcgccgtcgtcttcggccgccgccgccgccttcgcactggccaccgccgtcttccgcgccgccggtcaccgccggtgaccgcgcgtgccgccgccgccgccccatggctggccggccggcttgagccgtgccaagccaacagccacgcccctctcccgccctgtgccgctgcccggtggggcccaccagccggtggaccacccctcccttttagccgctgccagtggggcccgcttgccagccgcccccttcctctctcttgaaccgctgacaagcggggcccgcctgtcggcgcccgcccccccttccgctgacgtcagccctgggctttattgcgcaataaattgattaaggacttttctttattagtaaaaacacagtttatcttctaaaattcataagtaattcatccgagccccgtttaagtccattcaagtctcagtaaatcaagaaaaatgcaaagaatccattaaaaatggttttgtttcctgtttcagtagtcttatagcatgttttgcttgtgtgctttgtttgtcgcgtaggtttcggccgtttcgtcgatccgcagtttctcgaagacgttgctgaggtctcatcagtgcgagagcaaggcaagtcatacattgcaattgatcatattgtacccaatttacaaatgtcccgcatttctattaaatattgcattgttttacaatatcatgtgggattggtcctattactcagctatatgttgtttcccttacgccattgataacttgggtattaaaatgactagatgttggttcaggagatgcttagccatgcttagttcaactagtgcacaaaaggggatcacattaaagcatagactttgtttattggcatagctttggattggtgccaccgcatgggtgtcgttaattaaaatacactgaatggtgggctgtgggtgcatggttttgctggtcgcacccatggcaattaaggaccggttcacgggaaaccctgggagacttaccgtgcttaccacaagcgggagtgggtaactgcttgatctgaagtatagctcgaccctttcctaggcaccggtggcgagggtgggcgtgatggagttgggtcggccggggtgtccggttgtccagctgccggattcaccgcggcgcaagaggggaccgcccactgccttttgaggggtgggggtgaaaccttagcgtggtgtggatggttaggggagggttatgtggagggtcttgtcacgatttccccctttgcagtatcatggtgatacttcggggcatggcgacatgtgcggaatcgtgtcttgtgggtacagttgtacacctctggccagagtaaaactattcgaatagccgtgcccgcggttatgggcgatcaaccagattcaccgtgattagtctcacccctagtttagcttaatgaactggtgtagttcaggtggttggttgggcctgttgcaacgtggtgtagcgttggacagtgtttggttaatattgattaattactacaactgttttaccgctttcaactactgcttttaaatgctagctttatgcaaaagaacctctagcctcctttggttatatcctgcatcatacctcctcttccggtatgacttgctgagtacagtgggtagtactcagtcttgctctcttctcccccacaccagagctgaagatcttcctagttggagctgttttgtcaaagttggtttcgtcgctgccgtcaaggattgcctgtggagtggagtcgctcgctgctgaagtcaagcttcctggtttagctcgcttttatcttttccgctgcatttgtaatcttttctatttttgtaagacgtggatctgtatgtcaacaattgtcgtttgtgtaccttagctggtcctggacaggggtttaatgcacattcagcttagaaattctggtccgagaatttctgggcgtgacaatattgttcaggaactattggaatccttaagtcctaactctgttgattcatatgagctggaagtggaagaaagtaacctgatggccctatccctgcaagcaatcagtggtactgagtctgccacttccttcaggataaaggggtgtatccaaggaactgaagtgctaatgttgattgattcaggcagctctcattctttcttggatacccaagtagctcataagttccaaggtgttcagccactacagaaggtgttgtcagttaaggtagctaatggaggtatcatgttatgttcccaattgattcttcattgtgcctggtgggttcagggagtagggttccatacagattttaagctgttgagtcttggagtttatgatgttatcctgggtatggactggctagtgaccttggggacaatgaatattgattgggctgctaaatggatggagtatcagttggggaacaaaacaatcagaattcaaggaattcagactcagactgaaaactgtgctcccatttcagtggacaaatttcaggaaatgctgactattggttcagttatgcaggtcttccaactgcaacaactaacaccagataaacttgttgaggtccccctgcaattcgggcctcttttaactgaatttaaggatatttttcctgaaactactggtttacctcccagaattcctttgttgcccaactccaaacctatgtacatcaaaccttataggcacaatccaacatagaaggacgaaattgagagacaggtgaaagagatgttggcttctggggtgattagacctagcagcagtgcatactcttctcctgcacttttggtgaaaaaagaaagatggtacatggagggtttgtattgactatagacaacttaatgccataactgttaaaggtaatttcccatgccagtcattgatgaacttttggataagttatctggtgctcaggtcttttccaaattagatctaagggcagagtatcaccagattaggttgcaggaaggggaagagcataaaactgctttccaaactcatactggccactatgattacagggtaatgtcatttaggttgactggtgctccagctacatttcaaggggccatgaatgagactcttgcacctatactaaggtaatttgccttggtcttctttgatgatatattggtttacagtcaggatatgcagtctcatttaactcatctcaaggaactgttgctcctgttaaacaagcaccaatggaaagtgaaactcagtaagtgctcctttggtcagtcacaactcacaactatcttacttgggacacattatcagtggtaagggggttgctactgatcagtccaagattgaagaagttgtaaattggaaggtgcccaatactgtcgaaaagctgagagggttccttggactggctggatatattatagaaagtttgtgaaaaattttggtgtttgacgttattttgtacatacttaaatataaccatatatattacatgtattaatggctatttcaggaaccaatttagctagcaatgccaatgtgctaattaagccagttaattaaatattgattcatgcatgagccgtgcacgtactggcatatatacatgtgtatggccgcctgtgggtgttgggggagtgggggaatttccgtgggcaaaattgaccaagggaatctctaattgggccgtgaattagtgaatgggccaaaagaggaaggagggagtcagcccaataacattgaattgtttgcttttggggctgattgtggcctcctttttattttgacaatacacataagaaatacatagtataaatatcttttctttttgacaaaaatcttaggtatatacatatgaatactcttaaattgaggtgagcctgcccctactagtcaccatgttctactcatcgagatgtactcggtaggttctagtcggtatgctaagtagtctacagatttctccatcataacttgtgtggtatttttctcggcaatgtatataaactggatcgtgtatgattattatttatctcaagggtcggaattagtataaatccttatcctttgtcttcttgatatgattttgcgtataacatcctagtgccaacaacccatatactctacggataccgttgacatatatatagctttcgataatgatataattgtaatcattttcacttggattatgcatgtaagatttatttttcttcgtgttttatatataagcctttgtacttaattgaagtagcaacagcagtcagcaataatcttattctttctaaaaaaacaaagtcttcttaattattaggcaaaatttgccctaggacacctaaaaattatgtaattgggtgggagatactgtaaaatcgtgccgctgccgatggacaccacaaaattcatttaatttgccgtaggacacccaatacaatattttatcatttttgacaaaaagagtggtaaatttcaaaaaaaaaattgccctcagttctatctgatccctactgccgacacctgcttcccagcgccgcttgccaagcgcgccaccgtcgaagacgttgccacagggcttgccaaccatcgttgaagccaccgccactgccaccactgtcaccgccgccattgaagccaatgctgtcgagctcgtgaccatcatcaaagttgccgccgccgcgcgcttcccagcgctgcacaccaaccgtcattgaagtcgctgctgctgccatcagccatcgttgaaggtgctgccgccgccgccaccgccactgttgaagccgctattgccgagctcgccgacaatcattgaagccgccgacgccgccaccaagctcataagccgctgccttggggctcaccagtggtcgtcaaagtcggctcaggcctacttgccgctaggttaggggtgttgggggggggggcaaaagtgtgatgctagtggggttagatagggttgaacgcaattttgtctttctaaaatttctctctcatctttttacctgaaaataataagacattgtcttggatgttctacagcaaacaatactacaaaaatcatcttttacggcggccattttgggcctttgcaagcggcatttggcgccaccacaaaagcaaaggccagtgaagatcaagatcttcgctggcagctagctgtcttaagccagccgcgagcttgcgaaaatatatttttgttggcagatccgtaaagagaactactagcaaaaatcctccaccagatccaaacagaactgccagcgaaaatcccccacccggccaaactcccttacatatatattcaaaataaccccacatggcgaaaatccgaaaatctctcaacncnnaccctaatccagttcacacgaacatgaaattcattacaaatatcataatacattcaacagattcattcagaaacatcccttcacaaatcacaaattcaccaaataccaaaacaatccatccactctaaccacccgccttggccgcagctggccagacggacttgggcactcagcttgccgtcgaggatggcagccacgtcgagtcatgaagaggacgatgacagggaggatgctcgtcgtcacttgcgccatcgcagtggggaggaagacgccgccgcccgcgcccgcgcttctctccgccaccgtcgccgcccgcgcttctctccgccgccgccgcccctcccgacgccagatccctttgttgggatacgcgtaggctacgatagcataaatcaaaaattttctactacgtaaaccaggaaccgtgcaagtattagatcatagatcgctaccactggacgcactgcgtagcggaaaaaagtgctaagaaggcaaaggaaccctcgtgatgtagcgcgcgtcgatgtagaggaagtagtcgatcgcaccggctcaaccttctcttcctcgtgcgttctcctcgccgtacgcccaagccgatcaacaccgcaaagcagcagcgcctctatcggtatccacacgtacagggacaaaacgccacgtgcagatgtgctaggacccgcaagcggataaggttttgctcagggagaggtgtggcgtctagggtttctcatgtgatgcaatgcctccgccagtcacgcccctcacaaatatataggatccatgactcgggcctccaaggcctgtaggattcctattcggatccctatctgaattaagctcatattagatctccttccaatcccccttattccggcccattaagcatgcgaccctataggtttatgcacactaggctgtaacccgaaaattccttttcggtccacgtgtcaacagcggtccctagcagaacgtattgacccaccgggcatacataaagattatatcggctgaacctctagtgtatacatgtatgaacccctttgcctcacgataacgattaaatcaaggctagatatgtgccatcctctattagctctatcattcactcgaatctgtgatagattatataacttgtgatagactcctcaatcacctttggcatggtcatgcacttccataatctataacatcgaggggtccatagatatctctccataggaggagcaaatcacatcttgattatttatatcccactacatgtttcatagcatacctcaaaactacttttataactacccaattacagcgtagtgtttagcagtccctaagtaaggtactacacatgttgggaaccatgataatcttaggtctaacaattcaacaccaacacttaatgagatcactgatgacacaatacatatggctcttgcagtgtctcatgttgggtctatacaataacatattccccaacatgtgttcacattattaatttggtatataccatgatccatgagacatgatcatcaattatataatacatgcgctgatcatttaaacatatttgttccatatataatatttgatcagggatactctagaaatagtaacatacaacataaaaagtctcatgaaagaatcacatattcattaaccaataatgagttatctatttcaaggaacaatatctgataaatatgtaaacatagtatgtaatacaatcatctctattattatctctagggcatatcaccaacactcttaggcccgcgcttctctccgccgccgctgtccctcccagcgctggatctccaccgcccgcgcttctctctgccgccgccgcctacgcgagacacgccgccggtggggagggaggagggaggagggagggagctgtcaccagggtgagggaggagggtggatctaaagaggaggatgagaagaggctgagttgggtggatgagaagtgctgggtggcggtggccgatgggtttttaactgtgacaatattttcactggcggccgtttaagtggaccgccagcgaaaaagtgcaaatctttgctgtctgctctcctaactggccgtcagcgaaaatccatttttcgcaggcagacaattaagaggtccgcctcgaaaaatagagtagtttttatggcgaaccacttagcgtggccgccagccaaaatttggttttcgctggtggtcagtagtcctgcacccctcattatgtttttgcatatggccgccggcgaaaattatggggtaacgccataaaaatcgtttttctagtagtgaaattacacagattttaaagtgtccattagtagcgacatgattttgtgatatctcctagccaattacataaattttagatgtccgtggtaaattttgccctcttattaacatagctggctcagttcggcaccccaggctcctaaccgatacatccggtacggtaaacggagcaatccattagtacgtcattaattaagtattagctaattttttttaaaaatagattaatctgattttttaagtaactttcgtatagaaactttttgctaaagacgcaccatttagcagtttgaaaagcgtgcgtgtgaaaaatgagagtggttgggaagcgaacgcgtatcagagcacgtgcccgacgaccttccgtttagaactttaccgatggacagaggtcgcccaacttagtggtaggtcggtcacgttgacgattgcaataaacttagacgaagaatatatacatataggtatcgattactttttttttatcgattatgacataactgatatttttcaattgggttatgcatataagatttatttttttcgtgttttatatataatccatgatacgtaatcgaagtagcagcaactaattaatgaatggagtcaacagtcttcttattctttcaaaaagacaaagtgttcttattgatatagcctaagtcaaaacaagagtatacgtgtatgtgagcacgtgtccaagcgcaattcgccgggctgctaagactttccggttagaacttttctaatggacagaggtcacccaatttggtgatagatcggccacgctgaggattgaagtaaacttatttttggaggggacgattgaaatacacttagatgaaggatatatagttatcggttatgacatataactgtaatctttttcaattgggttatgcatgcaagatttattgttgtgacacataatctaagtagcaacaactaattaacagggtcagccctcttcttattctttatcaaaaaaaaaacaaagtcttcttactaacaaagcctattctaaacaagagctagcgtacatgcatgagatcgagcatgtgtctgacggccatttgccgtgctgctctggccttccggttagaactttactgatggacagaggtcacctaatttgatgatagaaattcgtactgttgcacttctgctgacgaccttgggtttagatttttttttctaatagaactttagaaactactttagtcatgttgataaaatcaatagataacaattgcattgcgatgttgcaatttgtcgcgtttgttgctgcgaacattccaactagagtattctttattttgcaatttaaatgcaaagcattcttaggatgcatttgaaagctcattaatttcacttttacggttctctcgcacatttttcaaattgctaaatagtatgtttttttaaaaactgtttatgtagaaattcttttaaaaagtcaaacaaacacatttttaaattttgtaataattaatacccccgtcctagagtaacatcatttttcatattctatttgtcccaaataagtttcttttttaagcaatcatcatcgtttgtgagagtaaaggataaatacattgaaaatagataaaatcaataacaattgcattgggattagataaaagagcattttagtttttttattgatatgtgtaggacggataaaaaaacaaatttattttagaacaaaggtactgcttaattaagggcatgtataaagatagagtctaatatgagctgtctatattaattaatatcactagagactattctcctataatgtaaagacaataagatttctgaaccattaatttactaaatattttttttgttatatttctttcctttttaccaccctcatgtaacaaagttttcattaataaatataaagagtcgactttgagatgatgtcatttgtagtaaacatatttcttcttccttctatctctttcttccacgtccttctatctttctttcatatcaccaaatttacttacatgataataaaaagagcccgttattagacaccattgtacatacctaatcatacgactgatttagcacgcgtgaaaaaggaaaaagtaaagtaattccatacagagctgttttgtcaggtcccagcttggaaaccacattgaatgggtcgtcgcccagcttgataattgaaatacgcatatgctggatataggtatcgattgcgacggagcttaatttgttaattaggaatattttccgatcgggatatgcatgggagtttttgtatccgcagtttatgggccgaaataggtcataggtgacgaaggcaagaactaaatttatatccacccgccattttaaattatgatatgaaacatccatatctttttgcgaaaataaaatttgcagactttggctaatattaaaataagaacattgggtaaaaactaaaatatgagacatgtgcgtacaaaccacgtacacatccgcgagccatatataacatacgtccaaaatcttgcatcacctgctgcgcgtgtgctttttttttcgaatgatcagaccgttgccgatgttttatataaagaagaaggtgttccattttagttgccgatgttttatataaagaagaaggtgttccattttaaggagaaaatgaaaccaaaccttacaatgcacagttaattagaaaaaactgggtgaaaatcacaaccacaacattcactacatcggaccaagtcatctgtgacgggtccaaaccctcacctttgacgggtttttccctttgtcacagattattggtcactgatgatttaacctcacctgtgacggttgaaggtctgtcagtggtgagagacacctgttacgggttacaattagcaaaccattagtggtgagagatatttttgacgagttataattagaacccgtcacagattatgccacctcaaatgagttaaaagcagtcaacccgtcattggtatgaaaaatcaaccaaaaaaaaacctcgctgcaacaatgatttgtagatccacgctaaataatccagaatattttagactacatttctgatccaagaacttacaaggttgatgttacaatgaacataaaaacaaactagtgcaactgcaaactacttgagaactacaatgttcagattccaattttctagcaaaatcaccaaagacaatgaaactctaaacacttccaatgcaccaccttcaagaaaaacaagacacatcatgcggcttcaacaaacaaatcagtggcaacacatcagtcatccacccctgcgattaatctccagtggcaacacatcatgcggcttcaacaagaacacatgccgattaaaaacttggcaccgataacttgcaagatctaaaatcaaatcacaagaatacaaaacacatacaaacacatgctcgaagatggaggaggtggtgaggaccggtgctcacaggaggaggtggactctgcggcagccgccgctcggggatgaaggaggcggctagcccttggaggtcgcttctcggtgatggaggaggagtcggatccggtttcccccgacctagatctagcatcccctaactcgcccttggaggagctggatccggtgatggaggaggtggctagcccttggaggggctggatccggtgttggagaggccggatctggcatcccctatctcaccgacgttcccaccgggcctcagcttggtgaactgcctgacgaggtggttgcggcggccgctggatctcgtccttcctcggccgctggatctcgccaccctgacgcatgggacgccgacgcccggccacatctggtcggcgcccggcggcatctggccgcccgacggcttggacgcctgcgctcggaagaagggagaaaagggaggggcggaagaaaagggagagcgcgggtggtggcggaagaagaagggagagcggaagaagaagggaggcggaagaaaaaaggataagaccgggcgtgggttcggagccaggaggaggttatgatggcgatattttttaatcatctttgacgggcatacaaatatttgagg

SEQ ID NO: 47958 - DNA, 2446 bp, Oryza sativa
ttcaaccgtcaatattaccaaaatagaggagaactagtaatgcttgcaatgcatatatatgttagaataataatattccactagtaataggtatactacccttttgcagagaatagcaacgaagtggaggagaatcgacatcagcaaagatgataaatcaatcggacgatgtcgataatcagacttatgcatgaatgggccaagaacttagaattgacacgatgaattgggccaaaattcacaagtctacgaagaggatcaacagaggaggccgccagccaaaacatgggttggttgggccggcccctggttctgccgaaccaggaggttcggccaaacccccgctagcgcctttggatgcagggttgcggctggacagtgtggaatagcccccaatgacggttggagggtatttccgaccattccaaccgtcacaacagtcattcggaggctatataaacccctcaccttctcacttcactcacacacctcaagcaagagctatctcatattctctcaagtttagtctagtagtatcaagctagtggaataggaatagagtagaaatcaggagttcgaaagtcttcggaagagttcggttatggctctagtagctttcctttccttttttgtaagctttgtactttatttagaatactcttctatataaatttatggtattgaaatactttccgagtatatgaatgcctactttacattatgttcttgttatactaaatatgctgctagcttatctgggagatgctttggtgcgggtatattgtttgcttattcaattactctatatcatgacgatgatattagagtagtatctggtagtttagacgtggtgtctagattacgggatatcattatttggggttatatgctgcggatcagaggtgggccgttgatggtgacagctcagtacgggtattcctccgcgcatgtatataatcctaagttaattccctggggagggtactcctccgtatttagcccaggttgtatggtcatgacggactgtcataaggaactcggcagtaaggggtggcttctcgaagtaccaggagggcattggagagggcatcggatagagggtattagctactatattggataactagaatgtatgtatactatgtatactagaagtataggaatagattatctttctctttttttttccacttagtttagataatttaatatgagaatgagtagctactgcttgtgtgtcactctacccttgggttatcttaacatataaattattagccaagttctctctacatgatcttcccacgggataaaataaatacgatacccttggaatactctcgggtgaaatgctacaatgatatatccgtgcgcttgtggatgaactctgtaaccgtaatataatagaagtatttatgcgccattgctgggaattatatttctagtaatgtcgtcaagaaataccaacaagcatttctggcgccgttgccggggaagattcataataaagattacttgaactaatactttatatttacctatgtataatcattttcctttgtaggctaaccttggttgttttcacttctgttttgaaaacagggtagtgcatgaccggtttcaacttgccggaaaacttcaaagaaaatccagaagatttcttccggagtgtcaggccgcgagtcgttgttccgcagaaaactctaccaacagacaaaccagccataccagcgccaccgaccttcaagactatggctgacaagaccttccgcgagttcgttgctccctctgctgaaaatgtggccattgggccgcagatcaacattggagacgtggatttcgacctgaagtccagccttatcacgatggcgcatgctagcccgttctatggcaagcctaacgaggatgccaacactcatctgcagcagttcctggagatctgtagcacgtacaccatcaagggcgtcagtcaagaagccgtcaggctgaggctgtttccattctccctcctcgggagagcgaagcagtggttttacgccaatcgtgctgctgtcaacatctgggacaagtgctctacgacattcctcttgaagttcttcccgataggcaaaaccaatgcccatcgtggacgaatttctagtttccaacagacgagggacgagtctattcctgaagcataggaacatctgcaagagtatgtggccgcctatcctcatcatgggatggacgactagctaattctgcagaatttttacaatggactcacacccacgtcccgcgatcatctagacacggtagctggaggggctttcttttgtaaaacggttcgaggatccgttgacttaatagagaagatggtctccaatatgggttggagggagaaatgactccggacccgttagagaggcatgcacaccgtcaaggagacggaattacttgctgccaa

SEQ ID NO: 47959 - DNA, 737 bp, Oryza sativa
tgaataagaacaagacaaatattattgggaactaacaaattttagataataatgatgtaactgaatgtaatgtttattttggcatgcttgcataactgctcagatcttgttagataacttcaggcagtgaacgacgaagtccggcagaatagcttcgttgtttctgaatgacaataagttggacagaaattcctttcgaagatctcgttgatcctgttgttaatatagaaaattatttattataaaggaagctacttcaatgaaacttaagttgaacctagtgtgtacagaaaactcacggattttggggggttcacaaggcgagttccatcccagtttcgcatgtagtagagcacgtgaaaggcacaatccagcctaccaaaattgttattattgtaatgaccataaatgagtagaatggaaaaattaatttggatcaaattgggagcatgaactggaacttgttgtttaaagctgggatgaccgaagggaacttagaaacccagtttggtatatcctcgccccaatctggaaatgcaagcttcatgcactccttcagagcagatgaaatgtgaaattttgtttttaagtgtctttctgctgtatcctcttatcttttcgaggcgtctctcagtgggtcaagaatgcatattttttttctccatatcaaatgcgtatagagaatagtgcagtggttgaagtaagggaataaatatctgcaaattaatattgacatt

SEQ ID NO: 47960 - DNA, 1618 bp, Oryza sativa
attcctgcagccctaatctagataatatatatcaaataataattgatcaccaaatataatgaattaaccgagatcaatcagacttgatatatttatgtagagtgatctatctatagaaatgacaaatatacgtataatagattatgagacatgcactatcatatatggtaagatcggctaaaaccccaatgctatccttagttataattaattccaagttaatttttaaggttctagacaagactagggttgatgtaactcaaagtatgtaaagagacctaaagtctaaacaatgaagtaattaattacttttcaagatggtagatatcttaaccaatctaatctggcatgatgatttagccgataccagcataaaccctaaagtaggccttagccgatatgactaaatcgagatgctaaactagattaaataagatatatgataacaaacgtcacacgaacaatattaatacatttaaagcaatgtaaaagccccgatgatgcaaaccattgagacaggttacctcttgtcgagagatcgtagctgatgtcccgacttgaagcaagaacctgtactgattttattgtcgtcatttattacaataaaaagtgtggcgatgtgcagaaaattgtactgattttattgtcgtcgtttattacaatgattcggggtttatatttatacacagagtacaaaactcgtccattatggacacgactcaaactttcataaagataaaaacaacaaacaagtccacacggcggactcttaccatttctctaattcaaaccgacattaatatcctaatgtaatagaaaaaattgccttaaatcagctttatctttatatggcaatgccagttatctcaatcgaggctccaaccgagcccaagtcgaggtgtatcagctacttcccatattggctgagttggtgtccaactctgtttcctgccgatatgatgtccagccgatgcgcagttagtttctggcaagatcaaatctctttcaagcccgctttaatatccatgtccaaatccgaatatatcttgccaaatttcattgttcacaataagacatgagaactaccttaattagacacagactaggggcccattggtccgatcggctgaacatctgcaatccaaccatcactatgccacaattatagaagacccggagtaagcgtcaagaaaacttagcaactcacagctggttgttgaatccaccaattggtctattcgaggaagagaaaagtaatcgtttgggcacgccttgttgagatcggtgaagtccacacctattctccacttttcgttgccccttgcggaccatgaatggattagcaagccacttcggaaggagaacttctcgggtaaagccagctttgagaagtttgtacagttcttctcgtatagcttgttttcgatatgatgcaaatctctgcagtttttgcttaactggcttggcatcgggtcgcaccatgagtttgtgctcgatcacctccctagggactcccggcatgtctgacggctgccaagcaaatacgtctgtattgtcgcggaggaaggtgatgagctcgagttcctatttactgcctagcgttgccccaatcttaatg

SEQ ID NO: 47961 - DNA, 959 bp, Oryza sativa
gtgtgggaaaagaaagaatatatagaaattttgtttatttgctaaataaggttttataaaataattgagtaggaaaatatagtgaaagttaatcttaaataaaagaaaacaaactaaattgaaaactaaaagaatttaaaacttaaaaaaaataaataagaattatttggtggaatattttataatttttgtatgaataatgatatgtcattattgtatgactgttgaaagagtttgtgattattttgtcattattgtatgattgtcattattgtacgaatgattatttgtgtacgattttttttgcatttcatgtagatggatcggcaatggatgtacactgaccggcggtccaaagagtttattaacggcgtgcattattttttgagagtggccgaagctaacaagcagaagggttttatttgttgtccatgcaataagtgtaagaatcagaaggagtattctgcatccaggactattcatttccacttgtttgagtcggggttcatgccaagctataattgttggacatcccacggagagcaaggggttgaaatgaaagaagatgaagtggaagacgacaatattccagactttgctcagtacgctgaatttgaaggaaatcaaacgggcgaggaggacatagatgctgattataacgacgttgcggatgatcttagtcagatgttgcaggatgccaaggaggactgcgaaagtgaaaagggggcccataaattggacaagatgttagaggaccacagaacgtcgttgtacccaggttgcgagcagaggcacaaaaagttggataccactctggagttcttgcaatggaaggcaaaaaatggtgttagtgacaaggcatttggcgatttattgaaactcgtcaagaacattcttccggagggaaacaaattgcccgagacaacgtacgaggctaagaagatagtctgccctctagg

SEQ ID NO: 47962 - DNA, 1204 bp, Oryza sativa
catgaaagcgggcactattgatcattgaactttccataccatttacttcacccttttttaccatatttagaagttcttccctgaagcactattcatccttgaactttccataacatttaatttttacccgtttgatcatatgtaaaggtgtttccatgaaatggtaaatatatatgcttctggaggaaaagtttagggatgaatagtgtccgattttgatatttagggatgaactttacactttcttgaggttgtggatatgaaaaataataattttccataaattcataaataatattggaaatgattatttaaattattcatattagatttaaaaatgataagatgtgagaaataataggaagagtttgtagcaaatctgcaactgtattttcatatgcgctttcaattatttctatctattatttactccttttaaaagaatattttactaacaactccttcatgtttgtacctactctttctttcatgtgttttaatattacaaaatagtcctttccacatatgactatcttatttcatttctaaaacacatgtttattatacaaagacacatatatcgacgaaattgtgaaaatcacaaccaatttgttccaagcaatattagcacacatataatttattttaatccaagcacgagtatttatctagttatataaaaaaaatcaaaacacagtgaaaaaaatccatatatcaagctagagtttctatatcaattagagctatatgtacttaaatatcgtctccgcttgctgttaattttttagacaattagaaagtatttcgccagtgcacagagttcatgcagtcagctttcatattggcatcaataatttacatggaaaaatacctacgttctaaacaattccttatatgtgctatactaatttcttcaggcaccaaaactaactttcaagaaaccaatagggagcatctgtatttctggccacaagtttattggatgcccaataccatgtggtgttctaataaccaggttgatggatatcaatcatgtaatgtccacaaacattgagtacatctcttcaaatgacacaaccatagcaggaagcaggaatggccatgctcccatctttttgtggtatgcactgaagcgtatagggtacaatggtctttgcaagacggttgaaaattgcttaaaaaatgcccagtaccttgcacttcg

SEQ ID NO: 47963 - DNA, 4816 bp, Oryza sativa
tcaacctgaacttacatgtttaatttagggctacatacggctgaaatcagtttggatagtatatatgcacaatccagacacttcacatatttatagtctagtttttttaatgctcgacatatattagaatgttcacgcccagctagccttccatatccacgtcagctctcgcaggtttggtggtcacttcttctgcacgatctatcatacacacacaagaaaaaattacaaataagcctacaagaaaaatactggggaaataaacggtaaaaataattaattggtgaggattggagccagaagggaagaaaaagatagactagatgttttatgaattcggatagcgaaaattaactgtacataagggtttgcggcgtatgcaagtacatagcggtttgtgtactctatgatagcacggtgaaaaccggaacaaaattaaaatgtgtttacaattgtagctgaactggaggccaacacaggaacccccatatagcaagagatgcttccacagccagtcttccaagaatccctcggccctggccccggacgccctggaccgccgtacgtcgcctgcttcgactcttctatgtcgtcctggttctatatatgcgttaattaatcacatagaagtccctgcaggttctatgcgttaatcacagttcatcaggtcattcaattccttatgagaaaactgatagcctaatgcaatggtgcattcgtacttaaattggtgttagtattagcagaggcaattaatcaccatgttaccatgcagggccgatgctgacatttcggaagccctacgcgaacttgacactatatgggccttaagtagttaaggctaattttttttacttccaatatatattctataaagcacatataccatatatcatatagtaaaattgtaacgtaaattatataacaataaccatgaaaattatagcctaattaacctattttttggagtggaaaaagttattctttcagtgtgagtcgaaattgtgccaaggatttcaattcaaatccgtccttgatccctctcgtcgccataaaaaatcgcctcctcggaattcctcttccaattcaaccttccaaaatctaatttcgaaattcaacctcgtcctttgaactcatcgccaaatacttcttcccatttccgaaagtatcaaattcccctttgaatcccttccttgactcctccttgaacctttgggtgcaaatgcctaattcaaactcgaaatccaaatccaaactccaaaaccctccgaattagttcactcggtaaaagtctattttgcctccctcttggtcgatttggttgtttctcccttgctcggccaactttttccctcagcacgttccttctcacgtgagccgcgtgtgctgccgagagagagaacgcgtctatatctctctctctctctctcctctcgcccgcgctatgtgccgtcgccgcgattcgattttcgccgccgcctttgaaatcccgccaccaccttcgtttccacgcgctgcgcgtcgtggccgaccgtaagcacgcgcctgcgtcacctcgcctgccgcggcgatctccgtgtagctgctcaccaccaaactggccctgccaacttttgccgtcctccatggcccagccgctaaccgccaaagcttggaggcagaggagcttgcctcgtctatcgcatctcctcaaaactggaggagcaaaacccccctttccaccgccctgtcctccctttatccctcccagaatcgacctcctctctctgccccatgtctctctgcgcgcggaggcagagcgccgttgacgccacgcactagctcgtcatcctcgcctcttgaccgcccaaggtcagttctccccctccaaaccgacatcgccacctctataaagcccaagccctcctcattcctcttgtttttcgctcgcctcacacccatagcgccattgccgcccctgccgcatagctgctcgccgccgtcggccattccccagttaattaatgaaagcaataacctatatgtctattattatttctttcttcagtttaaattaatctttgttttgcatatttcccatcaacctgaacttacatgtttagggctacatacggctgaaatcagtttggatagtatatatgcacaatccatacacttcacatatctatagtctagtttttttaatgctcgacgagctctaagcatatatggttcttatcattgtcacgcccggaatttctatccaaaattccaaacgcttacatgtgcgtgaacccttgtccagaaatcagccgaggcacacaataacaaattgataatagagtacaattattactctaattaataagcgaataaaatgtcattacagaggtagatagttcctctcaatcaataaagatctaagcagcggaaaataagataaacggcgcagacgactccactccacaggcagcttgaccagggctacacctaatcctccacaccatcagcttcactgtagaactcttcctctgatgaatgattgcaaggtgagtatatgacatactcagcaagccacgcagcaaatatgcaagtgcacaggataacaaaggatggcatagtagggtttcatttgcataaacaacatttaataaacatttcagcatttaataaaacagttaagtattaattaaacagtattaatccaacgctatacaacataccctgttgcataggcccaaccattctgaacaaccatcccggctgcacagttctatctccaaaccaggaatataccattccaaaccaggagctaatcaaattattaccaattatagcatctgttattatgatgagaggtgtgaaactaatcacgaaagacattgttcgacccgcccataaccgcgggcacggctattcgaatagttttactctgattagaggtgtaccactgtacccacaagacacagccccacatcatgtcaccatgtgcctcaataccaccacggtacctcggaaaggagctatgacaataccccttgcataacacaatccaccacagcgcaccattcctggatcataatcacccccttataaacaaggcatggactccccagcgacccccgtgggcttatctccgtcacttctcagtctggtgtcccgcaataaaccatgctatacaaaaggtaaagccgttgcccacgctggcttgtggttggcacgattaatgtttcacaaccgaaactcgtgaaccggtacttaattgtcatgagcacaactctcaaaaccatgtgcccacaacccaccattatcaagttttagttggcaagtaattaattaaccaatcacgattgaccatcgtgaactatcattaagccatcattaaataatagtgaatcataagttatcccaatagtgtgctaatgtttctaggcatgactaagcaattatatctaatatctagctgaaccaatatataaagcccaactagtcaagttataataacccaaggtatcaaggaataaagtaatcaagaacaaaagggctataacaaacaataggttaattccacccaatgacattcgaaaataaatgcaattgttgaataaaaacaatagctttaaacgggatcaacatgctcaaagggttgtttgggatctgtgtgacttgccttgctggccttggaactcttcaaattcttctcctgcgaaaacggactctccggaaacgtcggaatctaagcagaaaagagcaaaaacaccaaaacaacacataaacaagaatgaacagtacatgtggatatttttaacatgtagatctcaattttagaaaaatttagagacttgaaccaactaaatccgagctaagatgaattagttatgaatttttaaagattaaatcggattaaaacacttatatggattttaattgaattatgacgcaataatgaattatttttgaaaaggaaaaggggtttattgcgtcagcggctagggtttgcggtagaccgggcgcacgcagcggtccacgggaacggacggccaagatcgatcttatccaaaacggacggccgagatcgaccggtccacggccggaccacgagggacgacgacgatgacgtcagcgacgacgtcaccaccggcggcggctcgggcggcgcaagcccgccggcgaacgacggcgcttcggcacgaacggagggcaccaggacgtagagggcgacgcggcgaactcaccggtgaccaaaacggcggcggaagatcaacggacgacgacggcgacgaggaagaagcggcggcgctcttcggcttgacgacggcgacggtgctccggcggacagcaatgacggcgaaggggcggacgaggacgcggcgacttggcgaccacgatggcgaccttcccgagcgacgacgacgactggaacggcggcggcgcacggctgaagcggcggcggcaacagcggcgctaggctacacggcgctagagctcttccggcgacgagaggcgaaggcgagagtggcggcgggtagaggagacaccggggagccttttaaaggggctaggaggcgacggcaaaggcccacggcggccggcgacgagaaggaaaggtcgggctcggagagagaaaagccgatccgattcgacttcgaatccaacactttccaaaccaatttaaccgatgattccaaaggggaaaaggtagaggagatcgagaagatcatttcccctctatcaattcggccggagaaggaaaggatcgaccgaattttggaaggaaacggcggcggcgctcggttagggtttcgggcggcggcggccgaaggaagacgacgactga

SEQ ID NO: 47964 - DNA, 2386 bp, Oryza sativa
ggcctaaagccaaaagagacttttaaaaacctttttcaattaaaattattcatgaaatgcaattccatttattaaaaatacttccttagctcaaataaatcccagaaaaatctaggaattatagaattaagcaaagtatttaatgaaattttatctggccccattttatattggaatttattaattaaaattaaatcttctcttctaggctttttaaaataaattctaataattcaaattaaacaacaatttatatatttagaatttttagggtgtgacaatcatctattcgagcgacattttaacatatattgaatgttcacgcctagctagccttccatatccacgtggtttggtggtcacttcttctgcacgatcaagcatacacacacaagaaacaattacaaataagcctacaagaaaaatactggagaaataaacggtaaaaataattaaatggtgaggattggagccagaagggaagaaaaagatagactagatgttttatggattcggatagcaaaagataactatacatgagggtttaattgcggcgtatgcaaggacaggcatgacatagcggtttgtgtactctataatagcacagtgaaaaccggaacaaaattaaaatgtttacaagtagctgaactggaggccaacacaggaacccccatatagcaagagatgcttccacagccagtcttccaagaatccctcggccctggccccggacgccctggaccgccgtcgcctgcttcgactcttctacgtcatcctggttctatatatgcgttaattaatcacatagaagaccctgcaggttctatgcgttaatcacagttcaccaggtcattcaattccttatgagaaaactgatagcctaatgcaatggtgcattcgtacttaaattggtgttggtattagcagaggcaactaatcagctggtctagactctagacgatccaaattatacatgttgtctgaagaactttggctgcagaggcctgataccagctgttccttttgttagactgaatgatcagacgctacagtcacttgtgatgctgcttttggatatatattgctttatcttgaggatctaaacccttctacaagcaggccggtattcttgctacaataaatattctgcttttcttattttcaaatttccctttgtttcagttttatgaatctgttaagcagagagagattctcaaaccactggttccaatgatgcttggcagaacaaccataggtgaaaagacattttgatctaaatacagtagctctacttgctgaatgactaattgggatctaatgagaatccgtttgttttagtcactctctgaatatcaaatgttatatattcatgtatgtttagtacttgttcaggtattctggacatggctggatttttttggtttctgaaaacctcatcctcctcacctttaagatgtacttcctccgttttaggttataagactttctagcattgctcatattcatatatatgttaatgaatctagatatatatatgtatcaagattcattaacatatatatgaatataggcaatgctgaggtaggtaacaaaagtcttataacctaaaacggtggtagtactaaggaaataagatcagtcataaaatactgagtactttctctgaagcatcgacactttaactgttaaaactacatgcttatgttcaatgcgatttaggaaatgaattcctgacttatttgaaggattggtgatatttgacacttgatgttctcaatgtacactgaaatctgctgctagaattaaaaaaaaatcatctgcccacgacaggatttgacaattacctggcaccttaattgtgagttgtccgttttgtaaaaataaaactgctccctttcttagtttgtcctctgctttcatggttttactacttatgaattgtgataatttctgtatatgttcccagttacagtattaattgataatcctgctaattcgatatttgtttttccttacactggtggagaagtggtttttactcctatatagtcctggtttttcaaccgggactacgaatccgggactaaagatcgctatctttagtcccgggtgaaataaccgggagtaaaaatcgatttttagtcccggttataaagagacagatccggttgcttctttattcttttcttctcttcataatttttcattatttttaatatattgatttcaccctaaccctatcccatccctaaattcccaaaacaatcatcctcaaattgccttcaaatccacaaatcgatcatctcaaatacatcacaaaatctaaaaaaaattacatcacaacttctacaaaattcaatcacatattcacatctcacacaaatca

SEQ ID NO: 47965 - DNA, 5902 bp, Oryza sativa
  unsure (1)..(5902): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncaagtattttcaatttttcaattcattagcttgaaatcttatatttctttccccccattctattctcatggccctgcgacgcccgcgtgttgcgcatttgtttgctccctcggtggtaagagcccaacctctcccccatctacatgaacgattcttcactaagtgtgggggctaagttttctagccttatcctagccttaagttgagccccgggtgccgtcgacgcccgggacccagtgtgttggctcttccgtagcggctggctttggtcccgccggctggctacggtacccggcctggctcaactgtggacggggattgctggctctagagttttcggctctcacactcatgcgaaagtaatcgtgcatgtagaaggaaaagagattggaaggaggccaccgaaaggaaagagcaaacagaatgtgtagtgtggggacacaggctcgtgggaacctaacctcgtttgctaagtggtcacaggcttcccaagatggttcggaacccatggtggggggccctcttcgagctaaaggtttgtgtttgcttcattcatacaagcaattctttgctgtaagtgtggatgctacgattcctagctctatcctagccctgtgtcgagctctgggtaccgtcgacgcccggggccccctgtgctagctcttccgtagcggctggctttggccccatcggctggttacaacgctcagcttcgcttgatcgcaggcgaaaattgctggctatagaaagttcagtcctcacactcgcgcgaagataatcgtttgcataaaattattattgcttatatttatctctcgcctatctcttcctcgcggtctccgcggtacctatgtgtcgcgcaccggcttgcctcccttggtaacaaaaagtttgtattcgcttcatccattcaaacgattctttgcttaaagtacgggggctacgattcctagctctatcctagccttgcgtcaagctctgggtaccgtcgacacccgggccctcctatgctagctcttccacagcggctggctttggccccgccggctggctatggcgcccagcttagcttgatcacgggtgaagattgctggctatggaaagttcagtcctcacactcgcgaaaataattgtttgaatagatgaagtagaacatgaacaaaggttaacaaatggcaggggcaagtgaggtacgcggcgtaaggtcacgggcccgagagaatctaacaacgtttgctgaatatatacataaaataatttcacagcctaaggtatgggctagcgagtcgcccttaggttggggcgaaaaaggcgcatgggtcctagtaccagcaaagaaagaataagagatcgggcccacctatcatcagactaggaaagtggcgtcaccctgaccacctggggaaggttttggtcagggctaacgccgggggctactgtcggtgatatgggcccggggctatcatgtttagagggaggaggctgccccccgatgccacgtgcccctcccccgaggggagttaggcccgaggtggggtggtggcccctccttccccaaagactagtcggtggaggctgccccccgatgccacgtggtcctccgccgaggggagtcaggcccgaggtaggacggcggccactccttcccagagactagatgtaggaggctgccctccaatgccacgtggccctcccccgagaggggtcgggcccgaggtagggcggcggccactccctggccgagactagagggagaaggctgccccaggcgccacgtggctccccctcgagggggaatcgggcccgaggtcgggcggcggcggccccttctcgtgactaggggtcgggctcccccgaccccttctctaggtcaccacgtacggtaggttaggtgtccgcctccaagtgcccacctacccgcatttatggcatcccgagtagtcgcgccacgctgcatttaatgtggcgtgcagtgcactcaaccggtctgtgaccggtcgaatgaccaatgggactggctagtgcgcctgtgcgctgctcgtgtgtcaggcggcgtgcagcctgacatgtcccatcaaatagtgatggtgagaggttctcatcctcttatcccagccagagtcagtcctcccgctctggtaaaagcaaggctcccgtttctcggtgtaataggagcctagaagtcttcacccattaaatggtgactgacaggggcaccccccatgtcaggcggcaagatttgacaggccccatcatcaagacgacgtgtgcttggcttcccaagtcaagagacaagacatgcatttaatgcaaagattataatacttctccaccggagttaggttaggttgttgggcccatgtggtaaccccttgaggtataaaaggaggtccaggcctagtggtggaggggggacttcggggcgaactggcgcttgggtctcgcaaccccaagcacttgtgttctacattcaatcaatcatgcacaggagtagggtattacgcttctcagcagcccgaacctgtataaacctcttttgtctcatcgtcttggggggggggggctaaccccctcaagatcacacagctccgctcaccaagccctcgaatctcacccgctgcccccggccgaacacacaaaggggggcctcacggttccctggtggaggagttcattctccgacatacatatacacatatatatatatacatatatacatatatatatatacatatatacatatacatatacatatacatatacatatacatatacatatacatatacatatacatatacatatacatatatacatagatatatatatatatacatatatatatttatatatacatatatatatatatatatatatatatatatatatatatacatatatatatacatatatatatatatacatatatatatacatatatatatttatatatacatatatatatatatacatacatatttatatctatacatacatacatatacatacatacatacatatatatacatacatacatatatatatatatatatatatatatatatatatatatatatatacataggaagcctatatactactccctgtagtaggtactcctattgtaaccatcggacacctgcccaactcatatcagggtttcgggctttaactcactaacggttggtgagaaaagatccactgatccaccgatgcagaaacttgaatattctttttttctttgaaaattcgtatcaccgcgtggtgttctgcatggcgagtcattttgaatgttctgcatgcatggattgttgacccgcacgcatgcatggccgtgcgaccaggagagtagttagtgtggaggttgctgttgatactctatttaagttgacggtgatgtaggacagaaaatgaggagcagaattatatttcggatttgtgaggaagaagattttgttctgcaggtttttggtggagcagaacccctccggtggaaagggcagaatgtcgtcggcgaggtctgttgcgtcgccttccgcggcgcaagtaggcggaggctcgtcggcgcgtgatgtcgagcagcagaagtcggtggtggccgtaggcgcgtcgtcgccagtgagtagtagcaagcagcacaatctggcgaaggaagaaaatggaaccattacagctaatggtgacaagcagcagaagcctgccgcagataggtacacatagaagtttagttttaggttatgttctgttgaaaatttttctcttgtttgtttgtttggctctgactggttattgcgttatttggtcatcaggaatggttttgtgcgttgcatggatactgctgcccggagtgaagtgatgaaccactccctccagaaatatgtcattcatttggatggatgtcatcctctttccatgaggaatcctaggaagagatgtgcttggtgctcactccgtgatattcgcgtggcttgcgacgtgaatttcagaagcaacgaaacaacccggggcaacagtaatagttgcgaacatgtgtccaaggaaaatatgtagccaatagtgtgatgatcaggaaaattgtaataagggcttgctttctgcacggccgtagattagtcgtacgaactgtctctagttttgtatggtatattctatgagaaaaaagcgagtagtatctgagttgagaaatctgtatcttctgctatttgggaagtgaaataaaattgagatgttatcctttcatttatctatttaagttgtgtgtactgcaaactccctgttgtcatcgtgaatgcaatccttcaccaagatgaagttcttcgagcagaatattgtacaagaatggagcagagatttcgaattggtttctgtgagtgtagcgttgcgtattcggaatatttgttatagatgctatttttgtggcggtatggtttcatcagaattcgttaatgttgctagtggctgactttccagagtccaataacatgcttcgcacgtaggagccttgatttcggggaggttgttgagcagctggtggaaaataaaccgtaattatttgtcagtatatatccaaccagctgaaaaaaaaggacaccctagagcaaattctgtttgccaaaaggggtagctaccagagtccgtgctggacagaaacaatattcacggagataggtatggaggaagagggctggccggagaaaggtggcgaggatcatagtggacaacccatggacgtagttccgttggaaaggtatttttttatgtcagtgtgattgtagtgtacaattcccctttctgcattgtttcctgatttctcgttttttgatcctaggatcgtggttgagggggaggaagatagtgatttgctgcctatttcactctgtgacccagccattctgttgccggaaattgggcagaccttcaatgacgactttaatggctatgcgttatacaatctgtacgctaggttcactggttttggtataaggagatccaagaacagatacaaagatgaaggcgtgaagtccatgcaagagttttgctgcattcgtgaggtaaaaatctttagtgtgttctttttttttttgaaaaccatggtttcgtattctcgtaggattggcaagtttctacagtgtgatgcgtaggatcatcattcgataggttttacgtagtaaggtgttcctgtaatttatgcagggtagagataattctgtcactggtccgccgaccaggataggctgcaaggctatggtcaggttaaatcgttcttctgaaagtcaaaagtggagagtttctgcattcattagtgagcataaccatgaaatgaaacgggacctgcagcatactaagcacttcaggtctcataatttcattgatgaagggacaaagaggaacataaaggaaatggtagataatgggatgacacctacagctatgtatggattactttcaggtatgctcggcgggccgtccttaaccccctttacaaggagggctgtgacaagaatggcgtatgccatcagaagggatgagtgtagcaatcatgtgcagaagacactgaatttttttagggaaatgcaatgccgtagtaagaatttcttttacaccatacagattgatggtgcttcaaggattaaaaatatattttggtgtcattcactgtccagatt

SEQ ID NO: 47966 - DNA, 2945 bp, Oryza sativa
gtcggagagaaaggaaggaaaagcccggctggggaggcaaagtagacttcggggaggagagaaccgagcggcgagctgggccgagggagagagagagcccgagagggggagggggaggaatttgggccgagcccgaaagcaaggaaggggaaaattattttcttttctttttattctaattggttaaatgaactttgtgctattaaatttacttcttgagctccgaaaattcacgggaaaatccggagagtattttagggcacaaagaatattgcaaaatattcccggccaatgatttttaagggaaaattttaattctcccattatttcacttgattaaattgattaactttttattcaatttctaggaaatgcatcattaaatgatttttattcccgaacgaaaatcggggcgttacaaatctaccccccttacaggaatctcgtcccgagattctgggatggctagaaagaaagccggtgctgatgggcggtctgactgatctgcaccttgaactgccacattctgcttcgaactgattgattgactggttgatcaaccccgcacgatttgcactggctggattcgacctttctgttcctttgctttgccgaaactggaccgactggttctgcttgaactgacctaggccagaactgcggatactcctgaaacttacgtatcttggactgaactgttgatgctagcagcttgataacctaacaattcaccaagctggctagagaagggtgaagattgaatctggcatttgtaactcattgatcctacgtctgcttgaacgggtcctgactcgaatgtcaagtaattccaggaaacctgcttgacctgtccttcgtctgaactgcaactgtcctcgttgttgcttctctaagctgaactgttgacatgcttcacaggtgtaccttagaattgaacctgtcgacctgagattggggtgactctgctaatggttcgcaactgactcctttaactactaaccactttgtttcacctcgtcgatccttcgactgaaacaacgacgaggtaagccaaaactcatctcagagacctaccacccttacagtgagtagtcttactttcgcgtggctgggatcagttgaactgttgtccttcaaatatagccaacacttctctgatttacaaagagccctgactttgaaaactgaaaacttcatcgatccatctagttgaagcaatgacgatgcactttcatcccgacaagatttggaacttaagccttagttgatgataggaaattccacataaagaaattctcatttagctcctgatcttactaactcttgactattttcccatcagtaataactgctggcatgactgtccttcttctgacctgactccggtgtcgtgtcatccacctgaatgggttgtgtagttgatatctcaaaactaaactgaccgactcgcattggaactgacacaacttgaggagttgaggtgtcgctaacaaagctcttgatgtgatgacactgatgccttactgtggaacaaccctctgagaggtgccctgccgtacatcttccatggatggttggacactttgcaaaaactgctcttgaaaaccataaccactgtaggtagcatttgttactcctgggattggtggttggttagctgtgctgatatgctgaggacttggtggcgtactatctgaggttgtaggtgcttgctcttggaaaacaaactgactttcgctctgatcccgattccggcttgcatctgagcttgtacttgttgttggagacattgtcgttgcatctgctgctttggactctgcggttgcggtatcaacatctgacacatccatcatctgacattggctaaccaaaatctgaccagagcgaggtgctctgatttagcttgtagcttgctgccttgaactgatccaatggctctgaccgcaacatattactgctggagttacttccgcttcatttgacctcgtgtcgagctttgcatctcctgcttcaatacacccatcttctgatcttggacaccaaaagctgatcacgagctggggttcttctggtattgggataccttgaagctttcaactgaaccattgatcggtgactttaatacaccgtcgttgctcttctctctaacactgaccatcttctgccagggcggaagagaggtggaagagaggggttgctaaagataaggtactaaaccacttacctactgatctgttgtgagtagacttttattgttcaagttgcttaagcaaacaacctagtatggtcgcatccccaccagtgatgcaaaccatacccctacacacaagcaaacaacacacgatctagaagctaacgaaactactcttctgggacagattgggtttaggtcatctccggggaaactcttctttaatcttcgcagaacgacgactctgaactgatctcctcgctccttgcacgaagcttgaggctcgacctgacttgacttccgaacagacatgacgctggcggtttgtcctccaggtttgacaactaaaggaattggaggggcagggaggagaattttgaaaaaccgtttcgcaaagaaaagccgaagggcgaggggagacatttttcaaatagggttttcagaaagcttgtccttagggtttgaccatttggctcaacctacagtcaagttggctctgataccactttgtcacgcccagaaatttagcccaaatttccagactattttgtgtattaaatccctgtccaggaccagccagggtacacaaaacgacaagtaatatacagttccaaacgtaaataaagcgtaaaatacttacaaaagaggcacttagtcctcgcaccgaaacgaaaacagcagcagcggaaaaaggcgatcctagcggggcttcagctccactccacaggcaaaactcaactggggtctgagcctt

SEQ ID NO: 47967 - DNA, 18363 bp, Oryza sativa
tacttccttagctcaaataaatcccagaaaaatctaggaattatagaattaagcaaagtatttaatgaaattttatctggccccattttacattggaatttattaattaaaattagatcttctcttctaggcttttttaaaataaattctaaaaattccaattaaacaacaatttatatattttgaatttttagggtgtgacaaacctaccccccttaaacagaatctcgtcctcgagattcggaagaactagcgaacagatgcggatgagctgacttcaattcatcttctcgttcccaagttgattcttcttccgagtgattactccattggactttgcaaaaacggataactcaatttctggtttttctctcatctatttccaaaatacgggttggtctctcaacataggtcagatcctcttggacttctatctgttcaagattagcttcttcggtaggtacccttaaacactttttcagttgcgacacatggaacacattatggactcctgccaaagattgaggtaactccaactgataagcaacctctcctcttctactgacaatcttataaggtcccacaaaacgcggtgccaattttcctttggtgtgaaaacgatgaacacctcgaataggcgtgacacgaaggtacacataatctccttcttcaaaactcaaatctcgacggcgattgtcggcataactcttatgacgagactgagccactcgcaatctttcttgaatgattttcaccttttcttctgcttccctcaggatatccgtcccgaaaacctgatgttctcccgtttgatcccacaaaagcggagtgcggcacttccgaccatacagtgcttcgtacggagccatctgaagactagcttgataactgttgttgtacgaaaattctgcataaggtaaattcttatcccaacttccaccgaagtctaaagcacaagctctcaacatgtcttccaaaatctgattcaccctttcggtttgtccgtctgtctgcggatgataagcagtactaaagttcagtttagaacccatctcttcctgaagcttcttccaaaaatttgaagtaaactgactgcctcgatcagacactattttcttagggacgccatgcaaacacacaatccttgccatatacaattccgccaaccgacttccagaatatgttgtctttactgggatgaaatgagccactttggtaagtctgtcgactatcacccaaatagagtcatggcccgatgacgttctgggtaaaccagtgatgaaatccataccgatttcctcccatttccattcaggaatcttcaaaggctacagcaaatcggcgggtttctgatgttctgccttgactcgctgacaaacatcacatactgctacgtattctgcgatttcacgtttcatatttgcccaccaaaatctttccttgagatcctggtacattttggtactaccagggtgaatggagtataaggtatcatgagcttctttcagaattgcatcttttaaatctttgttgtcggggacgcagattctctcacccaaccatacagttccttgctcatcctccaagaaaccgatagcctttcctcttctcatattcttcttgatttcttgaatatcaggatcattaatttgggcttctctaacttgatcaattagagtgggcttcgcttctaagactgcaacaaaacctctactgacaattcccaaatttaatctttcaaattccttgcataactccaacggcaactgtcgtccttccgtagcattgcaatagcctttcctgctaagagcgtctgctacaacattagccttccctgggtgataatgaattcccatgtcataatctttaattaattccaaccatctccgttgtctcatgttcagatccggctgagtaaagatatattttaaactcttatgatcggtatacacctctatacgagtaccgaaaagataatgacgccaaattttcaacgcatgaaccactgcagctaactcaagatcatgagtagggtagttcttctcatgcggacgtatctgacgagatgcataggcaaccaccttcccatcttgcatcagaacacaacctaacccaagtttggatgcatcgcaatacacttggaaacccttctttggatcaggcaaaatcaaaataggagcggatattaagcgattcttcaactcttggaaactctgctcacattcttctgaccacttgtacttcacatctttctgaagcagccgtgtcatgggcttagcaatcttgaaaaaattatctataaacctccgataatatcctgtgaagcctaggaaactgcgaatctctgaaactgtctttggttgtttccaattggttacggattccacattactaggatcaacggcaactcctcctgctgagatgatgtgaccaaggaactttacttcagacaaccaaaattcacacttgctaaacttggcataaaattgatgctctcgtagcttctctagtgcaaggcgaagatgttcttcatgctcttctttggttcgggagtagataagaatgtcatcaataaagaccaccacgaacttgtctaggtattccataaacaccttattcatcaagttcatgaagaaagcggaggcattggtaagtccaaaagacataacagtacattcgaacaatccatacctagtggtaaaagctgtcttaggtatatcttcctctttgattctcaactggtgataccctgatcgaagatctatcttggagaaaacggtggcacctttgtcacgcccagaaatttagcccaaatttccagactattttgtgtattaaatccctgtccaggaccagccagggtacacaaaacgacaagtaatatacagttccaaacgtaaataaagcgtaaaatacttacaaaagaggcacttagtcctcgcaccgaaacgaaaacagcagcagcggaaaaaggcgatcctagcggggcttcagctccactccacaggcaaaactcaactggggtctgagccttggtcctctaacttcgtcttcagctcagaagcactacacttctgaaaagggggaataatagcaagactgagtacaaccaccgtactcagcaagccacaccaacgatgcagacgtgcaaggggatacaaggatggtttgtggctatttgcataaaggcggttgtaaaacattttattgagcaaaacagtaaaacagttgagtaaataaagtaacattaaatctccactgatcaacgctacaccacgttgaacaggcccaaccaacccacctaaactacagtgtattgggtcgatttattaaggtgggactaatcacggtgaatctggtcgaccgcccataaccgcgggcacggctattcgaatagttttactctgatcagaggtgtacaactgtacccacaagacacagccccacgacacgtttccgtgcgccgacatgccaccacgacataccggaaagaggccgtgacaggacccttcgcataaccccctctaaccgatcgcaccacaccttagggttcgcccccgtccccagcaggcaacgggcagcccccctttcgtgccgcggtgaatccggaagccgatcaaccggacaccccggccgacccaactccatcacgcccaccctcgcctgggtacgtcggctagagaaaagctacactacaagcccagccgttgcccacgctggcttgtggtaagtacgataagttcttccagggcatcccgcgaaccggtccttaattgccatgggtgcgaccagcaaaaccatgcacccacagcccaccattcagttgcattttagttggataattacgaccatgaagcatggccagatgtctcgagcacgcagctcaatctgatactagaaaggtctaatattgcaattatcccatcaactgagctagtggtaattaagcatggctaagcatatagttctagctaggtcacataagtaacacaagctagtcgattgattacccaaggttgacaaagaacagatatcaagtaaacatggcacaagcgagcagataggtaataccctgaccccatgtaattagcaaaacatgcatatttatttgtaaacggtaaaacatttataaattgggatcaacatgctcaaggggaatgtgtgacttgccttgcttcttcactttgatcttccgaactcttttcctcgcgaccgcggacttccgaaacgacggaaactacacgctggcacgcaaaacgaggaaaaactctaataaagaccaagcaaacagtacataaaaagtaaacaaacatgtagagctcaattttagatgaattttgcaagttgaatggctcaattcggagttcgaatgaattagatatgaattttagaaggttttgagccattttaatgaatttctagaattagtaccgatttattgcgcaatttaaatcaattatgacgtcatccgacggggaagaggtggcgccggcaagcgggccccacctgtcggtgactcacgggtggcgggcgcaccgtggaccgagtccacgcacgcgctggtccgcgggcgcaccatgtggcagacacgtggcggccacgacggacggctagcagaggtggcgccgacgtggcgccacagaggcaccgacgcgggcggcacgggaaggccacgtggacggcccagatcgccccgaagggggatcgggcggccacgggcgagcgggagccggctcaccggtcggccggccgggagcgacggcgcacggcccgatggtcgccggcgacgaccaccggcgcgacggcacgcgcgggaggcgacgaaaagaggggaaagggagaggagatggagggggtcctcaccgaggggcgccggcgacggagggagcggcggcgcatgcgagggaggcgcggcaaagggaaccgatcggcccgggcgagcagggcagcggcagccggccggtcgagcacacggcacggcggcgacgcacgcacggaaacggcagcgcacggcgctaggagggagaggaggaggaaaccggggtgctcaccacggggcgacgccggagagaggcagccgacggagggaggcgagatggcggcagcgcgagagaggtggtgcgcgaggcggcgattttccggaggcggagaggggagatggagtaggggccggggtagagcttggcacgacgttgccgacggcgcaagcggtgaggtgcggcgacgactaacgcggcggcagcggccggctgaaggcggcgtgtggcggtagtggctcggcctcgcgatgggaaggtggttccggcggtggaggagggagatggagtggatgccggggtgcggcggggtgccgtgatgctataggtggcggcggcgcagcgcggcagcgacgggagcggcggtggcgggcggctggagatcgctggcgagcggcggcgaaggggatcggcgtggagagctcggtagagggcgcggcggcttggggaaaattggggaaatggatgaggggaggccggggattgtttttatagcctcgagagtcgacggggaggccggttggcgacggatttgaagggggaaagggcgccggcgacgtgggtgagtgggggcagtttggcgccggttttggaggggagaagtgggggaaatggtggaggaaggggatgacgtggggtggaccgcgcccacaagcgcgcgggaaccggaagacgcgcggggaggggcggcgacgtgggcggctcgggcggccatggcagttgccggcccgggctggaggttggggatgaccccgacaggtggggcccacctgtcggtggctcgggggaaaggagagaggaggagacggttggggggggacgatgacaggtggggcctcgggtcccacctgtcggagagagagggagggagaggccggctggggaggcaaagtagacttcggggaggagagaaccgagcggcgagctgggccgagggagagagagagcccgagagggggagggggaggaatttgggccgagcccgaaagcaaggaaggggaaaattattttcttttctttttattctaattggttaaatgaactttgtgctattaaatttacttcttgagctccgaaaattcacgggaaaatccggagagtattttagggcacaaagaatattgcaaaatattcccggccaatgatttttaagggaaaattttaattctcccattatttcacttgattaaattgattaactttttattcaatttctaggaaatgcatcattaaatgatttttattcccgaacgaaaatcggggcgttacaacctttaagctgatcaaacaaatcatcaattctgggcagcggatacttattcttgatagtcacatcatttagtgcacgatagtccacacacatcctctgggtatgatctttcttttccacaaaaataaccggagctccccatggagatgaactcggtctgatgtatcctttctgaagcaaatcgtctacttgcctcttgacttctgccaactcattggctgccattctataaggtctcttatggatcggagttgttcctggtaccaaatctattctgaactctatatcccttttaggcggcataccaggtaaatcgtctgggaacacatcaggatactcccgaactataggaatctcttccaaagttatttggttcagtcttgaccttaaagactcagaagacaatgcatgaacagttacaactcgaccaccattactggtgagagttacttttctgttagcacagtctatcacacctttatgtctggctaaccagtccatccctaggatgacatcaaggtctttggattctaacaggataagattggccagaaacggtactcctttaatttctattctgacagaggggctacgttgcaaagagagtgcttgattacttggggtactaaccatcataggacgtctaagatcttctacttccatcccatgatttcccgcaaaactcatagataagaatgaatgtgtagcaccagaatcgaaaagcactgttgcaggaactgagttaacaagaaacgtacccaaaatcacatctggagcatcttgagcttctgcagcagcaacatgattgacacgggcctttgatgcgggtacggtagagttgctctggacagggacaaccttcacgcgtcggggcttcggacacttgtcagcataatgtcctggttctccacagttgaaacacaccacgagcttgctgccttgctccttcttggcaggttgtggagcttgattgcggatgttgttgccagcattgttgttgaagaactgacgctgcggatgaacaacagacgaagaacctccctgtggcatggactggggtcctaaagtaagacgcggcctctgattattcccctgttgtgtcttgaattgagcaatccggcgtttcttctgctccatgcggttgtacttgtcctcctgacgaatagccttatccactaacttctggaaatcaggataatcccgagtcatgagtgggtaagaaagctcatcattaagtccttccaagaacttctcctggcgctcttcatcattgcgcacatcttccggagcataacgagccagacgattgaactcgtgcagatactccgtaacagagcgagatccctgggtgagcgacctgaattccttcttcttgagagacactactcccgatggtatatgcgtcttccggaaagcagcggtgaattcaagccaagtgataggttcagcagtagtcctattaaggcggaagtgatctcaccactcagaggcagggccatgcagctggtgtgatgcaaatgagacattctcctgatcagtgcactgaagcaaatccaacttcttctctatggcgtgcaaccaatcaccagcttcaacaggattagtggtgctagagaaagtgggcggcctcacacgaagaaattctgctaacttgttctgcggcggtggagcattgttgttcccttggttgagctggttctgctggttctggagttgctgcatcatcatgttcataagctgtgtctgttgagccagaacctgggcaagtgtgggattctctccattgttgttgttattgttattgttggggccattcccgttgctgcgagtgagcaccatctggcagggacaagagcacaagaagagaaaccggggaaaactacttaggacagagaattaatataacttttattgatcttaagtgagtttcattattacaaactgaagactctcaccccactaaactcaccaagtacctaacactcgaaagcaaacaaacgcatgcacttacatcccaccactgatgtaaatcacatgcgagacacacacagccaaacttaaaataagcaaactaacacaacgatctaagacaacggtttgacaaggcattctagttctttcgggcatcggagttgattgaaggctcgttcagctcgtcttcatcatcttgagttgctccccactcaatcttggaatgggtgtgcttggattcttcttcatcatcacttatgttgatgaccggaggatctgctagggctggggtaacttctttctccaccacacagacctttggcgccaattggtagcgagggacaaatagagctctcttccttgcggtaagacgaattctggccttctgcggtggtgcttctccctttaacgcggctagttccttctccaaacgatccaccttgtcctctagcttgcaaatcttaccacgattccggtcttcacgatcttgagctgctaacacagtctccgcacgggtttcatccatagcccacagcatctcaaccaaatgccttgtggtagcatcattctcaattccctcagtctcaaggtaactgccacggtcacttccctgtggttggcgaggatggtaacgatactcagtgtcggccaactgatcactatagcgatcacgaagctctcctatggtgatccttgccacctcctgacatacatggatgtagtttcttcctccagcttcgaacatcactgaggggatatcttcactattactgttcaaggtgactttgactcggcacttctcttcatgacgatcatgaggaatctgggcataaaaaggagcagtcccaaatcctatgacaaaggacatcgtacgcaactcctggacaaatccctcaacaccaaacaagtactcaggcttgtagcgcggcatctaaagacaagtgaaaggagggagttaagacatttatccaattaatagcacaactttttggattaatttgcataaagtttagaaaatcaaagtaaaagggtaagccaaacttgcaggataagttgaaacagttggaaacaaggtcacaaattttgtacttttgaataacaggtttcaaaagaaaataaaagaaagttataaaattaacatgctaaatttattttattgtagcaagattaaataaaacaatattgtaaaacttttgctggtaaatgagccattagtacagtaataaatgtacagtactaataacgctagaataaattttgaatgagaaccattaaaagagattatgacgtgcatgtgccattagtttggtttaattaaaagagaaggagaggagaacagttctacttttccaatatttttagagggcttctatgggtaaccatttggcataacctagggtcaagggggctctgataccaacttgtcacgcccggaatttctatccaaaattccaaacgcttacatgtgtgtgaaccctcgtccaggaatcagccgaggcacacaataacaaattgataatagagtacaattattactctaattaataagcgaataaaatgtcattacagaggtagatagttcctctcaatcaataaagatctaagcagtggaaaataagataaacggcgcagacggctccactccacaggcagcttgaccagggctatactgtcgcgtcccaaaacgactctaaaattcatcctcgaaattgtgcaaagaataattaaaattcatgtgaaagcctccaacaattaaaatgtgcaaagataaaagtcaaatgaggcttggaggatttttgtatatttcctaaaagcctaaaatgtgtaaataaattttagtggaattttcagagcacaaataataattgaaaagaaataaacaaagttaaaagggttttataaaaagaaaaatccctaaaagtcttttccccctccccttttcccttcttgggccggctcggcccagtccctccctctctctctctcttcccccgcggcccattggcctcccccgcgcgcgcgcgccgctgacaggcgggcccgcccgccgccctcgctgacgggtgggtcccacctgtcatccctgtcctcgcgccgcgcccgccgccgcccgtgccctagcgccgccgccgccgcggattccgccgcatcccgccgtccccgcgcgcattaaagagggggaaatcactccccgtgattccctctcccgtttccccctcttttccctctctctctccctcggattcgtccgatttgaatcccgcaatcgtcgccggcgtcttcaatggagccgagatctccgcggccgattcctccctctccggccgcgctctccccctcccggcgctatatatttgctccccgtgccttcctcctccgtttccgccgttcgccgcttgctctcgccgtcggattcgtgctcgcgacgtccacctctctctccgccgtcgccgccgacctccggtacgccgccgacgtcgctccgggctccctcccgactcggcgtcacctccatccgcttcgccgcgtcgtcgtccaccccgtccgccccttcgcttcgcccgccgaccgccggagctccgtcgccctcgtcatcccgaaccgcgccgccgtcttcctccgcttcggtcgccgttgccgtcgccgccgtcgacccggggtgagccgaaggccgtcgcttcgcttccctcttctctcctctctctcgggcgccgctccgccgcgccggtggtcgccggcggtgaccatcggggcgcgggtgcgccgcctcccgtcggccgtgccggcgaggccgccttcgggcgcgccccgcggctgccaggtggggcccggccgtcagccgcccgcgcccgcgggtgcggctgacgcgtgggacccacggcgccgaccgccgccagccgcgtgctcccggtccaccgtggaccgagaggctgacgcgtgggccccgctcccgtggacccggtccgcgcgccctctctctcggctgacgcaataaatgagatttttaattaaaatttaaatgaagaaattcgcaaatatgcatttaaagagcatataaacttcaaatggccatatcttggccatttgaactcggaattggaccgttcaagtctctaatttttccttatgaagtcaagaacccatttttgtgctttatttctgctgttatatggagttatttagtgtttaagccttttcttttccgttggtcgtgtagacgctgcagcttcggaagatccgctcttcgtggaagttgaagccgtctgttgggaaagcgagcaaggcaagacacatcatcttgatcatattgaatcccagtttataaaattatgttgatttaaattattgcattatcgctttatttaaattcccgcgttatcactgttttatttagccatgcctatttacctttgttatgaccatattattattgttattgctattattattaccttgttcaccctagacaaacaaaacctcaactagtggacactctactcatagtaccacttgtataattgtaggtagatgcttcgcaatttaattaggcaacattaggtggttttataactttagacttgggaaactctcatatcacctggacactctggaattgttggtttgttgtggaattggcttcacaccgctccctctattcaaaagtccccaaaatggttttaggctgggctcgaggtgcatggttttgatagtagcacctcggccgtttaaggaccggtcttcgggcctctgttgcaaagcactaccgtacttccacatgtctagtgggtaaggcttagtttgtggctcagtctagtcataaacaaaagtacacggattggagatggatgaagtcgggggtcgatggacattctccagggcaaatgaaggctacacgagctgcggcccggtagtcgagatgtcatggcagagggttggtgccctgctgctaggggctcagtcctgcctgcctgtcccgggggttccggccgtaggcgggattgggtcggtactcttgtctatggctaggatgggttggaaactatgtcacgtcttccgtccgtataccgtggtggtatgtggcacgtggttacacgtgaggaagatgtgtcttgtgggtaaagatgtacacctctaatcagagtataatctattcgaatagccgcgccctcggttatgggcaagccgagcaatgtacccaagttagtgttttaattcttaaaacctgcttaacaactaaaatgtggaatggttggcctgggttggcttgggacgagctgggacccagggtcgggttgccagttcggtctgaatcatcgtaggccttgggttaaggcaggttcgtgtgggttcacggccttgattaataacattgtatagttctaggatcgcgtttacaaaagagctttgagcaactaaatgtctttaaatgctgattactgcaaccctaaccctttatattataactcccttgtactcccttgcatttattctgcatttgtgggtgtgtcttgttgagtacggtggttgtactcagtcttgctcaatttttttccaagtccagaagaggagttccttgaagatgaaggcttcggtgtctagctcgtgcctgccgtcaagcgcctgtggtcgtcgccctagtcttccgctgtttctcgtttgtctttgtgtgtgctgggccttcgtcgcccatgtaataattttatttacgcttccgctcgttaaactctgaattgtatcaacttttggtgtaccttgcctcctgggacaaggattaatgcacgcacgtcaggaacgcccgttgggttatttccggtcgtgacaagttggtatcagagccacccttgaccctaggacgagccgtagatcccaagccttagtaatattttcaaaaataaaaatcctttgctatttgtgaaaacagtctagtctctctctgtcttgctgcttcatttaccatcaaaatctgaccataaaaaaaatgttgatttcctttttgtttttgtttgtagatggccggcagcgtcacccgtcgtggtttggacatgactggcttcgttttggagctgcggggcatgtgcgtggtcttggggtatccacatggagtggattaccaggccaggccgctcccggagcaggagggtgaggatgcagagccccacgctggttgggaggtcactgcagtgatcctctctggctctcccgggcggacttcgctggcagtcaccgcgggtggagattccttccccgccgcttgccagaacgccgctctcctcgccatcggcacccttcaccagcgctacccggacgagttgcagcactcgccctaccgctaccaccctcgtcgcggaggagcccgcgacttcgccaccttccgagatgctagctcggaggatgacgctaccatcgtgcacctggcacgcatggtggaggcatacgacgcagctcgtatcgacttccatcagatggtgcgccgtgggatggtcgagaataacatgaagatcctggagctgcggcaggagaacctgcagctcaagaaggacctcgacgcagtggaggcgcagctgcaccagctcaagatcgcccagggagaggactgccgccccaagcgtcgccgcgtctgccgcagccagaagatcaccgcccgcaagagcacctccaggcctgagcttgttcgtcagtccctggcgtggacttgcttcgtcgagacccctcgtgtcgagcctgtgcccgtggttccccaggagggggaagcctccggcgttggtagcacggaggatgcgccgttgctcaccttccgccctggcccgtcgcagcagtagacgagtagttagtaggcttgcgtgtgtgtttttcctcgtttgtcttcttgagttgtgtggggcatggttatgccggtgtgtggcataactgtgtcggagcctgtcttattttatttgcctaagcaacttgaaccttaatgaaccaattcaatagcagtaataaattcaagaattatagtagtcgtgggtggttagttttaattgttagctctctctgtttgctggttctgtgtggggttttcagatggtgacgaccagaagaaatgttaacaccggtgatggcaaccaacccgaaggcagcaaccacaaccaccaaggcaatccacctccacctcctcctccgcctccaccaccaccaccagacaccaacgccattctcacccagatcctcgcccagcaagccaacatgatgactgctttcctccaccacctccaaaatccgtcacaacagaacgctccaccaccacctccacaacactctaaactcgccgagttcctccgcatccgcccacccaccttctctagctccaacaaccccgtggatgcgttggattggttgcatgccgtggggaaaaagttagacacggtgcagtgcagtgatgaagagaaagtcatcttcgccgcccaccaactgcaggggcccgcatctttatggtgggaccacttccaagctacgcagccagaggggcaacctatcacttgggctcgcttcaccgccgctttccggagaacccatgtgcccgccggagtcgtggctcttaagaagagggagttccgagagttgaagcaaggcaaccgctccgtgatggagtatttgcatgagttcaacaatctggcccggtacgctccggaggatgtgcgggaagatgaggagaagcaagagaagttcttggcgggaatggaccctgaactgtccgttcgtctagtttctggggactacccggacttccaacgtctggtggacaagagcatccgcttggaggccaagcacaaggaactggagtcgcacaagcgccgcttggcgagtttccgcaatcaacagggtgctaaccaaagggtccgctacaccaatccctatccagggggatcctcctcacagcagcaacaacagcagcagcaacctcgctccgcgcctcgacctcaattcgtggtgcgcgtcccacagccgcagcagcagcagaatcaacaagggactcgtgcgccccgtcctcctacgccggctgtgcagcccgttcaaggccgcagggacgctcaaggtccgcagcgtctgtgcttcaactgctttgagcccgggcactttgcggataaatgcccaaagccaaggcgtcagcaaggccaagcgcctccccgccccaacaacggtggcaaggacgtcattcggggtcgtgtgaaccacgtgacggccgaggacgtgctgacaactccaaacgtcattgttggtacgttcctcattcattccatccctgctactattctgttcgactctggagcttcccactcatttatatctgtgccattcgtggggaaaaatcagttgggggtagaaaggcttagaaaaccctctgctcatcaccacccctggaggggttatgacagcaaagtattatagccctgccgttcctatagaaattcaggggattccttttccctcggatctgattctgctaaataccaacaacttggatgtgtgtcgcgaccgggaaaattgccttttcccgaacgctagtgtattaatccccgtcccaggaaaagccggggtacaccatacaaacatgatataaaagacacatatttattatatcgataatatttacattattacaaaggcacttaaggcctgacaatcaaaaataaacagcagcggactagcgggcctacggctccatcttcacaggcgctcaactggggtataagccaggactccacctaagacatcttctccaaagcttctcttactgaagaggggaaagattgagcaagaatgagtacaaccacagtactcagcaagtcacaccggcagatgcatgattaatgcaagggggtacaaggggtaatgatataggggttaagttttgcagtaaacagcatttaaaagttacttagttgcccaaagccattttataaagacgatcctagagctacacagtattattaaacaaggccgtgaaccctcacgaacctgccttaacccaaggcctacgatgattcagaccgaactggcaacccgaccctgggttccagctcgtcccaagccaacccaggccaaccattccacattttagttgttgagcaaattttaagaatttgaaacactgacttgggtacattgctcggcttgcccataaccgagggcgcggctattcgaatagattatactctgatcagaggtgtacatctttacccacaagacacatcttcctcacgtgtaaccacgtgccacataccaccacggtatacggacggaagacgtgacatagtttccaacccatcctagccatagacaagagtaccgacccaatcccgcctacggccggaacccccgggacaggcaggcaagactgagcccctagcagcagggcaccaaccctctgcctatgacatctcgactaccgggccgcagctcgtgtagccttcatttgccctggagaatgtccatcgacccccgacttcatccatctccaatccgtgtacttttgtttatgactagactgagccacaaactaagccttacccactagacatgtggaagtacggtagtgctttgcaacagaggcccaagcttaatccttatagtacccgaggtacgactaacaaaacccaaccacgcacctcgagcccagcctaaaccattatgggggttttgaaaagagggggaggtgtgtgtccaattccaacataagccaaccattccatagtgtccaaatgatatgagaattcccaaagtctaaagttataaaaccacctaatgttgcctaattaatcagcgaagcatctacctaaatttatactagtggaaccatgaatataatgtccactagttggggttttgtttattctagggtgaacaaggtaataataacaataacaataataataaggtcataacaaaggtaaataggtatggctagataaaacagtgataacgcgggaatttaaataaagcgataatgcaataatttaaattaaaaataattttgtaaactgggattcaatatgctcaaggatgatgtgacttgccttgctcagagagaacggccttccgaaccttcggcgacgaccgcgaaccacgcttcgggaacctccggaacgacagaagctacgcgaagcacacaagcaaagctacaagcctataaagaagcaataacaacacataaaaagaaagcacagggttctttaggttataacaaacattaggagacttgaacgggtcgattcagagttcgtatgaccaagatatgatcatccgaggtttaatgctgttatatggagatttgcggattattgtaatcaagctttgcaattataaaacatgtgtaagcgctagcctggaaaggacaggaaggctgcgccgttgacatgcggaccccacatgtcaacctaaaggaccacggtagaccgggtacacagagacggtccacgggtcgacggaagcggaccccgtgtgtcaaccgaagcgagtggccgacaaacggactccactagacaccacacgggttgcacacgtggaaaccacgcggctaccaagcgggcacactaacacggacactacacggtcaccacccgcacacgtgaacgactaccgacaccggtacacgggtaccggggtcgacgaccgcacaacgggtacggggcgacgccgaaaggacgagggcggggaagcgagaggacggatccttaccaccacgcgacgaggcgtgggaacgacaacgacgaacgggcgcggcggagacagacgggcacaacggagacgaacggcgaggggacggcttcggcggcgatccttggacgaaggcgagacgcggccggcacggggcttgacgacgcggagccgagggcggagactaggacggggctgcagcggctcgcttgacgaacgcggacgacggacgagaacggctcgacggagggacgaacgccacgacgaccgggaacgacgagaggacgacgacgacgacgacgaccgggaccggcgaggaggcgacgaggacagccggcagcggctgcacggggacgaggacgacgaggaccacgccgctacgatgccgac

SEQ ID NO: 47968 - DNA, 1352 bp, Oryza sativa
aagccgggcggcggctggaggaagaaggcgacggcggcctgacgcgtgggccccacgcggggcgcgcggtcagcgcgcgcacgtgcgcgctcgggcgggagggcgccgctcgggttgggccgggcggccggcccaggaggggggggggaaggaggcagcccgggagagagagggggggaagggagctgggccgagaggggaggaggcccaagaggagggagagaaggagagggagagaaagagagggaggagggaaggacttcgggctgggcttggcccaaaggaggaagaggagggatttttagtttttctttttaataaactttgatcaaggttgttgttgcttaataattatttccggtgctctgaaaattcaagtcaaatttgagggctctttttagaccaaggagaatttaacaaaaattctccgggccacattggaatttttcttgtacgtattttagtgtttgccaatttcttttcgaattttaattaattctattattccttttagcgaatgatttttatttcgggatgaatttatcaggacgtgacaatgtgatccttgggatgaattggctggcccaattccaaggagtagtggattgcgcgagacgcactgtcactctgtaccgagggccggaacaaccggttgttttctttgcacccccaacctctgtcagaagttcagaactgcatcagatagggctgtcagaaatccccatagtcagagagttcggagacgtgtttccggaagaactacccggtatgccgcccaagcgagagattgagttccggatagatcttgctccaggaaccactcctctgcacaagcgaccctaccgtatggcagcaaatgaactggccgaagtaaagaaacagttggaagagttgaaagaaaaagggtatatacgtccgagtacttccccatggggtgctcctgtgatttttgtggagaagaaagacaaaacgaagaggatgtgcgttgactacagagctctcaatgaagtcaccatcaaaaacaagtaccctcttccccggatcgatgatctgttcgatcagcttaaaggtgccactgtattctccaagattgatcttcgttccggatatcaccaattacgtatccgtgaggaagatattccgaagaccgcattcaccacgcgatacgggctgtatgaattcacggtgatgtcattcggtctaaccaatgcacctgccttcttcatgaacttaatgaacaaggtgttcatggaatacttggataagtttgttgtggttttcattgatgacattctgatatactcacaatcagaggaagaccatcagcaccatctccgtctggtgttgggaaa

SEQ ID NO: 47969 - DNA, 2271 bp, Oryza sativa
ccgcagtttcttaggtttggcaggatactaccggaggttcatcgagaacttctccaaaatcgctcgacccatgacacagttgttgaagaaggaagagaaatttgtgtggagcccgcaatgcgagaaggcattccaaactctcaaagaaaagctggtctcctcgccagtgttaatcttgcccgatactcgcaaggatttcatggtttattgtgatgcttcgcgccaaggattggggtgcgtgctcatgcaggacggtcatgtggtagcctatgcctcacgtcagctacgacctcatgaaggcaactaccctacccatgatttggagttagcagcggtggttcatgctctaaaaatctggcggcactatcttattgggatacatcttcacccagtcagatctgaatcttcggcaaaggagatggttagaactcatcaaggattatgatgtgggaattcactatcatcctggtaaggccaacgtggttgccgacgctctaagtcggaagagccattgcaacactcttaacgtccgtggcattccacccgagcttaatcagcagatggaagccctgaacctaagcatagttggtcgtggattcttggctgcgttggaagccaagcccaccttgcttgatcaaatccgcgaggctcagaggaatgatccggacatgcatggactcctcaagaatatgaaacagggtaaagccgctggtttcactgaggatgaacacggaaccctatggaacggaaagcgggtatgcgttcccgataacggagaacttaaacagctgatacttcaggaagctcacgaaagcccttattccattcacccgggcagtacaaagatgtacctagacttgaaggagagatactggtgggttagcatgaagcgggaaattgcagagtttgtggccctatgtgatgtgtgccagcgtgtcaaggcagagcaccaacgaccggccggactcctccaacctctccaagtaccagaatggaaatgggatgaaattgggatggatttcatcaccggacttccaaaaacccaaggcggatatgattctatatgggtagttgtggatcggttaaccaaggtggctcgattcattcctgtgaagaccacctatggagggaacaaactagcggagctctacttcgctaggatcgtgagtctccatggtgttcccaagaaaatcgtatctgataggggaagccaattcacctctcacttttggaagaagctccaagaagagcttggtacccgattaaatttcagcaccgcgtatcacccgcagacagatggacagaccgagcgtctaaatcagatcctagaggatatgcttcgcgcatgtgtcctagatttcggaaagacctgggataagagtctcccctatgccgagttctcctacaataacagctatcaagccagcatacaaatggcaccttatgaagcgttgtacgggcgtaaatgccggacaccgctattgtgggaccaagttggagaaagccaagtgttcgggactgatatcctgagagaagctgaagctaaagtcagaatcattcgggataatctaaaggtggcacagtcccggcagaaaagttatgcagataaccgtcgccgtgacctggaattcgcagtgggtgattttgtatatcttcgggtcacgccattgcgaggtgtgcacaggtttcaggcgaaagggaagcttgcacctcggtatgtgggtcctttccgtatccttgctcgtcgcggagaagtcgcttaccagctggagctgcccgcctccttgggcaacgtgcatgatgtgttccatgtgtcgcaactcaagaaatgtcttcgagtgccatccgagcaggccgactcagagcaaattgaagttcgcgaagatttgacctacgtggagaggccagtgaaaatcctggacaccatggagcgcaggaccaggaaccgggtaatccgtttttgcaaggtccagtggagcaaccacgccgaagaagaagctacttgggagcgtgaagacgagctgaaggcagcccatcccgatctcttcgccagttcttccgaatctcggggtcgagattccgtttaaggggggtaggtttgtcgcgtcccaaaacgactctaaaattcatcctcgaaattgtgcaaagaataattaaaattcatgtgaaagcctccaacaattaaaatgtgcaaagataaaagtcaaatgaggcttggaggatttttgtatatttcctaaaagcctaaaatgtgtaaataaattttagtgg

SEQ ID NO: 47970 - DNA, 5828 bp, Oryza sativa
tactatgaactcatacaatccatagcgtgttgaaaacgcggtcttgggtatatccccggtcctaattttcaactgatggtatcctgatcgaaggtcaatcttagagaacaccttcgctcctttgagatgattaaaaagatcatcatccgtggtagtggatacttgttcttgatagttacttcgttcagtgagcggtagtccacacacattctcatgctaccatccttcttcttaacaaataacactggggctccccaaggtgacgaactaggacgtacaaatcccttttcttgcaactctctgatttgctttttgagctcctccaactcattgactggcatccgatatggtctcttggatatgggggcagttccgggtatcaggtcaataatgaactctatgtcatgatctggtggcatcccaggtaaatcttctggaaacacatcgggaaatcgttgcactacaggcattcctttcatgggtagcatggtaaatatgcctccggcacgttcggttagtctagtatcttgatccatggttgctctcatatccgatccccaaggtgtggtcagggtaacttctctacgtctacagacgattactcccctattctttgataaccaatccatacctaatataacatcaagggtctgtggtaccaagaccataaggttggagggaaataccacatccctaaggcgaaatggtacgtcaatgcaagctgtgtccatggctatttcacccccaggtgaatgtactaacattggttgccttagtttaactctggtcaaattgtgtcgttggcttgctttcaaagataaaaatgaatgcgatgctcctgaatcgaagagaactttaattggagtggagttgatagaaaacgtacccatcagtacgcccttgtcttcctgtgcctcttcagctcgaacgtggttaacttgcccgcggccaaatcctggtcctgttagtctgcggagtcctgaatagacctcgtccagcagcaagggtagtagtcccgtgaatagccgttgcattagctccggtgcgaatgggtgtcttgtttggatgaggacatttgttggcgaaatgcctgtactctccacagttgaaacagcttcctggcctcactgatccagtagcgacctgattcggtgcaggagctcggttcttaatggtaaccggcctgtggatgttgcttggtgcggtaggacgattggttgttaccaccgttggtttccatcctgatgcggtagctccgttaggacgctggggtgcgacctgaggcgagcggttcatggcaagcctcctcttacgattatgctccacaaccttccggtcgttctccagcctaacgaccttattgattagactctagaaactatcatggtcctgtccaatcatgggcccacgcaactcatcgttcaggccttcgataaacttatcgatcttttcctcctcgtcggctaggtctccagttgcgtaacacgccagttgagtgagacggtttaggtactcttgtatagtggtgttcccttgtcgtatcctcctgaattcattcttctttattcgcatcacggcggcaggcacgaagttgtcacggaaggccgtagtgaactcctcccagtttggttctccagcatcttcttctcgggcttctttgtaagtgtcccaccagtctccggctggtccttccagttggtttgctgcgaagatcactttatcggcttcacgtactcgaacaagggtcagcttcttctcaataatccttaaccaatcctcggcatccatacgttcttcagctgtggcgaacgtgggtggcttggtcctcataaactctccaaagcttgatcctccgcggttgccttggttgtttacaatggcttgtagaagttgggtttgagtggccataactccggccagggtggttaggtcaggtgtctgagtttcttcattgctggttgacgcccgacgttggcttgccatctgtgtagaccgattaagtaagtatcctaattttctaactagctcttatggttttatcccattaagggagttgttttgatgtgaactttgttttgcaagcatggtggaataaactcatttttaagacaacagcaataatattatagataacatcacagatttccacacatagtacataaatcatgatgcaattgactgcatacatacgcagtcaaataaggttcatccaaaagacacatcgaactaaccatcaaactactcgtcaatctaggtaagggggggtgtgtctcgcatactatcaaaaaccatctgaagcgagatcgaagctgcaacaatcctccagtctagtcatccaaccatccgcaggatcctggggcaggtagagggtggtcgcgggcacaggcaaacctgagtccccatggctcggaagtagtggcctctggatctggcttgggcttcttgcccgggggtcgggtgctcttgtgggcagtgctgagggtgcgagggccaccgaggaaggtgatgtggggaacaggggtctcatcctctgaagaatcagtgatgtctggcttgatctctggctcagtgtcggtcccctctgtctcggagtcgacctggatcgaagtctctaaactggaacccagctgcggagaaggtgtagagatcagtggagtgtgcagaatctccggggcaggtggctgtgtcactgtctggtccaccaagtaaggtgctgactcagtagccagcataccaacctctcccaaaagagcgtggaacgctggtgggtacggcggggtgagaaaaaagtagcttacatgtggctgctgaccgtggctgctcgaagctactgtcacgcccggaatttctatccaaaattccaaacgcttacatgtgtgtgaaccctcgtccaggaatcagccgaggcacacaataacaaattgataatagagtacaattattactctaattaataagcgaataaaatgtcattacagaggtagatagttcctctcaatcaataaagatctaagcagtggaaaataagataaacggcgcagacggctccactccacaggcagcttgaccagggctatacctaatccaccacaccatcagcatcattgtagaactcttcctctgatgaatgattgcaaggtgactatatgacatactcagcaagccacgcagcaaatatgcaagtgcacaaggataccaaaggatggcatagtagggtttcatttgaaaaagcagcatttagcaaacatttaagaatttaataaaacagttaagtaataattaaacaatattaatccaacgctatacaacatactctgttgcataggcccaaccattctgaacaaccatcccggctgcacagttgtatctccaaaccaggaatataccattccaaaccaggagctaaacaaattatttccagttatagcatcttctattatgatgagaggtgtgagactaatcacgaaagacattgttagacccgcccataaccgtgggcacggctattcgaatagttttgctctgatcagaggtgtaccactgtacccacaagacacagccccacatcatgtcaccatgtgcctcaataccaccacggtacctcggaaaggagctgtgacaatacccctcgcacaacacaatccactacagcgcacctttcctggatcataatcacccccttataaacaaggcatggactccccagcgacccccgtgggcttatctccgccacttctcagtctggtgccccgcaatgaaccatgctatacaaaaggtaaagctgttgcccacgctggcttgtggttggcacggttaatgtttcacaaccgaaactcgtgaaccggtccttaattgtcatgagcacgaccatcaaaaccatgtgctcacaacccaccattatcaagttttagttggcaaataattaattaaccaatcacgattgaccatcgtgaactatcattaagccatcattaaataatagtgagtcataagttatcccaatagtgtgctaatgtttctaagcatggctaagcaattatatctaatatctagctgaaccaatatatataaagctcaattagtccaattataatcacccaaggtatcaaggaataaagtaatcaagtacaaaagggccataacaaagaataggttaattccacccaatgacattcgaaaatagatgcaatagttgaatagaaacaatagctttaaataggatcaacatgctcaaagggttgtttgggatctgtgtgacttgccttgctggccttggaactcttcaaattcttctcctgcgaaaacggactctccggaaacgtcggagtctaaacagaaaagagcaaaaacaccaaaacagcacataaacaaacatgaacagtacatgcggatatttttaacatgtagatctcaattttagaaaaatttagagacttgaaccaactaaatccgagctaagatgaattagttatgaatttttgaagattaaatcggattaaaacacttatatggattttaattgaattatgacgcaataatgaattatttttgaaaaggaaaaggagatttattgcgtcagcggctagggtttgcggtggaccgggcgcacggcggcggttcacaagaacggacggccgagatcaatccatccaaaacggacggccgagatcgattggtgcacgaccggctcacagcgaacggccccgatgacgtcggcgatgacgtcacctaccggcggcggctcgggctcacacgctcgacggcgaacggtggtgcttcagcacgaacggagggcaccagcacgtagaggacgacgcggcgaactcaccggtgaccaaaacggcggcggaagaacaacggacgacgacggcgatgaggaagaagcggcggcgctcttcggcttgacgacggcgacggtgctccggcggacaacaacgacggcgaaggggcggacgaggacggtggtgactgtcacgtcctgataaattcatcccgaaataaaaatcattctctaaaagaaataatagaattaattaaaattcgaaaagaaattggcaaaccctaaaatacgtacaagaaaaattcaaatgtggcccggagaatttttgttaaattctccttggtctaaaaggagccctcaaattttagtggaattttcagagcacaaataataattgaaaagaaataaacaaagttgaaaaggttttataaaaagaaaaatcctaaaagaagttcttttcccccccttccctcttgggccggctcggcccacttctccctccctctctctctctcctcccccgcggcccatcggcctccccgcgcgcgcgcgccgctgacaggcgggcccgcccgccactctcgctgacgggtgggacccacctgtcatccccaaccccgcgccgcgcccgccgccgcccgtgccctagcgccgccgccgccgcggattccgccgcatcccgccttccccgcgcgccttaatgaggggggaattactccccgcgtttccctctcccgattccccctcttttccctctctctctccctcggattcgtccggattcatcccgcgaagttcgccggcgtcttcaatggcgcccgagatctccgcgcgcggtttcctctctccccggccgcgttctccccctctcggtgctatataattgctccccgagctccgctcttccgtttccgccgctcgccgctcgctctcgccgtcggatccatgctcgcgccgtgctcctctctctccgccgtcgccgccgagctccgttccgccgcccccgccgcttcggacttcctccctactcggcgaccccttcatccgc

SEQ ID NO: 47971 - DNA, 5386 bp, Oryza sativa
ttggtccccggcgggcaccatcggggcgcgggtgctccgctcccgtaggccgcgccgggaggccgccatcgggcgcgccctcgcggctgccaagtgggcccggccgtcagccgcccgcgcccgcgggtgcggctgacgcgcgggacccacggcgccgaccgccgccagccgcgtgcgcccggtccaccgtggaccgtggggctgacgcgtgggccccacccccgtggacccggtccgcgcgtccgctccctcggctgacgcaataaataggatttttaattgaaaatcaaatgaagaaattcgcaaatatccatttaaagagcatataaacttcaaatggccatatcttggccatttgaactcggaattggaccgttcaagtctctaatttttccttaagaagtcaagaacccatttttgtgctttgtttctgcttgttatttggagtttattagagtaaaagcctttttcttttccgttggtcgtgtagacgctgcagtttcggaagatccgctcttcgtggaagttgaagccgtcgtttggaaaagcgagcaaggcaagtcacatcatccttgagcatattgaatcccagtttacaaaattatttttaatttaaattaatgcattatcgctttatttaaattcccgcgttatcactgttttatttagccatgcctatttacctttgttatgaccatattattcttgttattgttgttatttattaccttgttcaccctagaataaacaaaaccccaactagtggacactctatttatggttccactagtatgaatttaggtagatgcttcgctgattaataggacaacattaggtggttttataactttagactttgggaattctcatatcttttggacaatatggaattgttggtttatggtaaaattggacatacacctctcttcctctttcaaaacccctaaaacctgttttcggtggggtttgggtgcatgccagttgtgggaagtagcaccccggccactataaggattaagctcgggcctctgttgcaaagcactaccgtacttccacatgtctagtgggtaaggcttagtttgtggctcagtctggtcataaacaaaagtacacggattggagatggatgaagtcgggggtcgatggacattctccagggcaaatgaaggctacacgagctgcggcccggtagtcgagatgtcatggcagagggttggtgccctgctgctagggggctcagtcctgcctgcctgtcccgggtgtcccggccgtaggaggattgggtcggtactcttgtttatggctaggatgggttgggaactatgtcacgtcttccgtccgtataccgtggtggtatgtggcacgtggttgcacgcgaggaagatgtgtcttgtgggtaaagatgtacacctctgatcagagtataatctattcgaatagccgcgccctcggatatgggcaagccgagcaatgtacccaagtcagtgttttaattcttaaaatttgctcaacaactaaaatttggaatggttggcctgggttggcttgggacgagctggaacccaggtcgggttgccagttcggtccgaatcatcgtaggccttgggttaaggcaggttcgtgagggttcacggccttgtttaataatattgtatagctctaggatcgtctttacaaaatagctttgggcaactaagtgacttttaaatgccgtttactgcaaaacttaacccctatattattattcccttgtacctcccttgcattaattatgcatccgccggtgtggcttgctgagtactgtggttgtactcattcttgctcaatcttttcccccttcagtaagagaagctttggagaagatgtcttaggtggagtcctggcttataccccagttgagcgcctgtgaagatggagccgtaggcccgctagtccgctgctgtttatttttgattgtcaggccttatgtgcctttgtaataatgtaaatattatcgatgtaataaagatgtgtcttttatatcatgtttgtatggtgtaccccggcttttcctgggacggggattaatacactagcgttcgggaaaaggcaattttcccggtcgcgacagtgacttggcgaccacgatggcgaccttcccgagcgacgacgacgactggaacggcggcggcgcacggctgaagcggcggcggcgacggcggcgctaggctacacggcgctagagctcttccggcgacgagaggcgaaggcgagagtggcggcgggtagaggagacaccggggagccttttaaaggggctaggaggcgacggcaaaggcccacggcggccggcgacgagaaggaaaggtcgggctcggagagagaaaagccgatccgattcgacttcgaatccaacactttccaaaccgatttagccgatgattccaaaggggaaaaggtagaggagatcgagaagatcatttcccctctatcaattcggccggagaaggaaaggatcgaccgaattttggaaggaaacggcggcggcgctcggttagggtttcgggcggcggcggccgaaggaagacgacgactgacaagcgggacccacctgtcagcgacagcgagggcgcgcgcacggctgcggactgggccggattgggccgaggagagagagaaggttttgggccgactttcggcccaaagccaaaagagacttttaaaaacctttttcaatttaaattattcatgaaatgcaattccatttattaaaaatacttccttagctcaaataaatcccagaaaaatctaggaattatagaattaagcaaagtatttaatgaaattttatctggccccattttacattggaatttattaattaaaattagatcttctcttctaggattttttaaaataaattctaaaaattccaattaaacaacaatttatatattttgaatttttagggtgtgacagctgctcctccagctggctgacgtgctcctgactctctctcagctgctccttaagtgtatccatcatcccgtggcgatcgttgtactggtcagataactgctggaactggtcgccgtggacctggagctgtgccttcagtgagtctatctcactaccccaagcctggtgctcctcctctagctgaagctgctacgctgtgaggtcagtcacctcggtctctaactctcccacacgcctctgctggtcgtcaatctctaacagagcctcctcgtaaaagtcgtctactgcctcagcccatcgtaacaatcgggtcactatcgggttgtagcagcaaggtgtgtcctgaactgtgcagacggagttgctctcctctcgatacgggtggtgagcaaactcagtactcgccaactcagctcagtggatagagctaagccggaggaaggcctcccgtgctgcatcctgcatcgcggtctccggtaagtcgcgacgatggcgtgtcgggaagctgtagtctaactctgaagtaactcgcgtgtgaacctcgacccgagcctcccaaacagatccacactgtctcactcggtagatcggaaatctggggtatcgtagacgcctcatcaaccggtgtagctcaatgacgtatccctctgagcggggtacgcccatctcccaggtagcgggtgaatcctgatctgccatctaattttaagaaaaacccaaggtcagttaagagtaaaactcgttttgtgaagaaaatagtttagagtaagatgaaaatcgtacagagttttgtaaacataacgtttttatttttgaaagtattactaaatgggaatttctcccttggccaacttagaaaaaaaaggggtggggcgccttttggtcttttcctacagtcgtatggctctgataccatgtcacatcctgatttttgtttcaggatttataaattatttaataaataaactaataatagaatttatgttaaatgttctttaatttacaagtgaagttaaaagtgggaaataaaatttcctaaatataaagcatggatggatttaatttttattaaattctccatgattaagtcaactctctgaaatattctcggatttttcggagctcaattcctaaatgatacaaagaacagttcagtaattatttgatcaataatgatctaattataattgttaagagcttttcttgtttaaaaatccttaaattataaattgttgtttaaaaggaattattagaaatgattttaaaagcctagatgagaagatctaattttaatttgctaaatctcaatataaaattgggctagataaaattttgttaaatactatgcttaattctataattcctagatttttctgggatttatttgagctaagaaagtatttttaataaatggaattgcatttcatgaataatttaaattgaaaaaggtttttaaaagtcttcttttggctttgggccgaaagccggcccaaaacctctctctttctctttccctcggcccagtccggcccagtccgccgagccgccgctcttctctctctctgccgctgacaggtgggtcctacctatcaggttcgtcttccccgcgccgccgccgccgcccgaaaccctagcgcgagccgccgccgtctgctttccaattccgtcgctcctttccatctccggccgaatcaatagaggggaaatgatcctcgggatctcctctaccttttcccctttggaaacatcggctaaatcggcttggaaagtgttggattcgaagtcgaatcggatcggcttttctctctccgagctcgacctttccttctcgtcgccggaagtcgcctcctagcccctttaaaaggctccccggtgtctcctctacccgccgccaccctcgccttcgcctctcgtcgttcgtagcaccctagcgccgtcaacctcgagccgccgtcgccgccgtcgctccagccgtgcgccgccgccgttccagccgtcgccgtcgctcgggaagaccgccgtcgtggtcgccaagtcgtcgccgtcctcgtccgccgcttcgtcgccgccgaagaccgctggagcaccgtcgccgccgtcaacccgatctccgccgccgcttcttcctcgtcgccggcgctgtccgttgcccttccgccgtggttttggtcaccggtgagttcgccgcgtcgccctctacccgttggtgccctccgttcgcgtcgtcgagccgtcgttcgccggcgagcttgcgctcccgagccgccgccggtgctgacgtcatcgctgacgtcatcgtcgtcgtccgtccgtgagccgcggtggatccgttcgatctcggccgtccgttttggatagggttgatctcggccgtccgttcccgtgaaccgttgccgtgcacccggtccaccgcaaaccctagccgctg

SEQ ID NO: 47972 - DNA, 2756 bp, Oryza sativa
aaaaataattcattattgcgtcataattcaattaaaatccttataagtgttttaatccgatttaatctttaaaaattcataactaattcatttgaactcagtttaatgtggttcaagttgcaaaagttgtataaaataaagatctacatattaaaattatccataaattggattaaatttatttaattccttttaaatgggctttaaatagatttaatcttgtaaaattcataataaattcatatgaagtcagaatgaggccgttcaagtctcataattcatctaaaattttgatctacatgtttgtttactttttatgtattgtttatttggtttttattagtctttttcttcgttttgcaggttagcttgtcgtttccgtcgttgcgaaggttcgtgagtgcgccggaagtattcaagaagattaattgaagaccgattattgcaaggcaagtcacacagatcctaaacacaatcctttgagcatgttgatcctatatttaaattctctatttatttcaactgtgcatttattttcgaatgtcactgggtggtgtgaatctattcctttgttatggcctgtttgcattgattactctattccttgatacattgggatattataatttgactagttgagctttatatatattggttcaactagatgttagatataattgcttagccatgcttagaaacattagctcactaatgggatgaatcatatatactacattattatttaatgatggcttaatgatagttcacgatggtcaatcgtgattggttaattaattacttgccaactaaaacttgataatggtgggttgtgagcacatggttttgagagtcgtgctcatgacaattaaggaccggttcgcgagctactattgtgaaacattaaccgtgccaaccacaagccagcgtgggcaacggcgttaccttttgtatagcatgattcattgtggagcaccagactgagaagtggcggagataagcccacgggggtcgctggggagtccatgccttgttttataagggtgtgattatgatccaggaatggtgcactgtggtgagttgtgttgtacaaagggtattgtcacagcctctattcgggtactttccagtatcgcgacgcatggtagacatgatgttgaggctgtgtcttgtgggtacagtggtacacctctggccagagtaaaactattcgaatagccgtgcccgcggttatgggcgagttgagcaatgtttttcgtgattagtctcacacctctcacaataattatggatgttataactggtaataatttgcttagctcctggtttggaatggataattcctggtttggagattagatctgtacagccgggtatggttgttcaggatggtcgggcttgtgcagcatgggtgtgctgttcagtgttgattaaaatttctgattaactactctactgttttatttcacttaaatatttggctaaacgttgcttttgcaaatgagcctatattatgccattctttggtatccttgtgcacttgcatatttgctgtgtggcttgttgagtatgtcatatgctcattcttgcaataatcaatcaacctcagttgaagaaaaaggatccagaaggagaagacgtttggcttataccccagttgagctgcctgtgggagtggagccggagcttcgctagattttattttccgctgcagttttcttcttggtgaggacttaatgcctcttaagtaagtatttatcgttttagtaaatttgatgaatctgtatattaaattgtcaatttgtgtacctcgactgattcctggacgaggatttcatgcacaaataagttcggaaattactagtgaatttccgggcgtgacataccagctctgtagacccccgtttttataacaggaatcaatcgtgtaaacattaccatttccctggatcaagtagtctggtacacacgaattcatagctgaaataccaagtgcacatacacgagtgtctggtatgaattattacatcacaagctcgcaggcatagttttaaatcatcggaccgggcggtccggaattcatatcaaaaacagaagtaagtaagacagcggagtcaaggcagcggcacgccattgccacaggcaacgacggtaagtaagacctactgagcgccatcgtcttcatcaccctcctggtagtaagcgtagggatcctccgaagcttcatctccgacctctgattaagtttatatattgtaagggtgagtaccaaccgtactcagcaagccaccacagcaacaatgcacatgacaggggtattcaaagggtggctatagttcttttgcgcaaagcaagttttgtaattcttttcacgagccctaagacctagcacggactgatcaaattttagtaccagtgttcatatttaaacaatgacggttctgtccaccatccattatgatcccaaggatggcttcccgccattgagtcgtcatggtttactgaggacgtccaccttcccgcctctcgggaagtggctccatcagcatagaaatcattatgcaatatcccatcccatacaatttaagaatttagagtctagccaagtgtaatacatgtcccggtgctcaataaccacgagcacgactattcgaatagatttggtttactcacactgcagtggatgtacactttacccgcactccgcgactgcccaacacatgagcctcgtcccaactcatgagatatgtcacggcaaa

SEQ ID NO: 47973 - DNA, 1555 bp, Oryza sativa
cggcgcggggctcggcgcggctcggcacggtgctcggcgcgacgatgacggcgacgcgacgggcgagcggcgcggcagtagcgcggggcgcgaggcggcgacgcgatgggcgagcggcgcgcggggcgagcgacgcgacggcgggacggggcttgaggcgacggtggctcgcgcggcgcggcagcgggatggcgatggcgacggcgcggcaggggcggcgcgcggctcggagcgacgatgggacgcgacggtgacggcgcgcggcggcacggggtgcgagacgaagggcgcgcggagcgaggccgcgcggcgcagtagcggcgcggcagcggcggtggcgacggcgcgacgggacggcgacggcgcggcggcggcggcgcggggctcggggcattgccgggcgcgcgacagaggagggtctagggctaggggaccacgtcgagcacttagagtgcaatgaacagtgtctttttcctatttctctcattttagtctatttcttatataaatttggttccacgattcctaatttttgcacacatgcattttactcaatatttgtgtgttatctcatctaatgaattcaccctagattaatattactcatattttatttatataatttatttgaatttttaattagggttaattcttattccatcgcattttaaatttaattgatccaaacatggtcgcgataatattttatttatttctatccacacctaatctttattttaatttatatttattttaccagtttgtttttaagttttattcctaattatctatctttactcacgattaatgaacttcgaaatcaaatccaaataaaataggcgaataagaccagcatggtgcaattaatttaaaagctttttggaaatccgtatttttagagttttgattttctcggtcgaattttcaggatgttacatcatagatcaacattagtttttcgcagcttgtcagcagcgtcaaatgattcagggtatcttctccctgattacagttactgagcacagtacaacatactccctccatctactttttatagttatatttcatctaggcacacagaccaattataagtaattctacttatcatctatttaaacatgctactagttattcctcataaacaagcgattcattgatatttacatttctcgatgcccatgtagccaatcttgtgtggaagaatggagagtcacgcattaaattcgagaaagtcattaagatgataggtcgttggattgaaatatgcctatcaaaaataaaattttcagatttgaaaatatgtctatcaaaagtagatggagagagtacattattaattcttccacctccggaatgcaatttcctaattatacacttgtgtaaaaaaatcaaacaaaaatattatgacgaagagagatatgttataacactggtggagaaaccatctttgatcggtcgaccagatttcacaatagtcccggttatattaaaaaccaggactaaaaatatctttagtcccggttttaaagctcttggggtactttccaatctttag

SEQ ID NO: 47974 - DNA, 2875 bp, Oryza sativa
  unsure (1)..(2875): unsure at all n locations
aggcgacggtggctcgcgcggcgcggcagcgggatgccgatggtgacggcgtggcagcggcggcgcgtggctcggagcgacgatgggacgtgacggcgacggcgcgcggcggcacggggcgcgagacgaagggcgcgcggagcgaggtggcgcggcgcagcagcggcgcggcagcggcggtggcgacggcgcgcggcgacgcgacggcgacggcgacggcgcggcggcggcgacgcggggctcgggtcgtggccgggcgcgcggcagaagagggtctagggctaggggaccacgtcgagcacttagagtgtaatgaacagtgtctttttcctatttctctcattttagtctatttcttatataaatttgcacacatacattttactcaatatttgtgttatctcaactaatgaattcaccctagattaatattactcatattttatttatataatttatttgaatttttaattagggttaattcttattccatcgcattttaaatttaattgatccaaaaatggttgcaataatattttatttatttctatccacacctaatctttactttaatttatatttattttaccagtttgtttttaaggtttattcctaattaactatttttactcacgattaatgaacttcgaaatcaaatccaaataaaataggtgaataagaccggcatggtgcaattaatttaaaagctttttggaatccgtatttttagagttttgattttgtcggtcgaattttcaggatgttacaaacctaccccacttaaataaatctcgtcccgagatttcttaccagttttctattatatgcgggtattccgttctcaagaattcttcactttcctaggtggcttcatcctcagtgtgattactccattgtaccttgtacatacgccacactttgctcctagtcctcatttcggcttcatccaatatccggaccgggtgttctggatacgtaagatcattgctaatgtgaatctcttccagcggagcttattcttccggcactcgtaagcatttctttaattgagacacatggaaaactgggtgcacatcggcgatatttttgggtagctgtaactggtaggcaacttctcctcgtctagcgatgatttggaaaggtcccacatatcttggtgctagtttcccgtttaccttaaaccttttcgtttccctcatcggagaaacctttagataaacgtaatctccctccttaaattccaggtttcttcttcgggtgtcggcgtaactcttttgtcgtgactgtgctacttttagacggtcacgaatcaggcgaaccttttcctcggcttcttggataatgtcaggtccaaatactgcccgttctccagtctcggaccacatcagtggagttcgacatcgtggaccaaacaatgcctcattgggtgacatctttaggcttgcttgaaagctgttgttgtaagagaattcggcgtagggcagacatctctcccagtctttgctaaaatccagagcacaagctctcaacatgtcttccaagacctggtttgttctctctgtctggccatctgtttgtgggtgataagctgtgctaaacgcaaggtaacttcctagggcttcatgtactttcccccagaaatgcgaggtaaactgtgtgcctcgatcagatataattttcttaggtacaccatgaagacatactatcctggtcatgtataactcggctagcttagcacagctataatttatcttaacgggaatgaatctcgccgtcnnnnnnnnnnnnnnnnnnnnnnnnnaaatggaatcatatcctgttgcggtcttgggcaatccaacaataaaatctatacctatctcatcccatttccattcgggaatcctaaggggttgcaacaaacctgctggtctctggtgctcagccttcaccttctggcatacgtcacagagcgttacgtactcggccacatctctcttcatattgggccaccagtacccttcctttagatcctggtacatcttcgtactttcggggtgcaatgaatatgctgatttatgagcctccttcagaatcaatccccttagtccaccctgttcgggtacgtagattctctttttataccacagtgtttccttctcatccattgagaattctctcgcacgaccagcggctatgcgctccttcacctcctggatctctccgttgtccttctgggcttcctctatctgggttctcaaaaggggttgaatgtccagggtgtttatccgtccacgaggtactatatgtaggttcagctaggctatttcctccctaagctcaggggccatccctttcattctcaggtgattgcaatagctctttcgactcaaagcgtcggccacaacatttgctttgcctgggtgatagtgaacctctagatcataatccttgattaattctaaccaccgccattgccttaagttgagatctgactgggtgaagatatacttcaggctcttgtggtcagtgtagatatcacaatggtttccaatcaaatagtgtctccaaatctttagcgcatgaaccacagctgctagttccaggtcatgggtagggtagttttcctcgtgtggtcgcagttgtcgcgatgcataagccacgacctttccttcttgcattagtactcctcccaatccttgccttgatgcatcacaatatataacaaagtctttcctattgtcaggaagaactagaataggtgcagaggttaacttttccttgagctgctcaaagctttcctggcactgttctgacccacacaaacttcttttccttcttgagtagttgtgtcattaagtcgagctatcttagagaatccttcaatgaaccttcg

SEQ ID NO: 47975 - DNA, 1503 bp, Oryza sativa
gactcagaaccaaccctattattacaatcattcctctcccgacctcttccacttcctcttcctcgacctcctccaaaaccccaactgccttttctgaaatcttgggctatcagattatccgggtattgtatagcttcgggtgggtgaacaccatcaccatgctcctttgtgacatgcccaacaaaaccacaaacaccgcaaaaaatcggcattttctcatacataacgcggaacatccacttctttttatttagagtggtacttaccaccctcgtgagcggcttacgaacatccagcatcacgcgcactcgggccccctcactgcttccccgaaccgaggctgcatctaatttaacaatgctcctagctctacgcgcaagctgagttgcaatgctacccgtcctgatcttctccttcagatcatggatttggatccatgctgggtaggtatagagattaacagattcaatcttagaccagccatcatattctgcgaggagcaccggacatcctcgaaaggtccatggaccttcattcataactcgttcccaatcccccaaacaattgaattggatcgagaacagattgtcttttattgctctgaaatctacttctttcgcgtagttccatgctgagcgcatactcccaaagaaagccccatgactaaacgatcacttcgtatgaactgtggctagggctagccatcttgcatctgcttcaagctcctctagatcttcctccaattccacatcctcctcctcatctgcccttaggtcaagcccctccagcataacttcgatttcctccttttccttcccccgatccgccgcaggcaccttgctgcccgtcgcagcctgtttctccgacgttgaaccttcgctcgccatggctgttgtgttccccttccttatcctgtagtgctataagcaagcacgttgaattctactcgagatctgggaagaaaccgagtcgataacgtaaatcgccgagagactccttgtcgccgccgccaggaggatagaaaccctagttttcagggtatggagttaactattttcgtttagattaggtagctgataaaacaatcttgctaatctatagctgttacgtggggaaaacagttctcatttttcttcggcaagaatgatatcttccaattcaagtaagaaaaaggacgtgacaactactaatgttccactacgatttacgtccacagaagtattaggacttaaaataacgacagttttctttgatggtaaaatttgatcacgtaccttccttaggattaaaatggaggattacctccgccccaaaatataacaacttttagctctcagaatttgtcccaaaatataacaacttttccaccaacattctcttcccaaccaatcacaacccttcaccattcactttttccacctacctccattactcatccaatcacaaccctccgccactcacttcaacctacttttttaataatcgtgtccacctctaaaattt

SEQ ID NO: 47976 - DNA, 7387 bp, Oryza sativa
ttgggaaaaaaattgcttaacaatgtcaagtagaaaaatttgccaaatattataacttctacgtgaaagagacaacatgtctctgagaaaaaaaatgtcaaaaaggacttgacccaagatttttcttgggaacagatcaaattttgcactgagctgaccaagattttacagactaagagggatttacttatttgtagccgagagattttgtacggtaggttctttgatccgagccgttagacacaaatcggacgacattgacatgctccttgtcaccatgttgttcgtatggtccgtgtcatatgtctttccagatgtcagctataaagttgtacgtgcaaaaggtgtaacccatttagtttcaaaaaaaaaaaggtgtaacccatcaggatctgccggacaccgccgagccaccgtgcgtttatacaggacgttaaaagcgcccccggggcccatcacatcgtgcacgagagtagtactgggagtacctggtggggcatgctcaaaggacgataaacaccacgggttcgcgggagggatgtggcccctcctccccaaacttatctgtccaaaacttgcatgcccgcggcccgcggctcggcaaatcgggcaattacgctggcaaatcaaccgggatccgcgatccagtcatccaaccaaccaacccaccccgccgctccctgtccgcgtccgtccagcaacagcgacagacgacgagacgaccacccaaccgcgcgcgctcgcgtgtagtacgggggtacgagggtgcacggtgcgcgcgggagcgaaaccgtgagttggttcacgggctcacgctgcgttggtcagcaggtcaggttagcagtagcacggttgcttcgtggggacggacggacggacggggacggggcgcgtcgccatgtgaccctgccgcgcgtatcatctcggtgttgagccatgcttctcaggagactttccgacagaagaccttgggctccgatcgggcaatgtgcgtgcaggccgaagcatgggagattctgaggcccatctgttatggggctatctaccgactgactgggccgtgtgggaaagttcggccggttgattgggctctacgtttacatctcggaataagttcatcagaggtccctcaacttaacagcaagattttttaacgtcccttaacaaaaaaaaaaccagaagtcttcacccctaaactatacaaaaccgtccaatttaggtcccatgacagtacagatgcctagtttcgctgacgtggcattcgagtcagcaaaattaatatatatatatatatagatcccacattaagtgaaatgagatagaaaatgtggggaccacttctcttcttctctcttttctctttttttcttctcttcagatcctctcccagggaggctgccaccgatggcaaatgggggcgaggcgagcctggccgagctccgccgccgtcgccgcactgacgcacacgcgctcgctcgctatcgcttcctctaccccctgcgtcgtcgcttcccctgtcccctttgcccccgctcccaacggcgaagaggcagtcctagggacattccttgaggaccagcagtgccgccgcctcgaccggatctgggagcaccccactaccacgacagcggaggtggctagaggaggagtggagtaggccggcagagtggtggcggcggctcgaccagccgaaagttgaggatgttgtggctggtgaggtcgagccggggcgaggggagggggaagtggagagggggttggaggagagaaggggaggcgctcaccctcaatctcgacggtgccgtcggcggtaagcacagagtccgcgcaggcagtgtagctcgccttggcctcgatgaaccacacccctccgccggtgctgtcgatctcaggcttcccgacgaccagattcgtgatgcggccggcgatagggtggtagtggacgaccgatgcggcctagtcctcgacggcttcggtggagacggaggggaatacctggatgaagtcgatggagatgcagacggtggtggcctttgtcgtcgttgtcgatggaggatagcgagagggagccgcccggggtgggccccgccgagggcaccagcgcgtccccccgacaaccggtgctaagtcgctgcctcctcctcgccatccctagtcggcgtcttgtcatcgccgccccaatctcgtcgttgcagcgggtcacacccccacgctacctcctcgccgtcatggttgcagtggtcgccgccaccaccacatagccggtgccacctcctctcctcccccctctctcgccggtgcggccggctgcctctctcgccggtcctcctcttccaccggcgtgttgccaacccccctcccgccggctgcctgggaagaagagagagatgttgatgggctgatacgtgggcttcacatatttttttatattttgtttactaggatgctatgttagcgaaaccagatatctatacttctatgagatataaattggacggttttgtatagtttagggtgaagatttctgtttttgcagttaagggacgtcaaaaaatctcgctcttaagttggaggacctccagtgaacttattcctgatttcacatttctctcttttggaagcagtaaaaaaaaggttgaccgggaaatcgccagctccttcgatctgaagacgacgagaaccacgacaacacgacgagaattcacattactctctgtttctacaagttgacccggtgttcgttggtcaataagaacaacacaaccacttcgggtgacatcggtatcgattggcttgggtttgacaggttaataagccacgtcagtttggattgacaaagtcacaaaactacagcgcaccagtgagctccccaaaccgaatacgttttctcactgttgtctcatccatcaagctagtgaaccacctccaacaaatctccaacaaatcccagatcctgatcgaaagcgtcccgctcaagccgtgcccacaagcaacgagcatatgcatatcacagctagccccagcacccaactccacagcagctgcagtgcagcaacagcacaaatgagggtaacgacgtagcaatgggagaaaccaaagccgaacagctggtgacggccgtgtacaaggtgcacgtccactgcaagcagtgcgcgaacaccatcgtgacacagttcacgcagttcccaggtgtgtgcctgcttcagtaccccgcaggccgctgcaaaaaaattttttttgccgtctgaatttggcgcctgcgcacgatttacattctgattaattgcgtagtaataacatgaacaggagtcagagaggtgaaattggatggaggaaaggtgacagtgaagggcatcggcttcgacgccgagaagctcaggaagaaggtcgagaagggatgccggaggagagttgagctggtgcctcctcccaaggacatagtcactgaggtcaagagcaagaaggaggtaattaatctatgtccttgattaagttatttttggagtttcacttgcctgaaaaattggattttggttttctggatatataatacaggaactgaagatcatcactgtaagggttcccttgcattgcgcagagtgcgcagccagggtcaaagaggttctacttgagcacaaaagtaattaatttctgtacctcggacagttttatctcaatccaacagaatgaaactgcagatactaatgtagtaaccatatgcatgcaaaatgaataaataattcaggcatttacgcggctaagattgaccttgggaagaacttgtgtgtcgtcgagggggtgattgaggagaagaaactctttgaatacatctaccatagaacgcgcaagtacggcttcatcgaaaaggttgagaagaaggagatcattgtggaagagaaggttgaggtgaagaagaaggaagctgagaagaagaaggaaggcgagaagaaggaggaggtcaaggtgaaggagaaggtcaaggaggtcgttgctccctacttcatcccctgcacgcaccctcacttcatcgattactcacaccctgaactccatggattcaaggacacggttttcttgcattgctcacactctaatcagttcctcagtaacgaaaacccggaagcctgctctgtgatgtagagtaatttcagatagatccaatatttatggaaaacgtgcgtcgaggtatagtatttaatactaacaaaacttcgcatacatccagaataaatttgcttcagttcagaaaagaaaggttgcgctgcatgtcctatatgtatctgtgggaattccgtatctgtgtatacaggcaagaatctgaagttctgaactaagttacagagaacagctctcatagtcatatatgaacagtatgtagcttgacattcccgggctgcatatcttgtttcaggaatcaggctagtttttcatgtgccttaatgctgagactacgagaaatgctatcaggcaaccaatgttactgaatataagcgatagttatcattttgtcaccataaaatcaaagtgtgtcattcgtgtgaagaacacaggacatttagttggaagcatatattagatcagcaaatacatgaacacacgaaattgaagatcgatctcttcacacgatctgacaatcaattaatcaatagatatacacacacttcatgttatttcttcagatcaagttaagatcttcaaatcatgaaaagctagttactactatcagtgtacgtacgtgagcgtagcgctgcaacttaacccagcttgcatgcatagtgatcttacaggatttcaatatattttggaagaaaacatttgtctccctctccaattcaggcacatgtgctaatactaaatgattcactcaattcaacattttgtaattacttaatatatatatgtaactaggaaacatttcgacatcaaagcatgatgtacctaggaatctatttgaggtataataatgaaaaagaggcaaacacaatataaagaaatacatgaacctgaactttgtcaaaacaagtactaagtggttagttctctataattttcatcctgttaaaaaagtatggttcatgcatgtaacatagagtagcaacaaacacatttttttagataacggaactacaatacaacaaacacatgccctttggatctaaaaaacttactgaaatggatactgtaggcaatcaaatatatacttaaatggatactgcagtatgcgcatgcgtgcggcatatagatactgaattgaatccattgacaactagtcagtgaagctaaaaatcatgctggtctctacgacctaacacacagactacttagttcggtttcatgtaacttgtagctgaacagggtaactgaaattagcaggctgcagtttttccttcttctatatatagttgctgaactttcttatttttcaggggcttatagtttgtaggttgaagcaaggaggtgattttttttttcatcctctgaagcccatgaaaattaatactaatacataacagcagatgatgtatttttaggccggggctccgttctgatgtattttcaggggctttacaggttttgatacaagaaagtatttaaagctcaattattgttacagatgaaaaaggttacaatttgcaagacctgaacattttgttgcaagaaattccaatgttttccaaagctgagcacattgaattaattgcgcgatcaagcggcgcggtgagttaagccataaacacagtattgataaaacatgaaagcagcgctgatgcaaagacagagcccatagaaatagaacacatgtcgtcaatagaaactttaggaatctcaattctttgaaggttcaagtcccaataacttaggaactagttctctgttcttccatttactcttacgagcatcttgcaatctatgcatataggacaagaaagaacatgaggggacacacactgtaagtagtggtaagatgataggcagacagttggtgaggattccccatgaacactagctagcctgttttgagaggatgcagttgctaattgcttttgatctttaaactaaggcaagtatgcacacgtgggagcaaggagttgtaactcgtgttgcattcccctagcttccacataaattttgaaccagaagaactgatgacatgcatataattatgtttccccagctgaactatctacaaatactataatatacatacatcactgattgttatatatcatcacacaaagacatctaacaccttcgtatcacacaaaaacaattagctaaaactccaaaagcacgcaccagcacatctatatgtgcatgataaagtaagaattgacagcttacgccacacgaacacataaaacctttttcttataattatcagtttgaggcgaatctctcatccacataccagtaacaaattgaacatcaacagcaaaacaaatagaacgcccatgcatcctcgaacaatttaaaggctacttaattattaaagccagattgacaattaagaaaggttacaccacaaattaaggttcaaaagaaacaataaaagaaaaaggggaaaaaaagaacaataacgaaaacacataatcagagatcgagcaaacactacgaaataattgtacatagagatagaaatagagcagtagatatagatcgatcggtggtaaccctgaatacgtggttcatgcgtgcgttcgctaaccttttgcaagctgcggccatgaacccttgcgatgtcctttcctttgcttcttgtgatctctcctctcatctcctctcctttcgccggagctacacccatgtatgcgcatgtcagaacggtggccgtgcgccggcccagccatggccgtcggcgccgggagggagctgtgagccgccgccaccgggcatgttgttgagcggcaggttgaagaacgggaggccggcggcagacgggtccggcgggaacgcgccacccatgccaccagcatcggcgccgccgccgggctgctgcatctgcaggccggcctgcggcggcggcgcctcctcctcctccagtgggaggcgctcgtaggcgacgttggcgaaggacgccgcgatgacgatgaccgggcccgcggcgtagagcgcgccgacgacgttgccgccgacgacctgtccctggcccccggcgaggaagatggtgaggctggtggcgccggggggagccggcggcgggaggaaggagcccgagagcgacaggatctcgaacctcccgtgcagcgacacgacggcgcccgcgggcgccgacggctgacgcagcgtcacgttggtgaccacgccgctgccgctcagcacgcacacgccgcgctgccgccggcgcgcgtacgtggagacgcactcgaacacgtcgcagccgctcccg

SEQ ID NO: 47977 - DNA, 3088 bp, Oryza sativa
gccatgcttctccactagctcatgtactgatgtagcagcagcagagcgcctctctagctctagcaaaaaaaatttaaaatctaaaaaaaaagtggagaaaaaagagaggaaaaaaaccgaattggaacaggggtggtgttttgtttttagggttaaaaggcggtgttggaaaaggaagcaatgatttttaaagtgggggagttgtttatactcctccttgtttttaaaatttttggatgcacagagaagcaaacagagagagaaattaaaaaaagaagcacaagagagcttgcatggaggagagaacaccaagagagagctattgctgtttgatctgaattggagaagggagaggagaggagaagggagaaaggcaagctatgaagaagaagaagaagaagaagaagaagaagaagaagaagagagacatgcacaggggaaagaggagagaaaagggagggcttgagatgttcttccaaccagaggtaggaggtgcaacacataaaataaggggagaggtgccaagggagaacaaattctagtgtatgcttgcacagctaagcagaggagacctagatcacctcactgacatgtgggcccaacagaacacgcacacgagggagggcccacgcgtcagcctcacgggagctcaagcgtgctggtgacaagaggagacttcggagaggagacgaggagcgggatgaactatgatgcggaaatgtgatgcatgtcgatagtgatggctagcgtgtcatcgtgaccttttgctaattaaccatggttaagcggttaaacctgtggtttagggctactaatcaaggttagagggcgtccataatgcggcccctcgtgggggcccacaccagcgcatgccacgataggatcgtctgcggccatggttaggtctggctagctcttgagagatgcacaacgagaggtggattaattttgcactacttctacaataattggttctcgtagtctttgttaacaaattcaatggttaatttgctccaaacactgcggtcacaaagagttacatacgcccaacaggtagccagctgcctttggtatttgttactccgatttgaattttgataattatagttatagggcgtattttaattttaaaggtcttatcaaaatcttgccaaattaataattacacatggtgtataaaattctgccaatagattaattttgtaataaactgttttcatgacacaatataattagtagtgagggcttgcctttggtaaaatctatacataactttgtagcagtttcagttgacactttttacctaattaatttggtttacgaattatattgatcacgactataaatatattccaacattaatttagcttatctaggtagctatacccatatgtatatgctcatggagacaatacacgattcattcattaattcatctgtttgacatgtgtacatgtatacatgagagatgtgcaacaccctctaataattaacaaaaaaaaatgcccgcgaattgattgatgcatttctttaattggcctttgtcctttacaacatatttttagacaacaagatttataattgatcgtgcgtttatagtttactttcaatatattacaaatgtcaagtcaaatgaatgacccacatcatgctcgcgctcaaactgaattttatatgcaatatcttatgatcagttcttgtaagcgtaacctgcatgccgtactttcactacgtctgatcgatgaccacaaaactttggacactagactactttttaccatcttttcacgagagaccaattaacacatgagtaacctcgagcgcaactgtttccgaatattaatttacagctttttaaatgtgtttcgccttggaagaaacacgaccatgcatgcacatgaacacggtagatttcaattctgtacaccgagacgcatggaataatgcataactttttaaggaaccaaaataaaatatatctattttttgtaaaatcaaagtgtttttgattccttattttgtgatgaacaattggcatatgagattattggttttgatatttggaatttatttgtgaagtggttacggagatgattggaattttactggtggtctacaggaactgttgtgatgtggtccggtcagaccaggcatgtgctgccgatcagactggcggcaagcccgcggtctgaccggccgactctgtgtcggtttcggtttcgggttgtttgtttggatatctgtgattgtttcatatttatggcttctagatggatactatacgtatgtaatactgttgtttgctaataatgagtcaagttggagatagcttggtctcggaatatggtttttttgtttgcttcatgtgtaggtgacttgatgcctcaggagagtattgccggtgatagatcgggagtcgacttggggataaggcgatgtccttgacgatcagatatcatgcgggatacttaggctagagttcaatgcacgtggttggtgaagattccatatggcatacgatggaggtattgtgtgcgtatgggatgcggagtcgaatttggaaggagtccaaatttggtatgattggagtttgtaaagtttgtttcttgtgcgagaaggtttcctaggtggtttaggacttctaatatgagtttgattcgtggctttaggctgcctacctcatgtataaatagagagggagcatgaggctttccggtatcgcttttgagaacaactgagttgatagtttagttaggatttcgagtttagtcgagatttttgtaagaagtgttgttgttgcactttgtaaacacagagagaagtaataaagttggcatctactttgagagttcttcgatttgtgtttcatcgggttcagcggtctaaccggcgacacaccggcgatcagaccggtgtcatatctgcggtcagaccggcggtggctacaagaggaatctgctgatcttggtggttcgactggacattctacttcggaccgacgacttccaggcggtcagatcggcgcaacacctttggtcagaccgcgatccgtcgaatttaagggtacttttaattccgcaaaaagttt

SEQ ID NO: 47978 - DNA, 1795 bp, Oryza sativa
ccgtctataaatcatatgtcgttaacttttaagagaataaggacagacgtcgtggatccatgcctggtattattattattattattattattattattattattattattattattattattattattattattattattattattattattattattattattattattattattagagatgtgcttctacacttctttaaaaaaaagttgcacgaaaatcgaagcacatcaatggctgtgattaaaagtgggttaacagtttaatcctcattagtgaggggtattttcgtccatagaaatttcagcccacaacgatatcgttctctcctcgtcaggcagcgccactgcccgctggtttcctctgcaacgtaagcgccacccgcttcacctccctgccctgctagaccaccctaactagatcccatcgatggatcgatggatttgcggtgatttgagttggtagttcgctcgcaacacgatgagcgggagctccagtgaataatatgctgctccacaatgaagatcgtcgccgccatgctcaacatgatcagcctcgagcacgaggactatatatagcaacgtcgacgtcctcatcaagggccaccacctcgcgccgtcgccactgccacattgagcacgccgccgtgccggcagtagtcaggccaccccagcgacagctgcagcagcttcttcggtgccatgatctacacctcatttaaggccaagtcgcaattcgattgaaccaaagtttaaacagaagaaataacacaaaataagcttgtgcccttcgtgctttggcttgtttgatatttgtttgtctgcaatctgcaacggcaagttcgatgtgacttgtgatggtggtgagctgtaaatgaacggggtagacaatggtatgcagatacttgttttatgactactggctgtgagatggacaaaatggagcgtcgtgctgcaccgcgcgtcgagaggaagaagagggcggagcggcggcgctgtttgcaagaggaagccgggcaacgaggggaggaagagggaggggaggtggcaggcaagggaagcgcgggcggtgcttgcgaggctgaggagcggcgctacccaaggagagagcatcccggactagcggtcgtagtcgtggaggaatcggcgtcgccattggtaatttggtatcgctgcagagttggaccggggctcaaaattccatggacaaaaatacccctcgctaatgaggattagagtgttaatctctcttttaatctcatccacttatgtgctttgattttcgtgcaacctttttttttaaagtatagaagcacatctcttattattattattattattattattattattattattattattattattattattattattattattattattattattattattattattattattgttgacatcacaaatctatgagcaaatataacctctgttcttaagaacgtgtggatatgatggagtatatatatacatgcacacaattatatatattcaatttaatataataaacacataattgtatcttgatactatatactatatggcaactggatcaaaagattacctatatgacgaaaagtaggtctcaagataacaaaacattacattagtgtaatgacaatacatataattacaagctagctagtcttagttaaattaactgaaagtacaactacttaccacttttatatgcatcaaatccagctatatatatcctcaaacactcactagtgccttctcctagtggtgcatgtatgcatgttcctcaattt

SEQ ID NO: 47979 - DNA, 1081 bp, Oryza sativa
aaagatatgtttatactccgtcctaaaattagtgtgcagttttattttaaaacggagggagtaattccttagcagaaatctcatgcacggcacattaacttgcagacccacatgccagaaggaaaacaatgagaagtaaatagtgataatttttggctaatgtatggtgaagcgctggctggtagtatttcagtacttgtatgctactagcaatacgtacctctcgatcccaaacttaaaaacggcaagttgtgcctggctaatcagttctcgacaagtatccccatccagggagccgatcgatcgagccgactgtgcagccgcgagccgacgctacggctcgcccccccacgtgcccggtcacgtgcggtcaagtgcgcggctgcccctaggcggtaactcggcgtggctgtcggccatggccgagcaacaccggagagagagaaaagagagagaagatgagagagacgagctcgctttcctcggaaaccacgctctgcctcgctacctccaaccccagcccatgcgtcccactgcacgtgggccccaccaccacagccccaaagcatggcgcaagaaccctaaccctaaggactccccaaaagttgttgcagtgagacaagagagaaggaaagacgaatactgcaggatatgctttgtagtatcagttcgttctgaatgaacagctgcaactattgtgctcgttttaattaatttcttctatatctgtttagttaattaattaccttctgcgctagctagaaagtttcagtgacaagataaagttaaactgctttccagaaaatagttaatttacttgcgcacacgagcaaacatatactagtactagtagctaacacacacgtcgatcaatctgaagtctgaagatagttaaggcagttaataatgctgccatggatcgatcataaattatgctgtccatggttgtacgtcgatctgttagtttatgaaaataacatatactcctagagctatgctacttgcattattatggtatcgtagattatttttgtctgggccgggggttagtggatataagctatctcttcgatcggaaagt

SEQ ID NO: 47980 - DNA, 2144 bp, Oryza sativa
aattcgctgtgtggtcagccgcctggtctactgatatggtgctgcggcatctcgcagcgttcacactgcacaggtggagttctgcatcttccctccgatcgcatgtgccagcaattccatgagagtccatgcggcccaaaacatcctcaagtggttcatagcgtaatcatgcgacacgtagcaggcgtttctaattttaccatttccaaaatttttaaatcacatgtgctaatttttcaccaggttgtaccctgtcggatggtttggaaattctataaatactttatacatctgtattactagaaacacatcaccctatatatttaacacgtatttaaactcgtcatagagcttatactgtactctgaacggtcgacatgcatgccatcaccactgcgatcctttcgctttgcctatccttctcgcccactaccaccgctatgggtgtcaggcctatgacaacgtcatcaacaagtgttacatggatctcctcggcatatagatcacgtgtggtgtaattaaagacacatgaaaagagctaaagtcggacaaaatgataccaatcggaaatgctttaagaaatgaaaggaaaagatacggtaactagcaaatgtgatagatgtatcggcatggattgactgagtattcaactcttcaacggattctactatcatacatatgtctgtacgacaaacaacggatacctcgaccaaacaggatgacaatcgtgataaatgcatcggtgtggatcaagtgagtattcgaggccgtgtttagtttccctctattcccaactttccatcacatcatatcacatgaaaattttttctacacatataaacttttaacttttttttcaaactcctaacttttttcaaactttcaacttttttcaggaactaaacacacccgactctccaacatattctactgtcgtacatgcgcatgaacgatgaataacgaaacatatacgtacagcttttgtcggactcaaaaaattcgtactctcttcgtcaaattaaactaatctagtataagattggaacattatattaaaatatatttattttatatcagcttattttggaatggttgtattaattcaattcggataacatgacggaggactgttatcgtcgttggttgcatcaacaaggctcaacctaaaagcacaattatctgttgcagaaaatcctccaccttcgcatcctgtcctgttgagacctgaggtacccttgcagtggtgcatccccctttctttcccacttgaccaccttgtttgattaatcgcttaaaagctgcaggtgtactaatgaaagtagtactagtatacttaaccaattgaccatactcttcctagaatggcgaagagcaaatttaatagtaaagctcactgcttactataaatttagagttaacttatataataagttagttgtaaggttaactttattttttctataaggtaactttattttttccattctctctctttctcactccataaatttaatgcatattttttggaggttgtgtggagctaactcttgcatgagagccaatactacccacttttccttatctctcttccacataaagtatatagtttgcttatagcccattattatccttgctcttatgagggggggcgattagttaacgttaagcacgcttttacgagcgagaagacaggctgtcacgcttttaacagcaaacacatcacacattaatcaattcgcctccagcaccaagccaaccgaggctcttgggagttgggagttgggactccctgtgcctctcctctccaccgcaacgaccacaaatcaccatctgctttctagtttcttcctgaagttctgcgtcataaaggcaaaaatccaagattgattttggatgaaaaagactgcagtgcttagcaagtgttctgttcttggagtcgcaagctgcggctagctagcaagcaagcagctttttttttttcgcagatcttggtgaagagcctgttcttccatggctttcgctttgtgaggtaacatgtgttttttacattctggaatatgagtaggagtatatacttgaaacaataaggtaccatggcatgcttgtaaaatttctataccatagcaccgtcagatttttatggt

SEQ ID NO: 47981 - DNA, 1731 bp, Oryza sativa
gaaagatgaatccaaatttgttcatccatggcgttgtcaatggcacctacaatgcgcccttcttcgtgacacgattcaaggaggctttgttctactactcttcactttttgatatgcttgaaacaactgcttcacgggtcgacgaaaacaggctgctgatagaaagagatctcttcggccgggaagctcttaatgtggttgcttgtgagggcactgagagagtagaaagaccagagacgtacaagcaatggcaggtgaggaacatcagggcaggcttcaagcagctaccactgaaccaagagacggtgaagaagcaagatacaaggtgaagaaatcctaccacagggatttcctagttgacgaagataacaaatggatgctgcaaggttggaaggggcgtatcatctttgctctttcagcatgggaaccaaactagcaaactgtaaatatgactaactcagctgatttcttctgtggaggtaccactccattagttatgtctgattcctatttcaacgaattttgacctatttctgggcaatagaagatattggattttgactgggctagagtatactttggatgagtatctgacagaaaaggatatacttctctctaagcgtgtgtgacctgtggggctcaaaactgtactttgaaaacacaattacacatcatgcatgtactgttcacatggtccagcctgggcaaagggttaaagcctacatggtgaattggtgatataaataacgaaatggtttatctgcaacttgatatgtagtagtacagcgtggatgtaaccaacttgcaactagttcaatgaaccaaaagaacagcacaatttatccacccaaaaacaaaagcccaacttgctcataatgtgctaatgtattgttcagtgcaatgcttctgaattcaagtggcgcctcaacatatttttcttctgtacaacatgagcacggagcgggcccagactgttttttcttctgacaattaatgtttgcattgagaaacataagcgtctcacactctcactgatcccaaatcgtcaaatttgatgagaggccctagagatccaaagaaagagcagtatattgatccattgcacgctgcctttccggtgttcatccacaagtccacaaccccccgcaccatcgctgcgttactggagcacgaatcatgcagcggagcggacaggagaaagctagctagccgcgcgcattgccggaaaacgcgcaacttgattttactttgggtggcagattagctgggagcatgtgtgtgtggagtaataggaatgcatgcacacttcaattcataggatttttttcatgaggtttgtgtggatgaaaattttcccttgttttctctccacaattagaaaggaaaatttattttggttttcttatatctaaattcctatgaaccgtatgatattcataagaattaatccctagaaatccaaatcctttaaaattcctccaaaacgattaggccctgattgttatctttgtatccaacttctgggccgaactatatctaggccctgcctcaggtggaggcctttctgcataaaaacgcttggatttgcaatacattcactaggctttgaatagctgatttccaacccagacaccaaagtactaatacactggtaaaaactttactataactatattttttatgccactgacctttgccatatcaataatgtattataaatattttatttcc

SEQ ID NO: 47982 - DNA, 3511 bp, Oryza sativa
caaatttgcttctgtttttacacctctctctttttttaaaccttagccagcttagctggttttatatttcataagataagcactgtacaaaatttacacctctctcaacaatatatttcaatgaaaacatcaacactgttacaaccataactgtcagtctgtcacattaccatctagaactaactctagatgaaaagcacaagctcttgcatgtttagttaagaacgatgcttgcaggacgtacggactctccctagtgattaggacacaagaaatgcccttagtagtgtagtctcccagacaacccagcggcatagtttcgcaacatatgccggctaaaactatacagaaattaaaatgcatttgaactttagatatacagacacgacgacaccaatggttggacttttcatccaggctcgacagagatgttatgactcatgacaacgttagctatatgcaaggacaacgtactgacatatcgtatacacatgcataattaattgcgtatactctctgttgtcatgtgtgtgttggaaaaacggggaacagattctgaaaaatggctgtaacctcattggaatgaccatttggccaatcatatcttccgttctagaagcagaaacaatgaaaggttgcaagcttggacatgcgaggcgaaggaaccgaggacaagagtccataggacaagatgcagacagctagcttggataatatatagagttgaggagcttaacgatttttacctgtttggttgtttgtattttacttgagattcactcagtttgtctcactgtcaaagagttcatgacagctcaaagtcctacttttatattagcatcacacattttactaacagacttgtagcttacttcagtttcctgtctgaaatttaagtactactagtactagccatataggagggaagagaaatggttgtcactgaatttggttagtgcataagaattctgtctttttgtttactctaaaattgaatccaacataaggtgcatttgagcatttggatagatgaatatactacaagtaaattcaatgcgacatatatttgtagcctctcaggtttgatacactgtaatagttggttttgcaattatgtgtcaatcctgctaaaacgaacttgcatagatggattcagagaatcagagatgccgctgcgtcctctatggtaccagtgtaatctgttagctactccttggaagtacttcacccagattccagatcgacttcattgatcccaaacttcaagttcaaggatgcatcacagaagccaatgcaacacaactgtgtcatatgctttttccttggcagatttttgctgattccatcagcagaatcaactcagctcccagcattcaccaggtgatagtgatgcaatccatgccagtttgcagcatacagctattctgtgtttcacacttgcaaacatgagcaaaagcacacaactcggtgagactaccaatgctagccccctcctcattttgtctcgccgaacccggctcaagcgtagcacaagatttgtataaatactcggcgaagaaattgcacgcagttctcgtcagtgttcgcgccaaaacttggttaaaaaaaggcacacgggagctgaccgacagaccggaaaatggcgccaacaagtagcactgaggaggtgaagcacctgacgcttcaccacttgttgaagcggcagcaccggctcaagcccgccgccgtggtgtggagatggccgacgtcggtggtgcccggcggcggcgccgggcggccgccggtgcccgacgagcagctggcggcggacgacgtggacggcctgggcgggacgtggccgccgcggtcctacacgtgcgcgttctgccgccgcgagttccggtccgcgcaggcgctgggcgggcacatgaacgtgcaccgccgcgaccgcgccaagatgcgcggccacggtctccacggcgccgccgggcagcagctcggcgcggcggaggcgcctgccgccgccgccgccgcgaggacggagtacgccgtggcgctgtaccccatcctgaactccggcgcgggcggcgcggcggtgcgcataccgcacggagacgtgctgctctccgcgcccgtcgcgctggcggccgcgcgccgtggccatgatcaccggtgcatcgatgtaggtgacgacgagaacgacaagaagattgacctggagctgcgccttgggtggccgtgatcgatataccatggacatggagacatttttttacagtcgccatgatgtgtgaatttctttccccaccattttgatcatttttcaaataactcgagtgaaactcatggtttgctactgcatactccctccgtctcataatataaggaattttgatattttgcttacattttttgaccactcatcttattcaaaaaaaaatttatgtaaatataaaaaacgaaaagttgtgcttaaagtactttggataataaagtaagtcaaaaaaataaataataattccaaatctatttattattaaaatagctttgaaaggaggcaccacgttgattgtggaggctagaaattcccacattaatcagagaaaaagaaaaaaagaaaaaaaaagtccaagtagaaatacaatctaaaaatagctaaaattcagaattaaacataagcaatattgaaagaaattttcatataagaacccaatacgagattaataaaaaatcgaaataaaaataaaataaaatccaaaattagaaaagaaaaggatagtccaagtagaaatacaattttaaaatagctaaaattcggaattaaaaataagaaatattaaaataagagtccatataaaaacccaatacaagattaattaaaattgggaataaaaataaaaataaaatctgaaattagcaaaaaaagagagttcaactaggaatacaatttaaaattagctgaaattcggaattaaaaataagcaatattgaaagaataatctatataagaacccaatacgagattaattaaaattcagaataaaaaaataaaataatatccaaaattaaaaaattaaaagagagttcaagtaggagtacaatttcgaaacaactgaaattgaaaataaaaaataaaaaaattaaaagaacacaatacgatattaattaaaatttaaaaaaaaatctgaaattagaaaaagaaaaataagatttcaattaggaatacaatttataaatatctaaaatttgtgataaaaataaagactattgaaagaaaataccatataaaacacatgacgagataaattaagtaacaggcctataaaggagtaaagtggtgacatataaaaactgttaataaaacacctaatagaatcctaatgacgattaaaatgagggacgacaggcaggccgtgaagcaaacgagcgaggcggttgccgggacttctagaaagtaaaaagaataaaccccattgataatcatattcgatttttaaatatctctatgacaataaaaaggagaagcagcagg

SEQ ID NO: 47983 - DNA, 2095 bp, Oryza sativa
  unsure (1)..(2095): unsure at all n locations
cccaaacgataattatgttcgatttttaaaatctcaatggcaataaagagaagagacagtggaggggccatagaggagtataatggtaatgtttgacgggacatctagaaattataaaaacgaaacccaacgtgacaataaactctaaaaattataaggtccaatttttaaagattctaaggagaatgaaaagaaatagtggtagatcgagcaagcaaataaaaatggagatgacataaggggtagcaactggtgtgacttaaaaaaatatataattagaaacaaggggatgataaggtttggtctttcaaagtcttaagacaatgaaatagctatttaataaattttaagtaaaatcataaaaaaatatgattttgtttcggtgctaactgcgtaattgtacgggccacccagctagttttttttaataagacgaatggtcaaacagtgtaagttcaatgtcaaaatcccttatattaggacggagggagtgcattagtaacggtgagacaaaatgaaatttatttccattattaacaaagaacagtgagaaaaaaatggtgaggcaagaagagcgaagaagaaagggacaaatatgtaggcctaagcatcgcgagtgatgtgcttctccccatgatttccgacagtttcgaggcggcgccaaggcccaaggattcctatctgaggattgccggtgaaatatcagtagcatacatgatacatataccatacattttactcctatcatataataagaaaaaaaaaaggaataagttcacttgaacttcaaccgcaaaaccggataggatgcctatccgaactattaaaaccggtgtaatttcattccctcgacggttttggaggatggtttcgctgacgtgatgcatacgtggcggtattgacctggtctttcttccacgtgacgttgacgtggcacttatatgacattaaaattttaaaaatatgtagctccagaagagagcgcagcagaagtacagcgccaagcagtgacatgaagcagcactgccacgacgagcatgtgcgcgtggtcgtgcggccgcggtgcgccgtccttgcagtacaccttgtggatctcctcgcggtcgtcgccggtgtcggggcgccaccggcggagcagcacgaggtggtggaagatcttggcgtgctggtgcaggcacatgatggtgaagagcgtgttgaggttctggaccatctggtcgatcacctccgtccacttcttccgctgctcgtcgtcgggatggtggagtcgagcatgccggtcatgagcatgaacagcagcagcagcccggcggcgacgaacaccaaccaaatgatcatggcaaagttcttgggcttcctgcaccagctcactggaggcgccgacgacggctcctccatggttgacatgcttttgcgtacatggtgcgatgcagatggcggtgacggcggcgttgaacggcgtcgggctagcactgcaaatcccggcgatatgctccttcaacgccgactgcgaatcctggcaactacgcggcggcggtgctggcagcgtcgacgaccaccaccgccaagccggtgcggcaagagctacaggagttcgcaagggaggcgaagggactcacgggctcattccccaggtcggcgctctccttcacggcgatgtggctagagctcgttcgctgccgtcctactcctcgcactccctagtggcctagtgacccacccaccgccgccaagcacggcgccgcgctgctcatggcgtcgtggaacccatcgtcgacgaacggtggtcggcgtcctcgccgagcgcctgnncggcnncnancnnnntncnnnnnnnggggggggggggggggcgccgccgtcgaggcggagcggtgcaacgcggcgtccctcgcaagggcgctgtatcgccgtccccatggtgctgtccggtactgagagaagggaggaagaggggaggaagaagaagagagaggatgatatgttgggcccacatgtcagtgggccccaccttttttatgtgtgtgaatgacaaacggatcccacatatacgtttttaattcaaatgacatctaagcgtcatgtcaacccacag

SEQ ID NO: 47984 - DNA, 2326 bp, Oryza sativa
tccatgaaagctctcctacgtgttccctcatttgaggcccaaaacacaacagggtcacgttaaatcacagcccacgccctactctcagttcaactggcctcgcagaaaaatgcaaatatcccttgttccaaacgggtgcatttgcagcgtatcgtgaattcgtgatcgggccgtgcagcctgcagctctcggcgctcgatcgaccggggccaagagggtactaccagcctgcgctgcacgtggcgcacgcagctaccgctggagacctggagcgtacgcgcgcgtgctaggccggggccaacggcgacatccacgcatgcatggcatgctgccactagctgctcgaccggtaccgcacatacacgctcgcacagtcgcacactcgcacagtgtggtgaactggtgacgctgagatgccgtccacgcgcgcgcgcggccgcggggaccgatagatcgatcgagatgccgtacgcgcgtcgactgacaccgtcgccgaccgtgtcatcacgattcgcttccagttgagcggcgccttctgcaggcgtcggcgcacgcgtacacccggccacccgcgcgtacgtaccgtgccccggttggaccgtgtccggccggttggccggttttgctccccttctcctgaaagaatcggtgtgcgacacggtgcatatataagtgggggtgggttgatgggttcatgcgtacgtacatgtgcatggcaagctgcatgtatcgtactggaggtaattaattagcggacgtacgtgattatttttcgatcacatgcatacaaagctttaacaacgagcaaacgcaactgcgcaagccacgtaccactcgatcgagtacctttaatatatagaggttatagacaaatccaacgaacctcgtacagggagctagtttctgataatccccggaaaagctggatttttcaatttttatcttctattttatttactgtattttgtacttacatcatcttagaattggtgtaaaaatatatcttgtttgagaggagttgaagatgaaagaagttgtaactgttagaaccgctctccccgataaaattgtagtttttacgaacataaaaaacagacgtaattatggacattaagatttgaactcgagttatacttccatagctgcattgaatccaaatatagcaccaaacgatgtgcttttgcgaggatttggatatcgtctctcctctatcatgtctcatctccaactacggcaagcttcatccctcgatcactgcagggaagagtggcagaccacatgatctgtggtgtgcatgcatccgacagcgagtactctcgtgaacctaatattgttttcatctgtccagcacctacgtaaaacattaatttcctgggtgatgttacagcttgcaagcactagcactaccagaaaaaatatacctaaagttgggtaacactgaagaaatatcgcgtatgataattacgaacaaaagtggggtgtaatcaaacacaggactatatatagggatatccggcaactacgtacactcgcaagtacatctcaagtgtcgtagaaatctcaataagaatacactgaagagagtacttctttttagaaaacaaaaatataaaacggccggagctctgcctattcgattgagaagagtattgtgcgaattacgtgcacaattaatcatgccaaaacgattaatttacaattactgaattacatttacatatatatcgaactgccaaaacaatgtcttttgcaaaagaaaatgttttaaaaaaaatcatatcactacattttttaagtttaaaataagtaatacttccgatccgttccatattataagactttctagcatcacacacacaaaaacacacacacacatatatgaatctagacatatgtgtgtgtctagattcattagcatttatatgaatgcgggcaatgctagaaagtcttataacctgaaacagatgtagtacttaattaatcatatggtaatggatcatatcatattatgtatttctcaatcttctcctttcttcttcccttaaacacacccttataattactatagtgaacaataaatacagtggtttgatatattggagaaatggtattatgccttttggaccaactcagtgaccgtacatctggcacagggtattttcctgcgcatgtacactgtgtgagtttgcttttatgtaaaccttgtaataattggttgtagctcgtgagcaaagatcgaaatatttcattctatcatcttaaaataaaatattctggcgcaggggtttttcctgcagtaaggctgtaaaacccggtcagacccctg

SEQ ID NO: 47985 - DNA, 2683 bp, Oryza sativa
cctgatgccgccccccgtgcctggccatcgacgtcgcagacgccgcgcgcgccttggctgccgtcgccgccgccactgccgccgcgcgccttggccgccgccaccgacgctgttgcccactggtggagtcgtggagatggtggctgcctgggtgggtggggagagattgagaatagggtggggaggggtggggaaattagggtttggatgtatatatatgatagactagatgggccttttgggcttacaacatactatgattaagtctaatatacatcctcggggctccgcgggtcacccgcgggtgaaacatctcccccgtcccctcctcgctcaaatgcggggccccaaccctgactcacccgcggggtctgaaatcgcccctgcccccgccaccgcaggggacccggccccgcaggggaaattgccatccctaatcttatcgatatttacactactacttagacctttgctctcgtaatatacaatatttaagaatgatctaaataatttaatgtcactcatgtatttctctttcaaataactatctcttttcaattaatgctcggattctatgtccatatatatagtatatatctactatagtatatagaagtatttttgttaaataatcaactaaatatatttttaaatttatagctattatacttgactagaaaaaatgcacgtgcgttgcaataggtaaagatgttttttcagtgatacagcagctattaggagttgggcaaattgaaatatagtatcgatatacattataattgaaaaagttactaaatattcttccttggttttgagcgaaaacccattcattctttccttttcagccccaacccagtccactacctccctccactcggtctgcatatcttcgggccagcacacgagtggaaccgcattcccagctcgcacaaccaactaccgtattcaacccatggaagatagacccgtgcccgtatgaaacccgagctgatcccacatcaaattcggttgaatctttctcgatctcccaaaattagttgagggattttgatcacacgatatcctcttttcttttttttttcaaaattgaagcgaatctgcaaaactcaagacaacaatggttggggaagctccccggccagccatcattggcgaaggttaaatggagattaaatttggggccgaattaatagaggacatcatgagaaaaatgataaggagcgggaattcgattttttaattaattggaggatgaaacacacgagagatagattgaagcaacaacgatatactagggctcggcccggcgatggctggaggtgcgctgcacgcaagtgccgtggatataggatcggacgagataaaaaaacggcaacagaaaaaagaccagacaatcaaaaaccgaatgccttaccgtgtgcgcaccaaaaattaagaacccttccatgtgtgtaaaggattattgataaaaaaaaaggcgatgaaaaaaatgaatggactacgataaatgaaaagccttatactattttctattaaatataaatatagatacagatataaattaattatgcacgaattattcgtcctttttccgaaccgccagccgctataagctcagcctaagaaacattaattaaatatccggcttctactacatccgtccaaaaggcttcgatataatcattttcctttttaacattgcactatagaaagagcttgccagattaaaattgctccagagcttatgcgcggggctggggtccaccggacagcgtccctcaaacccgaaagtacactggtaccgtggtacgcatagctggtgtgtggcccttgtctcctactctccttaccatcctcattctgtgcccactgttaatccatgtggctaggtacgtgcaccctacatcaattcttcttcacgtacgcatgtgattgtgtggcaccatcacataagcaactgccacagagctcagtactatcttaacacttgacagccactgaaaatatatcacttccagcaaacggcgctgctgaattagtcgtagcattatgaatactccctctagtaaagtaattgtcatctcagacaattgcatggttaaattaactttgaccactattttctattatagtatatataaatattaataaatgcacaattttattaaagtacattttaagattaatctatataaattgtctttcatgtttccaattaatgtaaatactttagaacttatctatagtcaattttttaaagtttgacatagatcttatccaaaacaataattatttttaatctggagagagtagatcatttgcagataaaaaccgatagtttatatatttgattaaaaaattaatatgatgtgttataaagctaagaaatagtttgaaacaagtaaccagctcagcgataagatagaagaggttttattttaaaatgatatttttgaaaacgtgatgtaaataattcatcacaataatcggatgataaactgaagcatggagcctactgctagatggagccatggagaagccaggtgaattatcaggagagagagatagaggagccatggctgtgaaagaaactcggcgacccgacccgacccgaccgccatgttcggtcattcccaatcagagacgacccctcatcacaagatgctgccgtgtggggcccccc

SEQ ID NO: 47986 - DNA, 875 bp, Oryza sativa
atcccccccccccccccccctgccgcggtgactttcgcttggcataccataccaagaaccggacatcaccacacaaactcgggagtggattcttatctctcgagtgaatatcccctcgtatacatttttcttttaaattcgatgtaaatagttgtgaaaaaatctaaaaaaaattgacaatgtagagtataatgatacctaccagtccaccaaaattcatgttcaaattcgatctacacatcgagaaacaaaaaagacaaatttagatataaacagtacgctactattcatacgctgaatttgtcttttttatatctcgacgtgtgagttgagtttgaacttaagattttgtgaagttgtatatatgtgctgtatgaatgttgtcaaatttttccagaatttttcataaccatttagatggtttttgagcaaacgagggaacatcccctcgagggattagaatagtttccccacaaactcatatctcaaacaaagctaagaaaaaagaaaaaaaatcacagcagaggccagagagagatgtgtcgctgatgaaagataagtgagtgagtgagaccacacctctttcgtctcctccactctcctttccgcggcttcccacccccagtctctccctcactttttcagccgaagcagcagcagcagaagcagaagcattgtcgatccaccacccatctctcctcacgtggagagagagcttcgctggtcgctgctagctagctccccgcgcgcgaagatttcaccgcgacgacgcccaaagaaagcgagcttttggtgccaatctcttggagcattgcgtggtgcgcactgcgcagcaggagggatcgatatatccacggtctatctgcccccccccc

SEQ ID NO: 47987 - DNA, 19795 bp, Oryza sativa
ccccccccccccccccaaatcctgcctgcaattgcgacgcacgatagagaggagggagggaggcacagcggcaggcggcagctagagcttagctcctgcgacgtccactgctctctcgctctcgcatggatattattgcccaatcttgcgctagctagcttcctctcctccctcccatgttgcgctagagacgcacgcgtagcaccaacgcgagcgccaggccgccagctgcttgtggtctcgcgctctctcactagctagcttgctgcatcctatctattctttcgaggaagaggaaggcaacaagcttagcttagctaccaaggcaggcagcaagaagggaggaggaggagaggttgcatttgcacgtcgtgacacggacgagaggccacgcgcgggttcgttcaatcgggcatggcgcttgacaccctgtgcagcgccggcggcgacgtcctcatctacgacacgttcaacgcctccgccgcggcggcggcggcggttgtgccgccggcgagcttcctcttcgggaataataatgccggcggcgcggcggggacggagacgagggtgcaggtggcggccggggcggtgccggaggtggaccagctgctgaagcaggctcagcagccggggaggaggaagcggcggcggcgggcgaggagctgcaagagccgggaggacgccgagagccagcggatgacccacattgccgtcgagcgcaaccgccgccgccagatgaacgagtacctcgccgtgctccggtcgctcatgccggagtcctacgtccaccgggtacgtacactagcacttactaacattctacatttcctgtacgctgaacttggaactctgatctgaggtgagaactgatccttagggttcatctccctagcttgattctcatttggacattggattttgggttgtgctgaactggagttggcaagagaatgtttcggcgagaagcactgtgatttttctctagtataaaaatcgtaccattatgtacccatccaactttttttttaagaaagattcgttcaacttttgtgatgtttaagcacttttttttttgctctttctcgtcaactgaatattgaggaatttccaggtctctttcatgctatcccaataatgaatcattaattcctccatggggcatacgttcctcggccactttgtgccattaatgtgcatgccccctccatgtcattatcattgcttgaatcatagtaacattattactgttctagtttactctcgctgacacaactgcttcgctctagaatcgcgatgatgctaggtatgctaggttgatttgatctgtcgtctctgcacttcactgtcgctcacttgcttgcttttaattggtcggcgtgtagggcgaccaggcgtccattgtcggcggcgccattgatttcgtgaaggagctcgagcagctgctgcaatccctcgaggcgcagaagcgcacgctgctgatgcagccgccgccgccaccgcagcagcagcgggagcccaagtgtgatgccgcggactccacgagcgcggccgatcaggagactccggcggcggcggcggcggcggcggcggctgatggaccgccgttcgcgcggttcttcacgtacccgcagtacgtgtggtgccacaacccggcgcaggacggcggcgggggcgggggcgcggcggcggagaaccgcgccggagtggcggacatcgaggtgagccttgtggagacgcacgccagcatccgggtgatggcggcgcggcggccggggcagctgctcaagatggtcgccggcctgcaggcgctccggctcaccgtcctccacctcaacgtcacggccctcggctcgcttgccctctactccatcagcgtcaaggtacgtatacacaggagtctgctgccaaaaaaattcctccgttttcttgctgaaatatggcccattgttgcttttgcgtttcctttttaagcataaaccgtcagaaaaaaaaggctgagaagtttcgtcatccaagatacatactccacataagatacgcatgagatgtccgcgagttagattaataacacgaataatctataatctacttgctagtactagtagtagagtacttcctccgtcccaaaaaaagataaaccctagtttttatgtccaacgtttaaccgtccgtcttatttaaaaaaatatgaaaaaaattaaaaagacaagtcatgcataaaatattaatcatgtattatcatctaacaacaataaaaatatgaattataaaaaaatttcatataagacggacagtcaaagttgaacacaaaaacttaggtttgacttttttttttttgaacggaggtagtacatatgtgcagcacctgatgtgacaaactgaccaaccaagtttgcaagagagacagccatacttctgatcagctcagatatacaaactactacacccaaatacaaactaccaaacggattgtcttaggtggtgtttggttggagggactaaagtggggctaaactttagtccctctcacaaaagtataagtctctatggtagggacttatatttttgtgagagggactaaatttagtccctagttcccaaacacccccttagcatatggccaacacgactccacatgtgtacagatcgatgatgcgtgaggccatgagcctcatacaccgtgcttgcgtgtacgcggctcagctggcgctgcacacgtcttgacaatcatgagaggccatactcgccagccacacagggaagcaaaatcatctccatgcatctgttgctgcctatatagtgtagtacacgagaacaataaacgtgtcataaattctcctctgttacccatcgtacgtagaccaacatccccgggggtattttactatactagtagaggctattgcatgggtgatcactgatcagaattgcgtctcgctgctgctgctgttgatgctgctccatatctgccatggccgattgcttttgaccagagattccatggcggaaaggccattgcttcccttggccccttgggtgtgttctttctctgtgctctgtatctgtggtacagtactacagtggtaagagtacgtagctctgaacttgatgtgccccagtcgactggtgctgcactatatcaagccatggcacttcatactcacaaagggagatgcagaattttatatatatatgttttatactcctagataggtttagagagagagggagggagagagaggacgatggacagcactgtcacggagaatctttctgctggggagtagattgccaaggcgaaatctcagcagaaaagaaaaaaagggctacagagttttgtgtgtcattgtgtgctgctgccgccttttcttgcgctgttttatttacagcagagaatctgcctttacgaaacgatcgctctattgaaaagcgtcgcctgtgcctcgcttttttcctcctcggctttgtgcttgtggagcctctgtgtctgtgtgactaggcgatcgactcgtggtagcctctctgtctgtcccgtgtaatacctttgcttatcaatcgccgtttgatttccctcgaatcgcccactttgccttgcgggcattaatttgtgtactttgtgttgcgttggccggatgtgaatgtgatttgtggcatcaagcaatcctttgatttttgtgtgtggattttgcatttgcaggtggaggaagggtgcggcatggcgacggtggacgacatcgcagcggcggtgcaccacgtgctctgcatcatcgacgccgaggcggcgtcgcagatgctgctcgccggggaggcctccggttagcgtggccacctagcaagataggcgcgcggcggcggccggtgtaacaaatctgtaaagtgtagcggatctcgatcgatctctcccctcccgtaggcgagtcgggtgatttgggggtcggtggcgtagggcaaaagcccgtgtaagtgcaataacatgcggcccgttgtaatcctagccggtttttttttttttttgccgtcgagtgtgtgcgttttgcggttttctcggcggaagtcgacgtggaatccgggggagtgagacggtgaagagagggtttttttatccttgcttgtccctccatgttgggccgactaggtacacagcctatgggcttgagattagcacatggtccggcccaattgaacacaggattttctttgagtagttggagtcataatcttagggcaggtttgacagacttaagttcaagtaaacggtttcagcattaccttaaaagaaaaataaactaaagagctggaacaggatttatgctgcttcacaacttcacttcagaaacaacttatgaagttaaaattagaaattggagcactgacaaacacacccttattcacctgttccgtgatttggctgatgctcgcgcctaatccacatcgtccatgtgggatcagagaatcatggtgaagagtcataacaaactgacagctagtcatgtcctcgctaattctccaatgcatacagatagtcatgtccttttagatcatgggaattaatgtgttcgaataattatcacacgtgttcacaatgtgcacattcttattcttgctctcatcaatttacactccttttccatccaaaccccaccaccggcctcttttccccttttgactttgtttttcatgctctctagtctcttccgccgaatcctgaattcctcacgtgaattcggaacaaaggcgcaaagagagcaaaagtaccaacactcaatcgtccaccacctgcattgtgttcaaaactcaccggaattaaaacaccatcttgacgcatctttagtagtgctttcgccgactagaaactatttcatttcagggcaaaacacaacaccgagtcaccgacgaaatcaagctctcgtctaaagtacaaaagcagcaggaaggcaggaataggatgcccatgctttctccattgccttagttgctgataaattaggaacatttctttagtgcttgcatgcacaaagatgatgccgccttagtgggaaaaataatggccacaaatcaacctcaataatgcagatcacttgcgagtgtgataaagacgtctacctagagggagttcaagctcattttcgtggaatactaatgggaaggtcaaagctacagcagttgcaagcaaaccagtttcattttgggaagccaacacttcaaataaaaagactaggggtgattagtgagtttgtaacgtgtgcaaagataattcacttatatttcatcaacctaatccccgaccacagatttggaatatcggaaacgcatgttatgcagggctaataggacctagtcagaagatgccagcttcatcgctgtcacagaaacttcaaccgaactactttgtctatacatatgcaactaggtagagaagcaaccgctggtctcctaaaacgaacagatttgggcaaagcagatgagagaaaaaacaaattccaatttgatccagactgaaacctgactagaaacacgcagtaactcgtggctaatttggtgtcagtttgcaactttgtcagtactaagctactaattcgtggttcacagcaaactccaacccgttcctgcaaattccatgcccataataagtaataggtccatcagtactatgatgatgttctaaacactgattctcctgggttttacctgaaaaaaatgattcttgtatgcaagaaaacaaaagctacttttttatgtcaaactcataggcctagttcacaccaccattccatttgatccttcacttttccgcaccacctaaatgccaatgcgtagaaaccaaagaaaacgcaaggtggagaaaagttttagccttggtactgaactagtgaactcacagaagaacaaactccacagaaaaattgaacggtgggaagtcaatgtaatgtataaaatggcagagcaaaagagagagagagagagatcagctctcaggtccttctcaactatgaacaaaagagacattaccaaccaagcactgcagaggatcgatttggcagtggcatcacatggagtgaggcagcagatcaacattatcacaagacgacatctccagattatgatgattgtccttgcaattttttcccattcgcatctcatcatgcaaacaaaggttgcttgtccagtatcctagagtaagaaaatgagaactgaccgcctcacattggatgatctgaatcttttcccctgccgctcttgctgctgaagcaggatctcccaccggagggcaatctcttccccggcagagcctccatggcgtcctgcagctgcaatgcacgtcggctgcggcctccccttcccttgctgttctcgccatggcaccgtcttgacgtgccagcgccgcctgcgaggaggccactctccctggctgccgtcagctcgtcttccatggattcctgcagaacgtcggcgatgcacatgcggttgtcacggtgaagatcaaacgacgacgcgcccctctttggcggcgagccttcttctctgatctcggctgcgccattggcctcctccatcccctctgcgacgtccttcgcatcgtgatcatcatcggcagtgctggccctgctcactgcctcctgctgctcttcacaaagattttccaagccatccatcaccacaaccacctcgtgtgtattgtcacctccagtctcgcctggagcacagccctccggctccggcgacgccaacccgacggtgacgaaggtgatgttggcgcggcagagggggcaattggagtgtgacttgagccaagtgtcgatgcattgctggtggaaggcatggctgcacctgggtagcagccggaggctctccccgtcactgaactcgccgaggcagaccgagcagtcggtggtgtggacgaacccatcaccgcgccggtacttgcacaccgtgatcttgttgatcagggtctcgtccagcccgctcggcggcgagacgttccatgactcgtggctcctcgactgcccgtggccgtggcggccgccgctaccggcaccgccgccataagcagcgccaccggagctcgagccgaagaccctccccctgagggagctaacggtgccacagtacttggagatgaaggtgtaatagctgacgaggaggaaggcgctggccagaacgccgatgattgcaatgacgagaggggagaagacagggccggaggagtcgtcggcgctggtgccggcgacgtcgaagggcggcggcggagggaagatgaagtagcaccactgggggcagtacatgctgcacagcccttgagagcaatctctcgttggctcgtaggggacccaagcaggagcagaggatgccattgcctcgtagaacacgaaatcgggcagctgcaagactgcaacaacagagagaaagggaagaactagaaagaagataggcagatgttaagcttcctcagtgctcggtctgaggctctgtgcaagtactagcagaggatctctgcaagtttctggaccgaatcattggtgaggagacgagggaaggagacagatgtgtgacggccgtgtatatgttcaatccatggtatacttgctttcttggtgtcgggagtcgtgagaggatggggagagatatcaagatgatgcctctggctgagaggacgagaggagtttgcttgttgcaaagcaaagatttttctccttttaatttgggtggaggattgagcggttgttgccttgtgttgggggacctctgcttttgtttttgggtgctgcaggtcttctttcttctcttttcctttgccccgttgctgttcctttcctctttaaattccaccgtctcttttgcaacaccgacacagatcagaagatgaagagaggatgtccagttggtatgattaaaacacactatagtacgaatagaaaacatgggcagaatagttcacgaatcacgaggaaggtggcgttgctgcatcagtgcagcgcagccaaacaaggttccactgtacgggataaatgacaactatcagtatcagattctaccagtcccagcgtgataaggtcatgtgcattctcatctttaactagcgtgacagaatttcattagtttggtgactgaaagctaaagtttactctagttcaaaatttaaagatgatcctgaatttcattatctggttcctaatttaaagatgacgtaggcttttgtgaaagagatacttgaaagcttttcttaagtgccaaagaagtaactttcatcaaagcccagcagctaaaacatcattatcctgtaagaatgacagagttgggactaagtagaacagtacaacttgaaatctcccgaaacaatctgatttgttcaagtaaatggagacaatgattactagcactatttgacagctttcgtcatacttatccatttccagcactaatactattgctgtgcccactaaagcgtttgatagcttgcattagtaacttgtaaaattaaaaagagaccatatacttctatttcaagtcaaagggtagcgttagggagattcagacggcaatttggatcgacaagcagaatatatgcacagaaatgcagtttagcctcaccgtgtatccacattacactaaagaaaagggaacaaatcaagattcaagacaaaatgcattcatgaatcacatgaatgtaattttattccagataattaagccagaacaacaaacatggttttatacagaagaaatcggacaaaaggaaatggatatgcagaaatagtttagaagcaactttttttttgaacggaacaagcaacttttaatacgatagtccccattgtgaagaacagacagatttgatatgtctaattatcttctttcagtgatcaaatcatcacttccgtatgacgctacagcaggaataacactgcgtgatacacataggaaagagaagtgcatatgtagataaaggaaactgtgcggtttcattctaatactaaggtctattttcctgggttatttacagaggactatcaaatcaagttcattctcactccttatgagggatgaccttgagaaagaaaattatgtttagatttctctaagatgattaactatttctcaaaaagaacatttgcttcacactacaaaagccatatttttaacccttttgggtatttttaaattctacatctccctcgaattgaacatgcttaccagaacatgcaaatagatcaattgaagttttgttgcagtcagataaagtggtggaccaggtaatagaggaataggagtatccttttcttttccaaaagtataatctcactgatagggatgactttttgactcaacactcctatgaagaaacttaaagaaatctcctggacatatttgcgaaaatcagatctcagtttggatcaatcaggcccacattagttccttaaaatttgcaggagcgactgctttaaagtttaacaagtaaaatatgctcctatttgccactcgattcctccttggagaggtgccacataaagtcaggcgcatggcttgcttttgtagtcatcagaccatcatcatattacaacttcttatccaggggactaaactggatcataactctttaagaactgtttcaagcagtttcacgaaacagcctattgttgactcttgtggattaagaatgttgtcaagacaactctatttggttcagttcatcagagaaatacttcagttacactatcctgtgtaccataggctatcgagggatgacacttccaagacctcaacatatgcatgcaaccatcgagtacatgctctagtagtatatcaaaacctaataagttgcaagtacttaagtgcttaaagttttcaacacactccatagtgtttgattagtggaaggtctaaagttaaggtgcaagaaaatttcaactatttttttcttagcctaggcatcttgcaataggaaggaaacctttcttgggcttaccatgaatcgttaagttttgaaagcatttcaataggcagatgcatcattagcaagcaatgagagtgtctgggtactagatgcttctattcttaaatgcaacgggtatcctgattctcatcaacaactattatgactagcataccatcagtgactagcacatgcatatctgttggcaaaaacatatatgattcaggtactgcatactgtgcatgatcaaaacactagtaaagctaagcaatattctgtaaagacctctaggagtcttcagcccgtcttttagtattttcagatttgtattacaagaatcactacaaaaatgagagatgaaaaatagtgttatggttctccagggttaaagagaatcatatgcagcaataggagagaaacgttccaggaacatactccctcaatccctcagttgattttgataagaactatttaattttacgagtcaaactttgtaggctttgaccaacaattataattaaactacaactttattgagtgtgtaataataacaccaatagatccatacttaaagtgttttcacacaacattggtttcacggctgttaataatatattttatgtgaaaccaatagtcaaagttaaatcttgaaggctatttggaaataaaactcaaggggacagtaaacggcatgatgatttccctttttatcctttccacaggtgatgtccacgacaaaagagtaacttgtattttaatagtacctcattgggcaaattaaggactactatagggaatacctaaaagttgctgagacaacaattgtctcagcaggagaagattgatgatcacaataaattacagataattagagtaaatacattactgaaaatgaacactaaaatttaaaatattaatccattcaacaacaatttttcaccttaggtcagaggtggcacccttttgttcctcatctccttatcagcgtcaagccgtcaaccacagacatatattgcagtatttgattacaatatctcctctgtttaaaatctacaaataaaagagccatatctgaatttctgttcaatgccaaaggtatggtaaattgttgcatgtaaagtaacatggtgtcataacattatggcgtgtctacatgacacagtttatctcaaacaacaaattattcgcctgagcaccgcattttttttcaatctcacattattatggaatcatggtaacgaacaagagacatttaatggtaaatgataatatactgccaattctggcagataaaaacatagagatgctcgccaaattgcatattaggtgtccatgtggcagtgcattaaagattgattggtacaaatgataaaaacatgaagttttgggttttttataaatatatgcaggcgaaaatgtgcagttgagctaaataaagcaggtgaaacaagattactgattttttttggcgtgttaagaaatggaactttccaccataaaacaagttcaatcatctagtgtgactatgaagcatcaaccatgaggtgctaagttagattatattagtcacgcaccaggaaatgtaaaaaacttgtagctgtacaatgaggctccacatatgtactattaatgaggctgctggtaactttctccgagtccaaacacagtattgttaaactattcctgtttatcttcaccatgatccttagtaccattatcagtgacaccttcagcctcgccatcaacatttgcatcttcaatttcaccatcagcctttacactgtcatccgaatcatctacactttgtcgccatctcaaacgaacaggtcttcccataagctcctgcatgacaaagaaatgtaaactttaataccatggtgtccaatgtgcttgcaatcttacatatatagcatcttatttcataggaagtcaaaaaattggggggaaggtggcagaaactactaaaggttagtacattacttaatatgcctaatgggaaatctttaacaacaatcgataatttaaacaacattgcagaagttaatttataaatgatcagttatcattcttggtataaaatgtaaaattggaaggcaaagtccatgtagttatcaccttcccatcgagttcagtgagagcagcttcggcttcctcttttgtcccaaaagaaacaaaaccataaccagctgattttcctgatgggctatcaaagaccaccttagcagaaagtggattaaattttgagaaaaactccttcatattgggagcccttgctttccatgggagattggacacataaagtttgtgcctctccaaaattgtgcccggaggaggaggaggagcaggttttctgaaactctttgaaaactccaccctgatggtccttcccatgacatcctgcaaaagatcagtgatgcagaaactagtaataagatctccatcgctgagtaccacgaaagcttagatacatataagtctatatcattcttgtcaggagcttagatacatataagtctatatcattcttgtcaggaccgccagtatctgacttcaagctgctagcatgttgatgataagatcactgaacaatacttcaactgtacctgactgatactattgtgagaaattttgagtctaccataatataagcttgtactatataatcaaattattgaatttccaccatttataggcatccatccctccactaatagaaacaagtagccaatatgatttttgcatatataaaagtgtgttttcattattttttttcagctttgtctatggggatgtggggatcgaagtataaccctagacctcatccagatgtattcatgaaatagcaatgtctccatgtttagtcctcatcctgtggggattgaaggaaagtaagatgaacagacacatctaaacatgcatcgcaatttgcaaccattttccactttgcgtgcgaaaaatagcatttaggttgtgtttagttccacactaaaattgaaagtttgaagaaattgaaatgatgtgacggagaagttggaaatttgtgtgtgtagggaagttagatgtgacggaaaagttgtaagtttaaaaaaaaagtttgaatctaaacagggcgttagccgcatttgtgctctatcaatccgatatccagtgcatgtgtattatcatattctaatcgatagactagcgcgaagttttcatacgctaaatcaaaacagtaaacaaactcacgagggagttgagcttctccacagcagcggcggcctcctccgccgttgccatcgtgacgaacgcgaaccccttcttcttcccatccttccccttgatcaccttcacccaaaaaaaaaaaaaagccacgcgtgtctcagaacaccatagcccagaactcaaagctacgcctccataagcatggcaactgggccgtaccggttactcacctcgacgtccttgacggcgccgcactgcgcgaagagcttctcgatctccggcgcggggaaggaccaggggatgttggccacgtacagcttccgccgcttctctcccccctcctcctcctcctcctcaccatcctcgaccgcctgcgcctcgggaggcgaggaggccgcgaccgcggcggccgggaggcggcggatgtcgatgagcgggtgggggcggcgaggggtgcggaggagcggcgcgagccggggaatgcgcggggccgggagcgcgagcgccgccgcggcgtggtggtggtggggggggcttcgcgcgagggagagcgccgccattggttcgctcgcggataacgtgaggcggcgatgtggtggtcgcggcgacgcttatacccagtttcgattcgccacggccgtgtgccatcgtaattcggcccgttgcgtcggcccagtggatagccctatgtttggggcccaatccaagtgaggaaaataatggttagctgcgtgttcgtcgtagaccatatagggatgtgcaagaattgaatcctatcatgtctcatgaatagatgaattcgtagaccaaggaccaaaaaattagttgtccatcttgttgatcctgtcaagatcatcgattgttcacgggttcgactgtttgatgaagattattctttcttctctatggtagtggtgtgagacagtgagaggctaacctgcagtcctgcaaggctgtaattgcaaacatcatatggcacaaaatgtcttgaaatattttcacacatgtcatggccatccactgatactccaaactcacagtcatgctaggatataaagtaccagaacatccagattcagcgcatcttcaaaagtgtaccttgtcaaacaaacagttacactgaaggaataacaagattgctcctgttgcagttctcaaaaaaaaaaaagattgctcctgttgcctgacgaataacaagtaaccatatttctgggtgctataaatgcatttggttcgtccaaatccgaaggtgcatatgcatatccagttactattaaccactaaatatgggtgagtattcgatactgtttttttactacgggcctactactgcctttgttttactggagtagatcgagggtactgcccttatcactgcattctgcatcgtatcctctgtcagagtatcaatgtctcctcattccgctacgattgggctagaccgacagagcagacgtcaagatccagtgtccatctccataataagaccaaagtaacttcaggaactggaggcaactacacacagccttgccataacaaaccggtccaggaggacttgtgccattggtggcatagaaacaatgtacgtagctagtgtcgtttctattctaagatcacctgctaggagcttatcatgactgtcatttgattcaggcctaatttcagtaggacccgggcattatttttagctttgctggtttcttaaggaaggagcttcctgacaacgcctgattcctgggacctagttttggtgcagaacctttcaacgtcccccttttgaactagtatgcatattgtgaggaaaataccgacaccacttggcctcaccaaagtcacacatctctgaacttttcttcgttggacttcaaagcgagggaggaaaaacaaaacactggctgcccgtgccttgtgaattctgcagcgaggaaagcgatctgatggactatacaaagaactatagagcgcagtaagagtttagggggctcatgagatattaaaaggctactgattttgtatgtgcatacacttttttcctcatgctaatatcctatgcctctctccctgtcacaaagattgctcaggatctattgcctccacaacttttcatttgttttctcttatttatgaaccttcttgttctacctctgaacttatctgatcgaaaagaggtgctcccacgaaggagtgggatactactgactgtcaccacaccactacagctctcgattatctatcacatttgcttggggggaattcctttgtgtggagatatgatgacaaaatggtggccatgaagccatgaactccaacagtccatccacccactgaccagtgaccactcacaaatgcatagcagaaaaaggcaaggagagaaatatgctctcaatgggattgagatcaaatgcagtagctactaggactgcatggtaactactgcacacaatccaagccctccatgtcaaaatctaacggcctaaaaggattcagcacagtaaaatcagaacagttccttttctacagtaaatcgctacagtgttttgctacagtgctcagatatatctggaacgtccattttgaatcatgtgatgctaatgtgactgcttatcttgcagtcacactagctactgcacctgaatcggatccctctcaatggcgtggttagcagttagctgaacccccattaagccaccacagtttcacagtgacagttataatcaactgaactttgaatgaatggccacattttgtcactgtgcctagcgtcactgatgggcccacctgtcagccgctgttggcaaagattccgtggaaggcagcccgtgccgcctaacacttgccatagaataaacgaagcaagtacggtggcccggcccccgcgttgctttcattgtggaaagccaatagaaactcggaaatatcccaaagcttacgcgcgatctaccccgatccacgtccgcgtccaaatcctcctcgcgctcgggctcgccgatccatccaccaccggaccggccgagcgcccgcgtgtggcccatcacgcatcagcggaaaaaacctaaccccaccgcaatctgcgtccctcccccccccccacccgtagtgatccacacggccgcgtcacggacggcgcccgcgaccggccgcgacacggcgagacgtgaggggttaggtcgcccaggaggaagcgggggccgtgagcccgtgacatcaccgcggcggcgtgggagggaaaaagtcgtcgcgtgtgtgtttgtgcgtgcgatacgggggccgttgagtgcggggggtggcaacacgccacgcgcgcggctgcaggggcagaacggccgtgtcgtgcgtgatgggctcggctcaagcccgcgcgcgccgcggtgaattcgccagcggcggatcgatccaatcccgacgggcgcgacacgggagcatgggggaactcagatccacggagcccacctcccacaccacccgcctgtcaccattttgcgccgcgctgccgaacgccgacggtgcgcgcgtgtgcgccgcacaacgggacggacggacggacacatgcacgcattcgccccggcatcctcctacggcaggggccgtccggcgcgtgcacctcacctttccctcgattgggaatctcaatctcgagtctacatatatatatacaaacacgcacgtggcatgccagtatatacacgtataattgggcattgtacgacggatctcgcctctagatcgatccctctttattgagagagagagagagagagagagagagagagagagagagagagggagagtgtgcccaccactgccgcgttaaatgcccggacggcggttggacggatggctcctctcccgtatgggaggaagcaaccaacatggacgatgatgatgatgacaacgtcggcatcaccgggcggccgctttccacaggccaaacggcgggtcaatggagttaggcgggggccgcacggcgggcgcaacttgatcgaccccgtcctatagccacagcagccattccttcacctgcaaacatacagtactacagagctctgaatctcaagtcgcattaccctagttctcaacaattctccgtgcattgcacgatctcgttcaccggagccactcccaattgctgtactacagtacaagggaagaaggggtgaagaagcagaaaccaagcaatgcaaaacagagaaggaaattactgactgacattgaaggccatcaggagcagcattctcatctttattacaggcaagcacgaatatgaacaccgggagcaccatctcctactaccattccccccaccatctgtgatatacatatatgtacatctaccatatcaaacacagagtaactaaaagagtaataaagacctataaggtttcagcaaaacttagtagttatgacagggagtaactactacctcctctcctcttccacaagagagaacccaaacccaaaccgttgttactagcacagtaactgtaactatgaagtaactgtcccacattgcatttgcaccggcctcctcatccagaagcacaggggtgcaatgggggatcctgttattactaagctcctccttttcactggctatgtatgctataactatagagatagatatggatatgtgtatgctacagtgtaccactgtttcgggggcgaggccggcatggcggcattgcttctgccctgctttagaactccaccatgaggctgccgaacggcgaccggtgcgggacgcccttgcgacgcttgccggtgcggtagctgttggcggtcgccggaggcgtggacggggtgaagctctgcaccacgctgctcttgtcgctcccgccgcttgtggtcgtggaggagtcgtccgagtccgacggcaccgccgccgcgcccttgtgcagcttcttcgtcttcttgatgccgccgccggcgtgcctcttccggccgcggtagtcgccggaggtgccgacgatctgcgcgtccaagaaggcatctgtcagcacaatgcgatgcaacaccaggtgttcgtgcggcggcggccaacggggggacgtaacgtaccttgcagccgagggagcagaagcggaaggtgtcgagcaggctgcgctcgcagacctcgcaggtgttggtgacgcccttgccgggcctcggctgggggcgctcgttgaggaacacgacgcgcgcgctgttgatgatgtacgtctgcacgccggtgatgtccagcactttctgtatctccgacacccggatcacgtcgtggtaggaggacctccgtatctgcgcacaacaccaaaaagagaaagcatcgtcttcgtcagagataagctgctggagatggaacagaacagaggcattcgctgccaattcaagaaagttggttattccgatccttggactgttcctaatgcgtgtggggaaagagaggccgttggttgaactggacacaactgcaactgcaagtctcaagagacctttttctcgttcgagttaagcttcgcttagctctttgagtgttccaatgggaaccgaacagaggagcagcagctcagctgccgtttcttccaaagaaagggtgcaatcagctgctccagctaatccaatgccgagaaggaagaaatgccgaggcttgcttgcttgctcacctggatggcgtggtggtcgcggtggtaggagaggcactgcgagcagagcgcgccgttcatgcagtcgaggcagtacatgttgcactcgctcttgtgcgagtccgcgtgcagcttgcattggccgaagaagctcgtcgccagcagcggcttcagccatggcggccaccgctggttctccgccccgtcgcactcccctcctcctccctgccgcattcgatccaacgccgccattaggatcaatcaatcagccaagaaagaaaaaagcaacaacgaacaaaccgatcgagccaacaccagcaagaaaaagagaaatcacgttaccatggcgccgcctctggtggtattgattctgagcggcgattcatcgtctattgccatttccaaaccctgaaccaaatccgcgcgcgcagcaaaggtgcggagctagaactagaatgtgaagggaggattcgagtgggtggaaaaagaagggaggggagaagaacgggaggaaaaggaatgggctttgtggaagaaagaagaagtggaggtaggaaagctgaggtctttgtagaccggagaaaggtttgcaactatcaccgaaccgcaccgggtggtggtggtaaaccaacaggggcccggatgctttgcggggagactatattgctcgtctcgtctcgtagcagcccctactcgttcttatccgatccgctcctcctccgggtcgccgccacaccgtgtgccacccgccccccacctttcaacgctcgcacggcaccagcagaaaaccggcttttagattattgttcgctcgctccatcgcgacgcatccagtggcggtgactgcttgctgcagggtgcagatactgaacacgccggtgaaatgaacagggaggagtggccacggagtctgtgcgagtttgacgcttttcacattgtcttttccaggggaatttacatcggccgcgtgcaggttgcagagtggcagactcgcagtcaattgtgccgcgcaggcggtgtttctcgtctcatcagccgtgacgtc

SEQ ID NO: 47988 - DNA, 1481 bp, Oryza sativa
acgtgccatctctaagagataacacgctagctccggcttgagacgagtgcctagaggctttcgtcttgacgggatggggcaaggcgtgcgtcagaccgccagtcgccacctaacccgtgatttgaccggtctgtgactggtcacagaccggataaaggaacgcgctgtactgcgttgcatgcagcgtgacacgcttgaccagactgcaataaatgctgttaggtgagcacagctgtgctcacttatcccatatatgtggcgcagacttccttaaggggtcggggtgcctcggccctcggggccggggcaagcgcaacccgacccccccctcgggggaaatcaggaggagggcggacacctcaccctcgggcccgacgtccccgaaggtgccaggccacgtgggcgattgcgtctgcctcaagcctctggtcatgatactcccggtcccatatcaccgacagtagcccccggcgttatgccagagcaatttcccttcccaagggaagcggtcaggtgtgacgccacccctaaagcctggtgacaggtgggaccggtctccgtagttgggcaaaatacccaacggtctcaatccatgcacattggtattggtaactttggttgtccataatgggcggtctattcaagactgccacaccacttgagcagcgcgcgaatctgggtgagcagattggtctcgcccggagatacggtaacgccgcttcggtcggcgagcgtaattaacgcgcgcacgatacaatccatttcgattgccacaaccgcatatccacttcatgcgccgtaagcgggcgaatgggattagtggaagcgtgggcacgggaaacgagggagcgagatagcgagatacgagggagcgaggtagtgggcgcgagaaacgaggagccaggcccagcgatggcaagggtataaaagcatcgagaaaaggatttgcttccttcctttcgccattgttcctcttgccttcgccgcctgagctctaactctttctctgctacgccctactttcgccacacgcgctcgttctcaatcatctcttcctccaccgccatggcacggggctctgctctgctcgacggcagtgtactaccgccttcccgcatcgtgagcgagaggcacgccggactgccgcgccgcttcatgccggagtccgccaccggtcgggagatagtgatgctgggcgaggggcgcccggcaccagactacccggggcggtccatcttcttcctccccttcgcaatggctgggctggtcccgccattttcttctttcttcatggatgtcctggagttctacgatctccagatggcgcacctcacccccaatgcggtgatgacattggccatcttcgcgcacctgtgcgagatgttcattggggtgcgctgtcacgtcctgataaattcatcccgaaataaaaatcatcttctaaaaggaataatagaattaattaaaattcgaaaagaaat

SEQ ID NO: 47989 - DNA, 22027 bp, Oryza sativa
  unsure (1)..(22027): unsure at all n locations
taagtgacttttaaatgccgtttactgcaaaacttaacccctatattattatctccttgtacccccccttgcattaattatgcatctccggtgtggcttgctgagtactgtggttgtactcattcttgctcaatccttcccctcttcagtaagagaagctttggagaagatgtcttaggtggagtcctggcttataccccagttgagcgcctgtgaagatggagccgtaggcccgctagtccgctgctgtttatttttgattgtcaggcctgatgcgcctttgtaataatgtaaatattatcgatataataaagatgtgtcttttatatcatgtttgtatggtgtaccccggcttttcctgggacggggattaatacactagcgttcgggaaaaggcaattttcccggtcgcgacaagctggtatcagagccatctcgactgtaggataagccaagtggataaaacctaaggacatattttataaataaaactatttgcgaaagttcctctttttctccttcccctaatgctatttgcaaaaggtttactcttttctttcttcggatttcaactaagtactagatggtcagctttgcgaagaagaagatgtcgtcagttgtttgccgaagctccggaagactgcaggatccgctagcgaagcgaaggaagcagtgaagccagctgtgaagcaggagtgaaggtcttggagaacccgtcgcagaacctaagccaccctctagtgtttcgtttgtcgtgtgtttccttgcttgtgtgtgtagcgcgtggtttgcatcggtgggtggtgatgtaaccatgctaggttgtttgcttaatcaacttgcagaataagcaaaacaaacaacacatcaacaaaaagagttagttcctttaaggtcttgtctctagttctgatctattctctccttgtatgcttcccctctcaacctctaccttgtgacagatggataatcctggtaaccaaggctatgggaatgatggatccgatgactcaagaacccaagccaatgggaatgagagaagcatcaacgcaacctcaccagagctaatccaagttgtggttaaccaaaccaacatgttggcaacagcctttcaactattacagaattggaacaacccagcaggggcaaccaacgttcaagtgcctacagtccagcaacagtgcaagttatcagaatttctcaaaactgagtctcccacctttgccattgccgtcgatcctaaggaagccagtgagtggttgcgcaccatcgagaagaagctagggttgattcagtgcaccgaccaggagcgggttggcttcgcaactcatcagctggttggaccggcttcagagtggtgggatagctacgaagcatcaaggccagaaggacataccatcacctggaacgagttttcatctgtattcaggagatcacatgttcccgcaggaatgatcacactaagaaaacgagagtttcgctacctgaagcaaggggatttgaccgtcacagagtacctgcacgagttctatcgtttggctcgctatgcaccagaagatgtggaaacggatgaagaaaaacaagagaagtttctccaggggttaaaagatgagcttgcagtgcaactactcctagaggattatgaaaattttgagaaacttgtggacaaagccatgcaacttgaaagtgagcataatcggatgacgaactgcaagagaaggattgtcaacatcccagtatttccaggtggtaaccaaagacagcgcactgagccacttcagatcaccggatcttctgttgtgcatcaagagttcctgccccaagaagatgaacgcaatgtagacaacaacaacatcattcaccaagatatcgacgatagtatcaatgaaggcacccagaatggcaaccctagcaattttgactctgagaaagactccaagggtgatagcaataatggtaccactgatgccaatgttagcaaggatttccaaccaccaattccaactcctagtcaggacgatcgttcccaggcggacaactcagcaaagaagacgttgatttgttacaactgcaaagaaccgggtcatttctccagagattgtccacagccgaagcgtaacctgcgtcaccactccggccattatgcaagaagaagacaagtcactcgtcttgtggtcactggagcaaacgccatacctgtgaggcctcgtgttaatcataacccatagtagaaacaatgtaccaatgttaagcaccttccctttttgtttaagacagtgccttgtattcatgtaatatgggagaaattgtaataaaaacaagttctaagaggattcttttggaagatgcggatatgtgatcatgtgtataattgtttactgacaaaggagacctagggtctcgtgccagaggaactatattctaacctcgagctaataaccaacctgaggatggaaaagaaaaatcaagtgattaaccaaagagacatttgtttggactaagagttacagatgagtccttttcggatcaaaggcaacgacagttagtatagcttttggcgaaacacttcaaggtctcactgaaaggcagcaagtcaaaggaccccatcgtcaccagaagtatccacaactctcggagtgaagagtacttggttgacaaagtttaagaggtgattgatagaagataccagcaaaggtgtttattatcgaaccaagaagtaggtcgaaaggtgattgataagagaaatctaaaaagaatacgccagggctgaatgtgtaagggaatactttgaatgctaaatgatgacaagcatggtatcttagtaatgacgagctgatctcgacgcatgacatgaagtgggtaacttgtatgaggttgaccccaaagatatgaactatgcaaagttctggaactgaagccccatcttcaagtgccgcaacccagtcgaagtcagctaaaggttcaaccagggacaagtcaggtgaagagaagattccatccgcaataggagatcgagccaagcagtcccgagtggagaagttttgctaggcaagtttgttataaaaggcgcaacggaagaagtcagacaagaagagaagaccgcccaacctatcttcttgctagcctcctcgaatctcggggacgagattcttgtaaggggggtggatttgtcacgtcctgataaattcatcccgaaataaaaatcatcttctaaaaggaataatagaattaattaaaattcgaaaagaaattggcaaacactaaaatacgtacaagaaaaattcaaatgtgacccggagaatttttgttaaattctccttggtctaaaaggagccctcaaattttagtggaattttcagagcacaaataataattgagaagaaataaacaaagttgaaaaggttttataaaaagaaaaaccctaaaagaagtcctcttttccccccccttccttcttgggccggctcggcccagtccctccctctctctctctcttcccccgcggcccatcggcctcccccgcgcgcgcgccgctgacaggcgggcccgcccgccgccctcgctgacgggtggggcccacctgtcatcgccttcctcccgccgcgcccgccgccgcgcccgtgccctagcgccgccgccgccgcgaatcccgccgctcccgtccgccccgcgtgcaatcaagaggggggaattattccccgcaatcccctctcccgtttccccctcttttccctctctctctccctcggattcgttcgaatcaagcccgtaatcgtcgccggcgcaatcaatggcggccgagatcttcgcgcgcggtttcctctctccccggccgccctctctccctcccggcgctataaaaacgttgcccgagctccgctctttcgtttccgccgctcgccgctcgctctcgccgtcggaatcgtgctcgcgccgtgctcctctctctccgccgtcgccgccgtgctccggttcgccgccgccgtcgctccggacttcctccccactcggcgacacctccctcggcatcgccgcatcgccgttgaccccgtccgcgcctccacttcgcccgccgaccgccggagcaccgtcgtcatcgtcttcccgaaccgcgccgccgccttcttccgcttcggccgccattctcgtcgtcgtcgttgccccggggtgagccgaagaccgccgttcgccttccccctttcctcctctctctcgggtgccactccgccgcgccgttggtcgccggcggcgaccatcggggcgcgggtgcgcgccgctcccgtcggccgcgccggcgaggccgccctcgggcgcgccctcgcggctgccaagtgggcccggccgtcagccgcccgcgcccgcgggtgcggctgacgcgcgggacccacggcgccgaccgccgccagccgcgtgcgcccggtccaccgtggaccgagcggctgacgcgtgggcccccacccccgtggacccggtccgcgcgcccgctccctcggctgacgcaataaataggatttttaattgaaaattaaatgaagaaattcgtaaatatccatttaaagagcatataaacttcaaatggccatatcttggccatttgaactcggaattggaccgttcaagtctctaatttttccttaagaagtcaagaacccatttttgtgctttgtttctgctgttatgtggagtttattagagtaaaagccttttcctttccgttggtcgtgtagacgctgcagcttcggaagatccgctcttcgtggaagttgaagccggtgtttgggaaagcgagcaaggcaagtcacatcatccttgatcatattgaatcccagtttgtaaaattatgttgatttaaattattgcattaccgctttatttaaattcccgcgttatcactgttttatttagccatgcctatgtacctttgttatgaccatactattattgttattgttattattaccttgttcaccctagaataaacaaaaccccatctagtggacactctatttatggttccactagtatgaatttaggtagatgcttcgctgattaaataggacaacattaggtggttttataactttagactttgggaattctcatatcatttggacaccatggaattattggttgatggtggaattggacatacacctctcttcctctttcaaaacccctaaaacctgttttcggtggggtttgggtgcatgccagttgtgggaagtagcaccccggccactataaggactaaagctcgggcctctgttgcaaagcactaccgtacttccacatgtctaatgggtaaggcttagtttgtggctcagtctagtcataaacaaaagtacacggattggagatggatgaagtcgggcgtcgatggacattctccagggcaaatgaaggctacacgagctgcggctcggtagtcgagatgtcatacggcggagggttggtgcccaatgctaggggctcagttctgcctgcctgtcccgggtatcccggccgtaggtaggattgggtcggtactcttgtctaaggctaggatgggttggaaactatgtcacatctttacgacgggttccaaggccatggaatgcggagtaaagatgtgtcttgtgggtaaagatgtacacctctgatcagagtaaatctattcgaatagccgagccctcggatatgggcaagcctagcaatgtacccaagtcagtgttaaaattcttaaaatttgctcaacaactaaaatgtggaatggttggcctgggttggcttgggacgagctgggacccaggtcgggttgccagttcggtccgaatcatcgtaggccttgggttaaggcaggttcgtgagggttcacggccttgattaataatattgtatagctctaggatcgtctttacaaaatagctttgggcaactaagtgacttttaaatgccgtttactgcaaaacttaacccctatattattatctccttgtaccccccccttgcattaattatgcatctccggtgtggcttgctgagtactgtggttgtactcattcttgctcaatccttcccctcttcagtaagagaagctttggagaagatgtcttaggtggagtcctggcttataccccagttgagcgcctgtgaagatggagccgtaggcccgctagtccgctgctgtttatttttgattgttaggcctgatgcgcctttgtaataatgtaaatattatcgatataataaagatgtgtcttttatatcatgtttgtatggtgtaccccggcttttcctgggacggggattaatacactagcgttcgggaaaaggcaattttcccggtcgcgacatgcgcccctctcttcagctgttccggtggttcttcaccgtgcagtcggtgtcaccgccgtcggtggttggcggctgctacttccagccgcgggggccggtgttgaaccgctacatcccctacgtcctccgcaagaagtgggacgactggaagagcgactggttctacacccccctcgccaacgaagcgcgcctccgacttccaagccagcccccggcgcaggtctccagctggcgggcgccggtagatctgggggaggactacgacgccgtcctcgaccgcctggcgggcctgcgatcccaggggctcaccggggccatggtgtacggcgattacctccgtcgccggattgcgccgctccaacggcgcgcccggtgcgcctgggagtacactgggcctgaagactacatgcggacccaccagggagccagatgggattgggctcccgaggacttcaagatcgtggtccaaagggtgctgaatcttagctccgtggaggcgtctcgcattcctcaggagatcctccccctctgcagcgatcccgaccgcgcctccattctaaccattatgatgggggtcggggcctcagaggagagagcccctaagggccacgacggcgcgggcgagcgccgccggggggaacaatctgccccaggagggggtcgtgcttctgggccccgcgtcgggggctcggggagcagccgccctgccgacgcccaggggaagaggaagttgggaggaacacctcccccatctcctccccgagggggcggggcggcgcgtgccagcagtcggcgcccggagggggccgcgccgacgtcgcagcccgagagggagcgcaagaagaaacggctccgcaagacgggggagacggaaccatgccggggaaacctgatttcccctccaaggtggtcattcaaccgaccccctcgcaggttcgtctcactctcattgcaaccatctttctcccaaaaggaagtttttttttttttttactcattttgttcgtcttctggttttttcttctgcttcagcgatgtcccgtcgcattcctcccgccaccccaagtccggccagtccgaggccgaagatcctgcggccgcggaggagcggaggcgagaatctgaccggcgtgaagccgcagaccgccttcgggaagctgaagaggccgcccgggaggccgcccggattcgccaagcggaggaagccgctcgggaggaggccgcccgggctcgccaggctgaggcaacagctgctgctggcgcgtcaactgggcccactccttcgggcaaccctcaggcgacagcctccggggaggctcgcgacgaggccgcgggcacatcgcctgggcccacctccccgggcgacgcccaggatcaaacgggtccgggggacatccccgagcccagcacgtcctccggggggccgagccgcatcgccttctctccaaggcggctcttctcctcatcttccgtcgccccgctgagcgccgagcccattctgcaggccttggccgccgcaaacaccgcggtgctagatgggttcagcgcccaagtggaggccctgcgcgcggaacgagcggagctcgaggccgcatgggcacgcgttgaggaggggcggcgctcggtggacgccatggtggaggtgggccgtaaagctcaccgccgtcacgtctcagagcttgaagcccggaaggcggcgctgacggagatcgctcgtgaggtggaggaggagcgagcggccgccctcatcgctaccaccacgatgattgaggcgcaagacgccctccgccttcaaaacgccagccgggaggcggagctgaaagaaaagctcgacgccgcccagggagtccttgactccgccgctgcccgagagcggcgggtaacagaggctgaggcggcgtcccggcggcgcgaggagtcccttgaggcccgtgctatggcgctggaagaacacgccggcgccatggagaaaggcttgacggaccgcgaggccgccgctgctctccgggaggcgacgctggcggcgcacgaggccgcctgcgccgaggaggagtgcgcgctccgcctccgcgaggacgcactcgctgagcgggagcgagctctcgaggaggctgaggccacgaccaaacggctggcggacagcctgtcccttcgcgaggcggcgcaggaggagcaggcgcgccgcaatcttgaatgcgtccgcgccgagagagccgcactggaacagcgggctgctgacctcgaggcgcaggaaaaggagctggacgcgagggcgcatatcggtggggcggccgcgggcgaaagcgacttagccgcccgcctcgcagctgccgaacacaccgtcgccgacatgcagcgcgcactagattcctccatcggggaggccgaggccctccgcttggcgggcgagatggggccctccgcatggatcgcgccggtcggcaagcgggcctctggaagggccagacgaggatgcgccccatcaatctggaaggcctcgctccgcacctcaacaggatggcctgggtcctcgaacgactccccgaggagctcgagaagaccatcaagtcatcctcgagggacctcgcccggggggcggtcgaactcgtgctagcgagttaccaggcccgggaccccaatttctctccctggatggcgctggaggagttccctcccgggaccgaggacgacgcgcgcgcgcgcgtccgggatgccgccgaccacatcgtcaacggcttcgagggctcggcccctcggctcgcgttcgcccccaactccgacgaggagggcaacaccagcagtgcagacgatggtggtgacgaggccgtcgactcgggcgcgtcggaatgagcccccgagcccccgccaatctttacttttttctttttctttcttctaaggccttcatgcctcttttgtgtacaaattaacttaatctgcaatcagaaatgacgaaaaaatttttgtgttagttttattttgctatacatacgcgatgaggatgatctgtgccatggtccttttgcgccttagcttgaaataagggctcgtgcccaagtcccagtcctcgaatggctcgggtcggggctagtgcctggggagatccacatgtcgagactggccaggccgggaacgtggtgaccgaggggtatgggtgacccgattgtgggtttttgccgattcccccccggagttcaccacgccccggggcacggctcggttctgggccccgtttggcgattttagctgaccgaaccgaacccccgagggcaaggttgagtacgagtgaccttattttaagtcaagattcttcaaaaggaaagaacagcacagacacaacctttaggaaattgaaactgcttctattgaaatgttgaaaaaagagaaataagaatgtaatgcatgtgtggtagcccccggtcaaccctgcacacccgaggggggtgcggggttggcctgagccaaaacctgacacccgacccccccctcctcaggggtagaagcggcgaaggtgttcgatgttccatgggttaggcagctccgtgccgtcgcccgtggccagccgtaccgagcccggccgggggacaccgatcactcgatacggaccctcccacattggtgagagtttgctcaatccagcacgcgtttggacgcggcgtaggacgaggtcgtcgacgcagagtgatcgggcccggacgtggcgctgatggtagcgccgcaagctctgctggtagcgcgcggctcggagggccgcgcgccgccttcgctcttctaagtagtcgaggtcatctctgcgaagctgatcttgatcagcctcgcagtacatggtggcccgaggagacctcagggtgagctcggatgggagaaccgcttctgcgccgtagacgaggaagaaaggcgtttccccggtcgctcggcttggtgtggttcggtttgcccagagcaccgctggcaactcctcgatccatgaatcgccgtgcttcttgagaatattgaaggtcttggttttaaggcctttgaggatttctgcattggcacgctccacttggccattgcttctggggtgggcaggtgaggcgaagcagagcttgatgcccatgtcttcgcagtagtcgccgaagagttcactagtgaattgggtgccattatccgtaataatacggttaggcactccaaaacgggccgtgatgcccttaatgaatttaagagcagagtgcttatcgatcttgacaaccggataagcctcgggccacttagtgaacttgtcgatcgcaacatacagatactcaaacccgcccggggcccgtttgaacggtcccaggatatcaagcccccagacagcaaatggccatgacagtggtatgatctgcagggcctgggccggctgatggatttgcttggcgtggaactgacacgctctgcatcgccggaccagatcgactgcatcattgagagctgtcggccaataaaatccttgacgaaaggccttgccaaccagggtgcgcgaggcggaatgggctccgcactcgccctcatggatgtcagcaagaagctcaacgccttgttcctgaggaatgcacttcaggaggattccgttagccgcgcgccgatagagggtcccttctaccagcacatagcgtttggaaatgcgttgtacgcgttcactcccttcgcggtcctcaggtagagtcttatctgtgaggtatgtttggatctcagagatccaagcgatcaatctgagggagcttggagcgctcccttcgggtcccgaggcctggactccgacgggcctcgggggccggtcaggcgcatccgtctcccctaaggggtcgggtcgcgccgacggctgggtaagcctttcttcaaaggcgcccggtggggtctgggctcgcgaggacgcgagccgtgagagttcgtcggctatcatgttatcccttctgggtacatgccgaagttctatcccatcgaaatggcgctccatacgccgcacttggcgtacgtaggcgtccatctgtgggtcagagctccggtactccttacagacctggttaacgactagctgggagtcgcctaataccaagaggcggcggatccccagtccagctgccactctgagtccggcaaggagtccgtcgtactctgccatattgttagtcgctcgaaagtcgagacggaccaagtatctgaggacgtcccctgtcggggaggtcaacgtgacccccgcaccggcaccctggagggacagagaaccatcgaactgcatcacccagtaggtggtgtgaggcagctgcgaggggttcgtgctggcctcggggattgagacggtctctggagccggggtccactctgccacaaaatcggcgagggcctggctcttgatagcgtggcgtggttcaaagtgcagatcgaattcagaaagctcgattgcccattttaccacccgtcctgtaccctctcgattatgcaagatttgcccgagggggtaagacgtaaccacagtgacccgatgcgcctggaaataacggcgcagtttcctcgaggccatcagaatagcgtaaagcatcttctgggcctgagggtatcgggtcttggcgtcccggagggcctcactaacaaagtagacaggccgctgcacccttcggtggggccgatcctctctgctaggggccgtatccccggggcgttcttcgttcaagtggcctttcggggcacacttgtcttctgtgccgatgacctcggggtcggaggatgaaaggggcggcctcccctcagtggcctcggggccgtcctgggggtcgggggctcctggcatcgtcggacaagcgggcaaagggccaactccggtcgtcaggggcctctggcctccgttcggctcgggggcctcttctccctgctttctcccgggtcgagtcagcacagggttagcctcggggccaaagggcgataggtgcggccttcccgcagtggcctcggggccttcctgagggtcgggggcacccagcaccgtctgacaagcgggcagaaggccgactccggtcgtcaggagccgtaggccaccgtccgacacgggggcctttcctccctgctcgctcccgggccaagttagcacagaatgggggtgcacgaaatgaggattgtcttcatcgcgctccacaaccaatgctgcactaactacttggggggtcgccgctaagtaaagtagcaggggctcatttggctccggggcgactagaaccgggggagagctgagatatgcctttaactgagtgagggcatgttcagcttcctccgtccaagtaaacggccccgagcgcttgaggagcttaaacaagggtagcgccttctctcccagccttgatatgaaacgacttagggcggccatgcaaccggtgacgcattgcacatccctaagtttgctgggggggcgcatccgctctatagctcgtatcttctcggggttggcctcaatgcctcgggcagagaccaagaacccgagaagcttgcccgcaggcacaccaaacacgcacttatcggggttcagctttatgcgggcagagcggaggttctcaaaagtttccgctagatctgaaagtaaagtttcttggttgcgcgtttttactaccaagtcatcaacataagcctcaacattacgtcctatttggctacccaaagaaattcgagtagtacgttgaaaagtaggacctgcattctttaacccgaagggcattgatgtataacaataggttcctacgggggtgatgaacgcagttttttcctcatcctccctagccatgcgaatctgatgataaccagagtatgcatctagaaaacacaaaaggtcgcaccccgcagtggagtcaacgatctgatctatgcgaggcagggggtaagggtccttgggacatgccttgttaaggtcggtgtagtcgatgcacatccgaagcttgccgttcgccttgggaacgaccaccgggttcgccagccactccggatggatgacttcacggatgaatccggcctccagaagtctcgccacctcctcgcggatgaaggcttgacgttccggggcctgccgccgcactttctgccggaccggccttgcgcccggccgcacggcaagacggtgctcaatcacctccctggggaccccgggcatgtccgctggtctccatgcgaagacgtcagcgtttgcccgcaggaaggagacgagcgcgtcttcctatttgccattcagaagaccaccgatccgtgtggtcttggatgggccgtcgcccaaggcaacctccttgaccggaacctcgtcgcatgtggcaatccgctgcctcggggcggtgggggcggaggtgccaagcctctcgtcaccaccctcgggcttggtcgcagcagcgaggtggtccgcgcgctgctccatgcaagcgagcgcgactttcaggtcgccacggacagagatggggccaccggggcccggcatcttcatctggaggtaggcgtagtggaccgccgccataaacttcaccaacgcgggcctccccaggaccgcgttgtagggcagactgaggtccgccacatcgaagttcacccgctccgtgcggaagttggctgatccaccaaaggtgaccggtaggtcgatgtgacctaatggccatgtgtgccccggcgtcacaccgataatcagttgggacggctggagcaccatccccggggccttgatagcatcaaaggccgcgggggaaaggatgttgagagccgctcccccatctatgaggacacaccccaacttcacgttgcagatggtgggggaaaccaccatcgcaatctgccctccccgggcaacgcacagtgggtggtcggtctggtcaaaggtgagagcaacctccgaccaccgcacccgacgcgtcgtctcatgagtaggggccgcggcgagaagctctcgcttcatagccttgaagctccggcgagaaacgtgagcacacgctcctccgtcgacagtggcaatggtggcccctggttcttggaaacctaggtcatcatcaccatcatcgatgtcaacggcgggggccttctgtctggcctcacttcgccgtttaccggagggaactgccgcagacttgccctcacggcgttcctgcctcctgtcctcctcccacttcctcgttcgctcagccaagtttttgactgcgcgacagtccgcgagatcgtggagggaggtgttgtggacggagcaccacctgctggctgggcgctccctgctggaagtaccagcctctctctttttgtcgctcgcaggcctcccctttcgggtggcccgcggagcgccctcgacggcgaggacgtgaccctcgtcgccggaatggaccgaccttttcttcctcctcctgtcacgccgccctgtctgagcggcggatccgggggcggccgaagctgccacaccggaaccggaggggttccaggtccaagcctcctccttacgagccactcggtccgcgagctgaaaaagctctgcggtagtctggggctctttggaggcaatcttttcgagcatgcggttgtgccgcacaccccccctgaacgcgtagatcaccgcgtgtgcagggatgcaaggtatagtattgcggacttggcagaaacgctgaatgtacgagcgaagggattcatcatcccctcgctgtactgcgtgcaagtccgcttcttcacccgggcgtggataggtgccttgaaagttcatggtgaactgctggcacagatcctcccaggagtggaccgacgcgggtggcaagttcattagccaaccccgcgcctgtcccttcagggccatgggaaagaaattcgccatgaccctgtcgtctcccccagcggcctcgatcccggtcgtatagacctggagaaactcggtggggttgacgctcccatcatacttctcggtgatggtgggccggaaccttgggggccaacggacattccgaagactcgccacaaaggctctacagccaacaccaccaaccgggggcacggagggctgatcctcacgtccatgtcgaggtgacaccctggacgaagaggcaccctccgttgcgcggggagcacgccgatcactacgtcggcgctcgatgtcgaggcgggcatccggctcttcatgctgatcctcccgagtcggaggcgccgacgagggagtggtagccgaatggcgtgcagcagccgccgctcgccgcgccctccgtcttgacgacgcggaaccggtagtggcggcgccggaggtcttggtggtggcggaccgtccgccagcacccaggcgttgctgtgccgtcatgaccaagttggccacgtcgtccagccatcgctgggctggagactccgggtcagggacgacaggcgggtgacgtaggagcgcgccaacagcctgaagcgcgccctgaggcgtgctgccgtcgccgtagacgaggaggcgacgctccccatctcgccgttctcctgcaccacccgcgactggcgatgctgcggatttttcgactctctcgagcgcctccccccgcttgggactttggcgtggaggaggtgggggagtacgagctcgacggcgtggattcggctccccgtcgtcgccgctcacactcggagagaggtcgtgcgcttttccttgctcggccattaggctgaacaagaaaaacttggcgcacacggaagagtctgagagctcagaaaacacacgctgagccccctacctggcgcgccagatgacggagctcgtggcccctcaccgggagactgcgcaagcccccctttgccggttcgaccaggggcttagggtgcaatcccaagctctctctctctctctgtatgtggaaggatcacccgcccgcaagacacacgagacacggcgacgtatacaggttcgggccgctgtgaagcgtaataccctactcctgtgtttttgtggatttgtgtatggacaagttacaaaggattaactccctttcccctccgccttcccaaagggaaaaaaagtcctcctctaaatgggcaaggtcctccttttatatctcaaggggataccacatgcacctttctctttccaaactggactgttctttttctctttaatgggcggagatcggtacggtttccatccgggagcccttctgatgggacagcccacacctacccccacctcccccgaagacagagatgacgcgggaccgtggctgtctgtcgatgacgcgaccagtgccagaccggtcattcttgtccaccacgcgtcagcttaacaacgtgcatgtttgcccgtcttcgtgtaacaccttgcctgtaatggttaggatgaagcctggtataaatctgaccagggctaacgtgccatctctaagagataacacgctagctccggcttgagacgagtgcctagaggctttcgtcttgacgggatggggcaaggcgtgcgtcagaccgccagtcgccacctaacccgtgatttgaccggtctgtgactggtcacagaccggataaaggaacgcgctgtactgcgttgcatgcagcgtgacacgcttgaccagactgcaataaatgctgttaggtgagcacagctgtgctcacttatcccatatatgtggcgcagacttccttaaggggtcggggtgcctcggccctcggggccggggcaagcgcaacccgaccccccccctcgggggaaatcaggaggagggcggacacctcaccctcgggcccgacgtccccgaaggtgccaggccacgtgggcgattgcgtctgcctcaagcctctggtcatgatactcccggtcccatatcaccgacagatgtagtagctcactattaacaatttaagatgcttcgtattgcggaagcaagatcctatttcttagtgcctcctcacttgttcctggttcatgattaggacgtgtaattaaactctttgtatatgcgtttagtattggattattggtctatttctaactaaccaaattattttgctagctgttgtatcgtttgagaagaaatgccgcagtaggttcaagaacagggaaaaaatcgtctgctttttttttagaaaaaaaaatcgtccgcggcagttctttttcatggccatcgtacgacatttggtaatttggtcaactactcttgtaacaccctcagactatttctgtcgtcctagatgaattttttaagtttaagacttctttagctcaggcatgcatcatgctcggaattgtttttttttctctttagttcatctcaagttcacctctagatccatatacaaattttgggttgaattatgtacttgtagcaactggttatcaaggggcggttacaacaaagcgtttgtcgcttaaattaatcatgctgcagttacgcatcacatcatctcttggaaccagtcctaatcccttagatgataacgatgcactaaccaatcaacaattggctagaatgatgaaactaaccggtcctaactagctagttgcaaaagcagcagagggaaattctgcttaattaccgcgaaagaaaagtgtattgattttgacattaatctgtttattttttatcattttctctatagtaattattcggagtctccacaataatgctgcattatgcacgcattattggtcttctgatgtaagcgtgatgcgcttcgatcacaccctggatcacggcttcaagtaatacagtacagtacatacataggcacgaatcatgaacaaaccatatttcgaggacatcaattagcatatcaatgacctagcttaactcataattcatgcatgttttattctgacatgcatgctagctacacctgtgctcacagacaaattaagctagccaaggtgaagacaggaattaatgtgaaaaaaaaatcagtgctactattccttcgtcgttttcctgcagaatatatgcaatgcaggcgccgagtacatgatcagatcatctcccatattgctatctgatctggttggacagcatctcggttcagaggaaagacacctcaaaaggttaccattatatatcaggcccaaagcaagcagctgccatctacgccgcgcacatatggctagttcggctcatcaatcatgcaagtgcattattcagttcctattcttttaggctcagcctcttcatgcccttcataaatcatctggaaagatgcattgctccttctttgttacgtgtttcgcttctctggggccccagaaggactagcttaaccccggaaaagaggagctgtgtacgcttaaaaggcagtggaatgaaacatgcatgggcgcatcggatcatgctatcattgcactcggttcggagcatcatcactgctgcaagctaggccacgaccgttcattcgttcatgtgtgcttgattgatcaaaagtttcctcctaactagctagcactgcgttgcactacggcatttgctggatgatagtatataatttctctctttttcggcagtggtgctgtggtggcctagctcgtgcgagaaaggctggttgttcgttcggtttggtaaagagaggctaaagtcttcttcgatccattgcacttcagtaaacacagagatgacaaaagcaaagcatacgcataataattctccgtcctaagcatgacattttcaacgaggaggagggtgcggacaaagaacatgtcgccctgctgatttcatggcggctgccggataatgctgcaacgtccggatgcgacaagcgaatacggcactattttactggagttctcctagccgaatgcttgggtttcatgagcctttacggtagtgtgtgctgcttgctgcacaccacatcgatttcttccataggccaggatcagaaacagccgtcaggatccaggaaagggagagaagcacccagaacgcctgaagacaccacctgttcgccctcgggatggctgaaccctgaaaccgactgcagcgcagagagcagcaaatacagtagtaaacgaaatccgaaagcgaggcgacgacgccaccatgattgccgttcgatgattgccaaggaatggctctcccgacgtcgcgtgatgtgctacaagcgatcgaagccttgcgtgacgcgtacatttgtcaaccatatccgtggacagccgcgccctgattcccgtgcgcatagcttccggggacatttccatccggcttcctctgccaaattttttggggttatcttgggcacggcgagggagtagatggcaagttctggcgcgcgcgcgccgcagcctgacacgccgccgcaggaatgggttgcttcgtgtctcagaaactcgggtgggtactttccttgaaagagagggcttgacaaatgtgcatgcttccagaatcccggactcccctagttcagtgtgtttggttgtgtttagatcaaagtttggattcaaacttcagtccttttccatcacatcaacctgttatacacacacaacttttcaatcacatcatctccaattttaattaaaatctaaactttggatccaactaaacacagccaaatgtctcgcagcagcgcaatagtagactgtaggttagcctgccggcgtcctttattcggttacatgtgctggctggactaaccactgaaaccagttgctgctgacctccacaaccatagaacacaacaaatgcaaaattcggtcaagcctcttgtgtgatgcaaagtccaaaccttttactagtactagtactttcgcaccgtgacacggacactgcatgaccccaagcaaacgatcagctaaaagtcaaccgttcaaaccaatccagttagcttcagataacgccatctcaatcccaaatcctcgatcgatccgtgttacgcgagacctggagattaatcacggaagattagggcgtgggggggtttgacccaggagggcgcctggacccaagaatttaacgaagcgaaaaaggccaaagcgatcggtcctgcgtgttcctgggcgaggtgacggacggcgagtgagaagccctgcgctgcgagtgggggaggcctcggggggagaggtgaggtcgggtcggtcgcacgtgtcgcgccgcgcacatggtcacccacccaccatccgtctcctgccacgtttattggctgaaccttctggctgcgcgcgcgtcgcgtccgcacgccgggggagcgcacgcatatcgcctcgcctcgggacgcccgcctcacgacgtggcccatcacgtggcctgatcccaacagcgaccttgtcctaaactctccatgggaaagagtttcatcgtgtgaagaaatttgtatggtcgtctgtccttagaccgcttgtcagtcaagcctgcctgcctgccggcgggtacatacagtatactccacatacttgctcatcacggtgtacttttgctcatcatatggctgaatttagttccaaactttttcttcaaatttataattttttttcatcacatcaaaattttcctacacacgtaaacttttaacttttttatcatattattttaatttcaactaaacttttaattttaacgtgaattaaacacgaccataagcgtagactcgggttaatgcaaaaactaaacagcggtactaacagcagcactgatttcaacaattcgccctacttcccgggcctcccggctacctggcgaggaattaagttgggagactaatcaactcgcgcgcgtacgtgtgatcgacatgacgcgacgcgacagagattgtggtagttggaggggaccagattggccgcaggatggggcggtggactgacgcggacggagcgcagaattccggtgaactgcgccaaccaacggcgaggcctcggtggtggtggcacgcgcgagcttgtggttaacctcggccggcctcgggacacctgcccctctgattggggagaaagccttcgtgcactggccatcgtcgctgttcgttccgctgtgattgagtttggctaggacaaggagccggccgcacggtgtcattccggtcacattccagtcaggttactgtggctgatgatcgtgtgaatgtactttgcgatcgcgatgtttcatcgtggagcattgaatggagaagatggcatctctgtcggagaaaaacgataaaatggctggagcgtgcaacacgagcatgccctagtcacaagcacattagcttctgatgggccaacaatatggcccatcacatatggttggcccgttgggctagcacgcacacgggttacttactggagcaggcccgggctggaaagagaattcagacttagcgtggacctatatttaaggggcttaaagtggacttaatcctagtaataataaatcaggtacgcattttttttttgaacggaaaaatcaggtacgcatttgaatcaatgtactgtgtacgtaggagagagggggcccatgagctaatttagacatacgggatttcaagtcgaaagcaagatctcctaaaaaaaaagttgaaagcaagagattatagattccaaattttttttagagcgaattctttaacttaagtgacggtggtcaggccagcagggaggaatcggtggtcgtctggtcgtagaggaagataacggggatcatgcatgcattgtgcagcttatgttaaacgcatagcagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 47990 - DNA, 709 bp, Oryza sativa
gggggggggggagtggctgtgtagggtgtagccagaagcgccaaagcaaagcactcatcagccacgtttttctcggcagaaaagttaccactaaaccgcaccactaatcaacactcaagagagagcaaatcaccactccaaagcatcgaagggagaaaggtgaaaatcaccgatcgatgcatccggtgcagtttaaccccagtgggggcagtgcaatgcaattgggcttaagagggatcggatgcttcctttcacattctgtaggtagtagtgtatgtttgtctcggatgttgacggagctcgtggcccctcaccgggagactgcgcaagcccccctttgccggttcgaccaggggcttagggtgcaatcccaagctctctctctctctgtatgtggaaggatcacccgcccgcaagacacacgagacacggcgacgtatacaggttcgggccgctgtgaagcgtaataccctactcctgtgtttttgtggatttgtgtatggacaagttacaaaggattaactccctttcccctccgccttcccaaagggaaaaaaagtcctcctctaaatgggcaaggtcctccttttatatctcaaggggataccacatgcacctttctctttccaaactggactgttctttttctctttaatgggcggagatcggtacggtttccatccgggagcccttctgatgggacagccca

SEQ ID NO: 47991 - DNA, 15000 bp, Oryza sativa
tacagattggagtgagagattcctttctttagctgggaaggaagctttgattaaaagtgttgctcaagccttgccgacttatacaatgggagtgttcaagatgccagagcggttttgcgaagaatatgaacaactcgtccggaatttctggtgggggcatgaaaaaggggagaagaaggttcattggattgcctgggagaaacttacaagcccaaaacttttgggtggactgggctttcgggatatccgatgttttaatcaggctctccttgctcggcaagcgtggagattaatcgaatcgcctgatagcttatgcgcacgagttctgaaggcaaagtactatccaaatgggacaataactgatacagcgttcccgtcagtttcatcgccgacatggaaaggaattgtgcatgggctagagttgctaaagaaggggctgatatggaggataggagatggaagtaagacaaagatatggaggaaccactgggttgcacatggggaaaatctaaagattttggagaagaaaacctggaataggcttatatatgtccgggagttaatcgtcaccgacactaaaacatggaatgagcccttaatcagacacattataagagaggaggatgcggacgaaattctgaaaattcgaataccacaacgggaggaagaggatttcccagcgtggcattatgagaaaactggcatattttcagtaagaagtgtttatagattggcttggaaccttgctaggaaaacatcagagcaagcttcttcaagctcggggggagcagatggaagaaaaatctgggataatgtgtggaaagcgaatgttcagccaaaagtgagggtttttgcctggaaattagctcaggacagattggccacttgggagaataaaaaaaagaggaagattgagatgtttggaacctgcccaatttgcggacagaaggaggagacggggttccatgcaacagtggagtgtacgctggccaaagcgttgcgagcttcattgagagaacattggacactgccagatgaaagcttgttttcaatgacaggaccagattggcttctagttctgctagacagactaagcagtgaaaagaaggcccaggttttatacttgttgtggagagcctagtatattaggaatgaggtggttcatggtaaaggtaatgtccctattacagattcggtgcgttttttgattaattatgataacctacagttgcccgcccgaaaacacatggaagacatcaaggggaaaggacctatgtttcaggatccatgtcagaaagagcagacatgtcagttgaatgcagagaaagaaaagtggagttgcccgcctgatggaagtgcaaagctcaatgtggacgcagcttatagaactgaaacaggcgaagcaagcgctgggattatcatcagagattgcaggggctagtactcctggctgcatataaaactttgcatcagtgtacctcagcggctgaagcagaagtgctagcatgtttagaagggctcaaagaagcaatgaagtggattcatatgccgattattctggagctagacaatgctgatgttgttaaggctctaacacagcaggtagcttcaagatcctcctgggcgacgacggttgcagaaatcaaaggtgtgatacaatgtatccaacgggtgcaagtgcacaagattaagagagaagctaatagggttgctcatgtgttagcacaaatggcaatgagtactaggtcgtgtggggagtagaggctgtgcgccgcccccgcataatcctagacttgttaaatcaagaatgtaaccctctatttagtcattaataaagttctctcttgacttaaaaaaaataatctaaacgaaaatagatagatttgtagaaaaaacaacaattttcatcacgaaaaaggttcaaatacagtacagtagtaagtttcctattctcgtcctgacgccgcggcgagccaggaggcagcgagttattttactcgatatctcgcgttttctcgtcactcagatctgatctgatctgacccctcacagtgaggtaacccctctcgcctcgccacctccccccctgttttctccatttctcctcccaatttttttctccgcatccgcagaaattctgtcccctcctcctcctcctccatttccgatgtattttattcgatttcgagatttgttttccggtgcatagagctcacgtacaaccgccgcgccgaacggtgcatgtgaactgttcggcgaaacgcgcaggtgaggagaggtcgcgaggagcggctgctgcggcggcggcggcggcttcgattcaggtgggggtgggtgccctagggtttcgctgccgggatggatggccgggagcagcagcagcagccgcgcgtgagctcgccgccgccggccggcggcggcgtgatgatgcctcagcacccctacggcgccgcgccggcgatgccgccggggtcggcgaatgttatgcacggggtgccgctctcgttcaaccccatggcgtcgccgaccgcctcgtcgcctatgaagcccgcggatatgtcggggaccatgtaccgcaccgatcccgtcgtgcagggcatgcagcagcagcccggttccggcggtggcggcacggcggtcggcggaggggagctcgtgaagaagaagagggggaggccgaggaagtatggtcctgacgggaacatcgggttgggactgaagcccgcggctgcagcagggacggaggccggcggaccttcaggtggtgcaggatcgaactcgaaccctgacgggaagcgcagagggcgacccccaggatccgggaaaaaaaaacagctagatgctttgggtaagcctgcatcatttctctgctttgggtttatatctgaactctgaaatgatatggcttaatatgactgaaaagtgcaatgttgcttggcctgtagctttggaaaaatatggtccaagcttgtggcgggtatggagtgtgattgttggaaatggaattaattcatgtgtttgcttgtgtgcattaaaaagggcatgtgtggaataatttttttaaggatccctcatcattctgaaggaataaaaatatggcagaatagtgcaggcagagatttgaataataaagaaaagtacaagcactctttatcctttcctggtgttgcactgggcacagtctaaacaggaaaagtaggaattattcaaatatgagcttagtctttgaatattgaacattcattggtgattggtttcttttatatatgttactttctattaagagccaatctatgtgcatatactgacaaatggacaatattttgctgatgtcctttttgcatgttttgaattacaataacttctacacttgcccctgcagaacagggcagtgtcaactcggtttacatattagtagtagtttgttctgttccatagtccttacccatgtggcacggtcagaatgataatgataatgccatttgtcagatttcgtagtttttttttgggtctcttttaacctcaactgaacttgaccactttgtgtggatcaataattatatgccagatctgatatatatgttcttttatgtgctgattttcaggatcttccgggacatcttttactccccacataataacagtgaagcctaatgaggtacctgaaaatgctcccctctctgctatctagtacgagctgaaattcattatttgtctgcttatgttgtcttgttgtgacaaagttacttttggagaacttaagtttttgatttcttgcttgtggtttgtaaattgtaataagtctttgtgccttacatattacatctgtctgctggtgggatctcaagtaatacaaccaaatacataagtgagagctaagaagagagatgtgtagcataagcttcctataataaataccaaactaacatataatgtattcttcagcatctttaaacttgttccctttttgagtttatttgagttgtcaatgccatttacagaatactccgtataaacctttcatttgtttctgaattagtaattttacaattcaggagattgcatatatttatgtcattatttgttgacttgattctgtcttggccaatgagtgtccttcctggctttgatcatcatacacttgccacttggttgtttttttagcgccaatctactacggattggacaccttttagcctattctcctcttctatgtttctacctgaagtccaagctgatgagcatgcatgcatcacctcttctttttggcaggatgttgcttcaaaaataatggcattttcacaacaaggccctcgcactacatgcataatttcagcaaatggcgctctttgcacagcaacactacgtcaaccagcaacttctggtggtatagtaacatatgaggtatattcaagctaaactatctgtgtgcagtgtgcttactgctcagagcaatgcttgagctccactggtgttctttctgtgaaatagtaatgaatatgcttaattaaagttttctcgatgtctttgtttcattacagtgcagtacaaaataggtggctagatttttcttagtagtatatgtgctactgtacagtggtggatccaatgcctcttgacaccgatgagttgcccaggcttgccatcgagccacagtagagcagtgctctgcagtctgcacttcctgtgttcggcaacaccagttgctacgtttgcctgaactacaagaaactccagtgtctgtcttgcactaacaaaccagatatatacatcacaattgccagcaacccctttttgaactttgtatgctttggtaggatgcactcagttgtccagctttctggctatgataacttattttctgatgtattccaatgataagaggagaaatgactagtatagtagtatgtttagaatgttatcacaaattgggggtgggggatagaatgaaaattttattcttctttgttctcaacagtcacaccaggtgcaagtaacataatatctaaatctgatgataaaggcttctggtcattttcatttacagcatgtggttgttagtggccatttctatgtggacagacaaattcgaacaatattcagttgctttgtttataatataattgtatttttttattgtagaaatcaatatatgaatatgaattcttactgtgatgtttcacagggccactttgatattctctctctgtcgggctcatttctgctcgcagaggatggcgacactcgtagcagaacaggtggtttgagtgtggcacttgctggaagcgatggacgtatagttggaggttgtgttgctggaatgctgatggcagcaacgcccgtgcaggttccccattcatctatttgctgctatcactttgttttcagctggtttgtgccctaaactagcattttctttggccttctgttacattctgttttccaggttgtagtggggagtttcattgctgaaggtaaaaaaggcaaggaagaacatctgaaacgtgagccaacatctgccccgacgccgaaccacgcagctggctttggcgcagccacggctgccagtcctccgtctgatggatcatcaagcgaccactccgatgacccagggagtcccatgggacctaatggcagcacattcaataattcaggtcatcccatgcattcttcgtatgctcctgttagctggtcgctatctgggaatcaaggccgttacgatcccgacctgaagatgatgaccgactagataatcctgtgtttttaagctctgttagctgttgacccagtagagtgtagggatcagggattcagtgtttcctgcaccgacaccaccggcagcgttggccaataatccggtgcgctagtagtaatcagtatcacaatgcctgaacaaaagagatcaggaacaaataagtagccccagcgcatggcttggcctgtcaggtagctaattttatttttctcaatcggtagcttatttagcatgctttgtcagttgtcagcctagttgtacggttttcttatgaatgtttgtacacctttttcttttctcgctagtattcggcgtgtacgaatcttaattaagattggaatgacatgttattggatattgtcgtttttcttcgctgtgtttcaccctgcaaaaccattccactactgatgcgttttggtgtagggatcacatagacatgaattctgatcgcattcatacatggtaccagtaatggtgtgtataagtctatggcaaagtgccaaaatctatcgagaatccgcaaggaaataacttgtaaggacagtaagaaaataattcttgtgggataggaacactagagaagaattaataattgtgtttaaagacaaggtatttgccgtcagctcggcctacagcttccaaaatggtggcagcaggtgcgtctctgttttcggtcaaaggcacagagccgccttcgattctctgtgtatgttgatctgctggaagctttggaaagaaagaaacgtaaggatttcgattctatgttcatgttgatctgctggaagctgtaaggatttcgattctctgttcatgttgatctgctggaagctttggaaaggaagaaacgtaaagatttttataacagaaagggtggtagaacacttggtggcagacatcaggaggtcctctgatctgaagagtggccggaattttttctttcgaggagtagcagcatgtttttggcctccttaaatagttttcctgttctttttcgaggtttcccctcgactctgtaatatcatgtatattgtattaccctctttttttatgtatattgtattaccctctttttatcttaaagaaatttggtttacgttctttttcgaggtttcccctcgactcgacagtgtaatatcatgtatattatattaccctctttttatcttaaagaaatttggttgacgtccttccgccgacccggcaaaaaagttttctttttaggctatggaaatgatatatttgccgaacaagttttctttttaggctatggaaatgatatatcagtatttcgttctaaaaaggtgaaacaatagggatactaagttctaaaaatattttacatgaagcagaggcatgtcggatcaattcgatttaagagaggcacgtggataacatattctcttacctttattggattggcaaaactaaggatgtcaatatcttgtactccctcggtttcatatttgactcttaaaactccttctgtttttttgtttgatcaaatttataaaaaaaatagcaacatatatgataccaaaataatttaattaaatatatcattaaatatattttaatagaatattcattttgtgttaaaaatatcattatatttatctctgaattctatcaaacttcaaaaaaatggggaaaaaatcaaaacgactagggagcacagcatacactgacacggctacatgattacattcatcgatataagtagatccgtagatgcgtacttcaaaaacacatgaaaacgaaagccctttcattgaacagaactacatcaagcatgttaattttacatctgacactttttattccagcacacgcatgtgcacacagcatacacgcgtgcgtacgaacacaagctaacacgatcagcggccgggctgggaccagatcactcgctacactgaaaaaaaacacactagcgatccagatcgatcaagcccgcccatgtccatctaccccaaatctagatgtacgatttgtcggacgccgcgtacgtgccggtgccggtgccggtgccggcggccgggtatgcagggtcgacggcggggccgccgaccggagcgtggtggtggcggttgccgccggccgtaagcggcacgcgcgtgccgtggcggcccgtggtggcgttggcgcggtgctccgccctctcctggtgctcgtcggccttggcctgtgccttgccggccttctcctcctgcttggccatctccttctcgccgtgcgtggccgccgtcgcctggccggccttgccgtgcgccttggccgtcccctccttcaccttctccttggcaccgctcaccatgtcctgcaccttcaccttcgccgtctgcatcttttcttttcttttgctcctacagtacagtagctacgtgcgttgcgtatcagtgtgagcctgtggattgagattcgttgcttgcgttttgtgcttcgacttgcgacgtgttttggacgattgggttgattggagtagagtatatataggccatcgacgatgatgggatggatcatggatgagatcgagcggcggcgttgggtgttcgtgctaggtggcgcgcatgcgggggatgcgggaggaggggatctgcacgtcacggcatgaggtggcgcggagcttttgggcctcggtgggcgcgtggctgcgtggcgcaccgtcgagccgccatgtgcctagatgccggccgtacgtcgtccgtgctcgtgacctgacgggcatcgcattcccatggccaggtacgcaacgcatctactccctccgtctaaaaaaaaccttaacctaagcaaatatgtaacatgtctccccgcaaaaaaaaaaatgtaacatgtcgtagtacaatgaatctggataactctttattcagattcgttgtactagaaaatatcacatttccttttaaatttatttttttttctgaaacggaaggtgtggagggagtatgtgttcagcttttattttttcccttcctcttaatgacacgttggagtctcccggcctattatcgctagactcaaatggccggccctgcagcccatataaggattttgtagtgaaaggagtacatgcacatgggcctgatctagaatgttgaccggatcgattaacgatgcgtccggcctgtactttgatcatctcaaggacagtaccatcacattttcaagttcaactctcttttgttctcgagagaagttcagttgtctccaatgaaagtcaacgctttgctcctctctgaaggtttcgatacagaattttttgtttgaaaaggaggattttctgtattgattccaagtcaatggtactagttttgctcaactaaacaaaagtacaaaacacacgtacatgtcgaattcaaacatgttgctagtggatgaaaaacgccccagcttttacacagttcccgttcttttttccaaaacaaaaagttagacgaagattaagatttttgtagcacgcttttcaaactgtttaaataaacagtacgtttcgtgtaaaaactttctatatgaaagttgctctaaaatatcatattaatatacttttttaagtttgtaataattaaaactcaatcaatcatacgttaataccacattgttttgcgtaaaaagcttaatcttaatcttaatcttcatctttagaaaaaaaacaccacctagattttttttcctatctcctaatgcacttgaattgtttaatttcaaatttctatgaaaatcacgcagaattcatgcgattttagacagcccacacacaaacacagatgcatataccatgctgaatgtcctgctttaatctcctgtattcctacaaaacaatacacatccaatttctcttaatttacaatttacaaatcactttactgatcactctgaaagatgatcagttgagagatttgaggtagtccttgaggtccgtggggaagcaagggtactgcctccagaacgcgccgtgcgctcgcagcatcttcaccgccttgtccttggtcgacggcgagctctccacttgcatcagcgccagcagcttcgccacggcgccgcccaccaccatgtcctccagcaccctctcggcgggggccggggcgcacgccaccagccacagcacgttgacggcgagcctcgtggcgagcccggacacccggagcacggcgcgcgccacggcggccaccgccagcccgtgctcggtgaaggccagccgcccctcggggcacttgcacatgcgcttcaggaggaggagcgaccgctcggcgacgtggcggtcggcgtcgaggaggagctcggcgaggacgcgcacggcgcccagctccacgggcttggcgcgccgcgcgccgcgggagtaccgcgccgtgacgtcgaggagcacgtcgagcgcgcgggagctcacttcgcggaggcgccgtcggagaggagctcgaggagggccttgaccatgtcgtcgacgtcgacctccgcggtccagtcgcggacgctggccctggagatcttggagatcatggacattgcgtgcagcctcgcctcggcgctgccgcgctggaccagcacggacacgggccttatgcactccggcttgagcaggagctccaccgacgcgtcgtccgagagcggcagcgtggcgaggacggcggcggcctcctcgcacgtccggaacgccgagaagtcccccccggcggagctctcctccagcgcctgcgtcatgacccggccgagcacctggatgccgccgcacgccacgaaatcctcccgcgccgcctcgtcgccggccatgcaggacttgaggttcttgagcgcggtcgccttgaacggcgtctcctcaatgccagcgagcaccgacggcaacctctccctctccatcgcgtttgacgacgacgacgacgacgtcgtcgccggcgagccggccgtgctcggcgacgacgacgaggaggcgcggtccagccacgacgagatgacgcgcttgagggtgtggttgggagtgaagtcgaaggaagcaagccgctgcatggtggccgggcacgtcgtcttgccgtacttgaagaaccaccgctcgatgctccggcggtcgtaggtgacgccggtggccaccgtgacggggtcctccattagctccatcgagatggggcacaggaacaggggaggaggctccattgccattgcgatcaaacaaagcagcagctcgatttcttggcttgagtgagaaggttgagggagaccaagctgggatgttggttttatacctgtaatgtcatcatatgcaattaaaaagtcaagctaacccaaagtacagccgcaaaatggctcaaattcaaataactaatgaaatactcccttgtcgaaatataggtatattttgtttcgttaggataaagctttgactaacaattgttatactaatatactagctctatattacattgtaatagatgacgccgttaacttttgggtacacgtttgaccattcgtctagttttttaaaaaaattatgtaattattatttattttattgtgagttttcttatcactaaaaatatctcatatatttacatacaatttttgaataagacaaacggtcaagcatgtatctacaaacaacaacgccatctacaccaccacaccacatttcattatatataagaaaaagtttttgatatgaatctaacaatatcaaccaaaaacatatgttctaatagactaattgttggtgctagaaaatctttgagaaaaatgaagaatctcagacaatttagtgctagaaaattgtaatacctgatgctcgaaaatctcagagcaaaatgaaaaaaaggtaaatcatgatgcacgagaaaaatgaagatgccatccgtctccttttcatctcaatagcaggttaaatatatgaaaaaaaaatgttttcttaataacgatacgaagatatgagaaactatcaaaccaagtcaacaattcttccaaattaaaatcccgtaggggaaatgcttaaaaagtacagcttgcagcattagtacattatctgttatgatttctaacgatctgtattgatgtaaaatactctagtcaagagtcagacgggcagaatagtaagcgatcgatcgatggctacacattaaagtgccactgtgcaatgcatgcaaaataaataatactaagtctatggattggccgtgatctgtattactcaagacttcgtctcttacctagagcttatgttctatggatcaatttattcgagattttgacgaagaactagagactttttttattccttttgttttgctgcgtgcagggagcaattcgatgggcgtcgactggagcaatctgatgggcgatgatgaggtgacagtttcacaagtattaacctaagacttggtgtgatgctacttgtcagaaacgtaatgaagagaacacacttgcttgcttattcctttctgttttcttcttcttcttcttcttcttctttttttgtggagacagaagaagtttaatttttcaaaacggcaaatgcatctttggagttgttaaatggagattggggaggagctggcagaggatgacggtggatcttgaattgttaatctgtccggttctatttcttcttctgtttgttcacttgcatgttctttttcctctgtctgtattaattagttgcgagcggttgagcgtttcatttgaccgtgattgggtcatccatccatccagccgcattctcatattttctttggatgaaattatattatagagataagaaatttgcctgtaatgtcatttagttagaagtttcacacctctcaacatcatattactgacggcggatgattaattaatggtaaaaaaaacaaggtggattgcctcttgtaatcttgtatctatacaccatcttctgtacccaattatattttacctatacaagggcttttagcttgttaatgctgacttccctcccatgtataatgtatttttcagaaatgaaagatcatgtgtgccagattacttgggagtcaaaattatggtttctcttaatgtggtttaggtgatagtttggcatcattacgacatctttctttgtcatgcaccgtctgccaactcctgaaactaaaatggaacagaaaacgagtacaagtgcagttccaactaaatcactgtctgacaaacgagtactgtcttcagttcatcatatctgagctatgaagatctatttcatcacagagaatctgtttctgctccaattaattagcaagtagttttaacaaaaataattaataagtatcttgtggttgtcatgccttaatctgccagcaaaacatttctatatgattaaaatggctatatcaaccgtactgtagtgggaacatggatgatggatcactttgttgctttattttttatatatagtattttgctaacgcaagccaaaaaaaaaaaaaaatggttggccttaagctgtccattagtgcaccgccagttagcggaagatgcaattttcaaaacaaaaataaaaaacttgcacgaaattatgtttacgaatacttgcatatatatatataagcacccactagttaatacccacttgctagttgctacactgacgttccacacgtcctaagatcctatcgtttgctcttgccatcgccatacgactttaagagtttttatttttaagtcttgtactttgacaaaattaggcatatcgtcgaacaaacgctccctgttgatttgactgtggcgaaatattcttttgaacagacgttgcaatcggcgcagctgctgatgatcatccataaattgataaattcgttgactaatcgatctgaaaacaaaggagcgtcctgacaagaactgtcaccggctggtggggttacaatatttttcagaatttggaactggtcagagttgaattactagtggtaataccgacacgttactcttactaggttcttatcctttatttgtccaccagtaattaactttaaattctgttcctgtgaacagaagcaataataattccactccggtgacaaaaatacattgacaattggcacagagatgttacctgttcgaacttggagtttcttctcgggaagacttcagatttcttaatttcggttaagcacacagcgtttgacattaaacagtggcttgtttttgcatccatttcagcaggctaacgttttccaaacgtatgtactgcagattgtagaaaaaatgatggtcggatgattcataacgttcaccgaattaacaatcgtgcttccacttggagcagctacctgtacctgcatgattcctttcaaacattgttgtttattcctacattgcatcttgctagtgggaattgatcctgacagtttagctttgaccatcacatcaactgttgtttcagcaaattttgtacctgatatctctttccagggaaagacaatcagattgtaaacttcagctctgtttcagacggcccaaatatatattttttcctgtcattgccacaaatggtaacattacaaagtcgttttcactattcatccgtatataatactctatcgcatgcgtgtacatcgaagtcagaagtaacaaaagaaaaggaaaaaacatgaaaatgatggtctattccaagtgttccacggcattgccgacaccgaattggggatcactcaatcctctgatggtacacattaaggacatagctgttcagaaggtcaccaaatgtcttggttgagaacttctgcacaacatggccccttgcttgtttacccatcttaactgctagatcgtgatcgttcacgagcttcagcatggcttttgaaaattcaggggcagagggctcacagagaaaccctgtctcgtcatttatgactgtttccactggaccaccactgttgcatgcaattacaggtttatatgcggccatggcttccagaggaacaataccgaaatgttcatcctgcaaaatgtcagacgcaggtttattatgggaaaattctcatgttgttgagaatcaaaagacatgccagatatttacctttggagtgtataacacacaaaggcagttggagagaagttcgttcctttcagaagttgaacaagatgtcacaaatttgacatgttcagaaaccccttcactcgctgccaatcttttgagctcctcaaggtattcaacattttctctgagacgcttatcatatccaccttaagcataatcttttgtaagtaaacagtagttgccagttggtaattcataatgcagtgacgatgcaacattc

SEQ ID NO: 47992 - DNA, 2304 bp, Oryza sativa
ttaaataaaatgaaacctaagcgagttacagagagatatacaagcatgcagttacttataagcatgaggttcctgaaactgttcaacagagacagctggatatagaacagcaggctcgactcctctagcatgaaggctgcaaaaggtcctggcaaatgttgttgcagtgaacttgctgtttactagaatcaaatctgccatacctaatacatacaaaaaagggataagcactacagatagaacaaacactagggaatggtaaaaaacatagcaggcaacagttctagatgaacaagaccataccagtagttgtttcttcaatcatgtcaattggcttgcgatacaacctccgaagcatggtagtatgttgagcaagcaacatatcaggaaagtgacaataaaatactatctgaatacacgggaaaaagaagttatcaacatatatctacagtggaaacatactgatcacataaagcaagggatcaataccttggattttgccttcagtttaagcagtggaatcacaaccgaaacctggtctactaatatgatgtcaaatgagggccaccaaagtagcacacacattgcaacaaaaatgcagcgaagatatgcacagatagcgtggaagcggtaaaaaatatggcgaggcaagaaatctccatatactttaacttcaaatggacctgcaggacaatagaaaatcaagtaaagtttccattggcataagaatccctacacactattgagcgatttgagtagggtatccgaggaaacgttttgtgaaattttgtacgtaatcaatcgacaattcacataggaatatatgcatatcctctacaagtccacatcaaatcagtcatagtacatagtaagtctttaacacaaataggtactgcaactaccatagtaagagagttataagcaacattcacctcagatagagtttagatccttaccagaaacagtctcttcaaagcatcggtttttgtcatgatgtgatgtgaaaacatgaacatcatgaccatggaccgcaagctgacaagccgcatcgactatcaatctctcagcaccacctacacaaaaacatatgttttctttgaacaattgagatctagtacaatgctagaaatgctgccacacttagtccattggtcaatgtcctataacctgctgcaatactgctacaacattttttttctcgaaaatgttcttaaaaatctcacctgcatataataaacaagccgcaagtcctacattcaaatgaaaccgtgcaacggcttccccaaaaaataagccaattctagggcatcactactcactacttaactagaagtatcaacacagtatggaagtgaagaagaagaaaaatctttccctaacactcagactaccccgtaattgcagcaagcaactaagcatacgtcgaaccttgagcaaaattgaggaacccaacaaatatcccagctacaagctcaggcagcaacggttcctcaaatctactgatgcttccaccgcgtggactcggaattgctacatatcgaccaatttacaaagtagcacgcaaccaatcgtttcggggactcaaccggatctaccaaaattctgcccacgagagatgagggttcacccaagcatcgacaggagcaacaggaggggggagagagagtagaggcgtacctatcccgagatcggggtggatcacggcgaccttaagctgcttcgtcctcgtccccgacggctcgccggcgactcctcccgccgccgctgccatctccctcgcgtaaccagatgggcttcggccgccgccgccgccgccgccgctgcgggccgtggatctctgctcgctaactcgctctcgctagtcgtgtcgtcacgattccagctgagttgatgtgcgggtggattgggcctcatacagcccagtatctgataacgcgtgcgaatcgcttacggcccagtagcccatatcaatttgatggcatcgagccgtcgagtactcgagttcgagtgctcgcagaatgcagatttccatagcatattatttcggggatggctaattagcgcgtacgtgccctttacctaagtcgcgcgcgcgtagagaagcggtgggcccacttgttttcggcatcacgtacgaagaaaagccaaactcccgttcgtgtttctctctttttttttccggaaaaaaaatcgtcacgggagtgcttaattctcttaaacacttttaacttagatttgaatcttttcaactttgattcgaaaactttcaactctatatttgaaagtttaaatttatatttgaaa

SEQ ID NO: 47993 - DNA, 3290 bp, Oryza sativa
ttttaactagcatgacgctgccgtggtaccaaacacaaaactaaaaggtaaagaaacatatgtgtctcaccaggcaatcccataggagagactgcgatgtgcgccgccgccggtggtgctgattttgtgatgggttcgttctcttgttgggtgcgcagggggtggaagtggttgtccctgttcaggttcaagatctggtggatgatcccgatggtgggcgaggacgtagtcgcctcggctgagctgggcatgtagcaccagaactctggtccatgtgattttttatttttcatattttttctttttttgtgacatgtcatccaaaaacatatttaatacttcctccgtttctaaatatttgacaccattgttcttttagtacatgtttaactgtttgtcttattcaaaaacttttgtgaaatatataaaactatatgtatacataaaagtatatttaacaataaatcaaatgataggaaaaaaaataattattatttaatttttttaataagacaaacggtcaaacaagtgctaaaaaagtcaacggcgtcaaatatttagaaacggagggagtactatcttagactatatttgcaccagtttaataaaatgagggacacgttatatccagttttgcggtttaggatggaacaaactcgacatcaagttgaaggacctcgagtgaacttagtcccgaaaaaacatgagccgatcacagcaaaagcaacgcggcctaagacctcattgtgatgggcctcattctagcccttctaatcggatgggcctcaattccatcccatccatataacgctagaatatacagggcgggtcaaagcccaagccccacactacgccgtttcacgcccgcaagtccgcaacacagatcaacacaaacgccatagaggcgtttctcccggccttgtgcagcatgcgtgcgcggcgccgcggtgccacctcccggacaggtcgggcgaccgccccgactctatcgttaccgtcttcactgtccatatccgtcaatactaacaaaaattaatctatcaccgaaaaacactaccggcttgacggccattgtgccggctccgccactagcggcggccgctcgaccgcttttcgatcgatcggcagggattcacgacgccgtacgagaggtgaaattcttcgccaatcgccgccagtacccgaaggaattcagttagctgcatctctctccccactctctcgatccgctgcacacacgcatatggcgctcatgcgatcgatcgatcgatcggaggcgtgtgcgaagcaattaatgcggcgagagggtcgcgcaggcgtgggagcacatgcggccgcctcggcgggcgcgcccgctgcctgccgcacgtgcgacagcgctcctagctcgctctccatggcgctagcctcgcgcgtggatgtgctcttttggatattgtagcttccgtggtggatgcatctgcgtgcgcgcgcgcgtactgcggagtacgtacgccgccgcgcgcgctgcactacacacagtctcaatctctctcgaatatctcgagagcagcggccgggcgcgcgggcacgcagccggcagccatggacgtacttacgtacgccgccatgcgcgcttagctagctagctcgctccggccggctcgatcggccggatgggacgcgctcacgtgaacgcatgtacatactctatccatccaataaaaaactaacctggtgttggatatgacacatcctaatactacaaatcttaatataactctgtgtctagattcgttgtactagaatatgttacgtccagtcttagattcgtttttttacgggacggagtgagtacgagaacgccatacatggtgggtagctagctagcttagagctgcatcacgtgtaccacccatcacaccgtacccccagcactgtatatgcatcatgctcatagctcatttgctcaactgcggccgcagggttaatttcatgtcgcgcatcgaccaacgcttgctaatgctagctccgtttgatgatttgattaactgaggctaatctatgaccgattaaaacgtgcatataccgacccccatgtggccttcagatccggccgagatcgagctagctatccgcagttctgcacccgccaagagtcaaatcggtggtaattaacagcgtatgtttcagcataattaattaatcaagtaagcgaacactgcaaataaataaataagtaaataaagatatgcgcgtgtacttgagagcgttgagacgatggagagctagatagaatgtcaaatgattgctagcatagctagactaattattattctccgaaagagtttacatatactaattgaccttattgtctatggacagaatcaagcacccatgcatccacacacaccaaagccatacttttcaatgaatcagtaaataaactatgcacgaaacaccacatttgcggccatgtataaactatagcgaggataaatctagcaggatatagctagctagatttgacatgacaaaataaccatttaattaaggcactaaattaaggggttgaaagggtgacaaatcaatcattatcaatcacagggcgctgtgtatatgcacaagcaaactctttgttggtcggttaatattttttctctcgtccttgaaaaatactcctatgcacacgcattttcctttaggtcaacacccctttattgcaagcttccgtcccctcacatttgcgccccatttgccgtctgatgtcgtcacttttatcaggggcccatatgctacttagcataaaatattggccttaataggtgtagtgcttatctttatatggccattaggttaaaggtttccactctggcaagatgccgttgagccctaaaatattagggtgagcaagctaatcgctcattggctcgtgaaaatagtgggtgtgagagagggggtgtctctggctagcttcaacttggcgacatgattaggtgaggcgcctcccagcaaacaaagtctatgccgaattaatctttatttttcttttcgttgccgcgcgccataataaactatactgctctctctctctctctctctctcaagatctctcgtcactttaggatgcttatgcaggtttgattggtgagacgttttgtcgtcgtcttcttagtttcatctccaatttacttcatgaacatttaatttgtagcatgcgtgattcatctcaacttgtgttccacggtttcacattgaatatttaatactccatctgtttcaggttataagatgttttgagggctgcagga

SEQ ID NO: 47994 - DNA, 4512 bp, Oryza sativa
tgaaacatatggagtacattcgatcgtgtgtttacatgcatgcatgcatgggaagtgtgtgttcatgtaaaatggcatccatgtgaatgctcttgaatcataatatacatagatatatgtcctgcgcatgcaggatccttattcaaaactaacaaagatgtctatataaacaaagacctttcatatatagcaatgaaaattagctccaacgaaggctagcgataagtatgttagtctcactgaggctgtgttcggcagcttgagatgatagctaatccctagcgcaggtgaaatggaacgactcattagctcaagattaattaagtattagctaaatttctttgaaaaatagattaatatgattttttaaagcaactttcgtatagaaattttttcttcaaaaaaataacgttcaacagttcgtgaggagcgtgcgcacaaaaaacgaaaaatgtgggagttgggaactcacactaccgaacacagcctaacctcttaaaatcacatcttaacacctacatgtgattattctgggtatatagatttgaattctaatgggtaatgatgcatctacgactttaccatcacacctctagtttcttccaataaatctatatgccattaattctaggtatttaattttatgtcaaaagaatttctagttattttcggaagttacataataattttacaaaaatcatgatatgagcttttgtattcttctagtactattactagctaatattatcagtacatggtagaaatgcaccaagccatatttttggctaccaattactcagaaatgctagcttttactcgtgcacatgcatgatatatagaaaatcattcagatgttgaagacttgaagtgatgacgctctctctcgtggcccgatcttctggtgagggggataactctcgctttgatcgagtgcgacgtttgcgacgtggctaccaaccagaacaagtccaggacgccgtgcaatcgctacaccacaaacgatgtcgtaccaaccgtgacgcgcggttgatgatccctgcaatgcaaacgagagaacactgcaagaacaagataagatgcaatctaaatattgcgaatagggaattaagcacaaaggaatagttgcgattgaagtggtagatctaatcgacccggcaaatcaacacaccaactattgggggctctgaatctatagtcgccgactaatcgagcgaggactagagacaaggtgaatggcacctagcaaaattcaactaaacaaaacccaaatgtttttgaggatgtataaagctatttatagaggaaaataaagctagggttcagtgctaattcgtggaggtggagggtgacacttccgagatgggcctagtctattacaaggcccaaggcccaagttcggtttcagcaacagcactgtcttgttttggcgattcccgttgactcgagatgaatttggacatgagaccagatgcgtttgaaaggtagcgagataatctttccacgaagtccaagatcacccaaatcggagttggcatgaaggcgctaggtccgtttgaagtcagtgctgtctccggaggccgaactggacttggatttggaattatcattggagtgtgtgaagttatgagcgtatccgacgaagtgatgtcctcatcatgaattcatgctttgtacgcgcttattagaaaccaagttgctctcgcccacagtttatccatggcgtggtaataaaaaaatggccagtacagtgactataaaagatttgatgcaacaaatgatgttgatgttgtcctgcgatcaagtacttacgattcttatattagtagtaacctacaaaatgaactttttgtgttctcgatcgatattttaattacgtaatcaacagtagtactatccattgcaagtgactaaatataacgaactttccgtgtttccatagctaggaagaaaatttatttagacttttgtgcatacacaataaagaaatccaaggtgctcgtgtactcattacacttataatactgaccctcaaagcaaaacatatggctgtaattatatgtagtttactcctgtgaggtaaccatcacacatatgttaacattatcccattgtaaactttgcagaagtaatctaatatttgacttgaattggagctatatatattgcgtgatgttagtttataaattaacacatggctctagctgctaattcgaggaatggacataaaatatatgaggccgtgctcgaattgtttgggctagtttctttttttatcttctttcctagggcaactaattacttgtaaaagcaaccaaagcaagtagaaagaacctgcaggagaataaactagaattagaagttacttttagtaccaacatgtgagttagtgtacatttatctaagcatgcgttaattaacttctaactttcttgcattaagtagtagctagtgtctcatcattgagtgattgaacagcagaatcttccaacccttccgggatttacatgcatttatatactgaccgagtaatatataatcaccaggcaaaggacgatcgagcgtcataaaattaagaaggctgagagcccaagacaacacacgcatatatttcagccaaatttatataattgtgcatgctcccatgatacttaccgcatctatatatgttagattaggttgactaaaacatttccatcagcagatcgacacgccagtttttttccctagagattcaataataataatgcatgtatatcaaacactcaggtgcactttgatgaagacctacaattaatagataattaatatgcatgcgtgtggaacatatatatacatatagactgaaacatgaaacaaatatagtagtatcctatgctccgggacgggcgctcatgcaagctcagttgctcgatctttattctaaattattcaaattcactgtgttggtcctcggatttttgttggaacatctcatcccttttatctagcttgtatcttatcgccaagttggaatcgaggaaaatatcaggtggaaagcactaattcatctctctgaaagtctgatgaacaaattgaagctgatctcgatgaccctatgcattcatgcatgtgaggacttaactgtacatgcacagtaagccaaaagtgcatatgatgcccattagccgcgaataacactgtgcaaccctagccaggactgaaaggaccagacgggaggacaaagggttgcaacaaaacaaataacggggttactacgattctgctagccgacagcatttctcggtgacatatcccaaatcacgaacgaccatgggctacatgcctcccggaagttggactttcccgctgttgctttcagttttttttgtgtggccaagaacagcgacaggccaaccaaccagctagctgatcgatcgatcgatcgaatgatcaccatatttagatcgacgcgcacataatattggcagcgaaaccgatcgaataatatgacctagctagcagctgctgttacggacgaacaaattgcctggccctgatctcttcttcttcctccgatcctctcctagctagcttagctagctcctcaatcgatcgatcgccttcgctttgctatagctttagctcactttcggactcgacgagggggattaggctaggtttaatcactccattagccattagctagcgccggtctcgagcttatccaaccattggcccaaaggcaacgtgcttgtcgggattagggaccatgacacgcacaataatgtattcgattagcgattaacttaatcccgcctagccttggctttcttaaagctaaagttgccaccgagggttagaatattgcggctggtacgggtcaccgtccttggaaccaccaccggtcgcgcgcacgcagctgcccaagatctagggcctcgacctctcatcgtgatcggcccggctacggcgccgacggaccgaccggtcaaaggatgcatgaagccatggctagctagctagctacgtactactagatgcgtatggcgaagataacgataattgatcgatcagctagctcgtcgccggccggcaagccggagatctccggctcaccgccggcagtacgctgcgctctggccggcatgtgcacccatcctattaatcaacgatgtagctaggttggaattggataaactggaaatttcatgcagaaaataaataaatactggtcgatatttttttatttgatatgaaatttaagggatcaattgaggggggggggggtgtgcaagaacacgtacggaagataatagacacatcatcacttcagagaccaagttgggatcaagaattaagtttgacaaacagaaacttcagaatttgctcagggtaaaagcgtagtggattcggttaaagaaataagccgattggtagatacaagtttatctagaggaatcgtgaagaccatgcagtttcatatttttaagtatatatattttaaatcggcataattagttattttccttaaat

SEQ ID NO: 47995 - DNA, 943 bp, Oryza sativa
atctcaagctatgcttgaagcatactttatctaacctagagctgcatctgaccattgtgagcaggattcagagagtacacattcaggaggaatagctcaaagagctagacatccagaggagctgaaaagaaaccctgacaaatggatgattgatattgactactatttatcgcagcaggttccctttgcatagaaaaagaaatataagcttatttcgttatgctatgtctatattctcttattctggattccgtttacagattcatcctgtagtttcccgtctgtgtgcttcgatccagggcaccagcccagctcgcctggctgaatgccttgggcttgattcatccaaggtgaaaaattcttcatctattttcatctttatatgattgatctattttctgctatgatgttttttgatccttttaattcatggaatcagttccaatcaagattgactgagtctgataatcaagatacgtctagcatgctcttgtctgtaattgatgatgaagatgagaggtaaattacagtgtatgcattttgcttttattactgtgatctgttactttagttagaatgacttgaataatatttgcagatatcgtggttgtgagcccctgcgattatcatgcccaagctgttctactacctttgactgcccccctgtgtctagtctgattattggttctagctctggaaatgtatcaaatccaaatgaaggaaatgatgcttccattaatttttggcgtcggatgcggtgcccaagatgtccagatgacactgatgagtccagagtttctcctgcagtacttgcaaaccaggtgaataacaattaatgtaagatgatcgagcattcagattgcttgtaaaactgaactatattttctctatgtgcagatgaaaaggcaggctgatagtttcatcaatctatattataaaggtt

SEQ ID NO: 47996 - DNA, 747 bp, Oryza sativa
gcatagaacatgctacagactatcaaggtttatgtggctgttaagcgcataccttagatgctaactcctgaaccatcagttgcaaatttgacatctttttagtatactcggagagcttcaactccagttctgttatatcaggcctgcaaaatgagaatgactcaagatttgaagcatacacagctgattttcaacatcttacttttcctctttttcttcaactgggagtacttacaaccaacaaaattatcagataagaagtacttacaaggggtaaattgattgtatctgaacatctgcaggaaatagtttgcactcttcagaaaatatttgggcttgtttctctgcaattgaatctacgagcagcacatcttttgccagctgctcatcaacactaccaaaaagcaatttgttaggaattatgtctccaatgcactcatgttgatcctaatggattatttgatgtatatgaaagttcagttttcttcagatatacttttattttcttacatgttttcttcagatatacttttattttcttacattgctagaagcctagaacaaaagtttcatgaaaaaatagtactgaattatcacaaactgacaatgtttatgactatgtcctgtatgaataacatgaagggtattatttcgttgcaaatagaaatagtcaagcttaaagccaacctccactctggattgtcagcatagcagctagcttcaactagatcaacaatgagacagaga

SEQ ID NO: 47997 - DNA, 1534 bp, Oryza sativa
accaaagacaatttaaccccaaatatattactgccattctcacaattcatagatcctgtataacagcagctaaaattcaacaactgttaccgtatgacacaaacaagcacacccatttctctcacctgaattgcctccgtgtcaaccgaaggcgttataccaaggaaattcgcaatctcggccaggtctgcacagtccccagcatttcaatgtcagcaccgcactttgatcccaagaacaacagcagtagtgaaatgtttgaaactaaaaaaccttacgttggatcctgctgttctcctcgtcgcggtcgaggctatccccctgccagttctgctgcgtgaacggcgatctgtcgcctaggagcctccgcaacaaagagaaaacgaaaccctcaatttcgagttgggactgtgagggggaaaaagaacgcggaccaaatctacccgcaactgtgcagcaagccttgcagattgagatgcggaaatagggaatgtggcgtgggtggccgcgtaccggaagaagagccactcgaggaggcggtagcgctcgacgccggcgaagaggagggactgggcgggggcgttggcccgcgggtaggccagcaccgccagcttccgctggatctcctccatctgcttcgacgccatggcgagagccctcccactcttcctcgcttccccacctcgccgcgccgcgccggccgaggctgccgctgctggtggtggtggtggggatcgagccgctcgcttcgacggagacaacccaacgagcgagatggtgtcaagatttgcaaattctcaaaatcgaatttgtttttatatttcccttactgtcgtttcaaattctgaaggtgtctggaacttacctgtagcatttgtaaatttaccactgttttttaaaatttatgagctgttcagatggtatgcactttcaacccttctaaaatttgtcattgtcaaattttaacacattttggcactatcaaatcaaattttggtagtgttggttgtgtttagtttgttaacttatcaaaatttgtaaaacaattttttaggagtagaaacttatcgaattaccaaaatttggtagggtagcattgataagtatttcttccgtttcatattataagtcgtttgattttttttattcaaacttggttaagtttggctaagtctaaaaaaaaagttttagtaacatttaaaatatcaaattaatttcattaaatctaacattaaatatattttgataaatatgtttgttttaggttgaaaatactgatatatttttctataaacttagtaaaacttaaaagaagtttaattaaaaaagagtcaaacgacttataatatgaaacgaagagagtatgtgtttggtttatagtctaaccaaaacttgactcttttggtgtagttaaaagtggcaacataataaacaaaccctataacgatgtcactcgaatgataattctagggatatttttataattttctagtaacaatctctcaacaaggatttaaaccattagcaaatgtgg

SEQ ID NO: 47998 - DNA, 2066 bp, Oryza sativa
cggagtctatcgtgcggtgcggttctccgctcgccacgacgacgacgagccccatgcctcctccgccccatcgcggcggcggcggcggccgcgacacgagcgcgttcttcgcggcgacgctggtgctgtgggcggtgtcggtggggttcgagatcggcgcgcgcgggcggcgggagctggcgcccgtggccgcagggtttgccttcttccaggccgccagcgccgccgtgcgcgccgccgtctcccgcgacccgctcttcgtcaacaccgccgtttcgctcctgcactcctcgctcacgtcggcctccggtctggcctctccctcaccccccaaaccccccacttttggttccgtggctttccctattcccgtgcttaggatccatcggatacacgaaatcgtacgctctgttccaacattacgctagtttgaggacatagacgcgcgtggaggattaaacagtaggtaaactagatgatgttgatgcttgatgctttggttcagtactagggaacgggaagcagcatggaatatgtaatcctactgtatagtgctagttttagtgctgcttctgtgggccaaagtggtaatgcaaaatctactaatttgtcttcatttaagctctttttggttggaactgtccaagatagcttacatcccacattacttagtatatgttgattccaagaggtggtgtgcttccaagtagctggcagccaacaggcttggaaacatttccatttcttcaccaaaaaaacatcttctgtttaacataggactgtcttttcccccgttttgtattggaatatactcaaacctctgcaacaatctaatgttactcgaatgtgaaattgagtataaggaatgatataaattgtggtcatcgtacccttttgtatcagcatatagtcgcttacgttacctctgcaacagcctatgactatgttactctaatgtgaactcgagtatgtggaatgatataaattgtgctcagcaaagaaggggactggcttgtcgtggccatgacttgtgcgtactaatttatatgacaatagccgtcctactattttttcatgacacttcttgggcacataattatgactagcaagggtgttgtacaaaactgctagcctctaaacaaaaaaactatacgtgttaaaaaataccatcttatcttggtgaatacgtggacttagtttcatccattaactccaccaaatgttatttctaattcttatgcctgtaaatcagctttatcccgtatgtcttccattcctgactggatgctgttgtatttgcagttatctttgttcttgtcaaccgatggcataataaggacctcaagaacatgtttgagcatgaagaattgtttggtggcagttgggttggagcatattctgctctgtgcttttcttgtggctattttgcttatgatcaattagatatgcttcgttaccgactgtacagtggacggattcctggaattctcatgcaccacctgattctgctcatttgctttacactagctctgtatcggaatgtgacgatcaactacctaattctaactcttgtatgcgaggtacgcctagctcttctcattcttgggcactctagttgtgtagacaaagttcatctttttggcaattcagacaaattttgaatttttgaccccaccttttaaccaggataaactaatttgctcacttatcactcaaagggatagatttgtgtttcagtataaggagtctctattgcacaaattttagccttcattacaaccaggcaaccagctatccatcttggtggcagcttgtctcaagtgtgacatattcagtagttgtttgtaaaaatcattttgtatctctgccctttgcacaaaaggtgcaagctcatgtaatacatatttgatataaccttcatgtctaactaattgttactgagattgaattgatggcgtgtagggttgtatatgatattagaggcttagagctgtttttgcaaagaatactttgttggtaaatacccgcacagactgtcttttactctattaagttgctagagaata

SEQ ID NO: 47999 - DNA, 1163 bp, Oryza sativa
catctacatattgtatgctacggatatgactgtatgtaccttcttttcagagaaaagatgatgtgcaaagccttaatatgctgtggtttgaaataagagaagaactcaacccagtggattgctctttcttttggagaaagtgatgaagggaagagttcttcagcaagtataagctccatgttctgtggcctgccataaaaaagaggtcagaatcaggagagtttgattaatggcatgatcctattacaaagttacaaagcacaaacctgaatatttcactatctttatcaaaacaaagtgttaaaagttgagctgggatttgttcatagtgaaaattaactgtggcaatcccttttgagcatttcttacagtaatctcggtataggtctagcaacttaagcattacatgctttctgacagatacctacaaaaaaggtttaagtgaggcaccgtaataaaacctgcagtagtgacaaaatgcaatagtttatgctgacctttttatcacgtagcctccctgctgcttgcaatattaccttagcaggaaatgagtttagatttgatttggccatatcgcagactgcagcaacagctcggatcctcactttgtcatcaaaatccaatagcctgcctgcaagtgatgctgccaaatacaatattttcatcaacgtgaagaggactctaatatagaaatacgaatgtaatagcaacagatataaatagcagacttactaagaatatcttctgcttcatttccagatgatatagccatgtaacagacttttgctgcatcaattgcagcaattcttacttctgcagatttgtcagagaatctcttcaagaattccttaaaaattaattggttttcttgagcaaaccggagattagataatacaagaagcctcccaatcaggtgaactgcctccagccggatatcaacacggtcgctctaagcaagcagaaaatacacgatcaaggctaatacacatgtaaaaggatatcaaaggagacacgaaataacataccaagagctcatgagttaagtgtggaataacagcaaaaagcatctggggtgcacactggaacatttccaggataatcttatgatgttgtttcctggtttcattagctggcacatccttgttgaaaatgcacgaagacaa

SEQ ID NO: 48000 - DNA, 1687 bp, Oryza sativa
agaggtatgtcaatgtgttattggcctctacgttcggtagaaactagtaatgatgtactatattatgtgttctgaactcattataagatctctaccagcaaatgattctttgctattgtgctactatttgtatattgcgtttcatttatcatcatatgcagacaacctggatacaacatcgttgctcatattacaggtagaaaacgaacaaaattaaatggcattgtgtgccatcccgttttgttttaaagcttcgcctaaatcctaatgtattttagtgtctcgctgtgattgaattgtttccactaactgttgcatcatttgcactcttgtagtacttcatgtacactcttctctttaaaacgagactgaaatatacactgatgtatcatatccttttctcctgaatcttgttgactcaaagtagctcattctatcacgagtacttatcttcagcaagaacatcttttcatttttcttgttcctggatgtaatttggagctaaattgttttgagtactactaatatttaccaggaaccatttttgttactcctgaatctggtggcttgggggtaaattgcatacattagcaataaaaaaaagtaggtcccaccgggattcgaacccaggtcgccagattcaaagtctggagtgctaaccactacaccatggaaccggttgttgcatgtggtccgtcgatggtgatacttctgtcttttactgaagatcagtaacaaagggaagtatactagttgaaacccacatgttcatttgtgggcatccatctgctaggcacttcaattaaacaaaaacacgggaatatccaacgaatcctcttctccacattcccgtacttttttgtgctgaatcgaatttcctgacgccatataaaaaaacgaatttcctgacatatctcaggaaaaaaaaaaggtaatactcgagagtcgataacatcctcctagactcctacggcgtggcacacagttcactaaaatccaggcaacacaagtacacaacacgcagagtcacacatatgcttggagttggagcacttttccaggagtccggctcaggtgcagggaaccctgcacatagtaatatacaggccaaatcaaatcgcgacacctgtacacaaggtaggtccacccaatcaaccaagtaacaatgtaaacggaggtttaaccacgatcccacaaaatcaggtaacagaaccattcacccgcgaaatactttgacgtcgcgcgcgacgccgcacagagtttctttcctctttctctgttcttctgtactgctagatctctaaaattagattggtgattcttgatagagatcagtgtcctcgtgaagcaagacgcatggcggaagccccagtccacccttcatcttcaaagagtatgttaattgtccataaacttggcaagacccgattagtttgtctcaatctctgccataagttatctgctaattgttattaaattagattggtttcacctatatatggtgaataggattttatattgttccttgcatgttaaactagcatatacacaataatgatcacgttatacttattcttatatttagatcatgaaaaagaagacgtgggagacacgaatataagcagtactgatgatgcttgtgtgcaaaagttagagccagtaattggcatggaatttgatgatgaaa

SEQ ID NO: 48001 - DNA, 1522 bp, Oryza sativa
ccattaagatcactcctactggaaaatatgctatagctagcttttctaacacgcataaccatgaactcataactcctagcaaggcccatttgttacgttctcagagaagaatgacagaagctcaaaaagctcaaattgacatcttgaatgattcaggtgttagacccaaagaaggccatgaggtgatgagtaggcaagcaggtgggcggcaaagtcttacatttaccagaaaagattataaaaattatctccgatcaaagcgcatgaaatctatccaagaaggggatacgggtgccattcttcagtacctacaggacaagcaaatggaaaacccttcattcttctatgcaatacaagtagatgaagatgagatgatgactaatatattttgggcagatgcaagatcagtattggattttgattatttgggtgatgtcatatgctttgacacaacatacaggacaaataattatggtaggccatttgctctttttgttggtgtaaaccatcacaagcaaacagttgtttttggagcagcgttactgtatgatgaaacaacatcaacatttgaatggttatttgaaactttcaaaagagccatgtcaggcaaagaaccaaggacaatattaactgatcaatgtgcagccatcattaatgctattgggactgtctttcccaactcaactcatcgtctctgcgtttggcatatgtaccaaaatgctgcggtacatttgagtcacattttccaaggttcaaaaacatttaagaatgattttggcaagtgtgtttttgattttgaagaagttgattagttcatatcagcatggaacaagatgatagaggagtacaatttgaatgataaccaatggttacatcatttatttgagatcaaggagaagtgggctttagtttatggtcggcaaacattctgtgcagatatgaaatccacacagagaagtgagagtctcaatgccctgctgaaatatatgcaacatatggattggttcttgaaattttcttttatttatatagagcaaacactcaggcacaaaattgggctttttttacatctcgatctgcagttcaatgtcattaatatttccatttgcaatctaaacaatatatctatgcttatggtgtgtatacattatagtacaagaaaaaattattaagcagttagacattaacctgtgacaggcttggtcgatccagagcaagcccaacctaatccatcaggactgcatgacctctccctgctctaagtctccatggcgaccacggctccttccgccggccactctcccacggtgagcgatgcgacctcctcaggacgccccacggcaagtgcgcaagcctgtagtggcacccggcaagcaccgccgccccaccccggcggcctgcctcgagaccgtcgtcctcttcgatggcccatggtgagcaccacttcccagccaacggcaggtgtgcaggcacatttgcagcagctggcaatggcgtggtaagcattgacctcgctcccgac

SEQ ID NO: 48002 - DNA, 2047 bp, Oryza sativa
agcgcgtcgcggccatagaagggattcggggagacgtggccgcccgggcgcccgtcgcgcaccctatcctcgccgcgcgcccgccggccaatcgccacccctgaatccacagccacgccacgcggcccatgcctacgcctcccacccgccacaggatctccctctcacgcgcgcgcgatctcataaaaacctcgccacctcgatcggtgaggtagcacgaggcggcctgagctgaacaccgcatcagcagcagcaagcagctaatcgcgcacgtacgcacaccgcgacccggggcgagatggcgcagtcgatgctggtgtcgggagccaatggcacggtggccgccgcgagcaccagcaggctgcagcccgtgcggccgacgccgttctcgcggctcgtgctgtcgcagccgtcgtcgtcgctggggcgcgcggtgtccgtcaagacggtggcgctgttcggcaggtccaagaccaaggccgcgcccgcaagaaaggttggaatttggatggatgaatgcaagctaaactaagctaagctaagctcgcgtttgttttagtcttatgtttgatggtgctaactattttgtaacgtgtcaacgtgtgtatgtaggctgagccgaagccaaagttcaagaccgaggacggcatcttcggcacgtccggtgggatcggtttcaccaaggagaacgagctgttcgtcgggcgtgtcgccatgctcgggtttgccgtaagtagacctttcttggccttctagttatttggtatgcatcatttcttgccatcttggtacgtacctgtgcgttcgggtttgggttagctagctagcaagagcacaagcttaaacgtcaaaagttttgtggttaacggaagcactttacccgggagcgtcatcctttattctataaagggtcacatgttgcataggtagatttgcttccaactacttttttttaaaaaaaaattatagtttttgtcatatattttactttgaattttctgtgcacataaaaatgctatatttctccttagcaaatattgctacttttattttatttttcagtccgagttttgacagcgacattgtttaatctaggccagttagcaactcacatgtataccacacacataactaatgaattatctggatttagtaatataggtattgtaggttttaaaaaattcgtctttcgagcagatatattgtttaatgagtaaattttagagaactataaatttagtgactaaattatcagcttgttgtaacgttagtgacatattatatttcagtttaggaagaagaggggatttctgaaaaaaaaagaatgaatctccttcctgcagcaataacaaagaaaatcattataaatctacaactacgtgaacaacctaacgttaatcctgctgaaacgccgctcagtcggtgcacctgagtcaaaacctcattccaaggtagggcaaatggccatttcatcttcccctttgccctttttagcttgatgggttttaacctcggtgcaccaaccgagtgcgagtagcattctagtcggaacaaacggaacaattagtttcaggccgattttagttacaaactttttcttcaaacttttaacttttctatcacatcaaaactttcctatacaaataatcttacaacttttccgtcacatcgttccaatttcaactataaacttttaagtttagcgtgaactaaacacacccctagtggagtcgaaccaaagtgatgcacttagttgtcggccgatgtggcatgctgctacgatgcacatcttgacattgacgtgtcatgaagacatgttcctccatcttgccacactatatactacctctatgacacgcgatgtccatgtatcaataatattactaggatgtatatgatgttacagatttgtgatattttttttcttttattactgtaacaaactaaaactggttgtaaatgttgtagcacttagatagtttagtcactaaatttacagtgctttaaaatttactctcgtttaataatttgtatagtgtacatgcat

SEQ ID NO: 48003 - DNA, 721 bp, Oryza sativa
  unsure (1)..(721): unsure at all n locations
tgtatttgaagtataggtggatggtgcctcnnttatagatagagttgtagttggcttagataaaccagctaccactagtagttgtgttagttgtgtagttacgtcctatttgctgagactgattaaacccgtatgcgtgtggtctgagaccaccggcgttccggtcgccggtgaacctcgccggcgtttcggccgatggcacacatgggcccatatgcaggccgcagcccatttaagcccaagtaaagaggcctcttttctttctccatttttgggcccaatctgttattgcataaacttaacttaagcccatacgtattccaatcagaaaattattagagaagagaaatactggaactgacgcgtcttgcgttgtcttggcttcacaaatcaacaaagatcggcagctgcatcaacatgcctgacacggcacgcatgttatttttgttggttgcgattagatgttaattgatttttctgcgattgaatgtaattacttgaccccgtccgtataatcacacgcacatagaatagaatggttatgcgtatacgaagatgagaaaggaagatacggtccaaagaaattcacaagcaattgaaaacaaacgaatatttttcaaggagcagatctctgttgcttccttttcttctctgttgaaaagggaagggaatgttctctctttatgtcaacgcttatctgacgacaaagtggattggatat

SEQ ID NO: 48004 - DNA, 778 bp, Oryza sativa
atctcgcgggccctgaccgcgacgacgtcgcccacgcggacgtcgcgcacgctgacgacatcgcccgtcgtcgcgaggaccgccttcgcaggtagcatgcccatcaacgacgacatctcggcactcgcctgcaacctcgcaacgtgagtgttcgtccaggtttgtgtaagatcgccatggatttggtgaagaagacgataacattgacatgaacctttgtgcatgccagtgtctcgagccattctgcggtggtgaagaggaagacgatggcgcggcagagcgcgccggcgccggcgatgagcatgaggacgttgatgtcgagttacagctggctcgccgcggcgaacccacggcgcaccatcggcggcgcgccggcgacgacggccgccacggccaggcactgcaagggagggaagagccactcgaagaaggaggccatgaggaggacgccagaggcgacgatgtacgggctcggccaccagatgaccatgccgctgctgccgtaggcccacaccgacgcctcgaggccggccttgttcagcgccttcactggactccagacaaagacggcgacgagccgacgacgactcgattccgtgagaatcttgcgcgagaatcgcatggaggattaatggcgcgcgcgcggtggcttacctatggcggactccgtggcggcggcggggtcgtgctcgacgacggcggcgcacgaagccgataggaggagtggagtgggcggcgcgggcgaagccggcaggcacacggagcatcgacggcgggc

SEQ ID NO: 48005 - DNA, 6918 bp, Oryza sativa
  unsure (1)..(6918): unsure at all n locations
tcaggatacttgaataaccttgtagcaagtcgatcatttgctttttgtggcttgtagtattgccgttgtgccaattgtcgttgtgttcttgtgtctgtagttcgtaactgcatagatgaaaactttaacattagcttatattgaaatatcatgccgagagctctctttcaaggctgtgtacggctgcacgttgcagcggctgcaacgctgtacaaaataatgtgcgaggcggccgcagccgcagtagtgcagccgtaacaggccccaagtttgtgcagtacttgtatgttttttcttttttctttttttccccctttgattctttagacagtagtaagtttcgctaagcaaatgtaccttttttccccctgaaaacggttctaaatttgacacatcaatgatgaattgaatcaagtcacagcctgcacgttgagccacttcccggcgcttcgttttccggatgctgctgccgtaagagctagccttcatcaatactgtccattgtccaacacttgtatgttgtgtttgctcttcttgatcttttggcggttgccaatttcagtgtacagatcttcaaaacttgacaccatggttctgaatcttctgataaacgaagggaaaagcctgcatttctacagagccacagcgatgcacgcacttgtgtttgtgtacgtataatcaggcttgacatatttgctttcaagagttcaagaccaagcatttcccagtccgatcgcagccacacgacgtttcagttttggacgtcacaacgccgccggcgtacgattgtacgagctgagggcgatggactacccaccacctactccctctgtcaaaaaaaaaaaaaagacaaatcctagggtttttttttaactttgactgtccgtcttatatgaaaatttttataattcgtattttcattgttgttagatgataaaacatgattaatattttatgtgtgacttgtctttttaatttttttcataattttttcaaataagacggacggtcaaacgttgagcacggaaagcaggatttgtcttttttttgggacggagggagtactccgtctttcctaaaaaaactcaacccctaaaatttcagtacacaaatagtagagagagaaaatgtcacgttaatacaaatttattactattgatgagtggataggaaaagagtattgaaagaataaaatttatcaatttacggtttaagaatagatgagaaggtagatattgatttactctaggacaaaatttaagattggaacagctagattttttcacagttagatgagctttgagatgtgtgcgtcaattggagatatactccctccgtcccattaaaaaacaattctagaactagatgtgacacattctagtacaacgaatccggacagatgtatgtctagattcatagtattaggatgtgtcagtactaggttgttttttttatggacggagggagtaacaattaaccaatgcatgcagtggtcaaggattgagaacccacgatctgtcgaatgctcacgtaccactaaaccaccaaactatgccaatatcatagttatgttacaatatagttacaatgtaattacgtatcaattatactatagttatatctaaattttttttaaaaaaaaacttatcactgttttagatactcccttaaagatggtagttagggcatctccaagagaatgctaaacaggttactaaaacataaattttaggaatttggtgaaaatcagccctccaacagactcctaagcatggtcccaaaatttagccacctccaaaaccaggaccaacctgaaccaaatattgggcaactagaagcgctcccaaattttagtcctctcttggagaagggggtgtattttaggctaaatatgtttttggctgtccccaatacatgatttttgggagtttaattttagtcatctattggagatgctcttactccagtttattttgggaatgagagaatactactctacctccgaggcatcttcagccatccaccattccaaccgcaccataggagcaactcctttgggcttcagcgtccgcaatatgggccactttaattggtcctggaatgaatattagactctccaacaatacgagtgacctaaagtgaacttatttctcaattggtccatggaggccacactcgaatcgaaatatgggcctggcacatggaggcccatttgaaatgaaggcgatgtgccctattagaaatgaataagttcatttcagatcccttaactttacaccaaatccgattttcgttcttagaaaccaaaaatcagatgcaaccggtccctgaactgtcaaaatctgtgcaaacgaagtccctcgacggtttgaaaggcgattttgactgatgtgacgtttgcgtggctggtttgattaggacttcgtcccacgtaacattgacatggcgcatatgcgacaatttgatcccggaaaaataataaaaaaacgtaagcatcacgtcagccaaaactgtctttcaaaccgtcgagggatctcgtttacaccagtttttgacatatacagatacaggagccggagtcggagccggatccagaattccagatacaccgtgtatcatacacgaacacgatcaatcacctgattccttcaactgtttcgtcagccatgacgagcgtttctttggctcttttcctccgaagtactagtactacattcttctcccatccagtcctcagcaagcaagaacttgggcaatcagttcactgtcctgcactgcgcctgccgctaactagagatcgaactatcgaaggcaaggcatgctgccatggacaagaccatcgttctgtacccgggcctctacgtcagccacttcgtccccatgatgcagctcgccgacgccctcctggagcacggctacgccgtcgccgtcgcgctcatccacgtcaccatggacgaagacgccaccttcgccgccgccgtcgcccgcgtcgccgccgccgccaagccgtcggtcaccttccacaagctccctcgcatccatgaccctcccgccattacgacgatcgtcgggtacctggagatggtgcgacgctacaacgagcgcctccgtgagttcctccgctccggcgtgcgaggccgaagcggcggcatcgccgcggtggtcgtggacgcgccgtcgatcgaggcgctcgacgtcgccagggagctcgggatcccggcgtacagcttcttcgcgtcgactgcctccgcgctcgccgtgttcctccacctcccgtggttccgcgcgcgcgcggcgagcttcgaggagctcggggacgcccctctcatcgtccccggcgtcccgcccatgccggcgtcgcacctcatgcccgagttgctcgaggacccggagagcgagacgtacagggcgacggtgagcatgctccgcgcgacgctggacgccgacggcatactggtgaacacgttcgcttcgctcgagcctcgggcggttggtgctctcggtgacccgctgtttctccccgccaccggcggcggcgagcccaggaggagggtgcctccggtgtactgcgtcgggccattggtcgtgggacacgacgacgacgacgagagaaaagaaaacactaggcacgagtgcttggcgtggctcgacgagcagccagatcgcagcgtggtgttcctctgcttcggcggcaccggggcggtcacccactcggcggagcagatgagggagatcgccgccgggctggagaactccggccaccggttcatgtgggtggtacgagcccctcgcggcggcggcgacgacctggacgcgctcctgccggacgggttcttggagcggaccaggaccagcggccacggcctcgtcgtcgagcggtgggcgccgcaggcggacgtgctccgccacaggtccacgggcgcgttcgtgacgcactgcgggtggaactcggcgtcggaggggatcacggcgcgcgtgccgatgctctgctggccgctctacgccgagcagaggatgaacaaggtgttcatggtggaggagatgggggtcggcgtcgaggtggccggatggcattggcagcgcggggagctggtcatggcggaggagatcgaggggaagatcaggctggtgatggagtccgaggaaggggagcggctcaggtcgtcggtggcggctcacggcgaggccgccgccgtggcctggaggaaggacggcggcgccggcgccggctcgtcgcgcgcggcgctgcggcgattcttgtcggacgtgggcggccgcgagcttcgatccgttgagactttactactttgggccttccacgagattgtcgtggcacgcattgggctaccactggactaatatgggcccaatatggcccagtttatttttggcattctcccgctcgagcgccccgttgggcgggaaaccaattttgatgggggaccactttgcgtgtataatttgtatactgtattattattaaccgataatttggataagctagattgcattgcggagtaatgtaatttgtaaagaacactatggtaggctgcagatataactcttttcctcttaaaaaaatatacgtttatacgattgcacttctggtacatgcattctaatctttactcccccataaaaaaaccaatactaaatgtgacatatcctaatataatgaatctgtatatgctatcacctagaggataatgattcttttgggtttaaattctatcctacaattaaaatgcataggcgctttttactattacttcctatgtttcataatgtaagactttctagcattgtccatattcgttcaatgctagaaagtcttacattgtgaaacggagagagtaccttataagcacattttgtgtaggtgtttattcactactacttttatatccacattgttcctgtagagcaaagacatcttagacatgggctaggatgtatttatacatctgtgcacgtataaatttccgtatttagaacgaagaaaaataacgtgcacaactttatacttgagtacgttgatcgagaggaccaatttaccctcggcaaaacccaccgtcactgctacccaactccgttccatggcctccgcctccgcctccgccctcgctttcgcctccgccgcctagcctccctagggtttcgggttccgagatccgtgccgccgcaatgcccgcctcgccggagcaagccgtgcgcgaggtcggcaagcgcctcgcgcagccacgcctcggcaaggacgccctcgtcaagcttctaaaggcgagcagcgtcgcatccttggtttcgtcttgcttaaatcggtctaaatcaaccgcgcttccatttccggtggaacgttgtttcgattttcgagctttcgaactggttaggggcgttctgtgttgccaactagagcggtatttgctacatgtattggtaatttctcagttggagatcaggggggcacttcagcctctatatatgtggctaccactaccaatgttatgagtttttttgttgacgctttggcgaattcgagtaccatgctgcattttctaatgatattctgctgatccgctcacatgtccacgcgacactgcagtaacaatgtagtagtgctgaggaagttgtgtatccactatgcctgtgtttgaaaatttgaatgaatagagcttccgagtaagtctctgacttaggggttttagggtcatctcggtagtttgtagaaaattgatttgtcgaaattagttttggtatgcggatatttctgattggcatccagtagaggagtcgatggcttaattttgtgttcatgcgaattcgaagtagccatagagacttcagttaattcttatatttgattnnnnnnnnnnnnnnnnnnnnnnnnnnnntgtcccaagttttcctgccttttgaattgctgagttgaagaaagttgctctccattgtaaacttagtgggtaaggaatgaatgataaccaagacttacacctattcattgccttaaattgtgattcacacttgagcagttcaatctatttttccttttccattttacatgatagtttctctggcagatctactgggattaaattaatttttatttgccttatggcaaatccaattctagtcacttgtctttgtattttattgatggtcaagggcactgactatgttcaaacactttgttgaaagttgaaactctgtttaactattcacttgctcttattagacaaatcgttgtgataccgtctcaacagtccaaaattgaactttgtagtgcagccaaatgcactttggagctactgatgaacattcaaatacttaactggcatcattgtaacaattatagcttcaaataatacacgagtcgatgttctcagcttcaatttgctgttaactgattgcttctttacattatcttttctctgaataggtttattctgtacttccataactgcttctgatatttttttctgcagcaagctgaaagtgctttatcagagttgagtcagtcctcctctctgcaggaggctctacatcctctgagtaaatctctggtccagaccacattacttacccatagggacaaggatgtcaaacttcttgttgcagtttgctttattgaagttatgcgtgtccttgcacctgatccaccttttagtgatgaaatatttaaggtatttaacctagtccaccttcaatactgatgattggttattgctgacttcttcaattatttcctttagtgacaacctgataggtactacctaatgaccatttttgaataggatttctgaaacagtaatcatgttagatttatttaatttaatttagtggcagagaaaattttgagcaaggaccattctctcttgacactctgttaactcctttttctcaggaaatatttaggctctttat

SEQ ID NO: 48006 - DNA, 5113 bp, Oryza sativa
  unsure (1)..(5113): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntcgcatagcctaaaatctcaacaaatccaaccagctaatatggtgtaaatatcacgctgcggccttcctactctagtagcccaaccaccaactacattgcagacaagggactaatatgaacttagctaaaagttcctgaatctaaacctagcgaaagctaaaccgatcaacccctcggaacaacccatcgatctcggaatccacgcccaaagctcacgggaaaaacacgagaccaaatccgcacagatccaaccacggagaagcaggaatccacgcggccgacgggaacggcgggggccccctaacaggagcagcacgggcgcgcgattagccccccaatgcagccgcccctcgccgcgaggcgcagcacgacgagcgcgtgggttgggggggttagatccagaccttgcgggtggaggtggtgggcgagctgggccgcggcggcgacttggccgggtcctccgggtcaaccgcctccgccgcctggctgagcgggatcgacgttgactcctccttctccgccatggctcgcgcccctcctcctcctcctcctccaaagctagctcccagcaagcggcgcggccggagacgagggcgaggcgaggtgaggcgtcgctgccgctgcttttggctggcggctagtagcagcaagcggttgatgcttggggtgggttgggttgccgagagggagacgtcagacgtggcgtgctggccccacctgtcagtcccgctttccgacgccgtgaaaccgccgtccgccacgtggcttttctcgaatggctggcaggtgggacccacctgcgacgcgggtacacgtgtcggcgcggccgtggctggcgcggttaaggagacgggaggtgacggcgtcaacggggaagcgcgtcggctgcggggtttgggctggcggtgagctggcccgggtggaacggaacggacgtcgggtgggccggacggaagcgggggttggaagggtaggacggttcggaatgtggggcccagtccacgtcagttcaacggccgttgtccatgcacccgacggcggcttcgggaacggaagagagttcgtctgggcccacctattcggcgtttacttattggtcccacatgtcagaggacagagtacgttccggactaccacttggagacgctaatgggccattttagtttcacagactcaacgtgtccacgtaataagaacatgggcctgtatgcggagttggatctttgttctcaactttgctggtgcctaatttgaagccgataattaattcctatgtcgctcttccataatcttgggcaaaatcatttccaatcggaataattaggtcgacggcgatcgatgttgacatggtgatgttggccaatctactactaatatccaaggcgatatcgttgttagaatatctatcatccaaggtcttgcaagacatccactcattctctagtattctatacttctaccatttaactatttcagatcttacatacacgcaggtcttttatagtaagaatttatgctagtaaatttggagatgcatgcagtggtaaggggtgtgtggttttaaccccgaagtctcgtgttcaatccctaacacgctcatgatctattcttaaaaaaatatttggagggtcatctctccctcaaaatctcatttcttttataataaatttgtcctatcttcgctttcttataagcacatataaagacattcctattatgtgtttctacttgtcttctgtccgagtaactgattttacgcagagatagattttaaaaacatttttttctagaaacacgtaatagagggactcaaaacatgtgtgcactcgtccttacgtacatgcgcgcacatcctatttcgatgaacatatctaaagaccggacggatatatattgatgttggagatttcatatgtaactgttgatttggtttctatagatatgattcgttttttgcacataaatatatcgatagtccctgccgttttaacgtgaaaccatcgcattcaaatcacgcatctcttttttatttttctcgatcaacataataattaggagaatacatcttcaaaacgagcgtggtgtcttgttttcatccagtagttggtgtaaacgtccttagcgccaatgtcgtggtataaggtaggcaagcatctaacacttgtgcaatccaactgtctcacatgtctacccaattctataagaccataaccagagacaaagattttgtgccttgttaccaaccattactctctcataaagaactcggagaatgcatgcttttacatccatctaacaaatctagtcctctcatcgttcttcctcttctaatttgcacccaaaacatgatcaaagaaaaagaaaaagaagaaaaaagagaaaacaatggagatgcatcccatattcccataccaccaaatctaatcaacgaacaaaagaaaaaagatcagagcagaacgcgatcagacaatctgcgacgtccatctccgtctctccgtctcatcccagccgtccgtgcttaccttattcttccagaagcgaaagagagcaggacagaatccggcggctactgcgtgtgcggcggcggcgggtggtggtgatagctcgactccgaccatgacgccgccgtcgccgggtagaccagggcgttctcccagttccactcctccgccgccgacatgctctggtgcgagccgccgtgggacgagtagtagttgcccggcgcggaggaggtggaggaggggacggtggccacggaaacagagggggtagggaaagagtagtaggagccgaggaagccgctcatggcgccgccgccaccgcctccgtagggattggtcatggagccaccgccgccgccgccgccgtagaacggaagaagggtgccttggttgggggtggcggtggtaagcctcccctgcagaagcatctggtagcgcaggtactcggcgctctgggaggcgccggggtagatggccgcggaaggcgatgccgccgcgaccggcgccgggggcggcgccgcggtggtggtggtggcggcggtcgggtagaggcgcgcgtcctcggggaagttgagcttggcgcggctgccgcggaaccggagcgcggcctcgtcgtaggcccgcgccgcggcctccgccgtctcgaacgtgccgagccacacccgcgccgccttgtgcgggtcccggatctccgccgcccacttcccccacggccgctgccgcaccccgcggtaccgccgccgcggcgtgtcgggcccctccgcgttcccgccgccgcccaccggcgagtggtgctcgtccatggtcgccgcgctcgcgctctgggtgtccgagctctgctccgatcctgcacacgcaaccacatatttatacacgcgaccgcacgaggcgtgagcaaacgacacagagaaagaaagaaaagagcaaatgcgaattcaaaacctgctcgctttaccactattaactactatacacacacatgtagtatatgaaatatgaatgcgatgtggcgcaatataaattataaaatgagaagtggacgatctctatcacaaaacgagtgtaattatttttggaatgaactatacaaatgcaagtgatgacatgacaccagcttataattttattcagacagcttttttttttgcccatgtacttttaataacattttttcctcatttatactttccagtagtatcttttgtgaagtgtatatatcctgtgtgttacgcaagcacatcgagagagagagagcaaatgcagtgcacgcatgcagcagcgctgcccaacggattcacatggggaatggcttagctgtatctttgttgtgttgcggaggtgcagtggattcgaagactttttttgtgctgtgccggtgaatggcgtacaactgtgtcgtgcagatatggtttgttttgaacccctgatgtcagctgtaacatgcagatatggcgaccaccctgccgctcccgtcaaatactttgatattaagcttcgggtcacgcatgcgtgtgacttatcgttacgctcgcaactgcatgggtatgcatactgtctcccatttgtttcgtagtgacaagtggtattgctatttaagcttaataaagaaaattgttggttttgggcgaaaagaaaaggaaaataatgttttttatgtttgaatggaactccgctgtaaagctttaaactatatagaggtgcaattggtttgtcattttccgttcgcttaactaagggtataacactggaaaagactatacatactatattttttttactaaattcttactaaaaccgatgtgtcatgctacgagtatatttagatttttttataacatttatctatctaaatcaaatggctgagattattgttagtataaattttagtacatgtagcagtgctcgggtacatgcatgctctggaaattttttttaaagaaggtcaccacatgtgtatattgcaccgtacaaattccaaatggagaattttttttagatactttgaacagaggatatgatatgaaaccgaagttaaaatatacgcaaaagcgcttatatttggtgaatttttggggggcatgcctaaaaagttgcaactggtttgtccattgaccatgcttgccacgtttcgtgaaaaaaaaaagttgcaaagcaaagagcagaagttggtaagcaaagcgtacgcgtgttcgctgttccattacctgcgaactccggcgatggcgcgcccccgcaggcgtatcccgccagctcgtgcattgcctgctcctcccgcctcctctcctgcacgccacgcgccgccgccgccgcgccgcccgccacgacgcgcgccagcgccgacaccatcgtcgacatctcctgcgcctggtaataccccgacatg

SEQ ID NO: 48007 - DNA, 1275 bp, Oryza sativa
gggaacatgcatgatatggaaattttttataaagaaggtcaccacatgtgtatattgcaccgcccagattccaaatggagaattttttttagatactttgaacagaggatatgatatgaaaccgaagttaaaatataggcaaaagcgcttatatttggtgaatttttggggggcatgcctaaaaagttgcaactggtttgtccattgaccatgcttgccacgtttcgtgaaaaaaaaaagttgcaaagcaaagagcagaagttggtaagcaaagcgtacgcgtgttcgctgttccattacctgcgaactccggcgatggcgcgcccccgcaggcgtatcccgccagctcgtgcattgcctgctcctcccgcctcctctcctgcacgccacgcgccgccgccgccgccgctgacgacgacggcgacggcgacgaccacgcccactggtcgccgtcgccgtcgccgccgccgccgccgccgcccgccacgacgcgcgccagcgccgacaccatcgtcgacatctcctgcgcctggtaataccccgacatgagctccgacgcccccgccaccgtcattgccgtcgccgccgccgccgccgccgcacgcccgtcgccgccgcccttcaccggcctgccgccgccgccgcgtggtccacgttggtctgccaggtcgaagcacatcaacgtctcatatgcaccggagtctctctactacagagtcgcttcgatgcaagagagagggatcagaattcagaggagaggtttatctcgttaattctcgtttcaacccttccgaaagttttcagcggacgactcgcgcatttatagggctagtttgtggcgtgcgtattctagtaatcggcacgaagagagagagaaaaaaaagaagaaattaaaggagattaagcaacgtgacagaatagccgtcttctaaagctggtttcaaacctgcatatatcatccctttgcagcaacgcttcccttggttttgtttattctgtttttgtgaatttatttatctatgtcccggtatgaacaagcgtagtaaatctatgatcggtttacggtttacggttggaaattatcatcggtaattcttctttttttctaaggattagcgtgggcaaattaattaccaggtcggcagtaggatcaagtgattagtacgagactacgagtgattaagcttgtgccgacatggcgcacgtcgtcgtggcgagcgcagcgccggcacccgacgctttgacgcggtcagcgtctcgtatccgacataaatt

SEQ ID NO: 48008 - DNA, 11574 bp, Oryza sativa
ctactatacaagaatggtatggataaagcccgattgaaaataaaaatatgagagcatcaaagtatctcgttttcttaaaagggaataaaaagggggccataatataacagaggtatcaactctaatttgggtggatgaactccaaatttgattcatcccccccttttggaatctaatttataatgtatgccttaaatgataaaaatatacaattgttgtactacataaataacattggtgagtatagtctctatctcctttctgtatcgccgtggttattcttatacgatgggttcatgaagtagagtttggaggggaggaagaaaaatagagcaagagtaagaaaagaaaacggtgcgaataaagacattgtcagtttgttaccaaaggtaagagaaaatctatgatatgataattttatatgatcaaaggagaaaccgtctaaaatattttagatacatgatggatgcagttggcatggacggcattctcggagtcttctcctatgactatctcccatcatgtggtttctaggctctccatcaacacctgtagttgatagtgtggcgggtttacttgcgatgcaaagtttgccctacgtcccgatcaaaaggaggttgcgctacctaatacgttcttctctggtgagctactcacaattgcaatggtcttcttacttatttttggcggtggcttttcatggtgtggctgaatttctctctcatcatcgaggttgcctcaacctccaacttttggacgttctatctaagtttgcgtcttggtgtcttcttctatagctcgtaatggttttactatcctagcccatgttagtccaaccactattgttgtggccaaagtgaagccaagtagttagttgcttttatttttctttcattttttaagtatttctttgattgttttcatgatcaaactgtaatttatctatcttcaaagggcttctttgattatcttgttgtacaatcatatccaaatatccacttatagggcctaattcaaaggtgagacacgcctggcacacaaaacgagtaacactattaatgctatattaacttagtattaactgttataattttaatgatagggtttatttgaatttttaaagaaacgtttatatacaatttttttaaaaaataaaacacatcgtttaataatacatggagtagtaaacgagtagctagcccaataaacccaaatgagaaagtaggtgtgtctgagagtaggaaaaaggaagattgagaaatatgcaaaagcaacgtaagttattagtgtatgacaatttacgtattaattatttcaatattgtaaataaattcatatacactactacaatagggatttttctgtgcggatgaaatcgattttcgcgtgcggaggattcgaccgtctagaaggaatcgtctgcgaaaatgcgcgatttttcgtgcgggcgacgcacttgcacgcgaaaatcattttttgcgtgcgggcgcttaagttgaaaccaaaataaaagaaaaaacaaaccctaaccctaatctagccgccgccgccggcggcggcaccgccaccctagccgaggcccgccgccgtcatcccgcggttgccggcgatggatccattgtcgccgcggtcgccggcgacggatctgccgccccctaccgtcgttgacgccagatccgctgcccgcgcgctcccgtcgccgccgggaaaggaggggaggggaggagccgcgggccccgtcgtggccgccgcccccatgcctcccctccgctggtgccggatgcaaggggagggagggaggggagccgaggggaggggaggggccgcgagccgcgccatctgccgccgccgcctgcgcccgcgccgctcgtgctgccgcctgcaccgcccaccccctgcgcctgagagagagagatcgagagagagggctgagagaccaatagagaggagtgagacagagaggtccgttcccgaagacccagacttaggcgcgcgcggatgggaaaaaaacaaaattttcaaagtgggtaggagggaaactatttttccgtgcggttatctcaatagatctgcacggaaaaatcggtctattttcgcgtgcggtcctaattaccacccgcatgcaatcttaatgggtttttgtctaggaaaatcacttgtatagtgtgatatttacatagcaacttttttctatagaaaacttttgcaaaacatattgtttagcaagtcggaaagcgtacgagtgaaaaacgaaagatttttttctccctctgttctccacttctcctaaggcagtttatgcataaaaaagagtttatcaaatggcaccctccaaatccaccttttggttcgaaggcgtccatgaatcaccaaagtgttgtatgaagaaattagctcagcaaatcggaacttcacatgaaatggatgatcttgcttttttgtcacgaagattttctgctggcacagtggcacttcaacctgtgtgcgtcaaactgttaaccaaaacgaaaagatgagttaaaaaaaacgaaacgaaaagatgtactacttcttccgttctaaaatataagtatttttaatgttagcacgggtattaaaaaagtaggtgagaatgattgaagaaggtgtgtgattggttgaaaagaaaaagtagatgaaaaagaatgattgtgattggttaagaggagaagataggtagaaaaataactttattttgaaataaagtactgtgctaaaaatagctatattttaggacggagtcagtactacccaagtttatctcggacgaaactttgctgtcaaatgtcacatcgttaagacaaatatcaagacgtgaattttggaaccacgttaagctgacacgacaaacacggagcatgttggttgatactccagtacaatagtgtagtacttcaaactagacttttcgttttttatatttgtacaattttttttaataagatgagtgttcaaacagtataaagacagatgaagtagtagtagtaagattctaccatgcggggaccacgtacgactcatgggacatgccattttccgaacatgtacggcaccgatgtcgtatccagataacgtataaggggcaaggaggagaaatcaacggctggatcgcgacgattcagcgtgcggcgatccgagtgccagcgacgccgctgccatcgttttccctccctcgcctagcctcactgaacctgagccgttggttgggaggcgacgacgtggtgcgctcgtagccgtcaacaggctcggtccgagccttgcatacagctaaatatacggtggaaaactccggctaatctaaaaaatcacgtaaatcccgattaagaagtcctgttaattcacagaaagtcttacatacagttaatatgatgagtccagttcaaactcgactaagtttattgagatatactctaaaaattaacaagctttaagaatgaaattgagccgactttttacacagctatgtatcttgttggataccagctaaacatccgtgttttgctatagatacaagaaaaaatatcataatattttctaaaataaattaaaatgtattttttatgaaatatgttaccaacatttttttataggacaaagtgtctatccacattaattttatactccatctgttccaaaataagcgtagttttacactgttcatatccaatgtttgaccgttcgtcttatttgaaaaaaatttatgattaatatttttattgttattagatgataaaatataaatagtactttatgtctgaataattgtttttttaaaaaaaattcataattcttttaaataagacgaacgtcaaacgttggatacggatatctatggctgagcttattttaggacggagttagtatgtgactatccatttatatttagttgttatgtaatattaagaaatttaagggttagtatgtaaaaattgcaatgatagtggatgatgtatcatcactatcactatcgttggagtcttttaaaagagtatagaaatgattctcacctgaattttccattgaataggaatgagggtatcgtcaccctatctacctgttaaattttctttcataatttagcttccttttttgttgagatttgtatcgttttcttcgaagttgggggtcccgctatatatttagacaccgataattttttagttacatgcaaaacgatatgggtcattagcatatgactaatgatttgagtattagctactgtaaatttgaaaaaaaaattgaaagaaagtaaaaaaaataacattgttcgatagattgagaagcgtggtcgctcaaaactaggtgtgcctaggcttttaagcggtttagagcaaggataataacagagcccacttcctactattagagcagccgcaatggtaaagtaaggtgctatctataaaacatgtacatctcagcaatagactagattaatagtaaactacttcaatggtatgtctacatgggtatctatagttgtctaatccattgcctcgtttttctctatagactatctccaggttagtaaatagctttgctctctctcttcatttaatctcttccaagtagtaaaatatgctgacatggatctcttgtagagagcctatagatagccattgcgggtgcccttagtccatcttaaagccaacacatataatagattagctataaggttggctacaattttcttctcctctctctatctctcacttatacatttaatgcatttatcttggagcttgtgataagctagctctttcataagagccaacatccttattttttcactatatctcttctccacctaagtttatagtaggtttatagccaactattatacttactcttacccgtctctccttgtgagaccttgttcatttaggctgagtttgagtgggaggagattgagaagattgggaagatacgcaaaacgaggtgagctattagagcatgattagttgagtattaattattttaaatttcaaaaatggattaatatgatttttttaaagcaactttcgtatagaaacttttcgcaaaaaacacaccgtttagtagttcggaaaacgtgagcgcgggaaacgagacaaactcactcacaatctcctcctgccgaacgctcccttaattcctcctacaaagattaattttttggattaaacgaacaagacctgatggggcagtcggctgccctgctcggtcgctcgctagtgctttatccactgcaagcatcgtgcggcaacggatcggcatgagccatgtgacactcgcgagtcgcgagatcacccaaggttagaattgctaatgatttggagaggttggcgtcgcgcatgcacctgcgcgcgcgcgcgcggcgtgatttggtggagtgccctcgtcgtgtcgccagcaggtggtgttgttgtttttgcacctatccacgatctaattaagttggcggtctttggctgggaatcttgatctttgttgttgttttacacgtgtcatttctcatgatgtcttatgacggtattatggcattaattaatagacgtgtgatgcgtcctcatgattaatattagagcaagtttaatagtacagcacactactagctctaaatcatccataaccaatgtagtaatagctaattcatataatagttgcttactatactattaatatcttgtcacacctgtcatacacacgttacgtcttagagtccgtgctacagctgactacagatctgtcccctgctcttctctctcttcctttatctctttaaaatatatttatagttggtttatagactgctattgtacttgctcttataagacgcactatcactcaatatctacaaaggaatataaaatttactgttcatgaggagtaaagggctggtttggtttcaggcctaaattggccttaccaatatttgtcaatttcaatagtgttcagtgtctatttggtttgaacttaaattttggcatgcctaagaaaatatgctattttaatagttaacttaggctattttggcttcaatccaaacacaactttactttgacaaaattagccatgctaaaatttaccaaaatttgcaattgataaaaattggtaaggtcaatttaggtcacaaaccaaaccagcccaaagtaacaaagtttacatatgaaaaaaatgatgcatcccatcacatcccaaagaatggtgaaaatcacatgtgggaccaacctatatgtgagcaatactacatatgtaatactgcagagaatccaatgtctaaaattactcccaaataaataacatgtatattgcagttattatatctacgaggacaaaggtatgagatgaagagggaggtggtggtagacgggctcagtgaagcacacgagccgcgagggcgtaggagggaggtgagcggggagaaaggcaacgtgaggtctctccacggcttggccgcttgggggattgggaattcggaataacgaggggactgacggtgtcggtgacatgggaccggggatatcttgactggaggtttggggcagccgcggtcacccacgtggcctgaccccctcgggggggtcgggcccgagggtgatgaggccgcccctccctctatctccccgaggggtcgggccgctcccgtttcgaccccccgagggctggggcgccccgaccccctgagggtttggcgccacatgtgtgggttaggtgagcacagcggcgctcacctaaccacgtttattgcgggttggacgagcgcctcacgccgcatttaatgcagcatagcgcatgcttatccggtccgtgatcggtcgcagtgtgtgaccggtcacagaccggtcagatcgtgggttagggggcaacaggcggcctgacacacgcctcgccctgtcccgtcggaatgatgagagcctccaggcactcgtccctagccggagccggcgtgggaactcctggagttggcacgtcagccccggccagatacattccaggcttcatcgcaaccattgcaaggaagtcattgtatgaagaagggcagacgtgtagcatgctaaactgacacgtggtggacaagaatgaccggtctatgactggtctgacgccagtcgcgtcatcagcaaacaaccgtgcttccacgttgcacctgcttccggcggagtggaggttggtatgacccatcccatcggagggtcattcggacagcagccattgcaaatctccgcccattaatgagggaggacagggttatcccggtgtcagacgaaggtacacgccaagttttggtcaaagtaggatgggtccccacccaaaagaagggtaggtagaaatggtgtatgtggtatccccttgagatataaaaggaggaccatgcctaccaagagaggagacggacaaaaagactagagaggacctgagctggtagactggagaaaagaggagtgagagggtctctagagtttgaactctcttgctctccagttctctgtaactccttcatacacagatccaccagaacacaggagtagggtattacgcttctcagcggcccgaacctgtctacatcgcccgtgtcttgcgcatttgctctctcgcgaaccattccacagatcaagggcttagaacctcacccagcgcccccggccgaaccggcaaaggggggcctgcgcggtctcccggtgaggagccccacgctccgtcagacggagaaatagtccgctctcatataaacgcttgatggtagatcgaatggatggcgcagtcaagcaacagaggatatgaaaaccaacctcctatcatagtatggggcgactttaatagcacggtgatcaaaacatgtcagttcaaaatattatgggggcttcaaccgctaggagccttcaatattctcgatataattgatataagctgaaatatatttttttgagaacatataagctgaaattagatgccctttttttcaaagaaaaaaaacatgatggtggtaggacaggaagtctggaacagtgggaggatctaggatggttgcctatgggattaacaaaactttttcagaacacgagaaaatctccgagaaactttcaattgggataaggcacacccaatttgaacatgacaaacttcaactgagaatgtttgaaaacttgcaggttaagtttttttttttaaaaaaaatcagtttcaattggaagaaatcaattcccatccaatgggttttgaagcgttcaccaaggaataatctcaaccaattaattgtgctactgttggttgatggtggtaggacaggaagtctgtaacagtgggaggatctaggatggttgcctatgggattaacagaacctttttagaacacgataattttatagtattttatataaacagcttcatttcctaagaaatctccaaaattcctcttttataaaggaggcttgaaccagatgtggacggggaagaggaacaacggaatcataccccatttacacaaatgctattgtgacaggcggttgatgcagggcgttcattgcataaaatacttcagactgatccctaacaatattgtacacaattttattagccaaatccggttgaacacacacaattggcgaagaacaagaaagatgccatgtatatctagtactactggtctagctgacgcacacgttttttttcttctttgtttgaaacgagtgattgaaatgatgccacattcaaatgaattgaattcgggctcaagtgatcacaatcgcgacgaaccgatcgaatcagttattgggatgtgacgatgacgggtgattgagaatttaacagttgcttcatatccatcactctttggttggctctcatcatagaaaaaaaacaaacttttaacctgtgatggttgatggccaccacttcagaagtggaggtacttgtggctcctagcaagacctgatcccagctaggtgatttggctgttccaagtgcctgtctagtcccgcaacgggcaacagcagtagccgatatgaactttatttctagaattaggcccggttgttttttagcgtattcaccttattattgaaacatgctatttgtttcatatttcaaaaatattttttctcaagagtttttttctactgcatttttctgttgttttaagtaatttgttaagtattattatttaaaatatctaatttatttctataatttatagtcaaagtttttatacatgtgatataaaagccagtactatgaaataaaatagactacggcgaacataactccaaaatcaacataaaaataatttccagcctcattttttcgattatacttatgcttatcaggcaaaatttgatttttttaactttaaatttggagttgattttggggttttttcattgaagtttattttttcagccttttcttttttatcactaagaacacgtatataaaagttttattcacaaattatttttagtttgcaaatataccgtttggcttattaatggggaccttcgtattttaaattttggttgtaattgacaagctaataaggagacgacaggaagcatagtctttggaaaagaaaaaaaacggttttactgagatgtgacaatgtgcttgtccattttgtgaagggcatgtgtcatgtgtgtcccatgcacagcagcacatgtactggcgatgtactacctcccatagtcacacatttgtttcttctccagcttaatttaatttaattagttagtgagcttgtgtgtcacatgcttgtcacgccaacaactgtggctacctagatctcattgtgattgttatgtacccaccatatccataacatggagaattggagatcttgcttaacacacatttgccatggatatgcatgcctgtaactgtagtgattacacactttattaaaaaaaaaacatagagatatctgatttgagaccagaactgcggggatcgtcggaagcgatatggtgcagagaaggagaagaacaagacaaaggaaacataaatagcaatgattcccaaaggaagatttgatcttccccctgtggagtttgacagtgacatgtcatcgagcaaggacgggaaaagagtgatcagagtgaccccaaagcgacttcttttctcttctttttttacataaccagaaaatcgatctccaaatgattgcaacccgtgaaacttcccggaaacacacacttgttaatccccttatcccattagtactactacaatccagctgatcgatcacatatggatcagtgagcattcatccatccatttattcacttggtcctccacaaagagcgaaacacagagagagagagagagagagagagagaggggcagacatggagagagaaacaagatgcaaaaatgcacgcgaacatatccgatcgacccagatgatccaaggataagatcacgagtagatcacccagaattggcctgcttgtgcctggataaagatggcaaaacggaagcaatacatggccctacacacacagctatcgtcacgagctaagctttcgttttaggcacttctggtgtagtgatggtgtggtatctagtccagtatttcatctgtcaaaacaacgaatctaggatgacgtgatatattctagtataacaaatttttacgctgtgtttagtttttaaaattggagagaagtttagtaaaagttggtagtttagaaaaaaagttaggagtttatatgagtaggaaagttttggatgtgatgtgatgtgataaaaagttagaagtttgagagaagttcggtttaaactaaacagggcgatatctctcgaatgtgtcctgtccgacgccgagacgccgtacgtggggcaggccgcggacgcgtttatcttgtgcgcgatcgcgcgcgagcgccgcaattgcgttggtagggccgcgccgtcccgcctccaaccacgtcagatgggggggaggagggggtctcgtctcgtgacgagccaacgtcctcttgagggaatccttccaccaactgaacactggctcagtacaacgctatctttccttgttttgttcgtgtttagctgttgagctgcattattagatttggggtgggggtttgaggaagagaacttcgacttaagcagcgtaaatagggatttgtttttcaaattattattcataacttcattttatactatcaaagtctaattagatcctgacttatccaaaccagggttcattacatcatttatcgtgcggttatcacgaatcgaaatcacccacctggtgtatcagttaagttcaaaaaattaaaaaaataaaaagaaatatcagttttcgccagtttttggtgggaaccgttcagttaccgctgatactgctgagtagtggtaacctacccttattaggtaaggcaaacatgacccaaacaagatgaacgtaggttgttgttgacgaagaacgtgatcacgaccggtagcatcatcggaccacctatatcaaataaatagcggaataaaataacacgcgaaggagtgacctgacctctattagatttggggtgtgtttagttcacgctaaaattataagtttggttgaaattagaacgatgt

SEQ ID NO: 48009 - DNA, 1504 bp, Oryza sativa
ggtactactcgtagaattcactaaatgtgacaaccaaagattgcattgcaaggcaagtgtgggcacgctgagtttgtaccagtaacatgttagcatggtcccctagcttcgctagctagctcccccacccccggctttactgtacaagacgatctccctgatctgtgcctaccaggagcacaagttgcaaaagtggtcatcaccactggtggtgactggtgagagatgcgtacggtcaaaactcggaaggggggcgcatccatccaatccatcctcggatcggtgcagatctcaataggactttcgctgctgctgcggccggcacgcgcgccggtgacgttatgctcgctcgcgggcggccacgttcctgcacagtggaggggagagcacatggcaaaagctgcgtgatgagggaaaaatatggttcgatgtgcgtagagtggagcagtactagtgtaaacttaattagcaaatgtttagttggaaaaaaaatttatcactgcatgactacattagatatacggataaatatttgaagtattaaacgagtctaataacaaaataaattacagatttcgttagaaaactgcgaaacgaatttattaagcctaattattctattattagcaaatatttactgtagcaccacattattaaatcatggcacaattaggtttaaaagatttgtctcgtaattttcaggtgcactgtgtaattggttttttttctacatttaatatttcatgtatatgtccaaatatttgatgtgacagcgtgaaaaattttatttgggaactaaacaagtctttatttcgtgccaaaataaaccaatcatgtactaatatatatgtgtccagcttagtaaaatgtgtaatctgttgtacgagattttattctgagaggaggaagtattatcagaaaccgcttggcatgcaggattacgccatcatggagcacgctttcaggtctcgtttcgtgatgattgggaaatattgcgatgttatggtttcactgtttcacacttcaggtttcgtttcatgattggcagacgttgtgttgtggcattatgttaatatgcattctgttttttttttcattctagaatataaaaatttctgactatataaaacttccaaaaaaatatgtatagacaagtgctattttaatgcatggacagtgtgtatatggacaagtgttttttttttcatatggagtatttagaatgatagaaatgcttgtattttgaaacggagttggtaatataattatagggaaaaaccaaaagtgtacttagtacggttgtattttcttagtgtaattggctaacttccataaatctttaataatctaaaaaataattacagaatcattaacctttcattgtttacatgtatacttgttagcttgttagctataaccaaaattaaaatttaaaataaaaaggttttgagatgtttttggtttttttatcgtagtttacttttcaacattagcttataaacag

SEQ ID NO: 48010 - DNA, 7093 bp, Oryza sativa
gtgacttgtagaattttccaaaactctaccgaaacggacaaaatatgtcatctattaaaataggcgtaactttctcatacggactcggaatcaggcaaataatatatgcacggacatctacagaaaatgttacatccgattctcccccgctttgccgggttcggcgatattaaaacctccaaattccgcttgcaagattgtgttttcgaggagagaagtttttcggtagaactttggaaaattccacatgccacatatttcgtccgtttgagtttattttttacatggttgattcctgtgagttcctaagtgtgaaaaaaatatcaaaaaataaaataaaaataaaaaagttgtacatctctcctttgcactagttcggagagaggagaggagaggaaaaattctacaggtcacatattacgtccatttgagttcaatttttctatggttggttctctaagcgtgaaaaaaatatcaaacaaataaaacaaaaataaaaaatttccgggggggcgccagccactctggcgcactccctagccacctcagcatcgccccgccacgtcagcagggggacggcgccagagaggctggcgccgtcctgttggacgacggcaccggccactctggcgccccaaaaggaccatttttaggataagtttttctagaggtctatttgagaaaataagttttttaaaaggaccaaaatatgaaaaatccagtcgtggtgaccatgtgacaactataaccacactaattgaaggcatcaacggaggtcaatcggtctgaccctgcagcgccgcccgcctagctaggccaccgtcgcttaatttgcatcgcatatgctgcattcatgaatgcgtgcgctcgtggctgcgtgtaccctttgcctctctgccctgcctggtcgtgttcaacgcctacgacgacgtttaatttgatcaacgcacggcagtagagctaataaatactagtacgtgggtcagtgatgtatgtgtggtgtatagtagtaggagtgtacggcatcattcgctgtatgtaccgtaggtttgctaaatggacaggcgtggaagttactcgatcgagattgaatttcaatcgttgaaaagttgaaaacaaccagtggcagtttaccctcgtatccctacatttatacgagtacaacgtgtttacaggggtattataagatgttttgattttgatcaaaatcaaatttatttaagtttaattaagtttgatgaacattcatgttagcaagatgaagaaaaaaaactagagctctattcagttgcaccttttttttttactgtagtgcagccaacaggcacaatgtcttgtatttgtagttgccgcagcatgatggttgcatatagtagccgaatatacccagggtgcgggatggttgctggggctcaacttcgctccctccactaccaccgcaacatatatattttgtgataaatctaggccagttactacatataagttgtagagtagttacaatataattatactttaattattttagttacatttgatttttttaataaaaaattatcgcatgttatatagctactcccgaaaagaaatttaaaagaaaacctcaacgttcgctaaagtacatgttttgtctgaaccaatattttggtttcaaattttcacaagcttagcacccaagatttgaaatttggttcaaaatcactaacttttggatttacaatgggctcctgtagggaaaaaagaaaagtaaatttatttgaattttaaaaaaatgcagggttttcaacattaaactaactttttgtcgaaatttttatttttcatccctggaatctgcttcctgagatgtaaaatctcgtagagcccagctcgtagctagtttgagtcagagtcatccggtcaggtggctaccggcaggactcgatacaaatggatacaaattactaaatgaaaataaatgagaactaaagctaagtgcctattctgtcgaaggattatgtataaaactgacttccggcaattattcgagtgcacaaaggaataaattaagcattaagaagttaaaaggttaattgattattttttttaagaaatcttagttaaaaaagtttttgcaaatatatagataaagagcttgggtaacatgtccctgaccctgataactcacgcgcctctacaacctttggctagatgctccactgtggtgttgggctggtggtacagatgttgctcttgtctagcagcggtcgtcgatcgttcacacgtagcgatggttgattcgatgctagacttttttttctttggttatgtgtacatattgttggtgcgtggtggtattgttttgccttttgttttttttttctcttgtgttttttcacaccctaactggattcaacgacgctactcccttgagcagcttcaccgtgcactgtctaccaacgacgccgtaatgaaatgttttagtacttctacttggcaacgcaacagaacacaaatgtatactccctccgtacgtgtaaagaaatcatttaggacaatatttaagtcaaatcttgagaatataaatcatgaatactccctctggattgataatatttatcgttttgaacaaggacacagtctccaaaaaaacaactttaactatcatttttcattataatatatataaaagtgttaacaaatatatgatattactaaagtactttttaagactaatatatatatatatatatatatatatatatatatatatatatatatatgtagtcaccatatttgaaagacaaatattttaaaaatgattcataatcaaatattctaaagtttgaccttatctttgtctaaaacgacaagtattatcagtccggagggagtaaatctcaagttgttgagtttgaaaatgtaaaaattatataaatagatttggcttgaaaaatactttcataaaataatgcatatatcatttttcaataaatacttttatagaaacaacaaatcaaagttgtgttttagagactatgtcgctgagggagtatccacattccacaaatgatctttttttttttttttgagaacatacattccacaatggtcggcacggtgaaaagtcgtagccatcagcccgtcacccatcagtgccccatgcatctcgcctttgcaacttggattccggtggaagaaacacccccggaacggacaagcggcgaccgggcgggatcgtacggcgaacccaaacgctcgccgccgccgtgaaacatatttggcggcttccccgtgcgagagcgagagcgagaccaccaccaccgctatggatttggatatttggatggagcggcggtgtcaacgcctcgggtggctgaccaaaccgcgtgatgagtttgcatcgcatatcgcagccacaggacaagaggaaaaggagcgcgagttgctgtggcggcaagagactctccgagtccaccggttcacacgaccacgggcgggggtgggtcggggtcgtggatggatcagtcggcatcggtcaaacctgcttctggtatgagtatgatgatgaccacggcgagcagcggggagttttttgtggttgggtgtgccatcgtcgcagagttggcacgatctcaacatctgcagagtactttatggaatgtttgtgtttttcacagttatactgtgagggtgtttttgttcacgagagctaaaagagttagtagtactctttaaatatcgtgaagatatatcgtttctttgaatgtttctttaggtatgtttgggtgagcttttagctgctgcagattctcccagaatctccagctcccccaaatagtccagattgtcagccagattctgggaatctgtagttgtagaatccaaaaaatgaactcaccaagaagctgctccagaatcttaagctcccaaacagggtctttgtagtttcgtcgagcagaaaatctaggacgcattgattcgctcagaaatggagtattcatgatgttaagacctctttgattcaaaggaaatttatagaaattttagagaatttcattccttcatgcggtccaatcaaacggtcattcctacgtttttcctatattttgcaatactctgttttacacttaggcatggtttatttcgcaaattttttccccaaaaacgtcacatcgaatctttggacacatgcatggagcattaaatatagataaaaacaaaaactaattgcacattttacaaatcgcgagacaaatcttagattaattatgctcaaaagattcgtatcgcggtttccagacgagttatgaaattagttttttattcgtgtccgaaaaccccttccaacatccggtcaaacatccgatgtgacacccaaaaaatttcatttcgcgaactaaaaggccttacattcctatcagaattctatgttttttctattacttcgtttttttcattcatgagattcaaagggtcctaaggtatatttctggagtagtgttctgtatttgggttttctggtcatcaagatatactgagaactacaggtgttaaatctacgagtgctttgcccatggaattcaaccaacatggataaggaagcgaagcagagagcacggtaagactccttacctgctcaaattacactctgctttttttctcttcttgtatttttttttaaaaggaagacaatgaaagtgcactccactgactgacgctctaacgcattatcaccagcatacgcaatgtcagcgtcaaattgatatcccatgcgacgcgacgactcttgggtcaacattccatttctgacagacagcaatggcgttttatcagaggcatcaaacgctcctgaaaatgcagatagtaactgagatgtcgtggtcaaatttttgcaccaaactgaactttggtaaccacgagacaattaagatatctacaacatcacagctgcaaattttctctgggttgcaaaaccatacagagaagacaaccttaaggtcttcggagttcggcatttaccaggagatgcttccagtctcagctagagtgagtccaatgcagaagtctgaatccagaagccaacgagagggatcgatgtcgccatatcattgattacaggattccagtagaacaacggcacgaccagcattcaaaaggcagctctgaatctggttgcgatggcaacatgtcggtgatgatgccaatgtcctctgcattgaccaccagatgagcctggaatgtcaagttgtagaggtagaaagacctgttgctgacaatccgaattcaacagcacagcatattggagaaatagtacggtatgtgaacagaattgtcccactagagtggtctcaaaatggaacgaagtgatgattgccctatcaagaaaattgtattgtttgtaagggtacaaaatggggttgcattctagatgaaatcgacatcctccagacgatatgagggtaagagtgtgcatgaggaacgacaactgatacgcgcacaggagaaattcagagcaatagaattacaggtagcatcctaagtatcatggatcagtttttttttacaaaaagaatcatcctggcactatcagatgagactagcagaaaaaagacccacagcgaagtaatcgcccacttctttgaaaacagaggtacatacatgaaaaatggtggaaagcactgatgaatgccgttgaagttcatgaagggcatttgttcctgtctgtgcagatgtgacttgaatgaatcagttcatcagcttaatgatccatgccactggcatctattcagacttcatagaaactgcctaaagagcttctctccgaaatgggaatgcaggttgggagactggagcacttgttgtgatgccttctgatgcgaggtccgaacttcgacttctttcaccccgactcgggtgctgtacctcatcttccactgtaggagcttgtgcatccgtctttgatatcaatttggagtttgagacagcctcattcctactatttctgtctccacctcccatttcaatatcaatgccatcataattatgtcgttgtgagatcttcaagagatcaccacctatgtcaaggtcatcttccacttttgtccgagcaccaaccggctcttcttctctctccacagcacggttagctggtggagctcgcgcttcctcttgtataggttccctgaacttgtgtttggaaggtggaaccttagtatagaagacttctagaaagttattcatacatcctcgatcataggcatttggtctgccatctgctctgtaccggaaattttcatatgtggtctgaaaagccaaagcatccgtatcagagatcatgcaatgtaaaaatatttatgttcaggagaagaggcatctaaaaggggttgtttcaaatgcttggaatgcttgccctttgaatcgcagggtagaaaaaacggaggaatagaaaaacataggattctgacaggaattgaagtgtaaaacagaggattgcaaaacacaggaaaaacacaggaatggtcgtttgattggagcgcaggaaaaacgcaggaatcggatgagagagatagactcaaaggaaattttccaagaggttggagctcttgctaaatttcctccaaaatctacatgcaatgtgtcattccataggaatttcataggatttggaaagcttcaatcctttgaatcaaagggccaaataggaaaatttcctataggatttgaatcctatgaaattcctacataaatcctttgattcaaaggggccctaagtattatttaggaactactcccttcttccacaaatataagcattccaagcatttaaaatttgtcaaaagtataaggattcctagagtactattttccccatcaatcacctctcattcattttttttcccatcttacccccaaccatccctcatttaatgaggggcaccaaagtcattttttcttctccttgtctctccaaaaatgtttatgaatgcttgtatttaaggatggagtcctgaggctgtttggatggattactcactttaccaaacttctatgccacaagtgtggtatgccatagtttttgtggcaccaaaaaagaaagccacacttgtggcaa

SEQ ID NO: 48011 - DNA, 3307 bp, Oryza sativa
cctaaagccctgaactgactcatcgaatcaagggtttgtgctttcccatgagcaaaagaatagaagctggcacccttagtcccttaccctcacaaatgcacacacacactgacaccacagtactaaattaagaagaggaatcccagattcagacaaaaatagtaatggagaaactgaaaacgccctctttcccaaccaattaatcaaataaatatttttttttcaaaatctctcattataagcactaagcataatatgactagatgatgttgcgatggtagaaacaaacaggcaaaaacataaatctttgatcaggagcacaggcaaatcaactagcaaaaagaaagataaacttcacataaacaggctgacctggtttgtgctgatgagatatgtatgaaatcctgtgagtccaccaacaaaccaaagacagatgaaacaatatattagtaatgcaagagaagcaggggagtgtttcaaagccttccacactgtgggatagtctccatccatgagaatctttatgtacaatgctgacatagcaaatacataaatgcataggatactcgccgaagaaacaaataggaaaaagtatcggtaattgcgctgcacaatggaaaagtagaaggaaattaagataagcaactaaaaaatggagcaactcaatcaaaacatttttgacattggatgctatcaattgtagatatgcctatgagaaactcatatttacactatggatgaataattttcttataaatatcaaattaaccaaaaaggttaaaaccaggtagctcgtatgaatatataggagcatttttagtaaatatgaaactgacagtttgcctttgcaatcacattgtctataacatgaatattgaggggtgtcaagtcaccaactactgactgggaagtgaatcagtacaattccagtgaatgctacatgtacattaggtagtgattgcctgtaacattatgttgagcaactctgctcttagatgacattgctgtccagcaatcaataaccgtagaaagtttactttgttaaaaataagttgattaaaagcaaggagataatatcagggaaatcatgtagacaagcggtataagtttattgcggacaactaaatactctgcctttagattttaatcaagcagttgctgaatttgctgtagtgtaagagtaatcatctcactacttaatattactagcttataacacacaaaaaaaagttacctttccaatgcattgccctacccaggggcaatgatggtcaaaccgttccacgcaattgttgcaaatggaacagtgcgaacaccgaggaggccgaaaaaccatgcaagtttcacagtacttgaccttcacaggcaccccatttaccataacatcttttacacgagggaagactagtctgccaggtgtgtccgcaagagataaattgtcatagtgaaactcttcttctggtggatgagatgcacgaggtacaataccaggatcctgagctgcggtgatgaaaagtaacgaaagcacctgcaagaaaaagaatgcgcatttgttgtgtcattaaatcttaaaatgcccagtgtgaaagatacctacaagaaatagaccaaaatactcacatagattgccaacactattgctacggcaagaattgcgtaccctgcattgtatgcaggaaattgatgacgaagattccgtgctacaaacgcacagaagaccgcaaccgggacaaaaatcagtgcaacagaaaaaagcagggatttagcatcaggtccaaatattagccgaccaccaaagaagaacctctgcagattagaagcatcgatcagttcacaacaatgaatccattccaccatgaagacatacagagtgccacacactttcaaagatggagcaaattgcagctgaagtaaaaaggcctaagcaatgtatgtaagcttaaaaaaaatgttattaatgttctggagcatcaattccatagaccatcaattatctaaaaaaagacaacacaaatcaatccgattcaactgacagtatggtgattgcagacagggtcggtacgagtgatgtccccatcacagccactctgacattcgcattcagattttttcgcatccgttatctccacgccaaaaatgaagcatagtattgcattggaacaacatagggcattccaaacaagtagtgatatcatagtatacattgcttcttaaaactaggcactactgaactaattaaacgaatcgacaagttcaaacagctagggcaactcgattccacaaagcctacaaacttggcagtaatctgtgtttgctagactatatgttatgattaatgaaacaaatagtatcacaacacacctgaaaagaaaaggtatcacagcgaggcgcatgtggccggaggtgctcataggggtagggtgtgcgtgtgtgcgttcataggggtgagtgtgcgtaagttgtgagcgcatgcgtttatactgtgtttctcaaaaaaaaaaaaaaagggaaatccccgcaagagaaaaaaaataaatgttgatacaaaatgtaaaattggtaagctgaagaaacagcaaaacctcacgaacgcttcgaaattcgaatcctataacggagcacaaaccttcgaatcctagaacagagcacaaaccgatccccctcctaacctaacaataaagaaaactagtatacaaacaacaatttaagaggtaaaaatcctaaaatcctcccaagaccctaaacgagaacaccgatacgatccctagaaactgtaaaaccaactcaataccagaaaggggaagcggaaacgagacgagtatacacgagaggaagaacaattctcacattattccccttccaggcttcgtagacgcgctgccgctgcgactgcggctgcggctgcgccatgggcagcggactccaggccctcccgaggctctcctccaatcaacaacccatcgaatccgcgcgagccggcgaggaagaaatcgatgctcgcacgcaagaaactgaagtgcacgaaatcgacgcgaagaagagagagagagaaggcaagcagccgagagaggaatcgatggtgaatgaaagcggctactgtgagcgagagtagggtacaaaagaggactttttttattgttcgtgggaagtatggagactggggagaccggaagtccagaacgcccaaaattctctcatttttttatttgttttttaaggaagaacgctgaaaattattagagcctgtttggtatagcttcaactcctaaatttaactccaagatttgagtctggagtggagttgtgg

SEQ ID NO: 48012 - DNA, 2418 bp, Oryza sativa
gtatcagtacctatgtaaaccgagtaatccggtagtatttgcgtgtgtaaaactgtaaattgggtaattctcctctagtgtgaaaactagtcggatttcatatgtaattttgcacggagctagattatccaaaagtcaaattatatttgatgttttgtttctaattttctgtgaatacaagtatgttttgtatattagttgatatatagtataaatttataatctggatctgacgagccactatgaacatggttctttttgttcctttcaattatttataggttcttagtataattggtgcctcattttagctttttttaaaaagtcttttgtcgattacctcattatttacattcatattgcacatatcccatgcagctgtggtcatgtcacacataagtactcttattgtcgcttgtgctacaaccaaactttagatggtattagagtgcaccacaaacttttggtggtatacagctaaagtcgtgaaatttctatgacatggaaccactttttcccaactttgagtttgtcgattatcttcaactctcgaatactcttattgtcgcttgtgctacaaccaaactttacatggtattagagtgcatcacaaactttttggtggtatacggctaaagtcgtgaaatttctatgacatggaaccacttttttccagctttgagtttgtcgattatcttcaactctctaagccgttcatatttcatcattacacatcaataaagataattttcaatgacgtggtatcacctattgaacaaatcaaaataaaggatgagtataagcggaaaagaaggtgaagaaggcatgtgaatttttatatatttttttcttttttaattgtttattattatttttatgatgacattattaccctttatccacgtaggctccatataaatgccatgccataaaaaacaactccagttttaaccaagagatgaaatacaaatcattttgatagtcgaggagctaaaagtgaacggtttttatagcttgaggaccaaagtcgaaccaggaccttagttgagggactgaagttatatctgtaactgtgcggccgctcaccgctgcacccggtctacttgacttgacgttaacaacggagcaggatgacccacggtgaaaagtcgaagggaaggcctcgtaggtcgcttagatcgggcccggccagcgaagatttcccagcgagaactgaaaagcgtgaagcggcaatcggcaacgaaagcgacgagcctagcgcctctagtagtagaagaagtaacaaagcttcctttaccgtgtgatgctttgattcgatcattcgattaggtataggttaggtgcattaagctcctagcagaagcaaattttacctcggatcccctcacattcagacaatcagatccctacttttgggagcagggaagtgtgggatgttcagctgttactccgtagtagattattagagaaaataatcaaaatgtaatgttcagtcctcaggagcacctgaatgatagctggtaaaagcacgcaaagagaatagtgcatatgatccgtgctactactatcttgctagttgctgcgccatttatatatagtttgacttgcagacgatttaaattggcagactgaaacttaaagaatggtcctgggttactgtattttgcaggagatgacccaagaagagacgtacggtatgtctgtggtccaaatagaaacgcaaaaccaattttaatgtgttccctatagtaagaatggttaaattgtgcaacaatttatgtacatactccctctagttttcaatttaattgacgttttggacaatgacacggtctacaagatatatctttaaccttatttttctattataatatatacaataaataaatgcacgtttacttttattatagtgctttgaaagacaaatttatatatgttgttctagtttctttaaactaaatatttttaaagttttcgatggtcaaagtaataaaagtttgaccttaacctttattcaaaacgtcaattaatatagaactggagagagcagtttttttttcttttaccaacatcagccatgcaggctatttgcgcagttgttcatgggcgttattatttttccataggtagccgcccggggtaacagaacacatttaagagttccagtacgctagactagtagagctgtcttgcatgtttgaactgtaaaacagttttcctgaaaaacgatatgcagaagaaaattgttgcatctatatcatggtttgacattatagaacagcagaagaaaaatgacggttccatgtcctaagcttatcagtataagctaatttaactgtttcttgtttgactcaccagatatgatcaacgcaagaatatcttatggaaatggtacttgcgtaacaagctggattagca

SEQ ID NO: 48013 - DNA, 1351 bp, Oryza sativa
  unsure (1)..(1351): unsure at all n locations
gactttttaaaatatatttgaccgttcgtcttattcaaaaagtttaagtaattattaatttttttcctatcatttaattcattgttaaatatacttttatgtatatatatacatacacatatatgtatatatatatacatatatgtgtatgtatatatatacatattttacaaaagtttttgaataagacgaacagtcaaacatgttttaaaaagtcaacggcgtcaaatatttaggaaaggagggagtacttatctcgatgacattgacaagtagtgtatgaaattaactaggaccaactaattcggcacgtaaggataactacagtttcagctactacttacccgtcagtaacgtacacgtagataacgctctatctagatctttagaaattgcaaagatctcttaaaaatacgaaaattttacaggttctgaacaacatgatttcccctctaaagaaaatatgaatatatacacacaagcacacttaccctacaaacatacccaatattttatcacaataaactctttcaagagactagtcggtaatatcgtagttggcaagtacatcatgtctactcttaattaatataaatacgaataattgtgctaagtcaaggacataattttggttggtaaagtaacgaactcatcgttcgcgaagtgaaccagaacagaacacttttaggtgaaccgtgctaaaattttctttcaagaaaaatcacacaaaactacaaaattactagtaccaagttgagttgctttcactgttctgtcatgtggtctccttgtccgctctgtgtattttctgccccctccagcgcgttggcgcccagcccccgctagtcgcaccagtgcgttggctcgatggaatccacgtcaccaagacaagggtgcgtgtagccatctagaccgagacaccgtctcgtgttacgtgggggcggctgccacgtggacgggccggcgaaaatcgcgcgttatctcccatttcgttcgtctcgcgccgcgccacatgcgtatggttttgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 48014 - DNA, 721 bp, Oryza sativa
agaaatagaacattcaggaatatatacttcatgtaactttagttcagccaagtatacgcaatagcaggcttgaatatgcacatggagagaggattgtgttgcaatttgtgtgaaatatatcaggtccaaaaatgtattgaaaagttactgactatagaagaagaaagatgaaaatgcccaaaagcttatgatgcagtttgttctcaatagacaaagatgctttcagaaaatataaactagacattttatttcaaaattatataaattgtgcatgccgaattgttttttgatggatgctcaagggacaatttgtttgtaaatttgttattgagaaatttccacatgtatatatagtccacatttccttatatggtaaaagataatatatgtgcgttagatttcactctggtattaacatggctgcatgtccccttaaaaagtcatgtaggtattttagaagcttgcttatcagagaaaattatagaattaaattagcagctctccgtacctccaaatttaagttattctgaaccagatcaacagtgttttgcaatatctctcttccctgaaagagacatcatagcacatattaatcgcaaccagcatacttgtacaacatttttctttttcttttttcttttcgaatttacttctgaggaagagtaaagatgttctcacttgcagtgtaataagctcagcaagtggctttgcataaaacctg

SEQ ID NO: 48015 - DNA, 29140 bp, Oryza sativa
ataatgatggtctacctggagagtttttccccacaggttaccgctgatatttgtcaattggcgtgtaagcgggagaacactcaaatgaaacatgagctccaaagcaagacatgcatcagtctcgccatattcaacctagatgagcaggacaatttggcaaataatgcttcagtttgtagtttctgaagaataagcaatctcataaacaaaagaaagttccaaaaaaaactgtaccagcttgagaagtgctcctgaagattggaacattgggggaatatcatgtggagagacctctttcctctcctttttcaattgtgtttctgcaagttgtgtcaaagaataactcacctgtgtacaaacaaattcattagagaataaatatggtagtaagaacaaacaaacaatttaaatgccatttacctccttcaggagatcgcgagagcataagtaggtatcacagaggagacgaccagcaatgcaggacataattcctggacttgccccagacccataaagtgtgttccctttggtgagtctgggcattactgagcgcctaagacgaccaatcttggaccacatattgcttggtactttgcaagtctaacaacaaaaggacagtgttttcaaatgattgaatttaaatcgaaataatagtaattaacatagcgtaaaatgatagaaaaacctgtgcacggtgcaaaaggacgtccaagtcaaatccagaaatattgtgtcccacaagtacatcgcaatcaagtttgctaagctcgatcatcaagcggtttaacaatgcacgttcactgatagcagaatcaaaaggttagtgaatgctaccacagttagagttattaacagttatagaaaagaaagttagaagtgtccacctgctctcgagtgccagcacattgctaccagccttctggttcctatcagaggattccttggagaggcctataggaaatatactgccttcaagcttgcgcataacagtaaaatggctgagcattccccgtttctgccaatcttcagaacgcattggactatctatctgaaatcgaccacccaaaaaaggataaattagttggtaggagaaatgttctccttttataatatgcatattctataattgttttagtgaaacctggaatgtgctagttagttttaaatattcatctcagtcatggaaaaccatttaatctgacaattcattgacaaaatttataagtaaatactatagtaaagtacttcaagtgcaaatgaagaatatgcttactttcacacggtgacagcatatgactgatgctgacacaatttcatgcacattgtgtttctcatttatgatagttttaagattaactgctgcaaccacgacaggaggaacttctaacgtggtacttgtcatcaaaacagatatgtctttgggactatcaactgtaacttcaaatttacaccagctgacctgtgaagaagtcaaaaggcatcaccatcaacatggtgcaaaataaaagcagataggagctatgagggcatcataaactagaaacatggcatggaataataggatatttaggatatacccgctgagtagctggacatgccaaaaatttggagatcgaaagccatgaaggccccttgatcttccttttgatgagaagcaattcaagagcactggaaaggtacgatggttaatatcaatgaagatactgagcatgaaacagcatatacactggtttgtgtatgctgtatagcatgaccccatgtatttgatggatcattacctattgttcgtcccaagtaatgcatggaaatgttgacctcgaaggtctgtaggtagcgccggatcctaagaaaatatatgcagtataagaaataagcaaataggagtcaaagatgcattgcccaatagacataccttatatgggtaatttatcttcaagacatactgctccccatttggtagatcagtcctctcaaatgcatagttcctctatggcatgccaaataggaaaaaatagtaaattagctcagcaaaagaaaaaaaaaaggaactaaaagataaaagtcactggatgcctagtatcaactttccaccaacagaccttgactggagtcattgcaaaatttgacacgttgaagtctgacaacttatcagctatttcgctcttcaatcctgatgctaactcctggcaagagaattagcatgtatagataagtggtgcatgcaaagcatcacatttactttcaaaaaaatcaatcattctcacatgtagacttgctcgaagtgatggagaagaatcagaagtagtggaattcttctctagccttgatatggtgtcccttgggaagattgaactgcttggaatagcatatatgcacctttgcatattctttacaaccacacaacaactgtggaaccgcttgcctacttcaacctacaaaagaaagcagcttgtcgggagaatggaaataacctctgcaggtagagctgcaggtgtgtcactactaaattaattacagtttctgacagaacacagtaactatccagcagagttgataactgttttcatatcgcatagttgtaagtagagcttcttttagaatgaaattttctgactagtttaagaaatgcatgtgagccttaaaatgtcaaaatgtatcaagcaccatatcatttaaggcaaatcaattatcccacactcccactaagttaaatagtgcttaaaggacacaatatgatataaaccccatgcttttttatatgaaattggtcattaagcaaaaacattctgccacacaacagtaactagaatctgtgtactttacaaatgaacagctgaaattttcgttacctttccaaacaaatatactgtgcccgaattagcaccaaaaggctcctcgtatgcatccaatatgtagaatggcagcgctccatccttcagctcaaattctgagctttcatccacgccggtgttgctgttagcagccaccgctccctcacctcctgcattgtccccatccccgcatatcttcatccaccctgctgttgcactagccatatccccattccggctgtcctccgtcttaatcttagcattcagacgatgcaccttctctatcttaacctccccattagcctcctgtttcggttcctccaggctgttactattattcgccaattcagcactagcaccaagaggtgtgtccaatttgggctccatttccacgtctggcttcaattccatatccatatcatttccatgatctgaaacctcatgggcctcgaaaacattatccgatctgaacgccattgccgtatcgactgccacattttcagccttgatgtgagcagttgttgttggcgctggcgccggggcacaaaccctaccaacgcggcggcgccgctcctcgcggtcattgtcgtcgggagcgaactccgcgatgacgtcatccacgatgctgtcggccgccagcgacgagtccctaccgcggtcgctgccaggcttcctaaacacggaggaggtgaacatggaagagagtcgttgcttccccatcatggcggcggcggcagagagggacgccgcggcggcggactgctgaggcgggcgcttcgactgcggacgcggctgcttccgcttccggggggcgccatcctcgccgtcggagccctcgtcggaggaggagtggatggtgcggtgggtccagtcctcctcccgcccgtcgtcggcgtagcccaggccgtcgtcgtcgacgatgaaggcccccgcgtccttccggcggcgggcgacgagcgcggcgtagtcctcctcggcgacggtgtcgtagatcggggcctcaatcctcacctggacggcggcggcggcgcgggcgcccccatcgcggatcgcgcggaggcgctcgagcgccgcggaccgcgccaccgcctcggagccccgggcgcgcgagcggcggccggaggcgcccgcatccgcggatccctcatccatggcttcgcctctcgctctccctccccttccctaacacacgcagtgacacaaggcaatgtcccgatgctttctcttgcggcggaaagggggagatctattctggatttgtgtactggttggattgggcgggaaggtgttcgagggcttgtggcttttggcgcgcagaatttggggaaatggaggtctagggtttcgcctggacccgtttagtgagctagcgggtggcgcaggtgagaacgaaggacccggtaagagattgggctgaggagtacgtgggcatgacgttcggctgctaatttagcccatcagttgtacacgttgggctattctgttgaggaataagtccactttaagtccctaattatacttgcatctaatttgtatccctcaaaagtcaaaaccattaagggagtcaaaatgtaccggttttaatagttaagaattcaatatatatggtattgcaattgagggatacgaattaaattgcacgtatatttgtgggagtccaaatgtacttattcattccgtcattccgttgatgctttggttcgctcgaggatagtatttaaatggtcttgggccaagattaaatggaaaaattagtttgagcaaattgcaattttctgttgttgacagacaataggggcttacatattttgcaattttctgttcttgacagacaagagggcttacatattctatatgatcgttcaacaacatatttttttttccgaaaaaacattggttatattttcaattttgttttctcgttctctgtcgtttgttgatggcttaccttctatagttggaaaccctggaatgccaccatattggaaagtcaacttcaaatacacttatcaaaactttcgtggatatgctgttcattacacaatgacttgtgatgttttaattactatgaacgtaccgagtctgtacagtgagcacaaatagaaaatcaaacgtggcctcgctgtttggccccgggaaaacattctagcccccgtttagtttgacatattcgtcgcattatcatttggcaatctccgtagagaatccatatgagaacaaaggctataaatagtggaatctcaagtctaccgcaaacacattctagctcagcctttgctggacttgttcccgccaaaagtcaggatcaagttaaaagaagctgcctccaatggccgatcgaatcaccgttcttgccattgccctcctcgttctgatcttgtcgccgcaaatggctgtccagggcaagcctgcagctggcaacaccgcgagcccaaggccgaagcagcagcaactcgggaacttcttcaagaagcacgggtcggacatcgccggcctcttcccgaggcatcgcaacggcggatcatcaggtagctacagcggccaggccgtgccggccgacggcggcgaaaacggcggtggtggccagagccaggacccggcgaccaacaccggcatgtacgtgttgagcttcagcgtcggcacgccgccacaggtcgtcaccggcgtgctcgacatcaccagcgacttcgtgtggatgcagtgctcggcgtgcgccacctgcggcgccgacgcgccggcggcgacgtccgcgccgcccttctacgccttcctgtcgtccacgatacgcgaggtgagatgcgcgaaccgcgggtgccagcggctcgtcccgcagacgtgcagcgccgacgactccccctgcggctactcgtacgtgtacggcggcggcgcggccaacaccaccgccgggctcctcgccgtcgacgcgttcgcgttcgccacggtccgcgccgacggggtgatcttcgggtgcgccgtcgccaccgagggcgacatcggcggcgtgatcggactcggcagaggggagctctcccccgtctcgcagctccagatcggcaggttctcctactacctcgcccccgacgacgccgtcgacgtcgggagcttcatcctcttccttgacgacgccaagccgcggaccagccgcgccgtctccacgccgctcgtcgccagccgtgcatcgcgcagcctctactacgtcgagctcgccggcatccgcgtcgacggcgaggacctcgcgatcccgcgtgggacgttcgatctccaggcggacggctccggcggcgtggtcctgagcatcaccattccggtcaccttcctggacgccggcgcgtacaaggttgtgaggcaggcgatggcgagcaagatagagctgcgcgccgccgacggctcggagctcgggcttgacctgtgctacaccagcgagtcgctggccacggcgaaggtgccgtccatggcgctcgtcttcgccggcggcgccgtcatggagctagagatggggaactacttctacatggactcgaccaccgggctggagtgcctgacgatcctgccgtcgccggccggcgacgggtcgctcctcggcagcctgatccaggtaggcacgcacatgatctacgacatcagtggctctaggctggtgttcgaatcgttggagcaagcgccgccgccgccgtcgggttcatcccgacagtcgtcacggcggcgctcatcgtcagccccgccgccgctgacctcgccggcagtggtcgtgatccatttaatgttggtcgtggtatacatgttcttgtgaacttctactcgaccttgcggtaatatctggaaggtatccttattgtcatgtcgcagacgtgcagatttcaccaaggtggttcattttgacaatgtctgtaagtaaaatgatgtattctgaatttctgattgtttttttttccaaattactactccaaatcaaagcgtatacgtgttgtatcgttttaaaccgtgttgtcacatgtggactgatgattgtctgattctagtttttaagtggttagtatcctttgctgacgctataatttctaagtgaaatggcatatagcctagtggttgcagtgacctgagtagcaccttaagatcctgagtttaaatttcgagcgaatttcggattggattatttgagggctaagttacctatttgataggctaaatttctaatctaaaaagttcaaatctacataggaacgaatttcggattgaattatttgatagttaagtttcctatttaataggctaagtttttaatctaaaaagactacctacatccggttggataaaggccgggtaaaaaatacccttctacaaaagaaaaaggcaatgtggtgatttcaaaagacagagagttgagcaataaaccatcatcaacgacagcacatttttggagaaaatattaccaatttaccatcccgttgagagataattgtagaacattacgtgctgataagtgacacagcatgcatgcgacatggtatgtctctagcaaaactagcacccataatcttgatgaaaatgtacccataacccataactagttggctactacacctgtacaccaacttataattagtttttcattttttttttgcggcgaccaacttataattagttgacactggaacatgtctgattccccttcttcagtctgtttagcgaactaaatcctgttctgagttcttttattagaacgtgcttgtctgtactttgaacccagaacacagactaaattctgttatggtctggatttgtgcagcgtctggattgggcgggaagttgttcaccgtttggcgctcagaatttggggagacgggaggtctagggattgcttgggaaggactaaatctcggcccatcatgggctgctaaaatgaaccgaaactacacagagatgggctttgtcaaacatggaccaagagatttacgaacaggttcaggagaaattggcccttgaactcggcctactaacttaaccgagcaccgcgcgatcacgttgacgctctgggtcaacctgttagtttactttgaaatggtcttcgggtcgaaattcgaaaatcacatgggcatttactttgaacagattgagtttttccaagataatcttattaaatggaacagactggatcactgaacagagaggaggggtcacattctcagcgatcattaaccactggttacataatcagaaattaatattacttgttttgttttttttctctctctgtctctgtcctgtttttgttgtgtgattcccaaaccaatgactagaatggtatccatagcattaaataagttgtcacctatgacaaaaaatgatgtagcaagtgaataaatgaggaaagagaagaaaatcatgtcttgcatgagacatggttcctacacaacatctaagatataatgtgagataagtagcattaaattaaagtatggaataatgatgtttgtattggaagactagtgtctagtactaattttttttttgatgatgtggagtttatggaaaccatgtctagtgttatgggttaggactgccctaagggcattcccaacccaatgactaggatggtgtccatagcattaaataagttgccacctatgataaaaaatgatgtggcaagtgaataaacgatgaaagagaagaaaaccatgtcttgcatgagacatggtttctacacaatatccaagacatcatgtgagataagtagcattaaattgaagtaatgaatagtggtgtttgcattagaagagtagtgtatagtacaaaccatgtctagtgttatgggttgggactgtcctaaggattggattccccgcaggacgttggttgtttccatttccgtttttgctatggcagacgctgtccttccatcaaaaaacatggcaatttcgttattgctgagagattaacttaccttaatcaaagttgatagttgctaccatttgtcagtcaacactaaatactttattagaaggtgggcatgtacactgttcattgagtacacaaggctttgagcgtttaccgatcttactataatccacaaaatcaaacatgacctggctgtttaactagaagagagtattctaaagatcaattgctgcaaaaatatgagtgtattaaccgcgtttgacacgatcttgagtcaccatgttaccagctagcattccacatggtgatctacgtaatgagagaggaatttaaactctcgatatggtgtacactcttatttacataaaacttaaatagttataaaaaagtgaaaaaaaataaaaagatgtattaacatataatatatcacttcacaaccatgcaagttaaaatttaaccttcataagtcataataaaaaaaataagttaaattatagctagttaatgtatatttatagtaaaaaaaatcgtcgaaacatgtagaaattaaatttgattttgcatgtttatagaacgatctatcacatattatactattttgtttaatattttattttttataactatttaagtgacatacaaataacgagcggatatccctcaaaagtttactatggtttccctctacgtactgcttcttcagaataaatagcagtgtacattcatcatagaacctcagctcaagctctcctcgcaacaaaaactagcagcaaagatcgaggctgccacctccaatggcggatcgaagccatgcccatgcccttgccttcctcgtcctcgccgtcctcatgccgcaaatggcgtccccgggcaagcttccacgcttcaccatgggcccgaggacgaataagcagctccgggacttcttcaagaaccatgggtcggacatggccgacctcgtcccgtcgggccagggcggccatgagcagggtggaggcagctcctccaacgggcagagccagcagggcggcggcgacagcggcggcggcggcggtggcggcaaccaggccccggccaccaacgccggcatgtacgtcttcagctacggcatcggcacgccaccgcagcaagtctccggcgcgctcgacatctccagcgacctcgtgtggaccgcgtgcggcgccacggcgcccttcaacccggtgcgctccaccacggtggccgacgtgccatgcacggacgacgcgtgccagcagttcgctccgcagacgtgcggcgccggcgcctccgagtgcgcctacacctacatgtacggcggcggcgccgccaacaccaccgggctcctcggcaccgaggcgttcacgttcggcgacacccgcatcgacggcgtggtcttcgggtgcggactcaagaacgtcggcgacttcagcggcgtgtccggcgtgatcggcctcggcaggggcaacctctccctcgtctcgcagctccaggtcgaccgcttctcctaccacttcgcccccgacgactccgtcgacacccagagcttcatcctcttcggcgacgacgccacgccgcagaccagccacaccctctccacccggctcctcgccagcgacgccaacccgagcctctactacgtcgagctcgccggcatccaggtcgacggcaaggacctcgccatcccgagcgggacgttcgatctccggaataaggacggctccggcggcgtgttcctgagcatcaccgacctcgtcaccgtcctggaggaagcagcgtacaagcctctgaggcaggcggtggcgagcaagatagggctgcccgccgtcaacggctcggcgctcgggctcgacctgtgctacaccggcgagtcgctggccaaggcgaaggtgccgtccatggcgctcgtcttcgccggcggcgccgtcatggagctggagttggggaactacttctacatggactcgaccaccgggctggcgtgcctgacgatcctgccgtcgtcggccggcgacgggtcggtcctcggcagcctgatccaggtaggcacgcacatgatgtacgacatcaatggctcgaagctggtgttcgagtcgttggcgcaggcggccgcgccgccgccgtcggggtcatcccaacaaacttcgtcgaagacgaaccaacaagcgggcgggcggcgctcggcgtctgccccgccaccgctgatctcgccggcggtattcgtgatccatttcatgttggtcgtggtatacatgtttttctgaacttatacctgaccgttacatactccctccgtaccacttagtacagtctttaagactatttcttgaatttaaaattttcatatactataatattttttaacaaaatcataaggtgaaaataaatttaaatgataatttaatgatattattagtatcaaataaaaattaaattataataaattatttattggtcaaatatttaaagagttgaattttaaaatgtctacgagtctttataactgaggcggagagagtatgttataacaccgaggtaatctctgggaaattatatatcctactttatgttgcagacttgtagatttcaccaaggtgattcattttgtcattgtcaaaaaaactgatgtattctgattgtttgttcaaagttctccaaattagcgtatgcgtgttgtatatataattattgagtgatgttacggtacagcggtcggtaccagtaccgcccggtaccaatatcatgaccgttggatctggcttgattgatccaacggctggtagagtttggtaccgggcggtaccaattctgcccctagtgcagtaccacgcggagaattgaggtggaagggcaaaaacgtaacttcgcgtgcaagtcctcttccgatccgccgtattcctcttccgcgtaaccctaaaatcccgatctgccgccgccgtattcctcttccgcgtcgccgccgtgtttctcttccgctccagcgccctcgtgttcctcttccgccccgtcgtcgccgtgtccgccactgccgtgtcctccttcggcgccgtgagatcagcctacgcatcgtcggtggcagcggaggcagaggcggatgagccagcggcggaatatgcggttgcagcggccgaggatccgctccggtggcggcaccgaagtaggccgtggctgaggcgcgacgaaggaggagacgacggaggaggaggaggcacacccattttctctcccgatcctacccttctcagattcaacggttggatgatttttggtaccgaccggtactagtaccgctcggtacattccgctggacggtaaaaaatctcataattattttgtggggaaagtgcatttaaatactttgtaaatatgcaagtttaaattcgacttttacaggttgtaataaaaatagttgtgattttatagtaactaatttcagtttgacttgtttgttttattacaacatttgaaaatcaaatttgactttgtatgtttgtggagtgatatgttgtaacgtcccgccttcccccaggccgggcccacttacatctgatagctttcataggtcatagactgccttcacagaccaacacatatcttttctgcacactttgtcctcactcgtgtgcacccgggaagaattttccggtcggtcacccatcccaaattactccaggccaagcacgcttaaccctggagttgtttggagattggcttccggaaaagaagttgcaacttgttgatatgagtattctattaatcctattaagccctaagccgggatgttacatatgtctcatattaatatatctttttttattttttaaataactttttaggtgtcattttacaaaaccggcctgaaataaccatagaaaccaaacgcggaagaaacgccataaaagatcaaaacatatataatgattgtcgacaggggatacccgtagactgattaaatagggtattggggtatattggtacgaggatctacacgatatgatatcaagcaaaacaagaagacaaggattatactggttcgaacccctcataaggtaatagccataatacaatttatatgagattgatatggaaaaaatcacagattacaatagaagaccaacgatcccaagtttactggcgagatcattgtcgagatggtttcgacgagatcttccggcgagtaggcttcacgtcctccgggttgtagactatggtggtggtgttggcgctatgattcaataccttgggaccctctagggggtgtgtctttatatcgcgaatcaccttaatttctatctaagtagaatttggagataccgaacccagcacgagtaggactctgttgttcacttgcccctgagaattgttttcataatatctcgtcgattttcttatcatatacggagacgtgtcgtacatacgaagttatgccgtacccgtatattccatgagtcgtaggatagaaggtatgcattatccataaccatgacaatgatgacattgaggcatgatatttgctaacggagtttagccgaaacctacatattggggcccattgattatgagcgtctctctccaatccaacatattacaacgtatcaaagttataacgatcctcggctggatatcgccggcaatagaactcgatctttatttaagagagagcatagaagaaagtccggctcttactatgttcataaaatctactaaaactctaaactataaactgtaaccgactatgtacatatattcgatacaaaatctaacatgatatgtaagaaatgagtagatatccactcaagcgatgaaaatccatctccctatcccgtgtctcttgtggacttattttgatttttagaatttgtgaaatggagtgaatcgcagtcacaggtctactggcaattactatattatatttcttttgttattgtgtacaatagatgcatgtttgaggtgtaggaattaatagatgcgctaaggcctattcgaagattaattctttggaaaatcacaaaagcccacctcatggtatggcatgcatgtggagtttagtaccaccttgcttattctaggagagggggacctccttaaaagggaggatgccctcctagccacttgaagcatgtgtggtggagaaaagagggggaacacacacgcgcgctcgctcgcctggcaggcggcgtacgcttcgaatagtccgcaaaattggctcctcaccacagttttgttttgctgcaggaaaattcggatttgttttgttttggaaacattccgaaaaatccagtgtccggataagttacgcgcgacttatccggttcggttacgtggagtggagatcgtgcgggcgccctgatcaagtgacctatctctatataaaccgagccgccgccttcacgcaaaacacacgaaatcaatctagggtttgcctcctcttctgtgctgcggcgtcgctcgtagactactccatcccgctcaccggcgtgcacctgcgatcgggagagcaggtctccttaacctctgccttcgacgtcttgcaccgggagaaggcggcaataaggtttttgggaagcgcttcgcgcgactgctccctgttcgtccgcgacggctcgccttcctctccgctcgcgtgttgcgcgccttcgtcgaagctcgtaaccgcgagtagttcctgtcgagcaaccggtttttccgccacctcggtacgtgttcgacatgttgcgcatatttgatctgttcatattttactgtttagtttacatgtgtagatctaatgatgcgttaatactagtataaatctgtaatgtcatgatttatttatggaatatattaaattattatatttctatattctcgaacatgaggtgctgtttggtttggccaaatttagcccgtatctgatcgcagcgtaaacagatgaaacaaaagttggtaactgtgcagaagcaatacaggtcgctcccatgcaccattttttgtctgtgataactcataacagtaacatgcaaagaagtactcccatctaccagctgaaatcaagagattaaccttgttgttgcagccgtaaaaacacactactaatctgtctgactctaataccatccgaagagatcaatgtggtaatctggctaattggcaattgacggtgcaaccgagacgagacacatcgtttataaggattacatagaacacgaaactctaatcccaaatcaacctagcttgcttgcactattactgaccagtggtcagcatggcgaccagcgcttcacacgcgcgtgcaccgcttctcctcctgctgctgatgtgttcgtgtttgcttctctctcccgtggcggccgaccgggcggcgtacatcgtccacatggacaagtccgccatgccggcgcatcactccgaccaccgcgagtggtactccgccaccgtggcgactctgactcccggtgcgccgcgcggcggccgtggcgggccgcggatcgtgtacacctacgacgaggcgttgcacgggttcgcggccacgctctccgcctccgagctcggcgcgctccgcctcgcaccgggcttcgtctcggcttaccctgatcgccgcgccgatgtgcttcatgacaccacgcactccacggagttcctccgtctcagcccgttcggtgggctgtggccggcggcgaggttcggcgagggcgtcatcatcggcgtgatcgacacgggtgtctggccggagagcgcgagcttcgacgacggcggcatgccgcccgtgccgtcgcggtggcgcggcgagtgcgaggctggacaggacttcacgctcgacatgtgtaaccggaagctcatcggagcgcgctacttcaacaggggcctggtcgccgcgaacccgaccgtcaccgtctccatgaactcgacgcgcgacacgctaggccacgggacgcacacgtcgtccaccgccggcgggagccccgcgccgtgcgcgtccttcttcggctacgggcgcggcacggcgagcggcgtggcgccgcgcgcgcacgtcgccatgtacaaggccatgtggcccgagggccggtacgcgtccgacgtgctggccgccatggacgcggccatcgcggacggcgtcgacgtcatctccatctcgagcggcttcgacggcgtgccgctgtacgaagaccccgtggcgatcgccgcgttcgccgccatcgagcgcggcatcctcgtctcggcctcagctggcaacgacggcccgaggcttggcaccctgcacaacggcatcccgtggcttctcaccgtcgccgccggcatggtggaccggcaaatgttcgccggatccatctacctcggcgacgacacgcggagcaccatcaccggcatcacgaggtatccagagaacgcgtggataaaggacatgaacttggtgtacaacgacaccatatcagcgtgcaactcgtcgacgtcgctggcaaccctagcacaaagcatagtcgtgtgctatgacactgggattctgctcgaccagatgcggacggcggcggaggccggcgtcagcgcggccatcttcatctcgaacaccaccttgataacccagagcgagatgaccttcccggccatcgtcgtcaacccgagcgacgcggcgagcctactgagctacatcaactccagcgcgcggccgacggcgacgatcaagttccagcagacgatcatcgggacgaggccggcgccggtggtcgccgcgtactcctctcgtggaccgtcgcggagctacgagggcgtgctcaagccggacatcatggcgccgggggacagtatactcgcggcgtgggcacccgttgctccgctggcgcaggtaggaagcaccgccctcggcagcgacttcgccgtcgagtccgggacgtcgatggcgtgcccgcacgccgccggcgtggcggcattgctgcgggcggcgcacccggactggagcccggccatgatcaagtcggcgatgatgaccaccgcgaccgccgtcgacaacacgttccggccgatcggtgacgccggccacggcgacgccgcggcgagcccgctggcgataggcgccgggcaggtcgacccgaacgcggccatggacccggggctggtgtacgacgccgggccggaggacttcgtggagctcctctgctcgaccaacttcaccgccgcgcagatcatggcgatcacgcggtccaaggcgtacaactgctccttctccaccaacgacatgaactacccgtccttcatcgccgtgttcggcgcgaacgacacctccggcgacatgaggttcagcaggacggtgaccaacgtcggcgcaggcgccgcgacgtacagggcgttctcggtgtcaccgagcaacgtggaggtgaccgtgtcgccggagaccctggtgttcaccgaggtggggcagacggcgtcgttcttggtggacctcaacctcacggcgcccaccggcggcgagccggcgttcggggcggtgatctgggccgatgtgagcggcaagtacgaggtgaggactcactacgtcgtgctatgacggtcaaccttggtcttctagtcatgtcggacttctgtgtactggtcggaataatgtcgtggaacaaacatccattcttatggattgggatcctctaacatgatataagaggaacatggtgattgacatgttgccccaccactcatgggcccacctgtcagtgatcacgtcagatagcagttcatattaaaggatccggatctctattttacacgccattacggttacaaaaggctattacacaagcattaagtgaaccccgtcacaagcattaagtgaaccccgtcacccaacaattttctttaagtttatataaacttgagtttattacaagagttcttatcgtcctttagggaaggcagtactaaatccaggccgtctatctcgcacaatctaagagttggaattgctttgtaccaggtggtactacgtccccaagagaggatttcgaactatgggtgggagggtaaaattgtactttcgcgtatacactctcgtttctatcggtttatctgacacaacctcagcgtacatcgccgccgccgcaaatcggggatgaatggagacgcctcaaatccggcttgatgctagctcatcgatgcattcggtgccaatgccctacaggccgctacctatatcgttcacgggctcaacccaaatcgaaagccccgccatgaagttcgatgacgcggacggccaccatcagcaccgatgccatggactgtgaggacgctacatattcatgaggagttatatggcggaatggattttgatacctcgaggggatgttcccttattgtgtgcatgctactcaaatggttatagaaaaaaaataaaaaaaattgagaagatgtattaacatgtgatatagcactccacaaacatgcaagttcaaattcaattttatatctcacaacgaaaaaaataaatttaactgtgaatatttgttaactagttgtagtttaatttgtttttttcgtaacgagatgtataagttgaatttgaatttacatatttatggagcgatgtatcacatgttagtatatgttagtacatgttacatatttttttaatttttttcataatcatttgagtgacatgcaacaaatgagggatatacccacgagggataaaaagagttacccttaaatgacaaccgactactatcatcagcgctgagatagcgtggatgctgccgatgcccggtatgctcttttttctcctcaatactcgcgtattccacattcataaaaataaaaacaaggcttctaacgacaccaaacaattcataacaacgaattcaagacactgcgggctatgatcgatccatcgaggaaacaaagcatgaaaaacgtatatttagcacacttgcacagccgcttgcctttgctgatcccagcctaatgtggccttataagccttaggcccaaataggtacgttttttttttctagtttttccctattttgtgacataaaaatagatcgaaactttatatccaaattttgtatttaaagactttgatttcttttactattttagccgttttaaatatttttaaattcgagtaaaattttgtattaagtagggcgagacaccacctctccccctaagaacatgcgcggattagcatccccgtacgaggaattgttcaagaccgcaagctaatctagtactccctcaatactcgtaaaggaagacgtttaggacaatgtttaagtcaaaccttgggaatatatattatgaataactctcaagttgttgagtttgaaaatgtaaaaattatatgaatagatttgtcttgaaaaatacttttataaaagtatacatatatcacttttcaatgaatatttttatagaaataagaagtcaaagttgtgttttggagaccatgtcaatgtcctaaacgacttcctttgtgagtatgaagggagtacagttcatttatgcgtccagggatcagttactacatctgtcttaaaatataataattttttgctataaatctgaacacataattattttgattcatagctaaaaatatttatattttaagacggatgaagtattagttaagctaccgcgccgtgcatggcaacacgacgaaacaccagcagcacccccgtgattttgggtgttccccggtacgcctcatggcgagacttgatataagtgcatctgtgcatggctcgcgagacctgaaaaccgtatatgtgggcgtgtggttgagaacttgattgggatgatgatgagacccggtgggtcgaacaacaagcgtacgtagacgagccaacgcgcgtacgccatttttcccggccctgcgtcacacggcattcttgtcccgtatccgcgccccgcgttcgcatcgatcgatcaaccggccaaccgccccagatatggcctctcgcgcgcgcggggacccaagcaaccaccgggcaaatccaacgcccaattcgtcgagagatttttcagctggtgcgtagacgtcgctaacccccatcgcctgctagtataataagatgacgcctacgtcgttccgtgcctgaatccgtggcacagctacgtacgtacgtgcgtgctcgttacacgtatatggcggcgtcgctggcaatcgttgccgtggtcgtcgcgctgtgcgtggcggctgccgcgtcggccgagacggcgacgtacatcgtgcacatggacaagtcggcaatgccgagcggcggcggcggcgggaacgggtcgaccagcctggagagctggtacgcggctacgctccgggcggcggcgccgggcgccagaatgatctacgtgtaccgcaacgccatgagcgggttcgccgcgaggctgtccgccgagcagcacgcgaggctgagccggtccccgggtttcctctcgtcctacctcgacgcccccgtgacgcggcgcgacaccacgcacacgccggagttcctcggggtgagcggcgcggggggcctgtgggagacggccagctacggcgacggcgtcatcgtcggcgtggtggacaccggggtgtggcccgagagcgggagctaccgcgacgacgggctcccgccggtgcccgcgcggtggaagggctactgcgagtccggcacgcggttcgacggcgccaaggcgtgcaaccggaagctcatcggggcgcgcaagttcagcgcgggcctcgccgccgcgctggggaggcggaacatcacgatcgccgtgaactcgccgcgcgacacggacggccacggcacgcacacctcgtcgacggccgccggctcgcccgtcccgggggcgtcctacttcggctacgctcccggggtggcacggggcatggcgccacgcgccagggtggccgtgtacaaggtcctgttcgacgagggcgggtacacgacggacatcgtcgccgccatagaccaagccatcgcagacggcgtcgacgtgctctccatctcgctgggcctcaacaaccgcccgctccacaccgaccctgtggccatcggctcgttcgccgcaatgcagcacggcatcttcgtgtccacctcagccggcaacgacggcccgggcctctccgtcctccacaacggcgcgccgtgggcactgaccgtcgccgctggcaccgtggacagggagttctccggcatcgtcgagctcggcgatggcaccaccgtcatcggcgaatcgctgtacgccggctcgccgccgatcacccagagcactccactcgtgtacctcgactcctgcgacaacttcaccgccatcagacgaaaccgcgacaagatcgtgctgtgtgatgcacaagcttcctcctttgctctgcaggttgcagtgcagttcgtgcaagatgccaacgcggccggcgggctcttcttgaccaacgacccgttcaggctgctgttcgagcagttcacgttcccgggcgccctgctgagcccgcacgacgggccggcgatactgcggtacatccagaggagcggcgctccgacggccaagatcgcgttccgggcgacgctgctgaacacgaagccggcgccggaggcggcggcgtactcgtcgcgcgggccggcggtgagctgcccgacggtgctcaagccggacatcatggcgcctggctcgctcgtgctcgcgtcgtgggcggagagcgtggccgtggtcgggaacatgacgtcgccgttcaacatcatctccgggacgtcgatggcgacgccgcacgcggcgggcgtcgcggcgctgctcagggcggtgcacccggagtggagcccggcggccatccggtcggcgatgatgacgacggccgcgacgctggacaacaccggcaggtccatcaacgacatggcccgggcgggccacgccgcgacgccgctggcgatggggtccggccacatcgacccgaacagggcggcggacccgggcctcgtctacgacgccgtcccgggtgactacgtcgagctcatgtgcgccatggggtacaacctctcggacatcagggccgtgacgcagtggtcgacctacgccgtgaactgcagcggcgcgtcgtcgccggacctcaactacccgtcgttcatcgcctacttcgacaggcgcagcgccgccgccgccgccgcggagaccaagacgttcgtcagggtggtcaccaacgtcggcgccggcgcggcgagctacagggcgaaggtgaagggcaacctgggtgggctcgccgtcagcgtcacgccgagcaggctggtgttcgggaagaagggcgagacgcagaagtacacgctggtgttgcgcggcaagatcaagggcgcggacaaggtgctgcacgggtcgctgacgtgggtggatgacgccggcaagtacacggtgaggagtccgattgtggcaacgactttgagctcaacacggctgtagactcttcttttcactcttgtgtactgtagcgtgcaagttgattcacatatctgaagttctgaacatgttgttcgtctctagctgttgggcaaataatgcttttggtggttagttagtgcagtccgtgagttttggtatatgctgctcgaatgccccagtaattggcataagtatttatgttcttgcttttgttcaaaggaactgttagaagccctaaaatatgtcctctatagagctaaactattggaattatgtcaaaaatcacgtctccaacaggtttccaaaggtgcacccagtttttatgcacgtccagtcctgatgccctcgtaagtatagacttcaggcacctcgcggcgcctcattttgatgtcaacgttaatataagaggatatttggccagaaacagttggagaggatttgcctaccctgatgccatatttctaagtttttgagaaccaataatatgtgatctcttgaaggaggagatgatttttggacccatgttttttcacagcctcaatccaagattattgaaagttaaattttggatcactcttggaggtactttaaggccccatttgaaatacaataataataaacatatgaataagaaaaacttaatgttttgataggaatacatatgaaaaacacaaagaaatacaaaacaaaagaatgaccatttgaataaactagaggaaatatgtactcctaggaattagacggaattagacgagagagagagagactaagaataatagctagaggttaaagctcttgctatcttttttttaaaatttacgcacaaagccattcctaagaaattttgtaggatttatgaagttccaatcttttgttgcaaagggccgaacagaaaaaaattctataaatttagatcctccaaaacacatccacaaatcccttgaaaaggaggtctaagaatcgttgctactgtgctgaaacggatttggcccgtcatatcgtcaatcaacaaagatgcccaatgcccgcatgcatgtcgttccggatccccgtacagggtgcatgtgcatgtgtggtcataagcaaacatgattgtcgatagaaagaaacgaaatgaacgtgctattgccagcttgtcacctaaagcaatagagcatgaaaagttcaccgattgaaagggaaggtgctaattggatctaattcttattctaagcatcctggtatctagtcatttttcatcatgagataaataccatagagataatgcaaaatatatgcagctgggatgaactatacctaattcgaactatatcttttttttttgtgcaatattgaaactgtacaaaactgtacataccagcaaagcgctcacaacttcaaatatcaagagtgtaagttccattgcttaaattcatatacgtatcagtagattgtacactaccagattgtgtttgctgcgtagattttggtgggagtgtcttgttatgttgttcgccaccgtcctcatatggtaacacgaccacaggagcagcatgtatagattcccaccgttccttcatgaagctcatgaacgccttgaccatctccctccggaattctagttccctcgtgaattgatcaaacataaaaaatgcaagaacatatttgaaaggaaccacaagaagaacagcagatgatgctagaagaacaagagcaacctgagtcgttacctgtcatatgatcaaacaagaattatcaagaattacttactcgtatttgttatttttagttgagaatgagatttatttcatcatacctcaggttggcctgctaaaaagattgtgcgtattttaagaagagagagattcaggttctgaagataattctccactgaagccattgcctctttaagagctataatcttttggattgtgtttgaaggtggttgatcttttattgtcactttgccaaaagatctacccaaccgaccttgttctttcagccctttcagggcaagcatggaaagagccaacatcatcaaggaaaatggaagaacataagaaagcatgttcctacatatcataataaatacagagaaatgttagaaaaatgatgcttgtacaatactggaagacacaatatttagttggaaataaagataaaacatgtaaatgaaccagcaaatgatgatcaatgccctgccaagcattttgtctataattgctcaaaactttcattttggattaactgtacacagtttggatgcagttggcaaatgtcccaatcagtgaaatttgaagatattcaatttatatggcagggtgaattttcaaatattgagtatattttcctattaatgcagcaatacttttgaattataatttacaaccaggcacaacaaaaaaaaaaagaagagtcaaacacgataactaccttagcaaggaaaacaatctacaccccttttcacaacacatataatccctactctgaattactttaagttgatattcaatgcattggagcagtacaacaactcaacaagaaaaggatacatgcgttaagtgaattacctgaagataatagtataaaccacaagtagaaaacaagcggttgtacgagaattttcccagcgtttgagcttgtagaatttttcactcactattgcaaaaggaagtataagctcctgattcatgaaacaagagatacattataaacatgaaccccctgcctaagaacaagagatttccaactcaactgaaaataaatcggtattttttctaccaaaacttcagcaaagaaataatatttccaaagctaaatctctgattgaaatgagagtaaccatgccaggacaaaccacaagtataacgaaacctaaataaaccatattgtttttgtaagccatgcaactggatgacagacatgtaccttgaagaggtcaatgttgcttggaataccttcaatagtagcggcaacaattgtggcctgtgtcctttcaactattttgctcttctctttacaggcaaccatagccttttctacaagatttttatcagctacaactaaagatttgctcaatattacaccatgcttaactgaggagtttctccaaaagttggccgagtggctggatgtccaactgggagatgtcatccacttgcgcaagtatacactaccatctatgtcaaaaatatgagcatgggcgctagatgagtcttctgaaggtctatgccactgagatgctctttgacttgctgctttggagttcgtaacaagtggcccgccccagaacttaaccgctaaagtctgaagcacaacatcaccaaaaggtgcatttgacaggtatgagaactgtactaacttggctggatcttcataaagtctacgtataaattgcagagactgaagccttgcaatactatttgctgcactacttacagctcttttcttgcctctgtgggcaccatatacatgatgaattgctggatcatcatcccttggtccatattcattaatgaacctatacacagaaatgatttcactaatgaatgcgagccatacatctcgtctcatctctccaccaaaatcaacaaactccaatgtccactcatttgacctgtcaacaatcaatcagttactttgagattacactaaatgcattttatcattacaattaaatagcgcggacaatatgctaacacaaatctacaatttataatacaactacaaaccaatagaataatcaatatgtttaacaatattgcaccaatagagaaatggtaacaaatcaaagaaataacagatcctcctgactatagtgaaatgccaagtatttgttagctaatagtggccagcagtgatttcacaaatggagtactatggtgtagtttggtatggttacaccaatcaatttggcagtaatcagttctagtgttctcctagcaatttgtagatagcaacttaatagtgaaaatggtcaccgtggggtcattttttttttcaatagtgaaaatggttcctctagagagtaaccaggcatactcacactgaaccagatgaaacagatacggcagagtcgaacaatctggatccaaatggtccaacctttgctttctcaacccttgaattacgatctgtaaggtcaagcttcaatggtttattggtacttgtcagtccaatggcctgccaatatcaatgtaaaggtggaggagttgggcccaaagtcatcacatcttgcgaaattccaaaagaagccacaagtagaattgttaaaggggaccatgattcacaaattacatgatcaacaaaactttcattttttaactgacttatttgatgaaagaagaagttctatcattgtacagctatctatttatatttacgtgagtgttaaaacaacatcaagtggtattacagaacatagaacatttttttcctttgctatcataacatgggaaatattagagagaaccgagatcagtatgatgcttaagcatgcttgacaaaagggccatctgtacggatagcaacaacaagtgatgcatatttttaaataacagaggaaatcactcttaaaaaaatacacacattccaagtattaattcatacctcaaaatagagtgccttgttggtcaaggttaagtgtccaggccacgcagtgttttcttcccatttcagaacaggtctttttctactagagcctatgcataggacttgctcatcggacaaaaaatgatctccacttttatgtgtttgcctcccatgatgaactctgcacaggtaccagtgatcacagaagccaaacattcagcatatagagtaatactccctaggagcatatgaaaatgatagttgaaattgtgaactataattaatagttcaaattggacacagaatctgacaacatgatcacgctttaccagattaaagtgacatataaatacattattattttgatttatgatggtggtaagagccatcaacagccaagcaatcaaatttcttgctggcctaagatctaagccaaaagtctaaataaagagatgtatcatgtaacctgaagttagaaatacatttcctgaaacttgagaagcttaagtgtgattacaatcagaaaaatcagccgaagatgtaaaggtgatcttacttcagaagttcaccaaggtatgttgtccatatatctaaagaaagccccttttcagaaccgacaagggccctgaagagataatgagccgttgaaacatcagctacacctgccacagcaggggcaattcggacaaaggcatcttctccaacaagtcttccctacatgttaacatacaaactcagaaattcatttcttgtaattccagtaaaggaactcagtgatattgcatgaatttaagttttccacaaggacaacaacgcgtacatatacagatgaattacacctcaccagtatagaatagttatctagtgaagactctgtgtcatcatcttcaccatatggatcttcccacgcaagcatagtcataaatattagcctttggaatgcaagctcctgccgaacaattcaagtaaaggtacttaccaaaaactagaactggctaaaaaataacaagtgcaacaagcatgcaataatgttgtgttaactgacagggaacttggcttaaggagtgtggagcactgtagcacatattacacttcatcgaaacaacaatactgaattagtaactattttacctttaaacttggatgcaaatcagagttatctcttgacaaatagcggaagcaacaatactcaaccagatttcgagcatcattctgaacatgactaggagcaagagcttcaaagatcctctgcaccttcctccccgttaacccattcaacctgaaaaaaaaatcatgtaaatgggtgaaattcaggacagatcccagaccatccatgagctcatattatatatatacttctccaactgcccttttgaactgttaccaattgaatccatttctcacttacccaatcagcaacatacacgaaatttagaatgacaagaccatacatggaccaatcaacctgattccatatgtaaatttgtgggatgcaagttgctaggatcaaagccatgccagtgagcatggctgctcctgtcatccatgctgctagtccttgttccacagacagcaaggtaggtatctatcaaaatctaccatctgaatttagccaaaccaaaaattgactgtcgctacatactaagtcacatactcacattgatcatgggatctagcaactctcagaccatcataaagtaggtgaagcataactgtaatgatatacgaactgattgagataggtccactcgtttttctacaaatctagtcattactattatcatcgtggctacaatgaacaatcaaccgtggaagcgcaatcggagataacttttaccaacctggcaaactgctcgatggtgacgacagcgtctagcgagagccagccacgaccgacccgccgttcgacggtgatctccggcaccgcgacgagcgcctgctcctccagcgcctccttccgccgcttcttcctcccctccgcctcctccttgctcctccccttctcccgcgccgcgttcgccgcgtcggcgatggcgcccctcgcccgcgacagccacgaccgcacccgctcctgcaccgcatctgccaggcccaccacaccacaccacaccaaaccccagcgatcagcgcggcgaccgacgcacacacaaacacacatggtgggggtggtgcgggcgctcacctgcgtcgacgtcggggatccgccactgggagcggagggcgaggggcggcgggggtgccgcggcgcggcggcgacggtggtgccccccgccagcgaccctgcggcgggggagcggcgtgaagcgcgggggctggagccgcagctggagcatggtggcgtcgccgccgcagccgccgactatcggtgggggggagctagtggtggtactgaggcgggcgtgccaaactttccctcaattccattggctgggagtgggagctgcacattatctcacactgcttgcttgcttgctaca

SEQ ID NO: 48016 - DNA, 705 bp, Oryza sativa
tctggactcgggtgtgtgggggaagaaaaagactttgccctcttctcgtcttctccatgtgatatgggctgcttgtttgggcgtgggcggtgggccccacccgagagattatccagacgaaatgaatgaggccgtcatcacagcctgtcaggccgtgttcggatgggccgaaatgtcaagaccggttcacgtgaggaataagttcactgtaagtccctttatttgtcgcccagcctaattttcgtccctacaacacaaaaccggatacaacgcatcccccaacttacaaaaccgtgcaaataaggtccctcggtggtatagtccctgattttagctgatgtggcgctctttgactaggtctttatccaatgtggcatcgacgtggcgcttacgtggcaattcgatccgaaaaaaataaaatccatagtatccacatgtcagttacacataaataataaaagatggtgggacccacatgggaactctaaaactgagaggagagattttttttttgtttgtttgtttaccgtccgacctcgctctagccgtcgaccaccacgccgtcgacagggacgatctcgccggccctgaccgcgacgacgtcgcccacgcggacgtcgcgcacgctgacgacatcgcccgtcgtcgcgaggaccgccttcgcaggtagcatgcccatcaacgacgacatctcggcactcgcct

SEQ ID NO: 48017 - DNA, 6347 bp, Oryza sativa
gtccgcccacgacacgccgccgctcctcttctcccccttctcccccgccgccggtccggccgctgaccggccgttccgcccacgacacgccgtcgcttcggccggtgacccgccgccgcccgcccctctctgcctccgccccgccgtcgcccgctccggccgcgcccaccccactccgccggctggagacagagaagagggagagaggggtgacagagagaagagggtagtgaagatgacgtgtgggtcccaccatttattattatttgtgtgcaacatgtgggtcccatggattttttttttccgaatcgaattgccacgtaagcgccacgttggacgaagacctagtcagaggagcgccacgtcagccaaaacaagggactataccgccgagggacgttgtttgcacggttttgtaagttgggggatgcgttgtattcggttttgtgctgtagggatgaaaattgaactgggcgacaaataaagggacctaaagtgaacttgttccttcccgtgaaacatccacaaggtttgggcctcgtttctaaatgggcctgaatcccggcgttgttgtgtatgggctgtaatgttagtgggctgacacctaaagaaagaccagcgccggggggggggggggggggcatagattccccgaggccgcgacaaaggaagaacgccaccattcgtccaggtccaaagcagatgccagtatgccaccaaccaattattaacacaacagatgcttgtgctaaatggttctttcctcatgaagactcagattttatttcaatttccgttagcacgtttttcaagctacaaagttgctttaaaatgttaaatttatccatttatcatgtttataataattaaaatttaattaattatgtgttaatagttttctcattttcctttgagccaacctttttttaacggaaaacagcattagagtgctttttcattgaatagagtaggagaaaataaacacctaataataaaagaaaaagatcaccgtaagctgtacatgagcgcggagccaacctaatttttatctccatcagtttcaaacaccggcgttgtggaatttttttttccaagttcacttggcaaacggaagcacctgtcgctgcgtatctgtggaaaacggcccggggccggggaaggcgacgactgaggagggcgtagccgcgcccgcgcgcagaggcgtccatctcacccacgacagcagagcacggcatcgcgcccatcggaaggccacacaagaaaaaacggccgcgaaaatcaccctcccttccttctcgaagcgttcgtagaaaaataccgtctctcgtctcgtgtcgcggtcgcggatgccggggtcaaaaccctccccgcctcgttcccgttgagctcgccgccgctaatatcctaacgaactaactaaccatctcatcctcgaggtatccggccaagccgccaccggggtcaccaccatcgagctcgtatggagcggagggcgcagccggtgtcggcggcggtggcgccggtgacggggaggaggaagggtgcggcggcgagccggaagtggatggtggtgccggcggtgggggaggagcggagggtggagtttgggaagcaccagatcatgaagatgacggggctccccgggcgcgacctccgggtgctcgacccggtcctctcctacccgtccaccatcctcggccgcgaccgcgccatcgtcgtcaggctccagggcgtcaaggccatcatcaccgccaccgaggtgctcgtccccgaccacgacgacgtcctcctcgcctccttcctcctcgacctccgctcccgcctctccctcccggttggtacaccgtacaccatctctttttctcttctgttttctcatcatcaccacatccaggttcactctgttgcattggttgtactagcagattgcatctgcaaactgatatgacattgaactctggaatttgattctgttatcgtcgtcgtgattgactctactgaaactctgatgatgattattctgggtgaaggatgcggcgcctagcacgaatccggcggcggctgatcgcgggaacgggacggagcagggcgatcaggggagcgtgccaggtctggcgatcagcggtgctggcaacgccaagatcccgccctttgagttcaaggtgctcgaggtctgcctcgagcacgcatgcaaagacttggaatctcaggtatactgccagaaaatttgtctattgctgctgatgatgaatcaaaccaatggtagtatatattaagggggtgtttagatctagaggtataaagttttggcgtgtcatttcgggcattatatatggtgtcgtatagggtattcggatactaataaaaaaattaattacataatccatcattaaaccgcaaaacgaatttattaagcataattaatccatcattagcaaatgtttactatagcaccacattgtcaaatcatggagcaattaggcttaaaagattcgtctcgtaaattagtcgcaatctgtgcaattagttattttttaacctatattaaatacttcatacatgtattcaaacgttcgatgtgacagggtgaaaaattttgaggtgtgatctaaacagggcctaattcatgttcatctctgtctctgcaaatggtgtcagacacgctctctggagaaggaggcgtatccggccttggacaagctgggatcgaaggttagcacgctgaacctggatcacgtcaggaatctgaagagccgcatggttgatctctcagggcgcgtgcagaaggtacgcaagaacagtggactccgttcgcttgagtccgtttaagttgcagctgaaagcgatggcacctaagcattttggccacctgttcttggtctcgcatgcagattagggatgagctggagcacttgctggatgacgacatggacatgtccgagatgtacctgacgaggaagctgtcgttccaagggctcagcggatcgctgagcagagcggattcacacaagtacgcatctgttgatcatgacgacgataggtatgtcacctgaattttgttctttctggtttttggcaggatcgaaagactcgaagtaggagttgttacctgaattctttaaccggaaatggatgttgattgttgatagattgccgatccgtggcttttgttttaatctttcatttgcgcctgtattcagggaggaggaagaccatgacgatgagacagagagtggccgtgaaagttctgtttatgttaagcctgatatagaagagttggaaatgcttctggaagcttactttgtgcagatcgatggaacgctgaataccctgtaccatgtatgttcatcctcctcctttactaagggcttcatcttttgcctataataaatcagccattgccaaattttaatataaaagttaattttagagtttattttgggcacttttaacatagtttcttttttagcaatagcttttaaatcactaaaaacacgcatctaaaagtttcacctacaaactattttttggttgctttgttttatacattttttagttgctaataagctgttatggtttataatcagctctcggtcaactgatgaagttgaacattgccatgcttagattgttactgaaatggttgtcatgctaatatcaactgttttagtacaatttagtgatactgtccagtttggaagataaacatgcgatatttagcataacttctgtaaaagtctctgcagccaaaatctgacgaaatcttgttaatgtttgccattgaaatcgacactggttttatcaaacagttaaaatgtatagcctgcattgtcacgcacttgcatcgctcactactagcaaattccatgcattgcttgatgtttcattgcccccctgacatttgcctattgacatggaacaaagatccgtgaatacgcggacgacacggaggattacatcaacataatgctggacgagaagcagaaccagctgctgcagatgggcgtgatgctgacgacggcgacggtggtggtcaccgcgggcatcgtggtggtgagcctgttcggcatgaacatccacatcgacctgatgaaagacccggagacccccgagatggtgaggatgtccaacatgcacttttgggagaccaccttcggcacggtcgccggctgcatcgccatatacctcctggcgatctacgctgggaggaagagcaagatcctgcagtgatgcttcccaacagaggaagctaagcgtcaggttgcgagttctgcagcctggctgcgattttgctgggcagtggcgtagttgataggttgtgtatggatgtgatgcatttttgttgatttcgtatggtgtgggagcaataataatcgaacgatctctctccatttcctgctcttattagaagttagcacttagcactactatgttaaatttcggccaaaggaaccactatgttaaatttcggccaaaggaaccctttcagaaatgctcttgccacatttcgcattcgaagtaaatccaaaaaaggtaccagtaattctcattcaaagttaaaacacgtgctctgacttttactgactatgctgaacggctgtgccactttttccagtggccgatccagaacaaaacgaagtaacaaaccagtgttgcctttgtcaatggcaaatcgcctaaagatcaacaaatgatatatatgctcatctgactatctattttgtatttacaaggtgatatggtgatgcaaacaagattttttgtaaacgccacaatactcattatctgatgcacaacaggtattcccgacctgagaataaatattctacacaaatcagctatgtttagacttacagttgcaccttccttgatctagtacaccgaacctggccaaaaaaggggagtcattgacgaaccaaagaagatgctcgagttttcaaaaaaaaaaaaaaagctcgagaaggtaaataaaagaaccaaagaggaattctgcgtattcttctcaaattgacttacgttatctaccgggttaaaagcagttaatccagagctggtctgtgcattactcgaatccaacgctctcttgctgtttttcttgaggccagcgactcctaaagaaattggaatcgatgggtcagtatcgatgtaaatatgaaaggagacaaaagaacttcccaactggtcagtgctgacaacttaattgactgtgcagcattgccatttccaaatgaatgctgattggaacatttctaacaattcaaggcttcctagctcaaaaataaattatggaaattgttctgaaaatgacagatatttatcacttcaaaacatgcaggcattcctagaaaaccaaattggataatgccactctaagtactgtttgcttagacattgtatatagagtaactcatttacctgttctgttatttgaaaaaggctgcttcacaaaattgtcgtcaatatcaccatcttcatcaggatcactgttacaagctgagatgtgagtaccctgtgttgcacgttaggcaaagttcctaaataaatgatacataatatttctcaccagacaatagaagagccaggaagcaacatctcttgccttttgttttgagaatcagctgaacccttcccacgaactctcttgaaagaactattgaggattcaggacaagtatcaccataagttggataaaaccttgaaagcaacggctcactacagttccaacagccatgcatcttactagtgctacatgcctacatcacattgttgattctgccagttttgtacaccgtaaacaacaagagcagtttcttatagaataaattgaaaacccccttttgaaactaccaagctatatatgcaatagtggaagaataatttgttatttcattttaaaggatgaaacagattggtagagatgcacttataatgttgtacacgaaagtaccaaccagctttccagaaacctaggcttctgaagttcactcaatttcgttctgggttctagctatgcaggccaagtccagatgaatgtgtcaagtttttttttttaatgttaactgaatgtgccaagttgttattgcatgctgcaagtgcgtgcatattgtatctctccttgtgtaaagtgttttatgtaacccaatcctttgtgctataccgcaattcaagtgtgtaaatgctcatgcactaagacgagccatgcatgtttagatcaattttacccatttctccaattaccgtgtagacccaataactgacatttgcatagttaacttacaatggcaatggaactattataccaccacaaaaaagatgaatgaaatcacacagcaggaaaaggaaaaggt

SEQ ID NO: 48018 - DNA, 1179 bp, Oryza sativa
gaccattcttgaccaacgtgaagctaaaaatacaacagaacatagttggaattgcagatagaatgtaccgggtgtactggtccatgagccccaaggattctctttacaaaactgtcactaatgagatctccttgacagcattcctacataagagaatggtggaatagctaatgcaggaataactaagcatcagtttcgaatgaagtataagaacaatgaggcaggaataactcacatctgtttttgcttgcgctagccaggcactcgtgaaataagcatgagggccaagggaaagtgcagcgtggagaatcgtgacatgcttgcagtaccttatgcaagttactttgaccaataaggcaagccctattgcttgagagcacatatgccagtttcctgtgacacagcagttctaggccatcaatgcatggaatgacaaatgcttgatatgcagaatggtgaaatgatcaaaatacgtggaaagaaatatacagtgaagtgatgcccacactcaggccagatcctcagcctcagctaaatccccagccatttgaatagcacggaagatccccataagaatgggaacagaactggtattgtgaccatgctcatcatccatttcagatgagtgttctcaacatcataacaagtgggctgccaatagaacaaaggagaaagtgattagagcttcaaaaactcccaaacacatgtactaactaaaaatccgaaaagtgttatgcaaacatctcaaacaagaaaacacctccaaaattccgcagagatcttgttttcacataacttcatgggaaattccttatcatatgctagggtatgggtcaagaaaaccacggcatacgctggatggtctacaagtgactctttcctttttgtgttatgatgaacaaataatcttctttgctcctttagcacttcagttaagtaccttgtcgactagggaaaatacaggtcaaaagaaagaagacaccttaaagcatacaatatgagattgtatagtacgttaatagaaacaagaacagaagacacctacttcagtacgaacatctctggagcaatctgttgatgccagcgcaaaagcacatgcatatttaataggaattgcatgttccattataaggtcatggagtttgcagatgaatgacttgcgaacagtatatgaagaat

SEQ ID NO: 48019 - DNA, 961 bp, Oryza sativa
tttactgaatttacttttatatgtctaagaaataacttattgaaatttaaaagtaatttagacatatcataaaagtaatttgtgatttttcatcaaaatataatcatgtgagatcttgttataaagatttaattattacgaacacaacggtgtaatcgtattgtaaatcggatgagtaatttaagagataattttatttcaagcatagatgctcaatggattaatagcaaccaaaactcctaaagtatgggtgtctctggttaagactaattggatgtctctggttaagactaattggagaggcatctccaattagatttaccgcagcaagtagctaaatctcacgttaattttctccatgggcattaattaacaactaattaaacaaggtacgtctttacacctacacgtacacagtacatatacacttgaaagaaagtctcaatgatgcgcaagcacaacaatggcggcgaaacctcggtagatcgatcgatcctcgtaattctactcttcgtcgtcgtcgctgacgaacttgccggtgccggggttgatggcggcgatgaagaagaagacgacgttgaagaggacgagcggctcgatctcgttgatggggacgccggtctcgatgttgagctgcgcgagggcgcccttgccggtgatgatctcgccgatgatggagaaggcgatgccgagctgcgcgagccggccgacgaacagctcgttggccttggtgaagccgaacagcgggccgccctcgctgaggcccagcgcggagcggaagcccttgcccggggcgatgacggccttgtcgaggcccgtcaccggctggtcgtcgacgaagctgccgcggtcgccgagcgcgccgatggcgccgaggagggtgaagaggatgaagaagaggaggaggggctccgcctcgtagatcgggatccccgtctccaggttcagctgcgccaggatt

SEQ ID NO: 48020 - DNA, 1779 bp, Oryza sativa
tcatcagcaattaacaggtagaccgtcgcgtccatctgcactgccacctgcacggcagccggctcgatcttgtgctaacagaacagggcctttgtccaccacggatagatacatctttgccactgcagctgcactgcacatcgcagttcacacgcacgaacgaacaagatcgtccttgtgtttctcttctctgcaccccccccccccttggtactgatgtggcacgcgtaccaagagacaaaaccaccagcagtagcagccatccattaatacgccttgacccactcccctggatgtctctctcgccaccgtttgcattcgccaatctccaccaccacatcatcttcttcctcctccacctcttacctcgtcgtcctgagcgctcctggttgcagttgccttctcctgacaactcctcttcgccttggctaagttagctagctcatcatcacactctgcatacgtgcttgtcaactccattgagagcgtcgccgttgatggctgagccgccggcgaccaaggtgtaccacgatggctgccccggctgcgccatggagcagaggaaggaggagcacaagggcattccctacagggagttcctcttcgttgccatcaccaccctcgcctcctgtatgaattgaacacacatatacatgcagagtcaacttagtttgatgtttatcataatctcctctgggtcttatcttattctactggtttttaattagtagccttgtctgtctctccccttaaattttcagctctgccaatctcttccttgttccccttcctgtacttcatggtaagtttagtttccatgcattccatctaatttcatgaaaaatatattttttacaaaaggtactcgatccattctcttctctagagcagataagagacttgcatgttgctcggacagaggaagatattggattctatgctggatttcttggtataacatttctgaaaaataatttgtcactgagtaacaaattattttgaacacttcttcacaactacgtcaaaaatgcagtaacgtttacatgatatatttctgctgcaggcgcatcatatatgatcggtcgtggtttcgcatcgatcttgtggggtatggtggcagatcgtattggccgtaagcctgtcattatcttttccatttttgcagtgtaagcactatggtacctttcctaaaatattgacaggaatgtatccatggcatatggcatttactttgtagtctgttccatctgctaaacaatttttaacctgtctttgaatctatacttccagcattgtgctcaatactttgtttggattaagtgtgaagtactggatggctgttaccacaagatttcttcttggtgctctgaatggattgcttgcaccaataaaggtacctttttaggagacattaagatactttgaaatgtgaaagaagtttgttggggacaaatgaaggatgtggtgtcaatatcgattggtattcttattccatcaaacatttactcaattattttttctattacttatggctgcaggcgtactctatcgaagtttgccgagctgaacatcaacctttgggcctatcaattgtaaattacaaatctataaatagcaaattgcatctatatatacgatgtaagaactctgtttcatccatgtcatctaaattttaggtgagcacagcatgggggataggtcttgtagttggcccagcaactgggggatacctcgcacaggtaatattacattatattattcgggttcatagatacattt

SEQ ID NO: 48021 - DNA, 707 bp, Oryza sativa
catacgaatttagtaccaattatttttttaaaaaaaactaagcatttaaaaaactactatgcccaaagttttagaagtttgattaaacctagtcttaaaggttaaatatttgttacttcctccgttacatacatacatacatacatacatacaaaatatgaaacggaggaagtactgccttaccggagggagtacataatagcattaggggtgcgcattcggtctaaccaaaaatttcggtctcgatcttcggtcttttgattttttcggtctttgaaaagtgaagaacaaatttcagcgcaaaaatgttaggaccgacaaattcggtctttgtcttttcggtctcggtcctaaccgaaattcaacaacattttcatatatgcaaagaaataatggaaattttcaacacaaaaatcacaaaaaaaaagttcgtaagcacttatgagtaaagactcttattaggttgcatgcctagaagaagtagggatgtgaaaattagagtttaatcctattaaacatagtggattgtaggttgcatttagacatttttgataattcggtctattcggttacccgaggaaactaaccgaattgaccgaacaaaattcggtcttttactgcctagggccgaatttctcgatctcggtctttttgatctcggtctccgtctttttctacccaccccttaatagcatgctgcatgcgtc

SEQ ID NO: 48022 - DNA, 2454 bp, Oryza sativa
caaacggcccaaataaatcccagaagacggcagatcgctctccccagtccccaaccaattcggcattcgcgagcgacggcaagccgacgccagcagcgtgaagtataagcggcaacggtgcaaaatcattcatccagaccttggcgtgttctgcacctcgcatgcactgttttcttttctatcctattttctttgccttctcttgccgatcgagcatatccttattttttcctgttggatctataagggaagagcacatatgttggatgcatagatgtccagtgattttggtggtttgggaattgtgatgtatctttttttcacggtaattcaatttattctttaattagttacttgactgattaaccccctataattgggcatgcagacggctgtcggccggcggcagttctgttatttttttttaatcggaactaaaaataaactttaatctgataaaaagttttaaatctttagtcccggtttataagagaaccgagactattgtaaaatttgacggaccgatcaaagatcgtttctctagtagtggctctcaacccagcggccagtggcactactatctgctgaatgtattgcatgttttgatcggcgaaaagatgtactgatactctccattcagaatttagtttgctgctacagcatcaaatatatattttctagtgattttgtttgtgaatttgtcagtggcagatacttctcatggtgatactcatgtcctaatgtattatgattttttctgagatctagtgtgttctgtgattcatatctaagcaaccccataccaattaatatctttaaaaatagcatatactatatttatactaactaaaaatagataaaaattagtacataccgcaactaacctaaaatgtggagtagtatatactgctactttataaaagcatatactgctattaacttaaaaattagtatataatgctacaaagttaaaagcagtacataccactactactattgtaaaaatatgacatataatgctactggtagaattcagtatatactactactactactaagttaaaaattaaacagtatgtaccactactactctataaaatagtatatactgctagtaactaaataaacagtatatactgcatgctactaacatttaaaaaaaagtatatactgctactaagttaaaaatagtatatatatacctactacattacaaaatagtatatactactattaacttaagaaaaggtatatactgtactaactcttcaaaggagaagaattcagtacatactctttcggagaagtaatcagcataactgattaagaaaaaagtatatgctgctctaattaagtaaaacgagtacaatttatgctgctactacttaaaaaaaaggtatatacttaaaatatttataaccctttttttaatcagtttgaatggtagaagatccatctgtttagaggatggtacgttcattattcaaatttaaactaacagcacactccctacgttcaattgtgcaccaaatgcggtctgtacctgtgcatgcatgcaccatgcagcgattagagaaaaacaatattttcattctcttcccaccagtttaattagatgctaatggttatccactaaggggagagagtatgtactcccgggagtacataacaatgatcctataaattaaaatggttctatactaccgtccatagaaggcagccccgatgaagagcgctattggattcacatgtggacccgttttgatttctattcgagaaaaaaaaaatccgtagtacgacataactatcccacattaatcggtataccggagtgttcctgacgcataaatacctctctctcaaaccatcctattggtaaatcgggtcctcggtgagagcacgatctaccggcggtgatccggacggatcaatggcaccggccgattttacggcgacatcggtgtccatccgatactaggttttccttttttttttaatttcacgatcttgtttgatttgatttcagatgcatcaagcaagagagagagatgggttgttacatacctttgtagaagagctgcagggagcaagatgagggagccaactgcctggcgatagaagacgaagatgtagatgttcatcccgtggttgaaagcagccttggatatcacaaacatgccagtgtagatcagttggacgacgatggcgacaaaataaggcttcatacttgctttcaccatcttgatcgatctagcaatggcaggcgtgcgtggtgtttgtgcgagtgcgttgtcttcagtgtgcagagtgtgtgttgtctacagtgtacgagagcgcccgtttagtttctctccatcaacctggcactatttctatatatttatataaaaaagaagcagtcagtatgccaagtgtaaacgcaagagcacggaggtactgtagctttgattttgg

SEQ ID NO: 48023 - DNA, 4637 bp, Oryza sativa
attcctgcaccccataattaagaaaatattcttttttagattttgcttactaacagattgaaaagaaatctatatatgagataaactttcaagtaaaatttaaaactttctatcgaaaaattaagggatttgctagatgtctattagattaatgggtaggccaaattaaatcccaataataccatattggaaatttagtgctatgggtaataataccatattgaaaatttaagtgaagagatcttaatttaaatatggagctagtggagaatctctgttcaccggttgagatggtggatggacagccacactcgtgcacagagctgtgtattaactcgggttaatcgcacggattgaattctccgaatgtaactctcacatgtgctacaaatcctctgcgattaatcgcgtggatgctctccctctcttgttctgtatcggaagatgattaattctggtgtattaactcgggttaatcgcgcggattgaattctccgaacataactctcgcatgcgctacaaatcttccgcgattaatcgcattaacccgggttaatcgtgcagattgaattctccgaatgtaactctcgcatgcgctacaaatcctccgctaacggggttaatcgcgcgaattgaattctccgaacgtaattctcgcatgaggtacaaatcctccatgattaatcgcattatattctagtgtattaacttgggttaatcgtgtggattgaattctccgaacgtaactctcgcatgcgctacaaatcctccgcgattaatcgcattaactcgggttaatcgtgcggattgaattctccgaaagtaactctcgcatgctctacaaatcctccgctaacggggttaattgcgcggattgaattctccaaacgtaactctcgcatgcgctacaaatcctccgcgattaatcgcattaactcgggttaatcgtgcggattgaattctccgaatttaactctcgcatgcgctacaaatcctttgctaacgggatgaacagacacaacgctcgcacttatgttcttcctctctcgcactttctttccggctgttctcctatttcggaactccgtctgcttacgtacttgcacgggtaggcaggcaatcaagtctttggggagcgtctcggtgcaactgctcatgttctgcttcgacttcttcctctacatcgcgatggcttccactggaaatggcgcaccaggagctggagggaacggcgatgctccaggagacaacactaacggaggcaatacaaatgactcaacctccttgcaccgttttctgggtatatggttctatctctaattgatgttcttcatgttacttatatattaatcatgctatccttaggattgcaatcctaggtgaatgttgatgatgcttatgcttatgttatgaaaaacatgcccatatttctatttagtcacaccactagattattactattgtgaatgttatgtttattattgtgttattttagattaaaatataccgaattatgatcaaatttacaaaatgccagcctgagggatcgacatctcagcgagcgagattggtgaattgaaaagtggggacgaagctgatcatggacgtcggcggcaggtagaggcgccgctgctggagaagaagggcagcaccggcatcggcgatgggtactgcactgagaggtgcccgggtgcggcgtcgatcggcgtaaggccgcgagctccggcatcccctacaggagcttcctctttgtctggatcatcacgctctgcacaggtaaccaccacttcattcttctctcttccactcacccacatgcatcatcaatcgcgcgcatctgcacctgattcgcttccccctcctcttaattgatgtccacatttttatcgagttatatcatgagtttgtgtttaatttctcctatatatgttctccattgatcatgccaccttggagtgctatatagaagtatatacatactgatgcagccccttcaattaatcaaaatctttaaattaacaattactactaattttatgaattgctttgagattcgtgcacctcaaccaactattgaatttgggcatgacactaagggcttttttggagagattctgaatagcttctctcataatcagaagctctccaaacaatttagcttttcattgatattctaataagttgtagttgtataatcttaggcaataaaatagaagtcagaagctagaaaatctaacttttttatattctaaaaagactcttcaaatttaatctctggccagatctaggagcggagggagagaaggggagccgccgccgtcgccccgtccatgcggccgccgtcgcaccccctcctctggccagatctaggagtggggaaggagaggggggagccgccaccgcgtccgcgccgccgccgtcgctcccctcctccggttggattgggagggagggaggggaggggaggagagtgacgggccggtgagagagagagagagagagagttgagagggaaatgagtggtggccggtggggaggggtggaggagaagataaggaagacttaaagatatttttttgggtaggtatgatttttgcaggcggaccacataaggttccacctgcgaaaatcaatttttccaagcggaccacttaagaggtccgcctgcgaaaataaagttatttttcgcaggcagacctccacctggaggattttcgcaggcggatgacgaaaatccaccccgttttatattttcgtaggcggatcatatttggttccgagggtcatacccgctttgaaaaataaaaggccaatttcactaaaaatccttttttaagtagtggtggctattgattaattgtagcttaatcaaatacgtgaaatttctatatgttacactaaaccatgattgcaaaagatggctaaagaaatgttagtatacatgagaacattcttcaattgatcagcatacaaagtgatctactgctaactgacgaaaacgagacaacatctaattaagccactaattaaacattattacttttgaccaaggtaaaataatgagtatagtactggtttcgtttacacaaagatcgagggttgcactctacgcgtacctgtttgttaagtagttaatcatgagtgatggagaagccgggagttaatcatatttgccacacaaaatcaatatgcaattattgaattcgtacggacaagctgacgatgtagactgataaataaaatcctgtatgcatgcatgcatgcgccattttgtactccagtaatcttttgtttggcatgcatgtcagcatgtgtgcgtggttcaggcaatgtgatatatagtgaattgattggcaatgtgagagtgagttgattgaagtagcaacaacctgtcgggcctagcggccggccagcctgactgactgacgtaggagctgacgatgccattgcacattgttggtgctactgatgctcaattagattagatatcctcattaataataagctattagtagtgttttactgtttgatgataacttatttctagccgtactgggctaaaatgtatagtaatactgaaattaaggaactgctggattcaagcagcagctggttgactttggttaccagcacacaattaacctaaaatttaattaactgttggttctggccgattaattagttatcttacggttgcagcagcaatggtgttaccattaatttttttaatttctacgtaatctatcggtgggatgtacgatggattaataaacttcaactaccttttaaaaaaaaaacttcaactaaataattgttattactgtcatgtactctgacttatttttcgaggggacaggcagggagttcctacaatttaatccagtttataaggaaaaccggaccaaaaaattttacaacagcacggttaatttatgaaaaactggcgaaaaccccggcattgacatactgaacctaaaaactaagaacagcagtccgacaagggataaaactcctaaaatgaatccttcaagaaggatacgccgacagaacaacgacatcgtccgatcctaacgaatctaaggttttcatccggagaaatctcttgaagtggggtttgaaccagggctccaatagcaacgccttcaagaaggtaaacggcacccaagggtgtcgccgttgctagcatcggcaagttgagcaaggctttcgcctcggagtcccatccaaacatagcatccgcgacggaagccaccaaataccacctgcacaccgggtactgtttaagaagattgacagcaactgcagcaggtggcaattccaacttggattggtgcagctatacatgatgtaacatgggaaagtttattcgtcgctcgaggaaacactcctttaattttttatactatttgaaaaatcataaaaatattaataaaaagtatatcaataatacaatatattgataaataaaatacaagctcaaatttaactagaaatgaaaataataaattaactcagaataaaacatgtcattcatagttaaatttattttttaagttatatatattaaattgaatttacatatttgtcgagtgacacccccacatatttaatttattttattatcttttttattaaat

SEQ ID NO: 48024 - DNA, 7171 bp, Oryza sativa
attcctgcagcccctatggtagttcaaaaccgatgaagatgatgctaaacgagaaaacccgttagtgcatgattaattgaattttaattattacaaacttaaaaataatctttttatattttggagtaacttctatatagcaaaaactatatgcattcttaataatcacaaaagaaaaacgaattttctaaaaaaaaaactttcgtaagttttttgcccccaaaacttttagatttgtgatcatcggatcatctcgagatctttgcatgaaggaaaaaaaatgttagaaattttcacacatgtcacgcgtaccatcctaatactaaccaatctatagttgaatgcaagatctatataagttatagcatagttatagtgcaattataatgtagttatagtacaggtacatgtaattacaatggacacaactacaccgagagtgctagctggatagtgctaaagagagacaccattctttccaaaaaaaagctactagtacactcaatatctatggttttttttcttcttagagaagtttctcttaaattactcatccgatttataatccgattacaccgttgtgttcgtaacaattaaatctttacaacaagatctcacatgattatattttgataaaaaatcacatattacttttatgatatgtctaaattacttctagatttcactaagtcacttcttagacatataaaagtaaatttagtaaagcttaaaagtagtttacatatattatagaagtaacttataacaaaaagaaagtaactttaatttagaactatatctagattcattaacatctatataaatgtgggcaatactaaaatgacttacattatgaaacagggggagtaactctctgtagtagaaataattatattgtgagtgagcttaaataagaaactatgtagagtgaattcgcaagtacagtgtagagaagatttataaagtccacaaaatatagaattaactaaaaataataataataataatcaacttagagaattatgaatgtacagaagtaatttagtcaaatatgaaagtaacttatatatattataaaagtaacttagtatataataaaagtaatttataaatataaatattttttcatcgtaatataatcatgtaagatcttgttgtgaagatttaattgtaacaaacacaatagtgtaattggattgtaaatcggataagtaatttgagagaaaactttataagaaggaagaaaaagacacacatgtctaagaggaaaaacagcgcgcacatcagcacgtgtagcagtaattcttctcacaattggatcgtcgttggttaacactaaaccgagaggcttctcggtttagattttaccaattacaatgcagttacacttcaattatactataattatatctaaaagttttttattaaaaaaatttgcggtaatttttttagatacaatcgctcgtattaggccatgcctctggtattcctttgcatttcgatcgtgtagcccaatacgacggcccaaacccaaactccaatcccagcgggcccagcaagtcagcctcacatcttcttcttcatctccctgtctctgtctctgtctctaacctaaacccacacctcgcgcgccgccgccttgctctcctcctccccgaccccgagtcctcttcgtgtgagctcgcactcgcagtcgcagcaatggcgatcaagcggaccaaggcggagaagaaggtggcgtacgacaagaagctgtgccagcttctggacgagtacaccaaggtgctcatcgccgtcgccgacaacgtgggatccaaccagctgcaggagatccgcaaggggctcaggggcgactccatcgtcctcatggggaagaacaccctcatccgccgctgcatcaaggtgcacgccgacaacaccggcaacaaggacttcctcgagctcatgcccctcctcgtcgtaagttcaccttcttcttccatgttcatacctaacctcgagtccactgtttttcctgacctgtttttcttgttgtttgtagggtaacgttggtctcatcttcaccaagggtgacctcaaggaggtccgcgaggaggtcgccaagtacaaggtataatcgatagccaagtacaaggctatcgatctctgttcaatacatacactgcaagaacataacagaacagtgttcaataaactgcaagaatagaaaacataacagaatagtgttcaataaactgcattgggttgaaggggcataatttgttctgtaagtgaaattggtggatttagtgtgctatcttaaggtgatcatgctgagttatgaaaataataataggatatgctgggttactttgaatttagctctatgttgtgccattttatccatatgcgttgtatatattctctgtgtgtggtattattagatgttctgtgagatgtgaaagtacaattttcaaccttatgtaacttttccaatgctatttatatctcaagtattccattgtttatatcatgatgtgatgccatatataatgatacatatagatatagggtttgatattagctagtattggctattgggtcatgatgttaaaagttgacttgttatggtgtgagtagctcaagtctctagctggtttatgtttttcttttcactgcaatctttttctactacaatgtagtttgtactgactgatctctgtaagaattctaactaggtcattatgtcgtgaacttgtgatgctatccaatgagtgaataaccatgatcttgtttttgttataaaacaggttggagctcctgctcgtgttggtctggttgctcctgttgatgtggttgttccccctggaaacactggtctcgatccctcccagacttctttcttccaggtgatcatttgtcgatgtgttaacatattgtttatcctcagagtcaaatacaagttctcactgttctatcttgttacaggtgcttaacatccccaccaagattaacaagggtactgtggaaattatcacccctgtagagctcattaagaagggtgacaaggttggctcctctgagtctgccctgcttgccaagcttggtatccgccccttctcatatgggctggtgatcaccaatgtgtacgacagtgggtcagtcttcagccctgaggtgctcgacctcactgaagaggacctgatggagaagtttgcatctggtgtttcgatggttgcctcagtgtccctggcaatctcatacccaactatcgcagctgcgccacacatgttcctcaatgggtacaagaatgtgctcgctgttgctgtggagaccgaatactcatacccacatgctgacaagatcaaggagtatttgaaggtaacctagtttctatttcataatttccctttttgatgtctaaatgcgtaagaattgtctgaggtagtctgataattagattgcggtactaagctgtagcatgcccatgtcttggcacaaacttatttgttctggtcttaacaatcaatcaatcaatcattgagaatttcatggtttagtaagaaactgaattatctatgatagctatttcacttagtttgatatgcctttagtgcttttagcactttcttgagactgcagtttacttttcttattcacgatgaagactcagttaaatattgattactactggaagctaagttaatgctgatttttgagaacttgggcatttcaccaccacagtttcttacatatttgtcttgcctattcttctcaggaccccagcaagtttgctgttgctgcccctgttgctgctgctgacagtggcgctgctgctgtagcttcttccaaggaggaagagaagaaggaagagcccgaggaagaatctgacggtgacctgggcatgagcctcttcgactaaagcctctgatgccatatctttgccaagtcgaaagttttgtttcagttctaaacatcaaagtctgtctataatctttagcatttcaagcttctggtagtcaagaactatctaggccttagcgtgtatccaacaatgttatctttattatgcaattcaattcagttgtgcccgtattcctctggtgtcatggtgtgtttgtgcgatgatcatctttctgttcatcctcttgtgcaattgttgctacagacgatttgaattggaatcaggttgatgctcagctcaagaactattttgatttagggaactaccagactggacttttcaccttttggtcctttgtaaaaacattatacaaatagatccttaaaaaaacttattctaagaatgaatcatttttgcggtgccaatgtcatctgcatcgtagtccaactgtccaacatgacccgttgaaaagtcactaatgtggagggagacggtaccaatatcgtttgtgccaagaacctatttgttaaaaaaataaaaaaggatccatttgtaataaaaatttacaaataagttctcggtgtcaatgacacttgtgccaaggatctatttataaatatttttttattacaaataggtccttttttattacaaatagatcttttaaaaattacaaatatattctatttgtagaatgatttttctaaaaagatcgaaaggtgaaaaatccatactaccagacgaccaaagggcgtagtgataagccatacatctctgatcattcagtcccttgcaaaaattgtcatttaagtttcgttaatgcaggttctcgtgggcacaaaaacgctagcatatgctttcttcattctaggtgaagtttgttgtctttctgaaaaaaattgcacaaattttcccagtaagatgcagacacatgcatcaagctgcagggttcaatcctgagcatcgatttttagattggacggctggtaaagcagcatgtgcttgctgcagaacccaatatataaagggaggcagccatcggttcaggttcagtaactgtgctcgagtgggcagttttgcagcagcagagcagatcgatcaaccaaggataaataccatacgactgatacgagctagcagctgaaaataaactaagatcgacgggaccggagccagaggagatcgatgggcagcggcagcgaggaggcggcgccgctgctgctgccggtggcggcggcgacggcgacggcggaggagaggtgcccggggtgcgtgcaggagcggaggaaggcgagccgcggagggcggatcccctacacggagctcttcttcgtcgccgttaccactcttgcctcatgtaatccgttcatttcagctactgcattttttttatatatatactccctccgtttcacaatgtaagttattctagcattttctacatttatattgatgctaatgaatatagacatataaatctataatcaatataaatgtgggaaatattagaaagacttaaattatgaaaaggaggaagtataagcaaatgattttaccagctgcattatccttgcacttcttattagtagttcttacatcttcatccgtctcttaaatctctcctcttttctactgcatgcgcaacactgcaatgcaccaaccatatggtagctatatattgattacagttatcatcgttgttaatgtttctgttcatgcatgttcatcaacgtgaacacatgcatacattgatacatagcactctttccagttataaacacttaaatttaagataagacgtgatcaacttttaaaattttgatcagatcatcaatagtttctcaaatgcttaatttaaaagaaaaaaaatagtgtgtgtaaatttatctggaaaggtactattataaaatcataaatctatcaaaaatttaaaacttattctaacataaatctaatggttaaaaatcaaaaaattaaccaagtcttatcttaaacatccaatatttatggcatcatttgatcatccttagccactagagagatgaagggggcatcgatcatgatgaataaacggtactacaagacggacaaaaggcaggttgcaagttgcaaacttggatctcctactcctaaataaaaggaaataaaaagtaaactaggatgcccttctggtacttgacaaaaagaaaagcataactagcacccaccaatacaaccccaacttgctctcttcttgacaaatcttgatctacatgccaaataaatatatactagtaatatattgccatattgatgcatcctaggctaactatagtatataagaccacatatttacctgttttgagatatgccaaaaacaagtatatatataatgacatggacccaatatatatatatatatatatatatatatatatatatatatatatatatatatatatatatatatatatatatatataagaggagagagaggagaacaaaggagaggatggaggaagaagacgagagaaattttgtccgaaaaatttagaatttgcattgaaagggtatgtagtggtacatcttaaacacatgttaaattatagtggcgtggttccaatttcacaaacagtaatgatatatcacaaaacaggtaaatatataatggcatgatccaattaaccctatatatataggagtacttgtggagccgcttgaattgaagctcaaacatgcatgtaaaatttgttcaggatagcaagtagtatctgtctatctgagatctgttccagcactatgcacctatgcaattatgtactatcagtatacatatcatattaatattggagatcaatagcgtaactaaccacaaacagcagcaggagcaagcacatgctttcttgtcgtgaataacaggattcttgtgtttgttcccttcatgctgcaagctgcacatctcgtttctgatttattgcttcctctgtcctttaaatattgcagctttaccaatcacgtgcctcttccccttcctctacttcatggtaagtatgtattcacttctccatctaattatttcatcatgcgtcttgagctacagtatcacctgcgtcgcacaaagacgtttacctaacttgaaggacactgctttgcatcattcctaattaatctctgaaccctggatcatttcgaatgcatgtcccagttcacacatttctccctaaccattataccttaccacttggttgcaacttggatctcatgagatattccaactgtagccttcaccgttttgctttgtatagctgg

SEQ ID NO: 48025 - DNA, 6954 bp, Oryza sativa
ccagctacaacacatttctatcagtcattttagggtagtacttagatttccatgtgtgtactgtagggtcatatttaacacattatttgggctaagtacaaagtattggatggcacttactacaaggtttgttctaggtgctctaaatggtttacttgcgccaataaaggtaactaaaagtctttcaagtgacaatttcagcatgaagttgtatgaaattattcatgtgcctaggagggagctttcctaacatagtatttatcaagcattacaggcttattctattgaagtttgccaaactgaacatcaagctcttggactctccattgtaatgccaagcaattctcttgtttgcccccattgtgttccacaatcctttcaatatgcactgctataaagctgttatgatttactttgatcataggttaacacagcatggggtttgggtctcgttgttggtccagctcttggaggctaccttgcacaggtactaatttcaaaatggaaaaagaagaaaagaagctaatattcggtttcttacatcgttctgcttccttctcagcctgttgaaaaatatccacatgtattttctaaggagtcagtttttgggaggtatgtcatacactgatacaagagcaagatataagcccagattgcttgcagtcagtgttgtaactactaaatacccatatctaatttcattacattttgcagattcccgtatctcttaccttgccttggtgtatcattgtttgctgctattgttctgataagttgtatttggcttccggtacgtaaagtttcacttagatgccatttccccaataattcttaagcgaattctagcactaaatgctcgttacttagcccttttctatggtctagttaatttcacaaaacaaaaaaaatattggattaatttttttagaactgtttttctagtgttactattaatgtggttttgtttgaaaaatgtatctggcaggagactatacataaacataaatctcctgataaggacatcaaaagaatcaaagaattgccattacagcaggcttattgggattcacctcgtaagaagagcttgttccagaatcggccatggatgtctactatgatttcatattgtttttttggtcttcatgacacagcatacagtgaggtaaagaaccatgttttctacgcctttgcttgttaccagtcagaaggtcacgttaatctatctagatgccactcagtttatttctcatgcttcaaaaattattatctacatacttgctaaactattcacacacagctttgatattcacataacttaaggggttctaaaaagattaataccattagcatatttatgctagatattatccttgtgggctgtgagtgatagaaaatatggtggccttagcttttcatctgaggatattggtcaggttcttgctgttgcaggtatattgccatctttcccccaacatacataatttatatatatattctgaactattcatcagactttaaagattcatgttctcacatagctgcataaatttgttgttaaataattgtacttcatgtctcttcgtttcaggtgctagtcttctagcatatcagcttattatttaccactgggttcataagtttcttggaccaatcatttcattacgaattgcttctgtgagtagtctcctatcacgacttcaaaagaaatataaataatcatttcatggtcatcactcatatttaactgaaattgcaggctctatctatacttattctttctacttatccttttatgacatacctatctggcgcggaactttccttagctttttattcagcggcaatgatgaaaagtgctcttgcagtaagcaatttcaaagctcttccttcaaattttaagtatctacacgtgtatccaaccacaccatttgttagctaataggtacagcagtaatatttcaaaagtaataatgtacaaaaaagaagatgtgttgcactgcagaatgcagattatgaaaatctaactcagtctacaatatgacaaattcaactgtaactacttggggaagacaagcctgggttatttcatagagtactattttcagggatttaagagtaacaactaaaataggggctttattatacttccattaatatccaagtctttatctctaatgtttgttttgtacaacgtgtgcagattactataagcacaggaatttgccttttacagaacaatgctgtggtatgcataaaaatcaagtgaatgcatgtgttctgatactgtgttcacgtaaataagctaaattatttattgactttgaaattcaatatcagcttcaagaacatagaggcactgcaaatggtgtatcaacaacagctatgtcatttttcaaggcgattgctccagtaggggcaggtgttctgtgagtaccacctcttaacacttttctcataaatacaattaatgatcgagacataatgtttcttaaatgattgagataaatgatttagattttagtgatcaatactcaattttcaattcagattctcgtgggcgcaaaaacgtcaggatgccctcttctttccaggtgagctatttatctgaactgcactgcgctatacgcctatatcttgcctcgtcttttaattagccaggttggccgaaagaacaccccttccctcccttgtctttcaatttgtttggcctagtaaactaccatatctttcagtcgaccatacattacatacccttgtcctatcttatttcgttaacaaggggtttgcctggactaattgtactaaaagaacatgtaatcaggaaaaagaaaaaggaaaggctgatccagtttggctttcttgaaacctgtaggtgatcaagtggtgttcttgatgctgaactttgtggagctcattggactcatatttacttttgagccttttatggtgttacctgaggcatcagatgagtgtagttagccaagtgcagaggaattgtttcttatcaataataaatttgaaacagtaataatacttaacacttgctaatgggctgagtaatgaggcatagcttaaatatgtggcatgcttgtctgctcacagaaatggaagtccttgaatgatgaatctggctgcagtcagcatgacatgtccaattttgtcatcatggtgtattagttgcatcttgtcacaatgattactttttaaacagaacaacattttaaggtagttcatgttctcagatgtcaacatttcccctttttgaggtcactactcctacttgactaggctgacagcttagtagttgacagttaagtttagcctgaaggaactgaagacaagaagaaatcaggcgggtaatgatgagactgattgattagacaatgggaggttaactcatcataatgcttacgcacctctgtcaaaactcaaaagccagtcatcatcatcttcggattgcatcgccgctgccggggccatgacggtgttctgttcagcttcagcagcctggacccaggagccagcagcaaagcagctagctgccttggcgtcggagctcaccttcaaggaggagatacggcgggactaaccgcgcgtagacgtagcgcgcttgcttctcgccggaaacctcccgtccttccccccccccccccctctccggctgcagcggccagcggcgatgattgggttgggggcagctctcgcagtgatctaggagcctttctcttcccgcggagaagaggagcatggttgggcggggctcccacggcgatgccggcggcgggcgccgccggaggcgagagcgaaacgcgatgagccactcaaaacaggggctaaaatgcaaaaaatcaggatcgctactgttgatagctagcgatcctaaataaataaggggtaaattgaaaataacccctatcgcgatccaaagcaggggttcttttgcaaaaacatccgagactcactggattgggccgcatcgcgttgcttgttttgtgggcctagctcccgattcggcccacgctaaccttgggccgcagagaaagtttattaccagttcaggctttccttcccgccaccgcggggatgcgccggcgatgaaccgccgtgaacggcggcgagggagaggcgcgcggtcccatgccctcttgacgaactcgtccatgtcaggcggcacgccggcgcgtggcctgacctcctcgggcgtcagaatctgacatgaaatcctcgccgggagggagagggacgggacgcacgccgctgctcgtggctcgccgccggcgttgccaagctagtctgcagcatgcaatgcacgactctgcccagtgcacgcgtggctgatgcaagcctcaaatgcgctgcgttttcagcatcctgattaatataatcagagattcagggaggggggcttgttccagtttggtgttctagaaacctgcaggtgatgttcttgattgcttaatttggtgaagctcgttggactcatattgcccaattatttgtcatcgtggtgtactaattgcatctcgagacaatgatcaacatactgacaaaacagaaatctaaggtagtactactgtcatcagatatctgtactgtttttttctggattatgacttgatgaatgactaggctgacaggttagttgtccggactgaagcctgaaggaaccgaaggaaagctaaaccaattttcgggccaaaataaaaaagctaggcggctgggctgacgatgagaatgttgagcttgattggtcttcaggcttgtgcacctctgtaaaaggccagtcaccatcttcagattgctttgcattattgcatattcgtgtaaggtcaccatcttctgattgcatggttcgcataatcgcatggccctcaaaatcgataggaactttaagtttctctccttgatgtaaaggtgagaactggtgagtggtgaccagtgatcatgcacacactgtcgcagtcgcgtactatgtattcctcattcctgaatatggcccaaattagaagagaatgattggtttatgcagactgcaactactgcactctggctaacttaagagcaagtttaatagtggagctgactgtttgctccaaaagaatccacgtcaccaaaaaaaaaagtaagtgaagagtagatttgttattggtactcctgctatctttgcacaactatcaaaattatattttaattgaatgggcaacttttacactagcaggacggggtgtttagatcccacccaatcaaaatttacaccatatcacatcgaacgtttgaacatctgcataaagtattaaatataggctaaaaagaactaattacacatattgcgactaatttgcgagacgaatcttttaagcctaattgctccatgatttgacaatgtggtgctacaataaacatttgttaataagtgattaattaggtttaataaattcgtctcgtggtttaccgacggattatataattagtttttttattagtgcctgaacacccatgcgacaccccatataatacccgatgtgacacaccaaaaatttacaacccttaatctaaacacccccgaaggcttgctggtcactcataggctgagcattagtggaccccacagtatgcatgggagcatgtgttagagcaagtataataggaggctgtaagacgactaaatactgaggtggaggagaaaagagaggagagagaggagaagcaggctgtaaacttacagccgacttggcacaagaaccaagaaactctgtgagagagacaagtggaccctgtattaattgtaaagagctaactataatatgggtgggctgagagaaggctgcaaagaaccttacagccaataagtcagctgtattattacccttgctcttagagctagcgataaaataagtgcccatatttctctctcttccatctcaacacaaatataacttgtttattgctacagcctgtttacataggattattgtacctactctaacaagtaatcatttgtactacaccgtgaaacagtgagcaaactgatttttctgtctcctagctagactaacactggaagctagatagtactgacaaagaaggaaggaaagaaagaaaaggagaactctcctagctagctttctacctggtgagtgtttaaagtctccttgatattctatactggaaacattacatatggcagcattgtagactaacaaagtgtaaagtacaccaccgatccttgggacgtggtgtcactcagtggcagagctaccacccggcgacaatgggcagccgcccgggctcatcggcattaaatccattaaaatttcatgtaattagaaaatttgaaatagaatatatgtagtaaatactagctataatgaagtttactcgggctctaaaatattttctagatccgctactggtgtcacttagatccacgatattgtcaatctgacatgtgggtccatgatcctatttcaatgaaccatcatggtctaaaagcccatctgactaggttgaccaccgacatggctgtctagtgtggtcgcaactttgcagtttgctctctccccacccggtcaacccacttctcccccaaatatctttgttatgtattgttttgattcagggaacgttgtatcgtagcggcagcgacatagtgatagggctagcgcagtgacgaggagggatgtgggtagggtggtgtcagcacaggaggaggcaggggggcttcatgaagtgcgtcaataggggaggccatggctactcgaagcaatgcgtcatcttcaagtgctcagagtaagaagcatgatctcctgctgattctgtgcccttgctgccgcaagaagaacatcgtagaacttactgcagcgacacatgctaattacggtcgcgtctccagccaccatagagtactgacgatcgcgagtgccgccctcagagtcatcgcagggctgcaggaat

SEQ ID NO: 48026 - DNA, 769 bp, Oryza sativa
tttctatccactattgaaatacttaactagctagcatactgcaaccgggctttacaggcttatgccgttgaagtttgttgaccagagcatcaatccattgggttgtcattggtatactacaaagttctataatattttttactatagttatattgcactttagattatgacactctttttatatgattaggttagcacatcatgggcaataggtctcattgttgggccagctatcagtggatatcttgcacaggtatcctactaaattttaataccatatgagttgggtgcatgcttaaacaatgcattgacgctattatgatgcttttgtttcatttgacagccatcagaaaaatatccaattctatttttagcaaactcattatttggaaggtatcgttgttataggaaatataattgttctagatggtataactccttaaatgactgattcttgaaaatctttccttaggttcccatattttctaccttgtttatgtatatcgatcttctgcttcgttattcttataagttgcatttggctcccggtaagtgcacaactagccaattttattcttattgatattaatttgggcacacataattcttgtttttatgcttcccttagctaaaatttatcttacctactaaaatacaaaagttaattaatattttgctaatactttcaggaaaataatgtgttttcatttcaaaataatgtgtttcataaaatttcaggaaacactacataaatattcaatagaaagaa

SEQ ID NO: 48027 - DNA, 2382 bp, Oryza sativa
cccctcctgaaagctaggatattttacttgtaccaaaaaccaagactggttagaaaatctttagccaggatccaaacacaccctgaatgtcacaggttgcaaaaagggggggaatgttccatacataccggcggtgaggcagatcatccagagatagaggaattccttgtaaggcaatcccctgtagacctccttcttgcgatcgtaggcacagccggggcaaccttggtggtagtcccccttgagcaacggcacctcctcttccatcccctcctctcccgcccggcaagggcaatgcgacccccccagaacaaacagggaggctcaccctcaccctcggctatcaatcggcaaaagaggagaagctcggcggcgagggagggagggcctgagattgagaggagaggaggaggcaaacaaggagagggccaatggccaacccaacaaggaaagccagcaacaagaagaggtggaagaggaagccaaaacgaagccgtggtcgtcgctaaaattccacggcgcgcattgccacacacaagaatatgtttagctccatggaggtgggtggaagtggaagtcatttattaatactagtattaggattactagcacatcagcacaagagaacaacagatttgcaactcatttattatgttccatcagcacatcagcatgagaagaaaacaaaagatttgcaacctcacactggcttgatgtggaatttgtgcatttttcatattccgaacttcatactcgttctgaaactttctaaatattcaaatttaatattttttttggacttggcatttttcgtgtttcaatttgtactacttatgcctatatatgtacactatactcaaatctgtgtatgttcctattgtatgttcgaattttgaacatattttttagacttgaatttttttccttcaactttttcacgaacacattcagatccttacgtctcccagacatgtacaaacagtaccgtcacaatcatcttcaaatattttctgtggatttcaagactcagaatattcagagatcgagcaatagtaaatatttgatgaaagcgaacttaacacatgcatgtacatatgggttcgtatattgtaccatctccatattttaatgtataacactgttgactttttatcgaacgtttgatcattcgtcttatttaaaaaaatacgtaattattatttattttattgtgacttgattcatcaacaattattctttaagcatgacataaatattttcatattttcaaacaaaatttgaataaaacgagtgatcaaacgttggttaaaaagtcaatgacgtcatacattaaaatacggagggagtacgtgatacacgccaaagttcacatgagccaccaacagttggacaaagcgacaaaaactctatccgacttgggtggttggagctccacgtcacatatagctccatgcatatttggaattagcatgcaatgctataaactcacattataccacgaaaagtgaaaataattatttaagggcacaaaccaataattagatgttaaaaagtgataaaacagattatagaaagtatatcatggaatttctatataggagacttttgtaaaagtcatggtgtttaaccgatcgaaaagtgcacctttatcatagaacatgattgaaattatgggcgaacaggctttagggtgtgggcagtgagaaatcacatgttagtgggtttttcttaaagagatagtgcttatacacacatgtaaggacgtacgaaaagagtgcaaacgaaccggttcgctttttaagtagtagagatatcatcttacgtagacttcacttaaaacttgatggtctacttaaaaattttaactccactggatatgcttttgttctcaattcgatcatgagccggttatataaactagtatacaattcccttaatatagcaagtttattaaacaactcattttattgttgcacacatgcagccaacggcggaggcacttcccgaacgggttgggcggccgcgtgaactccaccgctactgtctctattaccgttagctacttatacgagtataatacaaattgaaatatcgtatgagccgctatcttgtttttctttcaaaatatgggagacattatgaaaaaccatacggccaggttaataaagtaaaaaacaaatttacagaaggtaacgtggatgaagtgaagtctgagtaagcgctaatcatgcatggagcaatggttggcttgtgctaatcaagaaacgagaatataggtagtacaaaagcaatgaatgaaccattaagctcacgaatttaatctcagcaggtcaggtcatgtgcgagtgtgcgaccgtctgctacacatgcacacgcaccctg

SEQ ID NO: 48028 - DNA, 1068 bp, Oryza sativa
ttcaaatatttgatttgatagaaaagttaaagtatgagaggtaactaaacacacagccttggtagttatttcttagagctaaaaaattggttttctagctttctacttctattttattttgttaattcaacaactataacttattagagtacgaacgaaaagttaaatcgcttgaagagcttctgattatcataagaagctacagctattcagaaacccctcgaataagccattgctaaaattgaacggttgtatgaggtgcacaaatcttaaaacaaatcataaaattagtaattattaatttgatgattttgattaattgaagggactgtatgtatatatatagctctccaatgtggctgcatgatcaatggagaatatatatatatatatatatatatatatataggagaaactaattaagcagactcatcatgataaaactcgctaaaatatggagatcaaatgagaaagagaggaacggaatcagctgcagctgcagatcgatgagagcgcgattgatgatgcatgtgggtgtgggtggaagagagaataaatgaagggaggctattacctgtgcagagcgtgacaatccagacaaagaggaagctcccgtaggggatgccgtagctcgcggccttccgccggtcgacgacgcacccggggcacccctcaatgcagtacccatcgtccacgccggtgccggtgctgcccttcttctccagcagcggcgccgccgcctgccgccggcgtccatgatcacccatcaattcaccgatctcgctcgccgagatgtcgatctctctgactcgatagaccttgcttctgtctgaatggctgtattgtattgaataactgatgggtagttgttgagatcgattaactattgcctgctgatcgatcgatcgatcgatcgatcgggaatcagcaataaataaagagagtgaatgggcacgtgaggctcgcagctagcagagggacttgcttgcagttgcagagcagaaaacgcatggaacagaaaagccggaggggagaagacaagtcgaaacaggctttccgttgtccaaa

SEQ ID NO: 48029 - DNA, 1643 bp, Oryza sativa
tctcttacatagatactaaatttataaacatttttaaataggaattaatactcatgttggatccgttttgggtgtagcatttaatactactatatgatatggctatcttgatgatatatttatcaacaatattaaattcggcagtatttgtttttcgtgaaagatagcatatcttgaagatatatgcgttgaatctcgttaaatatgcatctatatggtatcgatcttagaagatttgcatccacgtcatccatgatatggcctcaatgttttcacccattgttaagtgtaagtacctagagctatttcctaaatgcaatcctgacaaaataaattcaattcaaggtgtcaattgggagcggattaagacggcccattttgtttgggctggagaatctagctagcaccatgttactactcatgacggcccagtgggccactctttatccaagtattcggccttggcccagctaagctagcgcctattagggctcgcccccctgcccgtgcgcgccgccacttccaagttccaacctccgccctctcttctcttctcctctctccttctccccgagctgcccctcttctcttcctccgatgggtcgcaagatcaaagtcaagaagaagaaggcatcgagcaaggtgagcgattggtgctgactgtctcgcgatattttattttattttattttattttcatcatggtttaattcgagcctaactctgcctctactctttcttcaatctttatcggtgggtggattgaagaaagccgaagcttcatcgtctagggtgccttcttgcccagccaaggtgagagggcaaatacatgccaattattacaagcagatgcacacatatttttcttttcttttattttttttggtagttgcagtgagaggaaaaggttcgatgtgtgattagttttttttttctcctatagttttaatttcctaagctaaggcaaattgctcctgtcactgctcttcgaatgaaacactgacccgattggtatttcttttcaggtatggcaacctggtgtggatacactggaagaaggggaggagctccagttcgatcctcaggcttacaattatctcagagggtttaacattggctggccgtgcttgaggtaaaagttcaccatggcagccattgcgcgctccttatccgaggccaatatgcgcatcattgtatgggttatttatcctcatcgatttgttatctgttgcagtttcgatgttgtgcgggatcaacttggactcgtgcgatcggaattcccacatacattatatggcgttgctggaactcaggttgcattctctctataatgctttccttcaaaatttacatgatgaatatacatatattttcctattttgattaatgaattctgtcaacaacaaaattaggattccagttcgtttccatgtcaactgtgctctgtcatgattcatgggtgcatttgacttttttttttcctagtaacattccttttcaatcagtggttttgcctgctcctgaattgatggaatcaatcttttgtcaacatagtttgtgtaattatgagtggtgcctgtgttttcaggctgagagggcttcatggaattatataggcattttcaagatttgcaacataaatg

SEQ ID NO: 48030 - DNA, 1094 bp, Oryza sativa
atatttggtggccataaagatgaaggctatgcaattgattggagtccgcttgttactggaagacttgtttctggtgtgtgatcttgtccatgctatatttgtttgtcacgtcctatgctgttttgcttagaaaaccgtggcctgtcctgtgttaatagaacatccatatgctttcatttcgtacatgggcattgagtatatcaatttaatgatttgcctatgcaggtgattgcaataaatgcatccacctctgggagccaacttcaaacagttggaatgtcgatacaaatccatttgtaggacacactgcaagtgttgaagatttgcaggcatgccactgaaagcatatatacttcttggtgctctctagagcactgaacgtttgattatctcaaacatcttgactatatttttgcagtggagtcccacagaagccgacatatttgcctcttgttcagccgacagaacaatatctatctgggatatacggacagggaagaaaccttgtatttctgttagggctcacaatgctgacgtgaatgtcatctcatggaaccggtatgatatgttcacttgaaaattcgattatcttcataaaaaattcttctaatatttcatgaatatacggactaccattaccaggctcgctagctgtatgatagcttcaggatgcgatgatggaagtttctcaattcgtgatcttagattaatcaaggtacttcatattgttaagccacactgttctgtgcttgtcagttgcaaatagcacactgaaatggcatattccctccattgctgtttttatggtttattttcagtttggatttctgtctatgcatttaatattttggaaggaaaatgtggggtattgggtcttttgatagtaatattgatacaagatgattgaaccatttcatggatgaatgatattttgcattttcttgctactagatttgtcaagccagagacgctatggtagataatttgttgcttctgatgtctatatttaatatgcagactcctgtagaatacacgctcttgtgcaaaaatcagtgcagctacgatagttaaacgataatgttaattctttgtta

SEQ ID NO: 48031 - DNA, 5603 bp, Oryza sativa
  unsure (1)..(5603): unsure at all n locations
ctgccgcccctccaagttttataccttatgtttaaagtgtgctgaaatgccccaaaaagaatgctttctttactattttctgacttgcatttttcaatcctgaattgtttgtgtacagaatttgggatctttcattggaaaaagatgctgaagaggaggcagagttcagggcaaggatgagagaacaggctgatgcccctgaagatttacccccacaacttctctttgttcatcaggtactgttaccacacttgttttatgtttacttcctctcattttcatatcattgtgttcaccattccttgtgtaattaaaatacatgtttgtggacctcgagatgtatttcaaaagtacagacactgttactgagtgaaatcataaatgtgatgttgattgttttatgtgcagggccagaaagacttgaaagaattgcactggcatccacagatacctagtatgatcatatctacggcagctgatggattcaatatgttgatgcccagcaacatcgatacaaccattcgagaagctgacgcatagatttctacagtagttgtttatctgaatcaaggtttcatgggttttttttttttttgaagtggatgagtgtaatgatactgcatgtctacaagtatcagtttttgatagcttgtatcctagtttcgttgtcattcatagtggtaggttctcagttttgcactgatgtcgcccgaatgaggataatcaaaagtatctcgatcaactgaaatgacatgttatattctacaagataagattaataattgtgcatctctgtgtttgcattaggtaatattcacctcgatcgtttgtatatttttgcctgataattaagttggatattaggtccatcggccagaaatctgggtcttgcagcaaaataagttgcccaagcatcattcttgctgtaaaatcttgttcttagaaaaccaagtggcatgtacctggtggtgttaatgacaccaaaggtgccaatataagttgtttattttataagttcctttatcgattgctcgcagaatgtaatcatgttctcctattatagcttggatgcgatgcgccactttcggcacttgacaatcaactatctgatactcctattaatcagcaaagtttctgacactgtaatctgaatatttgttactgttatggcatcagaacgtgcaattcgctgactagaatcaggatggatatgttgtgtgtgaagctctggttggccatttgatatctttgacaaactttattcgtttccgaaaatttggcagccgcccatgttgcctttccgaagatgcttatgctgttggttcgttttgtgaaaaaaaatcagaatcagaatgtcatcattctccctgaaactagtagaaaagagcatagcagcagcagcagcagccatcgatcacgatcactgcactgcaagccttcaacctggagcaagtgagccatgccatattggcatacgatacgcgagcaagtgccctcctttttatagccaacagcaagagcaaggcagatattagatagaatgaaagttggggaatcaatcagcggcagcttaatcctctcgtcatctccatcaatccatcgtcattaatcagagaatttgcttcttgtgttactaataatctttgaggggaggcaattaatggaccacctgacaaaggagcagatcgccgagttccgggaggcattcaacctgttcgacaaagatggagacggtaatccaatcaatcaatcaatcaattgcatgtgttcttggacgatgatcaatcaatgaatccagaagaaaatgcaatgcagggacgatcacgagcaaggagcttgggacggtgatggggtcgctggggcagtcgcagacggaggcggagctgaagaagatggtggaggaggtggacgcggacggcagcggcagcatcgagttcgaggagttcctgggcctcctcgcccgcaagcttcgcgacaccggcgccgaggacgacatccgcgacgccttccgcgtcttcgacaaggaccagaacggcttcatcacccccgacgagctccgccacgtcatggccaacttcagcgaccccctctccgacgacgagctcgccgacatgctccacgaggccgactccgacggcgacggccagatcaactacaacgagttcctcaaggtcatgatggcaaagtcagtctctctcttcttccttcctcccatttcatttcttttctgctttcttgatttctttttctttttcttttctccatgtagattattactagcactggaattacaaatcttttctagattatcattatatttcttcttcctatttaatctgcaaatgttgcttctgctgaactgtacataatgtagtgcattcgtcatcagataatcatatttatctgaacaactttggtgctatcatatgcaggcgaaggcagaatatgatggagggacatggaagtggaggccatcggtcaagtaactcccacaagaaatccggctgctgcggcccgaattcctcatgtaccatcctctgaaaaagatgtaggtttcaggtttgcaactgttctgatgaggattgtatagttcagagttttttttttgtcacctcaatttctggttacacttgttctggggctatgcaaacaagaaaatcaaacaactacacagtgtaaatgaaaatgaataatgctggccaattaatatacttgttcctcacaagattctgatttacatacaaaacttgacacacaaaacccattgagtgatcagcttcacttgagctatcacaagggttctctgacaaataagagcagcatttacaacactagtggagaccaaacatagtttacagggccactcacatctaattacagatgcaatgaacatgctttctgcttttccagcctctagaaatgggaatgctgattcaaaagaatgggatgctaaaatagttcacccattcctcctctcccaagttactctaggaaagttgattttgaagatcatctgatttccaaacaacatcctttaaggttctggagaggttcttgtagaactgcaacacattacaagtttgaagtgattcagtacaagccattcaaccaaatgttgcaaaagaaaaaaaaaacatagtcataattctgtgagtagttgatccaatcatcaaagcactgactcaattttccaatgataattcatgagcatcaacttttaattggcatgatctaccttatgaaattcgagggtgtcgccttttgcttttcgtacttcaaccatatgaagagagggtgcaacctgcagtatctgaataatagtgcacaataaatgttagattgaagaagcttacacaaaccagattgcagtatagcagttcttcatattacctcagtagcaacattgagatttccttttctccctgcttttaccttttccaaccttaactggtcaatcaataaaaaaaaattcagcacgtagaaaatatatatttgaatttgctataaattgtccctagaacccattactttaaaacggatattcatgcagatagttgttaggcaaggggagcataccttgtaatttttcttctgaacatcaaatcctagaggttttgcggcttcctcaatcttgcggacaatttcttttggtggacattttgatgtgaaccttgtttctcttttgaattcctgaaatagtgtgaacaaaattaaagtacagcagaataagttgcaaaactataacaaagttatggcagaattatgaggtgcaaaaatcaaaagacattctgaccaatgaactactacatatattctgggacttgtgacatgcagcattctccaaccatatgattgagtaaattgacaaagtgccagtgagccagtttacatgtttccagcttgatttagggaggtataagttgaaccaaaaacaatgacgcttaactttaagttacaggttcgttcataaaaataatacagggagaataggttcaaaaggttgttggtcaatattgattaaatagggagatcacgtacctgctctgaatcaaacaaattcccaagattgaggcctgctgacattgaaatcagttcaaatgcattgagagcttctggttcttctttcttttctgtcacatggtgctcctggaggaggtcaaatcacagtggtcaaaccatttagcaactggcatgcttttatcttcatgtcatgtgaaacagaaattcaagtgcatattgcagtttactcacttcagagtcattgaagacagcataaacatcatccaatgttgtgtcatatttttcgtcaaactctgggcgtttgtagccctttttgaaccactcatcctctaatatttctggaattgttactctctacaacagtagctcaagtagttagcttaagaaatcatccaatgttgtgtcacgaagaaagatgatattattttattagttattactatctgttttaatgattattattaagcatagaagagctttctaaaaggagtgctagcccctgtagaattgagtattatctggttgatgaatgctacaggcattacaggatctactgtgttattagaagacacattacagtgccttcagtgatgcattatacctaattatctactatgttattcagttgttctagcataccgtcattgggtttggatcaaggattcttgttaacaacctcttggcaggaaaagacgtccaaggtggaaacgtaaactctgcatttgatatctgccaggaagtgcagagaagaatcaaataagcatgaaatattaatacaacaaaaatgatctaaaagtggtacaattctcactttcttatacaacgtcataagattagagtcctcaaaaggcaaataccctgctagcagaacgaacaggataactccacatgaccacaaatctgccattgctccatcatatccttgatcttcaaggacctatcacaaaggtggatgaaatgtgtgaattattaatggcttctgatgaaaaatagttccaagtatggtaggttaaaattctataatttctctttctgacattacctccggtgcaacataatttggtgtcccgcaggttgtgtgcagcaaaccatcatcctgaacaaggccacaaagaaaaaagaaatattaattgaagagacatataacgattatctaataatttctgaactgtaatatttgtagcctgttggtacatacttagatgatacagtataaagcaataaacctttaccttaatttgctgagaaagtgcactcagcccaaaatcagagaccttcagattcccatatgaatctagtagtaaattttctggctgcaagtattgtaatttagattgtttcttttggaaggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 48032 - DNA, 23232 bp, Oryza sativa
  unsure (1)..(23232): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngacccgagaatgaggacgtagagttgggaatcaaaaatcatgttgtagatactctgccatgcgtcgtcatcttcatgcacgttacaacgttatcatcttccagtggagtacagtacacgtacatgtagagggagtagtatacgttttctgttcgttccgggttcgcaagactggagaggtagctgaacgagagtgacgcaatgagctgcaatgcaccacagcagcagcacaaactctgcacatgtgctgctgcgaatgcagagttggccgtagagcaatgttgtgctgtactactactggagactggactggccgtcgccattctagcaaatgtcatttgtaacaacgatacactggagtatgcacagtggtgtaccgtgaaccagcaaggacgtgcgaatgcacagtgtgtaacagcaaatgtgccccaggcagaggtagcaagccagaaagtccaacactacactgcataaagttttggatctttataggattctcccaacacatgatgagtcgcacgcagctactactcctacagtagcagctagggacaatttcttcttcagctcaggctcagctgctgagccggtcgcgcctcccaacgcataggcatgctcccgccggccccgtctttcttgtccgccattacgccaaccagccgcagtaactcagcgtactactctactcctactccttttctttcgtttaatagtatagtcaactactaactttaaatcaccattaacttaatagctacttcataccatacttagagcagtcccaacccttcacttaggatagtgtttatggcattaactacattgcaatgtaggacttttagcttatgtgacactatattaattaaaagagagagtgaagagaggaagaaactgggtctcatataggacacagcttcaacacgagaatatatgcactatacactatcaagttttacattgagagataatagtgtctttataatagatgaagaataaatatgattggtagagaagagagatgatgtatttattaatggcccattttaagaaaccatgggttgtagagtgtagtttctattgtaatgtcttattaacatggcaccatagacacggtttatgtatactatgggttgtgactgcctttatatactacactattaatacttgatcctatttatcatacacacattgcgtcttgaaattcgtgctacagctggctataaatttatagccctctgctcatctctcttctctattatcttcttaaaatatatttatagctggcttatagcctgctattatacctgctcttactcgctgcagcattgctcactactgtactctcttcgttaaaaaaaaaattaaattctggccgtaaacctgaaccagcgtaagccacctatacgtataccaggtttactaaggcctgcttagttccaaaaactttttttaaaaaatatcacctcaaatctttagatatatgtatgaattattaaatatagataaattaaaaaactaattgcacagttggaggagaaatcacgagacgaatcttttaaggctaattagtccatgattagccataagtgctacagtaacccacatgtactaatgacggattaattaggctcaaaagattcgtctcgcggtttccaggcgagttataaaattagttttttaattcgtgtccaaaaaccccttccgacatccggtcaaacgtccggtgtgacacccaaaaattttcttttcatgaactaaacaggccctaaaccttgaggtgaggtcattgccacctacggagtatgaggtatgatttaacggttaccacgaaatatatcggttttaaaaactaagaagattatcgcacgtgatgtcgtgataattgtacggttttataaaccttgtatatgactctgtagtacaacttatgtacaattaaagacatgtaattatagattaattaaaaaataacatgttcatatgtctgtatagttgtttataatcgttaatcaaatttagtgataacgtgagtcaaacagttagaccgtatgcataatattttttttttgaccgaggatgtactcccaacccagacgagccaccaccatgctagctgctgctgctgctagcgttgcccagtgaccttgcagctcgccatgctagctccgctgctgcttttgcccaaagctgcaccccctgcattgcccctcccctgaccaccttgcctcatctgtatctccgcccccccccccccctctcctcaacctctcttgtgcttgcttctccattgcagctcacctccatctcctattctcctcctccttgttgaaggagttcgtgtgcctctaccaagaacaataagaagccttgcattggtagccatgatcacggtggtggacctgtaccacgtcctgacggcggtggtgccgttgtacgtggcgatgacgctggcgtacgcctccgtccggtggtggcgcatcttctccccggaccagtgctccggcatcaaccgcttcgtcgcgctcttcgccgtcccgctcctctccttccacttcatctccaccaacaaccccttcgccatgaacctccgcttcctcgccgccgacacgctccagaagctcatcgtcctcgccctcctcgcgctctggtgccgcctctccgcgcgcgggtccctcgactggctcatcaccctcttctccctctccaccctccccaacaccctcgtcatgggcatcccgctgctcaaggggatgtacgccgccgccggcgccgcagccggcgccgactccggcagcctcatggtgcagatcgtcgtgctccagtgcatcatctggtacacgctcatgctgttcctcttcgagtaccgtggcgcgcggcttcttgtcatggagcagttcccggacaccgccgcctccatcgtctccttccgggtggattccgacgtcgtctcgctcgccggcggcggtggtggagccgcggagctgcaggcggaggcggaggtcggggacgatggcaagatgcgagtcaccgtgcgcaagtcgacgagctcgcgctccgaggcggcgtgctcgcacgggacgcagtcacactcgcagtccatgcagccgcgcgtctccaacctctccggcgtcgagatttactcgctgcagtcgtcgcggaacccgacgccgcggggctccagcttcaaccacgccgagttcttcaacatcgtcggcaacggcaagcacggcgacgaggagaagggcgccgccggtggcgggggccactcgccgcagccggtggtggggaagaggaaggacctgcacatgttcgtgtggagctcaagcgcctcgccggtgtcggagcgcgccgccgccgccgccgctgccggcgcggtgcacgtcttcggcggtggtggcgccgaccacggcgacgccaaaggtgacgacaccttttttatcatcttttcgtgcactttgacttccctttttgttttgcccgcgtgtattacactgttgtttgcttctgcacaattaatcactcttgtcttgtgctcttgaccatccgatcagtataatcaacggtccagatcacactggtctgctgattgtttggagaactcaactgcgtatactgatttaataccacattcttgaagtgattctttttcacaaacttaccttcttgaattgttaattcatgtaagcttttctgatcttaacagtgacattgactgttaagtagagttgaattgtacagttaagacaaaatcttaacagtaaactactgatttgacaaaagaaaatgttctttgatggatgcacaggtgctcaggcctatgatgagtacagcttcgggaacaagaatgagaaggacgggccgacactgtcgaagctggggtccaactcgacggcgcagctccggccaaaggacgacggcgaggggagggcggcagcgatgccgccggcgagcgtgatgacgaggctcatactgatcatggtctggaggaagctgatcaggaacccaaacacttactccagcctcctcggtgtcatctggtccctcgtctcctacaggtcaattaagcaaacattttactcacacttttcacattgccatgttcatcatcagtcatctctgtttgttgcatgtgttgttaatcttgtgaacaatgtgatgtaattcaggtggggaattgagatgccggctatcatcgcccggtcgatttcgatcctttcagatgcagggctcggaatggccatgttcagcctaggtttgtttgtgcatctctgatacatgctgcattgctgtaatcttacatggttccatgtctgattgcaatgactgaactatgttctggtttgcaggattgttcatggcattgcagccacggatcattgcctgtgggaactcccttgcttcgtatgccatggccgtcaggttcctcgttggtcctgccgtcatggctgcggcctccatcgccgtcggacttcgcggggtgcttctgcacattgccattgttcaggtaagctgcaagttcaggcttctgcaccaaaatgcatccttaactgcaaaagaatctatcgtaactcaacaattgtcattgaactctcaggccgctcttcctcaaggaatcgtgcccttcgtgtttgccaaggagtacaatgttcatcctaacattctgagcacagcgtatgatctctttaccaccatttttttcagtattggagaaatgtccccattttgaggtttcttttcttttatgccctgaaatctctcgccctgtttcccggttcccttttccattgtatcacaaacgccatgcactgaattttctgaaaaggggcgcatcttgcagcttttgatgattcctaatcatattgttttagactaagaaatccatttttactcatgatttatcatccacaaaggcagagtccataacaataccattaaccatgattctataacactatcattgtatctgacatgaccatgaactcttgttctgcagcgtgatattcgggatgctgatagctctccccatcacattggtctactacatactgctggggctctgaagagctctccaagtctcaactcaactgtgcaagaacttgatgttactgacagtttgattaggatttatggtctgttttagttgctcagattttgtttggatgataggtcagcttagtgatgctaggtggacaattatccgagaacttttgggttcaagtgacggccagccacggtttctgattgaagattaggaacatagacatcacattagtgataacaggcatccaatttgtaagacattgagaaggtctgtttcaaattactgacaatgtagtaagacattgaacagtgcttatttagcattccaataactgatggtaatgcgcttacttaaggagctactctgaaggaatttatttttaatctcttgagagattagctccggattttccttttcaaatgtttctgagtttgagggctccttcggaagacaagattctgaaaacacgggaataatcgtaggaataggatgtcatgctataacaaatattataggaaataaatttataaatttataggattctataaaaagtattgttttgtagtaccataggaaaatcaagaaactttaagttacaaggatgagaaaacatgaggtctagtctcatgttagttttctgtcaaaattcctacaaaatgagcaataggaattttaaaggattttggggaagccatttctatgtttcaaaagatcatatggggaaatttttcaatggattttaggggttgaacgctttatcatcacttgccaacaaaagttattacactttgtttaaggtgaggtgaataaattcttagacataacttactaagggcaacaacaatgtatatagcaaaaatagtccatataaataggacctatatatgtgggttttaactattataacattcacaatgtatataaatagcaaatagtattaggaggagagaaagtagagacaaaaaatatattttatcctatatgagaagcccatatgcttatgaattttttttccttactatggactagttccacaatgttgttaggtgactggataaaatattgtattagttatgaactagttttacactatagttatgaactatattgtattagactgaataaaataagtctaagggaatcttgccacattttttaagttattaacacatgagactgactccctctatttcaggttataaaacgttttgactttggtcaaagtcaaactactgtaagtttaactaattctgtagaaaaaaaagtaatatttacaacaccagcatagtttcattaaatctataattaaataaaatttcataatatatttgtcttggtttaaaaatattactacttttttctaaagaatttatcaaacttatagtagtttgactttgatcaaattgaaaacatattataacctgaaacggagggagtagttagaagggaatcttattaacggtggttacaatcaaacacttaccaaattgattaaatttgtctaaccttaggtttgcagactatggtaaaatgtagcttacaaccaaacattctctaatcctttaaaattttctctatgtttctttttatctacttttcctttgttccaaagaatcggaaagatggaatctttttgccacttttttcaagtttcaaatgaagaaaaacatgcgtagcattttgagcatcttttctagtactactcccaagtataacaaaaagtttgggcccaaaattaaaaggctaatggctggcctgtttgctcgaaacagcaggacagaaaaatgattgtgttgggagtcagacaaaagtgttggctttaggcatgcgcacttgaaggttgaagcagcaaccgacgattatactccactcttctcgtcctgtgacagacttgacacggttggatgtctctgaagcttataaccaacggtaattttatcatttttgccgagacatatttcttattataaaatttggtatattagcatatcatgatataaaaaaatttagtataaaatttatatacttataaggaccgtaaaaattctttagtaccaatgcatggatcttgtgaagaagattttttttactcttcatcacactcttttagatcatctgatatagtacacggttaccatgggttcttttagatcatctggcatagtacacggttaccaagggttattagacatatccacggacctaatttacaaaatcgtggaataaattggtcaagtttaagagaaggtaaactcaaaatatagataaaatttatacaatttgtcaacgaaattgcaacggtttttagagcaagtagtttttattattttttcggtttagatcccaacctatgtattttgaatttgttttatatctcttctatagagctgggtattctttttacattaatatactcccttagtcttgtagtatagcaacctatgattggatgagatattttagacctattcaaatttattataccgtgaaatgttccatctggtcctaacttggataaagggagtaggggtgaaaacgggatggatatttatatttctgtccagtcgcccgctcgtattattttggagcaatttcgggtaaaaaatccgggtactcgggtgtttgtacagatatcgaagccgaattcggatacattttggttgatacgtgatcgggtttgagagggtggtatccgatggatacggattatccgataaataatacagatattacacggtgtctgaattgatacctattcgttccgtatttatgaccgatattatccatgtttgtatctgtattcgatactatctatgtctgacccgattccaattattaaatatgggttaggatatgggaaggatgcgatccgacgaaaacaaccccatttcacccgtaggagggagtagttggtttgattgttttttcgattgtgtagaatttgatttttgtaaaagattgttgtcagggtctcgggtgggccacacatgggctgtcagcccatcaccaagaagtccaagcaagccccaacctgaagtaatacatagcagcaacagcttacaggagaggacatcgatcgatcaattggccaaggcggcaaacggcggcggcggcgacctggaggcgggcttgcctccttgtcgatctctaccttccctcttcctctgcttgtctagaagttactagacctttctagcccttgtattcctccatcttccaccccaaaaccttccaatattgtaacagattcactagctccttgtgttggatttgataccactacttctgaaattgcattgttgaagtgggtcgctaacaattgtaaaaacgaaaaaaccccttgtcgtcttctccattgcggcactgaaactcaggcggcgccaccagccagcgtaccacgacgttgctctgctagggtttgctccaccctcctcccacctcgcgccatcggattccaccttcccaggtctccctcccctcccgtcgccatgccgcacctcgtccgcgagcgcctcttcttcggcgacatcaacgacgccatcgccgcgctcaccaccaccaccgcggaagccggcggcttcacccacctcctctccgtcgtcagctccgccttcatctccttcatcaccgactgccgcccgggcctctccatccccaccgaggaggtccgccgcgtggtcgccggggaggagggcgcgccgccggtctccgccgtggcccccgggcggctgatgcgagtggtggagcgcgctggggtcgggctgcgggtcacgcggatggccgtgccgctgcgggacaccgaggaggagaacctgctcgatcacctcgagccgtgtcttgatttcatcgatgagggcaggaaggaggggaacgtccttgtccattgctttgctggggtctccaggaggtacgattaatatttaccaacactaatattccgagtaatctgtgcttttttgtaatctttagtgtcgtgtgctaatcaaagtgaagttcattagatatttttagttctggaatgttacatatatctgttaggcatacttccgttttagccaaatggacattgtgaattttgttccaagaatttatcaattaatcataagcatatgatggaatgtgaatccctgtatcatgctctgttttgacaagttggatatttttgcctgtcctgatgcattggttataacaaatatattggttaacagcgatgtatctcctgttcactgttgttcatttgtaagaaaattaaatacttgtaaatttatctgtatcttgttgcagtgctaccatcatcgttgcttatcttatgagaacagaacaaaaatctctggaaggttcgattatttcaacaaaatgggtgatttttcagtcgttgctttggttattactccagatgaatacctgagctgtctttttgatacactctggtgacatgccatgcttactgtcttgtttcagaagcactagagtctcttaaggaagtcaatgagtcagcctgcccaaatgacggttttcttgagcaggtaaccctttgtgatctgtttgcaccctattgctcttagctttcttttatttatttgttgaatgtgttgtaaattgcagttgaaactgtttgaagaaatgggcttcaaagttgatacttcaagtcctctatacaagcgtttccgtttaaaattgctaggttagtcataattcatcttggattctttgttactgttggacaggttgtgtggttattatgtcagggaaactgtgaagattctggccactggttagcatttatttaaaaaatggagatgtaaattctttgttttagtaaatttcaacattgcatgtctgtgaatcatgatatatttgatgttttcctgctttttttttaattatccatgactaagagtgctattcatgcagtcctgttgaaaataaagcagtcatacacttctcaatattgcttacttttgtttcttacttatgaaaaatctttgacaaatggacagatttgggtactttactgtttcacctttgtcctttctcttatgcatagtctcttactttgccacttttcactaaacttgtcaattttttttacttctcacaggccaatcctacaaaattggagagaaaataggaagctatgtatttgaagatgatcctggtctttctggacagcctaattcttctactcagaatttaccaaacaagcaaacccaacaaccagcataccgctgcaaaaaatgcaggagaattattgctgtgcagggcaatgttgtgagccacactcctggtgagggtgaatcttgctttcagtggcaaaacaagagaaaaggagagcgatcatatagcaaagaacaagattgctcatcgttgtttgttgagcctctgaagtggatgactccaggtaattcaccctcgtaattcagccctttgcagttacctacggtcacaaatgacttctcagattgatctcctattgatgtggctcatagcaaatctgtgtttactgctgagtgttcgtccaatctgttatgtaattctatttgttttatcatttctaattggtgcttttgttattgatggaacagtggaagatggtgctttggaggggaagctatcgtgtatccactgcggagcacggctaggatatttcaactggtcaggaatccagtgcaactgtggcagttggatcaccccagccttccaaatttccaagagcaaagttgatattagtaccacttagatagttgtcagaggctagtagattatttcaggaccatgtgagctggtgtaaataccgttttatcagaaggatttacgaactcgaaggatctcgaccgaagattttcagatccattgtgcactagatagataccatgaagaaatatagtctcagaaaccaccacttgtattgctacttgctgttagactatgccatcaattgtaattgttggttctgatgatctgaaatgctatcagcacgaatttcattttttttcttctcttttttcgagtacgcaatgcatcgtagtacgtatataaatccgtaatgcagttttgttgtacatgagtgcatccattgaaaacaatactgtgtttctcatgttccgttttatgccgctgaggtggcgggttcggagtttttgcttccggcccagccaataatgctctaagatgggcttgctcaccaagggtgtgggctcgacgtctaattgtgggccttgtattcggcctcagccacgtacgtgggctttatattgggccgcatgttccttgaggcccatgtacaccatcaagtcaggaggagaaatccccttccacgccgcacactctgtcacacgccggcgcgccggccagcggcggaactcgcgacacccgccggcgaaggagcagcagcacaggaggtggacggcgcgccagcgaggtcgcccatccagcctctgcgtttagttgtttgaccaatcgggaaagaaggcgaggaagggaggagaggagcggagaggaaaggaggaggggaggatgccgcaccacgcgcggccgatgacggggctgctgctgttcacgggagtcaacctggtgctcctcaacaccatcacccccgtctatgacttcgtctgcttccacccctactgggaacgcagggtacgccgcctccctctttcttcttcacccaccttatccccccattccgatctcccaaggctacgctttgatcctgtcgccctactacaccctggccaagccttttccccacagttcgatccgtgcatctgttgattgtttcttgtctcgagcatgcgcgccagctgtttgtggaaatgcctcgcgtctgtgctgcaactttcttcaattttatgatttcgggaacgaactatccctaacacttcctttcgacagacaatttggtgaagaaattccatattcgctagccagaaatttttacaattgaagagtgctcttataggagcatctttgtgctattatgatgtttttcctttctatactatgatcttgatatattgcatacaatttgaagttttgttgatgtgtaatcttgtgaccaatttagagagaacgtcgtcaaaaggagcgtaaagcactacaagccaatggttctctacaaactgctaaatgattttattcctaggtatgtgcgtgacactccttgagaaaaatctgtttgatggaagtgttcatttttataaccacttcaggagtagcttcacaatttggtggatgtgaaaggaaggtgagaatccccaatttatctggtaaaaaacttgagatatatttttgttcatcctagtgatagtgaacttgcttttggtatgctttatttatgcatgcatttgtttaactttgaattgacatggtatattttaaattttcagttgttttactacttggttagttggatgaaaccctggattcttcattgatatggagtgaagaaaattttataggcaggtaatattgtgatgctcttcagatatgagtagatctccgcactccaggtcttgctttcataatgctactcaactgcatcatcacatccttgtaaaattaccgaggaaactagatctgatgaatattgtttcttgaaactacctttatgtatctcttatcttctcatactcatctggctataacatagtaaatgaaaaccactgtttggctcaagccatttattctgatcaggatcctattaacttagttatttcctggggtggaaggaacatatgtttaacaactgatcctgcagagtgcttcattacgtgtttgaaagttctgaaaacctccaaccattttactgttcttccctcaacggtttatctgtcaacaagcagtagaggaatgctttctctgttcttgttgaatgtaccagtaatcttttgggctttctaatcaggtaggattcaatcatgtagtgtacaagatgactgaacagaaagaaggaacaaatccatcttcccaacaactagccaggacaatgtgcaagaccaaacatgaacctgagcccaacctgaaatgtaaatatgcaattggaaagaaaattccattgtatacattacactcgtggtaaatgcacatcatgtttgaaattgtgcacaaaccagccactatacacactaccctgtttcgctatagaactagatctcgcctcttcttctttgggtttgttgcttctgcacagcctgatcctttcctcatcatggccacaaactctgaataatctatcctcccatcctacatgtgcaaaatgcattcagcgtctcttgataggacaaatattttcagctttatcgatttcatctgttttgcatgaacacaatttaaagagcatttcttccttacattattagagtctgcatctgtgatgacatccttgatctcgttggcgtcgtataacccttgttccttcaaggcttgctcgagctcttcctttgtgatgtacctgcaagagggatggaataaatgtgtacaaatccctgaagttcagaattcagttatatcagtttttgctatccttaacttacccactattatccttgtcaaagtactggaatgccgtgtaaaggtgctcttctcgatccattttgttcatgtgcaccgtcgcggtgacgaactcctcatagtcgataattccattgccatcagcatcagcctgaaagttgaaaggaatttccaggagtcctgtcagttttagcatttcatctcgaactgaactgaagtttgtagcttcactatgaggactcactgcttccataagttgctcaatttcgttgtctgaaaacttggtgccctgctttgctaacccatttttgagctcctcaagcgtaatggtcccactattgtccttgtcgatgttcttgaacatctccttcagccccttgatctcctcctctgacaggcatccggctataatctacagaagattcaaaacaacaattaagatgcatatatctaccctgatgatgtgattaagagtaatatttaccctcagtgcagctttcttgaactggttcatggccctgaactgcttgagcctgttgagaacaacattgtcaagtggtacatcaggagcatccccatcttctttgatccacgggtgatctgcaaatccaaattgatccaaatgaatccaaatttaattctgacaccaattaagggaaaattaatccaaactgtacctctatatgaaaaaaaggagcagatttgagtaattaatctgtaacaaataaacttactgagcacttggaatgctgtaagcctctccttggggttgatgttgagcatcttcctgacgaggtccttggctccagaggagatcttcggccatggctcactggcgaggtcgatctgtccgcgaaggatggcggcgaagatggcgttctccgactcggcccagaagggcggcacgccggcgaggaagatgtagagcatgacgccgatgctccagatgtcggcctcggggccgtacttcctcttgagcacctccggcgcgatgtagtaggcgctgccgacgatgtcgcggaacacctcgccttccttgaagaagacggagaggccgaagtcggtggccttgagcggcgcgtcgtcccctttgctcagcagcaggaagttctccggcttgaggtcccggtggatcacccccatggagtggcaggtgtgcacgatcccgacgatggcgcggaggagcgccgccgcggcgcgctccgtgtagtggccacgcgcgatgatgcggtcgaagagctcgccgccggcgcagagctccatcacgaggtggacgttgtgcttgtcctcgtaggcgccgcggaggtcgacgatgttgggctggccagagaggtggtgcatgatctgcacctcgcggcggacgtcgtcgacgtcctccttgttcgccagcttccgcttcgcgatcgtcttgcacgccagcttctcgccggtggccttgtgggtgcacaggtgggtcacgccgaactgcccgcgcccgagctccttgccgatggagtacgtcgtgcgaacctcctccatcggccgctccagcacctcgccgatggggcctgccggcttcttggacgacgacgccgccgccgccgcttccgtcgccgccgccttggccgccggcgagcacggctgctgcttggcggacccatttttggaggaggtgccgcggctcggcggcgccgccttggaggtccctggctctgcctcgtcgccggcgacggccttcccgccacccgtgcagcactggcccatggcgtcgggggatgcgcgcgtgcctgctccggcgacggagaggcacggatcggagagagaatttttggtagaaggaagaaatggatgtgtgagtttgatgggttgagaggaaatggcgggaagaagtgagcggtagttgtttcggtttggattttcagcgtctcgtaggtttggtcgctggctattcttggctgctaataattgtttctggttagattttcctgtgaccaatcatcaatcgattagctgctaatagttttttctgattagatttttccagtgaccaatcaacaatctgcctttacaattgcctaaaaaaatgcgcctttgcaaacactaccaaactagtcaaagcttacaatatcaagcgtctcctctgttatgaaagaaaaaacaggccctaacatcttaagctctcatttctgcagaagcaccgagagcaaatacaaggatacttttcctaattttggtgtgctatgtatgtattttaactttcaggatacactcacaatttgttgattttagtcctgcattagtatgtcaccgcaaaattcaagaagaccatttaatcatgtaactgtataaggtgttccactgtcaatagagtgaaagcttcttctggaatttctattgccgtatgcaattctccctcctgaataaccacatcagataatgttctcctgaagctgtcaatagcatcctctggatgccctttcgcaatggatgcctgcagtggtgttgataaccgtaagcaaataacctatcacaagaccaaaactagaagtacaagagccaaagtttaggcactgtagatgatgcgaaaaattcagacataccaaatgcatttcatcaatcttgaaaagccaaaacatccatttcctagcctcttctccatcaatacagagagaaatattagtccaattcatatggtggaattccaaacgttgcagcccgaatccaacgccagcacctgtagctttgacaaatgcttctttaagacaccaatacctacagaaacagacaattgttaactccacaaattttggcttgtaaacatgatcagcaccctgcacttgttctgaaaagaaaaaaatgaacaagaacaaatgcatacctgtagaactcagttagcataccatcatgactgtctgcagtaacaatgcagttccactcatgatctgtgagataggaagtgaaattgttgatgaactccagggcagtttctcgttggggcttggagatgcacacaatgtccaggccaacgaggcagagaggctcagatgctatgccaacgtactccccctgatgcgacgtgttgaagttgaagccaggaaggttgacatttttattctgctgcaacaacaagacgtgatcgattccaatttgggcttcagaaactgacagaatgtaaacgtgaaactgaagatatggatttgggatgaattaattgatgagaatatctactagactactactactaccagatagggcttcccttcaagcgtgcggttgatgcgaatttggtggaatggcattccaagggcatggtgcacgagcgagtacttgagcaggcggctgacgagcgctcgtttcctgtcttcttctctgacgaacctgcaccggtgaggtcgtgaggacgaggagaaaaatctagaggctgaattcaattgcagtagtgagtgggtggaatcaatggggagaaagaggagttggttggaaaaacctgtggatggcggggcggtcgtgcggcgggaggacggcggcggcggcttggaactcggcgggggaggggcgccaccggccgacgtcgacgagccacctacaccgccaccgccccccgctgctctgcttctctccttcctccatcatcaacaactcgatcaacggacaacggtcaactcaagagttaaggcagagaaagccgtagaccatggcctggccggccggcaaggaaaggaaaggaaaggaagagggacgacgacaacagagaggggaggttaggatgggcctttctcacgaggcctgtaaacttttgaagctaaactaggcccaaattgcatatgtgcatcttgccatggtgccatggcagagacatcagcaaattaaacagcaacagagacataaccatagccatcagtccatcaccatctgccaatctctcacattcaataacagtcgccattgatacgctgagtgttgtgcactacattgattttttcgtcagactcggaggagatggagattaattgagctcgagtgtgagactaacagcaatgctacgcaggctaaagatcgcaatagtaattaatggcgaatcgagccaacgtcagttcgctatcgaccgacataataaatcaggttggttgtgaaccgagacatctcatcatctcaccctggagtcaggagctcaggaacagcaaagcaagaggaggaagaagcggagatggctgcaggcgacgctgcgacgccattgctggagatggcgtaccaataccatgagggctgccccgcctgcgccgtggagcgcagcaaggcgctcaaccccggcatcccctacatgcgcttcttccacatctggatcatcatcctcgtctcatgtacgtacgcgcctcctatatatcgatcactgcttcatttatacgtgttcatgcatgcttcgcttcctgctctgcttgactgcctctccagtctccttattatctattattaacttatgaagtctcatgttcgctctcatggcctaaaaattctcacattaatcggagaaaaaaaacagtctatataggaatctacctatattattttactacttaaagttcaaaatatttccatcgtcataaaaaagaaaaaaaataagtcggactcaacatgcgagaaaaaagattctctcgtcagtaaaaataggaaaaaaatatttcgtagtaaaaacaacgtccgactcattataacagaaaaaaagaatctcccccataaaatacatccgattccttaaaaaaaagaaaaaaatatcgccagtaaagaaaacgaaaaaaaaagtccaactcccatagaaaggaaaaaataacttctgacatcctactcccataaataaaggaaaaaaacatgtcctactcaaaatcgagaaaaaacacatattataaaaaatcccgtttataaaagaaatcgattcgaaaaaaccacccgactagataaaaaaccgaaaaaacacagattataaaaaatcccgtttataaaagaaaccgattcgaaaaaaccacccgactagataaaaaaccgctccgaaataaaccatcagaaaaaacattgctgaaaaaggatcgaaaaaaccatccgaattcacacgagaaagaaccgccatatataaaaaatactaccccgaaaaaactgtctgacccaacacgagaaaaatcccgcgtttataaaataattccgattcagtactgtgcaatgcgaaaaaaaactgtctaatttcataaaaaaaatccgatttcatgaaataagatccgtattgtttgtattgtccatcgtctaccatgtcgttttggtttttccatagcgtcgtcgaatgttcagacgtgtggatctaaaacaagtcttgcttaggcttgtttttctcggaacaagatcaaattgatcgaggctttgggtcagataggattctcgatttttccatcatctaaaaacttggtttgtgttccacgattatattctcctctattggagactctacatgtctctgtatgcaattattatactactggtaagtatagctaatattcttgatagcttatcatataaaaataataataataaataaacatatttttaattgttattaagagaagagtgcactgaggctctatttatttagacttgacaatacaagacaatgcaggatttgattgatcctattattattgcaagaatgagattgaaagattattttagattatatgtgtacaaccacataaataatccaatttgtttgggtaaaacatgcattgttaaggttgtcatagtcaagattgggtcattatattacagatgtttcaattttccttataatatgtcttagcaacaacgatcgatacgattattatcatgggaaaattgaaaccatgccattataattttgcaaaatttgagatatgacatcctgacccacatgtcattgactcatgtgggtcctacatgtcattgagataccgatggcatatcttaaactttgcaaaattataatggcatggttccaatttaccctatcatcattgacataattatagaatatagctgaaattcggaatttaaaataaggaacacaggaagaaaagactagagtccatactggcataccatagaactaatggaaatccggaactagaaaaataagaaaactaaaagtagaggttagagtccatatagaaatacaatttagctggaatttggaattagaaaaataacaaaactgaaagtagaggttagagtccatatagaaatacaatttagctgaaattcgaaattaaagataaggaatataggaagataagactatagtccataccggtatacaatataactaatggaaatttgggattagaaaaataagaaaatttaaagtagaggttagagtccatatagaaatacaatttagaaataacgaaaattcaaaattttaaaaaataaggaatatggaatgaagtatatagagtccatataaaaatacaattttaaaataattaaattcgcaattagaaaaaataaatactaaaagataagtttagagtccaaatacaatttagacataatagaaactaggaattaaaattaagaatattggaagaagagtatagagtcatataggaatttataattaactaaaatttgaaataaaaataataaaactaaaagtagagtttagagcacatgtagaaacacattttacaaataaataaataaattataatgaaaaaaagaatattggaacaatagtccataaagaaataatattgaaacatgagtccataaagaaataaaattagaaataataaaaatttagaattaaaataataagcaatagtagaaaaagagtctagagtccatataaaaatacaatttataaagaaaagaaattcggaattaaaaataagaaatattggaagatgagtataggaatataatttagaaataactaaaattttgaattttgaattagaaatataggaataaaattataaataatagaaattcatgattaacaaaatgaagaatgttggaagaggattctagagtccatatagaaatacaatttagaaataactaaaattcgctattaaaaataattaataattgtcatttatatacaatacattacgaatattacacattggttagtttgatcaagttagtacaaaatttaaaattatgttgtccttttaatatatttgataataaaatatgaaatatgctattatatgagagaaaatataagaatgctagctgcgcaatttacgcgggccaccatgctagttcatgttatgttcgaaaaagctaatggacgagcgctcgcgttcacctgcccccacgcgatcaatttactctgaccaatcccatgccacacgaagtatagatggccaatggattgcccggctccgcatggcccaagcacggctgtgcctgggctgaggtcagtcaggcaagcacggcccaacctacatgtcaggctgtgtcgtgccagctcacgggctgcacacacattccaggcacggccctatatgactcgggtcatgccgtttcggctgtaaggcacgataacccatcgtgcttcttcatagaataagtctatttttcatcctcaactctttgggctgtcttatatgactataaataagtctattttgtattcctcctctcttttggcattgccttatatggttgattaagtctattttggatccctataatattttcttcgatcgtgccgtgccgggccagcccaccgtgccaaggcattggcctaagcacagcccaactgtcgggccatgccgtgcttaggcccggccaaatggtcgtgtcttcggccgggtcgttgggccccgggccatatggccatctataacatgaagcgtcatattctttttggctctaatacgaatatagccacttcttccattttcggctagtcctttttcttttcggctttactctttcccatttaattttatttgaccaagttgaattttaggtgagaccaaccagttaggcctcacaacccgcatgcatgatttttctttttttattctatgaattcattttaatttgtatatatgatacaaactttatacgtatgaagtttctatacataaagtttatatgtataaaatttattgcatattttttttgggacagattaacatgtcgttgaattcatttgaaatttatgtttataaaaatttacatgcacaaatttctatataaaaaatttctctttctatatatgtatatatattttagatatgtaaagtctatatataaatatattttctttactgggccatgttgcttttgttgggctgaattctagaaaagagagaaaaagatgcacgtggaagcctacgagcgtggaaacatgaccgagaaatctgagtcgtcgcgctcgcgccttagcaattccttcttaggtgtgtaaacgtaatcgtgcacaccgtggacccatggttgctaagtattagacggaccctattatgtttgcatatccattttttttccatttccaccagcattgcaagatgtgaatgctttatcagtcatttctagttcacctgaatttatcttatagaggattattttgtactacctccattttttctttttatatagatgactcatttgacttttggcataatgtttaatcattcgtcttatttaagaatttagtataaatatgaaaaaaatatgagtcatataaattttattaataagagaaatggtcaaatgtcacgttaaaagttaaaaaaataaagagagtattagtgtctaaaattaaggggctaaaaggaaagttcaagcttgtaatcgttggtcgaactattgaagcaaaattctaaattgttgtttcttgcatctcttttgcatctttatttatcttgtcattggcttagcttgttccattgatgcgggcctgtgagcttttcatggtagatttttaacctttcatccttacaatattttttttactgaattccatccttataattgaatttcaggtttgccaatatcatcgttatttcccttcttatacttcatggtatgtatttatgattgtaaaatttacaatagcaccaaaagtatactctacattgtataagttttagtgtaaattagctgtttctatttctcattagcggaatttgtaccttgcataattttatcatttggttccgtgaaatgttgttcatcattcatgtagcaattcaaatttctctagtttccatttatattaactagttttttagtcttggaaacggaaataacagtaaagttaccacctaattcctaattcttcaagctatgtatagtcatatatatgttgctatgtatactcatactcatatgttttggctaatcattgtttgggggtgcaggaa

SEQ ID NO: 48033 - DNA, 1415 bp, Oryza sativa
cctgcagccccgtattattttgtttctggctttccaatatttccgatattattttcgtttccgactttaccatttttgatttcgtttctgagaaaaatatgattatggaaatggttgaggctgtttttcgatcgtttccgatcgttttcatccctagctgagacgtactctaaacacacacagtttcggttgaaatttatggaactgctgggtttaggctgcagctggttgactttagttaacagcacacaatttgcctaaaatttaaggaattactgggttctggcagattaattagttctcttacaattgcagcagcaatggtgcctccattaagtttttttttaatttgtatgtacgtaatctgtcaatgggatgtacgatagatgaataatcttgaactacttctactttttttaaaaataaacttcaactaaatatttttaattattattattattattattattattattattattattattattattattattattattattattattactactactactactactactaccatatatatactccagtttggagtagtacatagagtaccgttgaagaagattggcaacaacggcaggtgacaattccgacttggaatggtgcagatatatacatgatgtatacatgatgaagaaatcaagtcagtgaaacctgcatgtcataatcttgagtcaatagttatgcacctgttcactaactttggatggagattcacaaatagaattcaataatttttatgatctttttatgctgtgagttcttattagttcgtgtatgcttttgtttattctagtgtgagtttttgttgaattggtgtaataattggttgtagctctttgagcaaagcccgggattatattccattatctaaaaaaaaggtggaaaagtctattcgtctcgagggaacaccctttatttttatatatcgtttacaaatcataaaaaaaataacaagatgtagatcaatatacaatatattaataaataaaatacaagctcaaatttaactagaaatagaaataataaattgattccgaataaaacatgtcattcatattgaaatttattttttaactatatatatctaattgaatttacatatttgttgagtgacatatcacatatttaataaatcttattatatttttattaaatttattaatgatattttaagatgacatacaccgacatgcacaagtaaagaaacatagcaccgatatatatatagggtttagggttagagttagaatccccttatctctaagaaggaaggcaacactatgatatgccttggtaaggaactaggcataactttgagtgatcaaagagaatcattcgaggagctaagctatgtttacattttcaaaatcaaatggaaaaacccaagt

SEQ ID NO: 48034 - DNA, 6172 bp, Oryza sativa
ccccgttcacaggttcatgtgaagcctggaataacttgtatgcatgtttcatatcaaggagatgacccatcttggtctttaaagcttttctcgaggacgagtaaaggactaaagtgtgggggagcttgttggcggtccttaactcatatttccaactgccaactctcacataaaatctgcataaacaaacaccaaactttgcaagacttacacataaataactaatgaattccacgagttttggtgattcaccattgtttgcaagacttatacataaatatggtggaattataaagaaaggcacattccgaaaagcataaatgtagaatccgtgcaaaggaacaagatgaaggcccaagtatcctacgaacatgggccaaccaccgacgtaggagaggtcctggctgacgcaacagccctccacgtgaacatggtggtgagggggagcccatagaggggcagccgcacccctggtgcgccctaccttctcagccctccttcgtgtggcagtgcattccatacatgggttttccatgtatatttctcctatataccgacctatttggactataaaagaagagtagaacatccctcatcatcatcaacatccaggaagaagagctactagatattgagcaacactccaaagggcgactgtagcgaagaagagagatgtgagatgcaaagaagagagcgactgtagctgcatgagtcttctactcggtctactatgtacaccaaagggtaaaaggagtgccgggcctgtcggctccctacaacttatacctctgagcacttgtgcttccatgggttctcctgttaagtaagtgttcgtggttcttatggtattgtgtattttgattagctaagctatgtttttgtttgtttgcaggttcatcgttcgttcttgtaacagatgttctagcgtaggactacgatcttctcggactccacgatcaacgttagaatagtaatcgatagcatagatatggtgtctaggctagaggttaccttcgttttcttcgtttccccacggtagaggggtaggcggcaagtggtgacagccctatccgtccctagcactcccccacgtacgggttggaagtagagctataagccagacatctacctagtggactaggtgctggccggtgcatgaagtaaagatctgttcttagacctctaaaaccgtaggaatccatctttgccctaacctttcctacccttgtgttatccttgcatggattagctagaagaataccttcgttccctgtggaaaatacgatactttgaatacagcttggtgaagtgctacgttggtaattccgttacgctttcagattatttctgtttgcgttaaaaaataccaacaagcaaaggttcaaccccattactgactaagtcaagcctgatgattatttagcgtcgaactcggcactaaagtggaaacacttcaccaagaatggagaatttaaaaaaaattacttggagctccttacatccttatggcaagccattgattatgcaattgaagatctatcaagcagtttaactatttggattcccagctaactggttcgataaccagttgaactggtcggatcaccagtcaggctggtctgctacaagtcagcttgctctgaaatgctcaagacggtgttgctcaatggatacaaggcgcttggggactagctgtggagggtataacccccggtacccacaacaaggcgcatgggccggcccaccaggaatggcctgacctagtacctgaagacctgtggcgcacggcagcgctcggaggcgctcggcgtgcactgcaagtctaccataaggcaattagcagatagatagggatctgatctgataagctagatatcagatcccttgattgatgcttatcattgtaaaccaactagattagatcttaaccgacttgtaaaccctatctcccggctatataaggagggcatggtaacccctcaaaacccgataactacacctcatcttgtatcaatatacaatccaccagaacacatgacgtagggtattacgtcgccttgatggcccgaacctgtctaaagctttgtcacagccagattttcgttttaggatttataaattatctaataaattattaatagaatttatattaaatgttcattaatttacaagtgaagttaaatgtgggaaataaaatttcctaaatttaaagcatggatggatttaatttttattaaattctccatgattaattatactctctgaaattttctcggattttttttcagagctcaattcctaaatgatacaaagaacagttcagtaattatttaatcattaatgatctaattataattatgttaagtgttttttttgtttaaaaatccttaatttataaattgttgtctaaaagggaattattagaaatgatcttaaaagcctagaagagaagatctaattttaatttgttaaatctcaatataaaattgggctagataaaattttgttaaatacttctcttgattctttagttcctagatttttctaggacttatttgagccaaggaagtatttttaataaatggaattgcatttcatgaataatttaaatagaaaaatgtttttaaatcctccttttggctttgggccgaaagtcggcccaaaaccgctctctctctccctcggcccaagtcggcccaagccgagccgcccgtgcgcgcgcgtgcgaccgccgctgacaggtgggtcctacccgtcagtcgtcatcttcctctcgccgaaaccctagccaagctgcgctgccgccaccctcgccttagtctctcgtcgccagtagagctctagcgccgtgccgcctcgcgccgccgtcgccgccgccgctcctaccgtgcgctgccgtcgctccagtcgtcgtcgtcgctcggggatgtcatagccgtggtcgccgtcgcgtcgccgtcctcatccgccctttcgccgtccctgtcagccgccggagcaccgtcgccgctgttgatccgaccgttgccgccgctcttcctcgtcgccgtcgtcgtccgttgatcttccgccgtcgttttggtcaccaatgagttcgccgtgctgtccgctacgtgtaggtgtcctccgtttgggccgccgcgccgttgttcgctggcgagcacgcgaggccgagccgtcaccggtgatgacgtcatcgccaacgtcatcgttgccgtctgccgtggtccggtcgtggaccgatggatcttggccgtccgttttggatggatgaatctcggccgttcgttttcgtgaaccgtcgccatgcacccggtcctccgcgaaccctagccgatgacgcaataattcccttttccttttcaaaaataattcattattgcgtcataattcaattaaaatccatataaatgctttaatccggtttaatctttaaaaattcataactaattcattgtaactcagtttaatgtggttcaagttgcaaaagttgtataaaataaagatctacatattaaaattatccataaattgaattaaatttatttaatcctttttaaatgggctttaattagatttaatcttgtaaaattcgtaataaattcatatgaagtcagaatgaggccgttcaagtctcaaaattcatctaaaattatgatctacatgtttgtttactttttatgtattgtttatttggagtttcttagtctttttcctcgttttgtgtgttagcttgtcgtttccgtcgtttcgaaagttcgcgagtgcgccggaagtgttcaagaagattaattgaagaccctttattgcaaggcaagtcacacagatcccaaacacaattcctttgagcatgttgatcctatatttaaattctctatttatttcaactgtgcatttatttttgaatgtcaccgggtggtgtgaacctattcctttgttatggctagtttgcattgattaccctatttcttgattacctcgggttataatttgactggttggatttatatattggttcaactagatgttagacataattgcttagccatgcttagaaacattagcacacaattgggataactaatgtttcactattacttaatgatggatatttaatgatagctcacgatggtcaatcgtgattggttaattaattaatgtgccaactaaaacttgataatggtgggttgtgagcacatggttttgatggtcgtgctcatgacaattaaggaccggttcacgattttcggttgtgaaacattaaccgtgccaaccacaagccagaatgggcaacggctggacacttcgtataacaaggctcattgcggagcaccagactgagaagtggcggagataagcccacgggggtcgctggggagtccatgccttgtttataagggggtgactatgatccgggaacggtgcactgctttgagttgagttatgcgaggggtcttgtcacaatcactcaacatggtgacgtgtctgcgcggacacggtaacatgctggtgggttgtgtcttgtgggtacagtggtacacctctggccagagtaaaactattcgaatagccgtgcccgcggttatgggcgggtctaacaatgtctttcgtgattagtctcacacttctcaccataataaatgatgctataactggtaataatttgattagctcctggtttggaatggtatattcctggtttggagatagatctgtgcagccgggtatggttgttcagaatggttgggcctgtgtagcatgggtgtgctgttcagtgttgattaatattgatgattaattactctattgttttacaaattctcaaatgtttgctaaatgctgtttttgcaaatgagccctatattatgccatcctttggtatccttgtgcacttgcatatttgttgtgtggcttgctgagtatgtcatatgctcaccttgcaataatcaatcaaaccttagttgaagacaagttgcgaaggagaagacgtttggcttataccccagttgagctgcctgtgggagtggagccggagcttcgctagattttattttccgctgcagttttcttcatggtgaggactaagtgcctcttaagtaagtatttatcgttttagttaatttgatgaatctgtatattaaattgtcagtttgtgtacctcggctgattcctggacgaggattttatgcacaaataagttcagaaattactagtgaatttctgggcgtgacaagcttcatgtccctgctcttcgtgttcatcatctggttctgatcatgcacgtccctccacgtagttaatctaccatcgtggttatccccctcagtggactgccgaccatatttagtcaaagtgaactataggagcctttgagcaagtttaattgcatagccaactactaaatgcaaatcatctatagccaatctaatagctcattcatacaatagttatccataaaccattaatacatggtcccacctctcatacacacataacgtattggagtttgtgctacagctggctacgaatctgtagcccgctttccttctctctcttctctcctccacatatgcttacaattgacttgtagcctgctattgtactcactcttatagattactgtaacctgcccttaacaactaattaaggtggaattaaaattccacggtctcataacacagtaacacatgagccaaattcaaataggctgactgtcacctaatttaaggtgactaaataaaagggctaccatgccaaaaacaaaattatagttcttggacatgcaaagctgccgagcttgtcaacatcgattctttggcctgatctgttgtagtatgttgttgctctctggggtagatatgtgtagatttctcaatatcgtcatcagtgacatcatcagtctcattaccctctttgctcttaccccacagcatggtgtaaagacttgcgaccagcaaaattccacccaagatgctgccaataaaggaagagaagaaaaggaaagtttgtttatttcagcgtgtttttagaatattgcacctttgatcagctgacagtgagtatatatatatatatatatatatatatatatatatatatatatatatatatatatatatactatatgatttaatttacttgccgaggtgaacaatctctccggggtgcagga

SEQ ID NO: 48035 - DNA, 15017 bp, Oryza sativa
gactcagcttttcatctaaagatgttgggcaagttcttgcagtggcaggtaagtcaaattcaatcaatttctttcctgcaaattttaaacacattcaattccttaatcacaggatcagggtgtttgcatttaatgttgagctctaacatcttggttcggaagataaacatctcctttgttacattgtaggtgccagccttcttgtatatcagctttttatctacggttgggttgataaaattcttggacctatccactcaacccgcatttcagcggtgagttactaaatttcagtatttcttatataatttttacagtttacttgttattggtaactgtgagttttaaaagaaaagagttcaaaatattgctggttactactttgcttttatcagctgacctttagcattgcaggcactatctgtaccaattattgctgcttatccctttatgacacacttatcaggaataagacttggtgttgccctctatagtgcagcaatgatcaaaagtgttcttgctgtaagtactttatgaacttaggattttttttaataaaaaattatagaagtacaaattcttaggtactttttaacaaacattttggttgtgccactcatggaggcatggaaaactaatactgcaacaccacgaaaatttcatagcaaaggtaatattgcacaattgttcagagagactatgtgaaaataaataccaattttttagttcaaaagagaggttgagaaaaaaatatccatgagcttacagttctgaaatttaacccatataaaattagttagcacttcactgcaaattgctagataatttagtttatttatttttcacatggcatatttgaagatatcaagatactgatattttgtaatgttgatcagataactataattacgggcacctctcttctgcaaaacaaagcagtggtacttgtcgaacttatctcaatcgactgttgtctgataggctcaaaaagaaaagaaatttctctgatacactaatatcaaataaatttaatttttgaaaattgcatcgttttgacagccacaagggcaacggggtgctgcaaatggaatagccacaacagccatgtccttgttcaaggctattgctccggctggggcaggagttatgtaagtacaaatgttgctgtctacaactcctagttataaacaaacaactcaacaaagctactagactcagtatcactttccaagattgaacagtagatttctggctgacataattgtcagtttgcaatttgcagaaagactagagggatttttttttgaacaaacctacatttagattttaccaatttcaatgaatagagcagaaaaaaaaactgtaatcatgaaaatgttggtgattagttcgcccttcccaatttagtgaatagttgttgcctgaagcctaaagatgaacatgtccttacgaaactgtaaacccgtttgaagaaagaaaaggactgactgttcaaaacctgtggttgcagattttcttgggcacaaaagagacaacatgtggcattttttccaggtaaataactaaatactccaatgaatttttaggaaccatcaactgtgtgtgacaaccatttactacaatactttaaattagagcaagtttaatagtatagccaactagtaaatccaaattatctacaatcaatttgatagccaattcataaaatagttacctacaagtatatactgcactattaatatttggtcccacctgtcatacacacaggagtccgtgttgcagcccgcttctcttctctctttcctcttttatctcctccacatgtgtttatagctggtttatagtctgctattgtacctgctcttaggtatgtataaatcggtgctttgtaatgtttatttgatcatataaattgtaaattcaacgttgtgcaggtgaccagatggtatttcttctactgaatctgaccgaggtcattgggctcatgttaaccttcaaacctttcttggctgttcctcaacaatataaatagaacattcagatactgctagctggtgtgacaaagatcataaagatgtagttacagtgagtaataagtatggcttggtattaaaagatggtttagatgtggttatagcataatggtaggatcatgcagcattccagtgcagagtctctgttggattttgttctgctttgggcttatgagcaagataaccttgtatattgcagtgttgaatttgaataactgctcttctagctgtggagtactagtgaggtgaggtttggccattggaactgattaatcaaaactaccaaccatccaatcaaatcaagcacaagaaaacatgtaggactaaaaatcagttgagtgctattcgcgacacagaaaatgggatgaatagctcgtaccaggcagagggcaggatgaattcgggtgcagaggcgatggggagtagctgctaatcggatctctcagcagagatcaatctctatctccgtaacgccgccgcctccgccatcgccaagggcaccacgaatcggggcgcggagcactgaggagccactggcctccgccctcctcgagcggctgccctcgttcgctcgatgagccgtatgtatccgtacaccacctccgtcgtctcccggcgcggcacggcagccacggccccgtttcatttggggaagacgagcggccaaccgccgtcatatttactagtaggtcgagaaaacggacgatatgccggatgaaatgccacttaataccatgcacaggataaaatactactcaatatattatctaccggatgaaaattgaaatgccactttgaagatttttatgcccaaaatatccatggagagagagggagaggggagtgccggccgggcgacgccggaggccttcccgggtggcagcgatggaggcggccagcattgacgacggggagaggaggacggggcggcgacgacgggggaggaggataggccttgccgagcggtggccggcgtggacgacaggggagggaggagaggcgatgacgtgtggaaggaggacgggcagcgagcacgcctacccgcacgttcgtcgggaggtggcagcagcggggagcagggggaggaggaggcgacgcggagggaggaggatggcgaggcgagcagcatcgcccgagcgacaacggggacgacggtctgaggctccagggccggccctggccctatgcagccgaggcgaccaccgggggcccatgatggtggggggccaactctgaaaatttaaaatccttcgatgaagtagatctttggtcgcactgcaagatttttgcgaaaacatttagggcccctttgaatcaaaggattcatgtaggaatttcatagaattcaaatcctatagaaaaatatcctatttggccctttgattcaaatgattgaagctctccaaatcctatgaaattcctatggaatggcacattacatgtgaattttggaggaaatttagcaagagctccaacctcttggaaaatttcctttgagtctatctctctcatccgattcctatgtttttcctgcgctccaatcaaacgaccattcctgttttttttcatgtgttttgcaatcctctgttttacacttcaattcctgccagaatcctgtgtttttcctattcctctgttttttctaccttgcaattcaaaggggcccttactcatgagaactcatccaatgtttagatcaatgatttttattcagaatcttcgatgtccgcgcctgagattctgaagtctgttatggatacagattgctatctaaatgtttcagttgcctatcgaattctcttaactgtacctatgacggtagcttcagctgaaaaaagtttatcaaaattgaggttgttgaagaactatttgagatcaactatgtcgcaagaaaggttaaatggcttggttatgtgctctattgagaatgatatcttggacactattgatcttaataccgttcttgataattttgcatcaagaaatatccaaagaagtatcttttcataagaagcaatgaatatgatggggttctatttttcactaaggtaatgatattagttctaaggtattattttggtcgactttatttctcaataattaccagtcatgttaaatttaatatatggatgtatttattttcgttttgcaagtaaaattagcgtttatatatatcacaaaattttttatatagtttagagggcccatcacgataagttcgcctagggcactcaaaatcataggaccggccctgtgaggctccactgcagtcgcctcttcttccgccctgtcctcctcccccgtcgtccccgccagccgtcgccgttgcctggcgaggcctccggcaccctccggccagccctcccctctccctctctctccaaggacattttgggcataaaaatctccaatgtggcatttccctctccctctctctccagggatattttgggcataaaaatctccaatgtggtatttcatccggtaaatgtattgagtggcagtcaggggcggatccactatataggcagtggggtcctaggaccccagtcaaattttaactcgcaaatataccctttagatgtatgacatatgggtctccactatacccgggaaaaaggacccccgctctcataatttcagttcattttctcacttgtgcatcggtgacaaccttttctgtggacatgatgaatcaaaatagtctaaaacaatatatacatggagtatactatgaagtaaaatggtgtgtatgttctaaaccttggataactctcatatagatgcccccagtccatttttgtcttgcgtccgcccctggtggcagtttatccggtgcattatattgagtgtcatttcatccgaacccaagctagagagtgacatattatccattttctctatttaggtccgtttgttttagtaatctagattattgagtcattactacttccgctttacattatggagtagtagtataagctactctctccattttatattataaattattttgattttttttagtcaatcttggttaagtttgattaagtttataaaaaaagtaacattttaaacattaaattagtttcattgaatatatttccataatatatttgttttgtattaaaattactactatatttgtctataaacttagtcaaacgtaaaaaagtttgactagaaaaaaagtcaaaacgatttagggtagtcccaacccatagtgtccataagcagtatttatggtgccatgtcaataagacatcataatagaaactacactccacaacccatgatttcttaaagtgagccattaataaatacatcatctctcttctctaccaatcatatttattcttcatctattatgaagatattattctctcccgatgtaaaacttgataatgtctagtgcataggttctcgtgttgaagttggatcttgcatgagacccagtttcttcctctctcctctctctcttaattaatatagtgccacataaggtaaaagtcctacataacaatgtagttaatgccatagaaaccatcctaggtggagggttgggactgccctaatataatacgaaacataagaagtatttgtttctctctagattattggagacacaaaatactaggtttgaaagattaaagtctataaagcccttagctgttttgttcgcctaaacagcgacgcccgtctgagtgctgccatgattcgctaggtctctctaactctcgatctgttctggagtaggggcgataagagctaagaggtacaaatgatagaagtgagtactttctttgaagtatgtaggggccgtgggtttttagccacccaagaataaaaaaagaacatatttttggaggagattactagattatactaatttgaataatatgattataataatctacttcctccgtattttaatgtatgacgccgttgactttttaaccaacgtttgaccattcgtttttttttaattttttttatgcaaatataaaaatacttatgtcatgcttaaagaatatttgatgataaatgaagtcataataaaataaatgataattacataaatttttttgaataagacgaaatgtcaaacatttatcaaaaagtcaacggcgtcatacattaaaatacggattaaaatacggagggagtattaattttgtttcaaattacttctaataatcttaatctgattgcaattgcgtggccgttgctgacatggattgtaggcttgtagcgggtcaacacacagttggcccagaacacatttacccctctgtctaggcccatatctttgcctgtttaatgtcacggcctctaccctagtcgtcgtcgtcgtcgtcttctttttacatggatatccctgttctttttatagcactaaaagttagcgtacagttcaactaaataattgaccatttacaaaaaaaaaactaaacaattgacccaaaacaaggttcaaatcaagaatcacatgtacagtttttttaatgaagatatcatgtctgtcgtcctaaggccttcggtgggttaggaattcctaaccttaggttggcagggttcgccttgcgcgttcgctggctttggcttcagcgttccgggcatccctattgggatggcttgaaggccccggtcgagcagtctgtctctgacatgttcgaggcgtccaccttcttcgtgccgggggatggtgaatctatgctcttctggactgactattggattgatggaggccgctcagtggcctccttggctcctgacctcctcttcgttgtgccacagcacctccgttcgcgcacggttgcttctggcctggcgaacaactcctgggtttcggacatccgcggggccctcactgtccctgtcatctcccagtttcttcttatatgggatgctgcacttcgaattcagctctcgccgggtgtcagagaccgtcttgtttggcgttggacgagcgaccagcgctactctgcgcgttcagcgtaccaggccttcttttttggctagcactcctttgcctgtgccgatcttctctggcacgcgaagggccctgctaaatgcaagttctttctctggtttgcatttcagcagcgctgctggacggccgacctcctcctaaagcgcggcttggatagtcattcggcctgccctttctacggtcaagagcttgagactgcgaaccacatcctcctcgattgcgtgttcacgcggcaagtttggctccgtgtgcagtcgcctcttggttggactgccctctctcctccccggggtagctgtctccaagattggtggccttcttctagggtttgcttgccggggcatctccgggccagtttcgattctatggtcctcctagtctcttggcaactgtggaaagagcggaactccagagttttcgactctgcattgtcatcggtctcggaggtccttgagtccatcatctctgagggccacctttggtctttagctgatatcattaattttgggcttctcctgggagggtaatggctttgccccctcccagctatttggagttgtgtgtggccatcacagtagtctttcgtctcttctttattttatctttttttctcccctttcttggcataagtcggtctgactgattgcgttgtgtaacaaacattctattcttctaatatattgacgtgcaatccttttgcgcgtttgagaaaaatgaagatatcataggtagaagtaatggaacatatcatagtactccctccgtttcgaaatatttgacaccgttgactttttagcacatgtttaaccgttcgtcttattcaaaaacttttgtgaaatatgtaaaattatatgcctacataaaaatatatttaacaatgaattaaatgataggaaaataattaataattacttaaattttttgaataagactaacggtcaaatatatgcttaaaaagtcaacgacgtcaaacatttcgaaacggagggagtactatatagctagctaactgccaccgccggccaggttattttggcttgtggcgtgttcatcgatgcaaagaatgcatactttgtttcagaattaactgatctggaagaaccatgcgttacacctatcgaccaatcaagatatgaaattatgcaccattgtttcacgggattaattaattaaagctagcttacatgcatggctactggctaggagaggccgaactgggtggcacacttcatgcatgctgccgaactcaagcacattgcaagctgatgatgatccatcgatggtgctgtatccatcatcagtgtaaaatgaatgggagaagcgataccctttgtctcgggttcgcatgtatttatataggtagaaagagcctctaccgtggctgttacaagagattgaatcacagaagtttatcccgtgagtttacaacaaaccaaccttatctatctatcttaacaaactacagatgaatatacatgagataacaactcttatcttaacactccccctcaatcacaacttaccaagattgagattgtgtcgaaaacctatcaactgctgaagagaaattggtttcgtgaaaccatcagcaacctgatcttgtgagctcacaaaatgtatatccaacaatttctgagctacttgttcacgcacaaaatgataatcaacttcaatgtgtttcgtccgagcatgaaacacggggtttgcagtcatataagttgcacccaaattatcacaccaaagtcttgcagcattaggatgtaaaatacctaattcagttaataactttcttacccaaataatttcagctgctgcattagctagtgctttatactctgcttcagtactagaccgtgagacagtggcttgcttccttgcactccatgaaatcaagttatcaccaaaaaacacagcaaaaccccctgtagatctcctgtcagcaaaaccccctgtagatctcctgtcatcaacagaccctgcccagtctgcatcagagaaagcactaacaagatttgatgaagacttaacaatcttgagtcctagatccaaagttcccttcaaatacctcaaaatccttttgactgctgaccaatgagctgttgtaggagtttgcaaaaactgacatactttattcactgagtaagatatatcaggcctagttaaagtaagatattgtaaagcaccaacaatactcctatactgtgtcacatcactaggccccaattcatctccaatctcaacagacaatttttcagcagttgacaaaggtgtactcacaggtttacacgatgtcatattaactctttcaagaagttcagtagtatacctttcctgtgagagtaatagagtttgcggtgtcctcttaacttctattcccaagaagtaatgcagatcacctagatcctttagagcaaagtccttttccagatctttcaacaacgcatttacagctggggaagatgagctagcaacaatgatatcatcaacataaacaagtacaaacattttatgatgccccttattatagaaaaatagggaggtatctgcctttgaagagctgaaaccaagttcctgcagtttcttactcaacctagaataccatgccctaggagcctgtttcaatccatataaagctttatcaagtttgcacagaaaatgtggttgtctagcatcttcaaaaccaggaggttgtctcatatatacttcctcatctaaataaccatgtaaaaaggcattttgcacatccaactgtcttaaactccaaccttgagacattgcaatggacaagactaatcttatagtagcagccttaacaacaggactaaaagtatcctcatagtctatcccataccgttgtttaaaaccctttgctactaacctggctttgtatctgtctatagtgccatctgctttctttttaatcttgtaaacccatttagaatctataatatttttacccttgaccggtggtactaaatgccaggttttattatgcaaaagagcagaaaattctttgtccattgcctgtttccagtttgcactgctaagagcttcctgtaaactagatggctcacctgtctcagtcaaacaaccatacctgacagtaccatccgtatacttctttgggcgatgaacaccatgctgtgatcttgtcactggacgctgctggatctgttgtgctgcatcaaacgtgtgtgggctggagacgttgcctccactggacgtagcggatccatgcgtcgcatgcatcccatctgcagccgcagacgagaccacatcggctggcgaaatcgacgacgtgtctccccctggttcgtcatgcggatgcgtgatggaagccggcaccgagtcctgcgtctgcgacggacaggtagcagacggcgcgctgcgcggaggtgactggagcgcagaaccaccctcggggtgagcaccatgcacgtcggagccatgctgcataaaatgacgactgtttgcagccgtttctgcaccatcagcaccagcgttttcaccaggatttgcaccattttctcctgcagaaattcctgcatgcagctcagcagtctcgtcagtatggttagggatattaatcagaggttggttgcacagttcagtacccccgaacgaatggacaagatgtgaaggcaacaacaagacttcagcccgcaggcgagccccggcattaggacgaagctgagcgaaagggaatatattttcatcaaacacgacatcccgtgagatatacacccggccagaattcacttcgagacacttaaaacctttatgcaaaggactgtaaccgagaaagacacattgtttggagcggaaggccaatttatgggtgttgtaagggcgaaggttaggccaacacgcgcaaccaaaagtgcgaagagcattataatccggttgttcctcaaacaaatatgcaggtgtatcataatggatgattttcatgggagtacgattgatgagatatgtggcggtgagaaaagcttcatcccaaaatttaagcggcattgatgcatgagccagcagagagagaccaacctcaacgatgtggcggtgcttgcgttcagcagagccattctgctgatgggcatgagggcaggagacatggtgagagataccaatgcgctgaaaaaaggaatttagacgttggtactcgccaccccaatcggtttgaaccgatttgattttgcgatcaaggagtcgttcagccatgttttgaaaatctttaaatttctcaaaaacttcgaatttatgtttcaacaaataaatccaagtgaacttgctatagtcatcaataaaactaacataataagatttattgccaactgaagagggggcaggaccccatacatctgaaaaaataaggtccaaaggagctaaagacaaactgaaagacttggggtagggtaattggtgacttttgccctgctgacacgcatcacatacagaccctacattggaatccctaacaacagggagattattttggctgacgactcgatcaacaatagaaaacgacgggtgacccaagcggctatgccaccttgtcatggacggcttgatgacggcgacatgagcttgtttattggaagactcaaaggaagcagcagttggcaacgggtacaggccgcgtctacaccgacctcgaaggagaagcttcttcgtttcctaatccttgagcaagaagaagaaaggatgaacttccatgaatgcatggttatctttagtaagatgatgtgcagaaacaagactcttttgggcatcaggaacatgtaaaacatttcgcaaaacaacatcacgaacaggggtacgaataacagtgcgcccaacatgatcaattcccatacctgtgccgcttgccgtgtggacttgatctccaccggtgtatttgtcccgcaccgtcagcttctctagctctcctgtgatgtggtcggtggcgcccgtgtcgatgtaccagttggtgtcgacgccgtaggagtttgttgccgcagccacgctcttctcttcaccggagtacgaggtgtcaaacctcttccagcacttcaccacagtgtgcccgatcttgccgcaaagctggcagatgggcttcagcttgccatcgccacggccgcctccgccgcggccaaaaccgccacggccgcgatttccgctgttgggaccgccatgtcctcctccgcctccgcctccgccgcgccctcctcgtgacgcagagtttgcagaggactgggcagccccttgaagcagctccatgcgcgactcaaaccctgtcaattgagcatgaagctcgctgacagagattggttcagcccggtttgccacagatgagaccaccgagttgtagtcgaagtccagcccggcgaggatgtaggttaccagctcctcgtcatccataggctttcctgcagaagacatttcatctgcaagcgatttcatcttaccgacatagtcagatatgctgagatttcctttcttggttgttgacagcgccagacgagtgttgatcacacgcgcgcgcgactgagaggcatagatcccctcgatggcagaccagacctccgatgctcggggtgagcgtcgccacctgcgtgagtacctcccgtgacagagacatcaggagataactcagcacttgttgctcctgcgccacccattgggtgtacgccgcattgacaaccttttcaccagtgttgccgtccttgtcctgcagcaccaccatcttggaaggaggcttgatggagttgtctaggaagcccgccagttgggctcccctcaacgccgcaaggacttgagctttccagaggacgaagtttgtcttcgtcagcttctcggtgaccacctgccctaggatagcaggtgccgcagcagtggaagatgacgccatctaatctagatcaaattgagatgagtttggtggagggagacggctctgataccatgtaaaatgaatgggagaagcgatacctttgtctcgggttcgcatgtatttatataggtagaaagagcctctaccgtggctgttacaagagattgaatcacagaagtttatcctgtgagtttacaacaaaccaaccttatctatctatcttaacaaactacagatgaatatacatgagataacaactcttatcttaacaatcagcaggtaggcaggcacagcttggtgcagctagcaactgtcatggccatgcgtgtagtcctagtattgatcgatcgatgcagagagaggtcagatgcatgcgtagcttctgatttgacttcaagtaatacagacagccgtcgcatatatgcgtgcatcagcgcttacatattattttcttctccccgaatatatgataatgataggatcctctcgtttcttaatttcattaattaaccccttcatgattgctcatttgctcttgcgcatgcatgctacctgaatccctctgtctctgccgctgtagcgccgatgaacaatgacagattatgatttatgcaacgaaaacctgaatcactgaatgtgctagaagatgagttaattaatttcacggctttaattgatcactatgaatacttggcttgttgtcattatgtatgtacgtacattgccatctagctagaatttaactcatcaataatcatggcttcattattcgccgattgcaaaaagagaaacatatatcagcctcatgtggcatgaggtgcctaaaatatctcacacgcgcacatactgaagcggccggcaagcttgatgcatgctgctatggtgctgactagctagcaaccagcatggatgcacaaagaagcaacttcatggatccatggctatataatatcactggatgtgtgtcttgcctacccatccggtctctgaacatcgatcgagttgaccactgtcgttttagtttcaatcggtatctgaactttattgtgtgctctgagtgtagtgcatagctgtatacttaacctgactatcacaactaatctgcttgacttttcaggtcagctagctactgcaaatagtcaatgagtgaggaggcgccgccatcatcgccggtgatgagggcggtgttctatgatggctgccccggctgcgccatggaacggaagctggagagcagccaaggcatcccctacaaggagttcttctttgttgggatcaccaccattgcctcttgtatgttcttcttaattaactaatgaactaactacggttatgatgtcttgaaatttttactatgagcccatacatgcatggtatacttgttttgatgatacaactagcttgcaatccatatgttgataatcttattttctgatgattggttgtattgttttccttttcagctttaccaatatcctcgttgttcccattcctctacctcatggtactacgttaatctcaatgggatctaatccatgtcatatatcttctctataggagcaaaaacgcatgccatgtttcactaagtcatattttataatcctacaattattttatcttcacactagatagaagacctacatgtggcaaaaaaggaacaagatattggattatacgctggatttcttggtaagaatcatgaaagttatgattttcaatcagcgtagcccactttaaattccaaagttccttctctttcctatttcataaaaattatatgctcatgcagaagtagaatgtgacaatatttatgttttgtaggtgcatcatatatgatcggtagatgtttgcctcactcttttggggtgtagttgcagatcgtatagggaggaaacctatcattgaattttctattttatcagtgtgagtatttattgtctcaaaatgttcacttttacatgaaaaatttgaaaagctcaatatatgatcctctgtttttaagggtcatattcaacactctgttcggattaagtgtaaagtattggatggcaattgccacaagattccttcttggtgctctaaatggcatgctggccccaataaaggtatgctacaaagcata

SEQ ID NO: 48036 - DNA, 2280 bp, Oryza sativa
gctctaggattatcaatagtaaataaatttatactcatctcatcacaagtacaaaattcagataattgtatctctaatgcacttcaatacttatatataggtaagcactggttggggcatagggcttgttgtgggtccagccattggaggctactttgcacaggtagttgttttgttataaattgtaaccatttttttcacagaatattacaacagtattataacttactttgtctctcatttctctcagcctgctaagcaatatccaaatgtattttctgagaagtcaatatttgggaggtatacacaaatggtttgtctcaagatatatttcataaatagttttatcatttattaaaaaagtatatgtgtattttttataggttcccatacttcttgccatgcatttgtatctcactcattgctcttgttgttcttataagctgcatatggctaccggtgagtgatactccatgtatatactacttttatgtgttttacaagactctacttaaaatcactatcaagtttctcacctcttaggctagctcccatatagctctgttaactctttcaatgctatgcataactttacccaaccatgaataggaatgatatatgtcaattggtcacatagttatatttgaagcatgaacatatggagtgtaaattcaatagttgacaacttggaggttttaaataagcatatgatacaatttttaagaacatgaaacacttccactgatttaaaatttattttcttggtttccattatgtctaaaagagaatatgattagtgatgaacaaactaatttgtatttattcttgtactcaattgttgcatgactactgcccaaaaactgtgacttgtgtacttgaagcttttaagtgatattataattattaagacatgaccgcaaggaacaatattaatcaaattgacaatcttaattaccaggagacacttcataagcataaaaatactgaaggtgaaattgaaatgattgacaactcaagaagtacacttgaagaagattcacataaacagaagagcctctacaagaactggccattgatatcctctattattgcatactgtgttttcacccttcatgatacagcatatagtgaggtaatgattttaactgtatccctattcattagaatatgcagattggttaatatataaaagaaatatgtttttcatatatataaaggactaattgattttttatatgtatactagatattttccttatgggctgtaagtgacaaaagatatggtggattaagtttttcgtctaaagaagttggtcaagttcttgcagttgcaggtactccattaactgttgtggagcaacttattatgaccatcatttccacctctcataaatcgtatgtagcactttattcatttgggggtaactattcattcaaagtcggtatatacagatgttcgcacactagatatattgttatactacatgtatatatttcttcctcgacatctagtcaacactccacaatatcaagatgagattctctaaaattttcagaattctataatgttttctcttttggaattaatgtacgaagtaaatacgaaacaatttaccaataagggaatatggtactagaaggaatgtgtaatgctcatctcaactagtgtatatgattgttacggttgttgtattgaaaggcataagtcctaactcctgtatttcttattttaccaaaatttattgagtagtataattatgcaaaccccaaaaatattaatcctatatatgcgccattttaggtgctggtctacttgtgtatcagcttttcatctatagatcggtccataaatttcttggatccatcaattcatctcgtattgcatcagtgagtatttaaaccatatgctcaaaacacatatacatgtttcttagccaagccaaatatcttatacaaattttgtgtgtatattacaggctttatccataccaattcttgctgcttatccctttatgacacacttgtcagggcttagacttggaatagctctttaccttggaaccattttaaagggtgttttatcagtaagtttcaaatattgtttgtcacattccaaacaacatgattcaaggaaaaattagatatgatgtacttatcatataagacataatagcataatatacactatgaaaataattttcattttatattacaagacaaagaatatattttttcttctaaaattcgcaattgtttgatcactcatcttattgtgcatat

SEQ ID NO: 48037 - DNA, 713 bp, Oryza sativa
  unsure (1)..(713): unsure at all n locations
ctgcagccctgtcgatataaaatcatgctgaacatcgcacgttgtctgctgaaatgcatattatttctagtgattaactgagtgtaaaccacatgagctaacaatttatatgcaaagcagtagcaaaccatccatagataatagcaagaacaatatacctctgtataagccatatcatgaaaggagaagacacaatagagaattatggaggacatcaagggccaatttctcaataagctcttcttgcagtccaaactaccattttggtcagccttttcttttggatcaatcaaatggctctccaaagcttcaacagtttgggatctacttgcatcagctttatgcttgtgtaatgtctcctaaaatacatttcaagttactttacaactatacaaaaagaattaatacaaggtaccgaagaattatcctttctcactatgagtcatgctaaatattgatacttctgctaatgcacaagtttttaagagaggaaatataaatttgacttcaaaaagtaacaaaagagactattaattcctgatgaagtggaacaaccacattaggataaaatgcagattatctccgttataattaccagtaactgattttggttgctaagcatgcagcaaaacttttgatttcttttttcagatccatgtcataagatcttccacagtgcanatatatcanatacaactaaatatatgacaaat

SEQ ID NO: 48038 - DNA, 866 bp, Oryza sativa
actagtggatcccccccttgggggatgaggaatgcctccacggagctgagattcaacacccgttggatcactatcttgaagtcctcagggtcccagtcccatttgcgcccatggtgggtcctcatgatgtcctcgggcccggtgtactcccaggcgccccgggcgcaccgctggggtggcgcgatccggtgacgaaggtaatcgccgtacaccatggcccccgtaagcccctgggatcgcagaccagccaggcggtcaagaacggcgtcgtagccgtctcccagatctaccggcgcccgccagctggaggcctgcgccgggggctggctcggaagtcggaggcgcgcttcgtcggcgagaggggtgttgaaccagtcgctcttccagtcgtcccacttcttgtgaaggacgcagggaatgtagcggttcagcaccggcccccgcggctggaagtagcagccaccaactaccgacggtggcgacaccggctgtacggtgaagaaccaccggaactgccgaagagatgggcgcaccccgatgaacatctcgcacaggtgcgcgaagatggccaatgtcattaccacgttgggggtgaggtccgccatctggagatcataaagctccagaacatccatgaagaaagaagagaatggcgggaccagccctgccattgcgaaagagaggaagaagacggaccgccccgggtagtgtggcgccgggcgtccctcgcccagcgcgaccacctcccggccggtggcagattccggcatgaatcggcgcggcagcccggcctgcctctcgctcacgatgcgagaaggcggcagcacgctaccatcgagcggtgcggagccccgtgccatgacgcc

SEQ ID NO: 48039 - DNA, 839 bp, Oryza sativa
  unsure (1)..(839): unsure at all n locations
ccagaccacacgaatcggtggtcttctgnacggcaaataggaagacgcggtcgtctccttcctgcgggcaaacgcngacgtcttcgcctggagaccggctgacatgcccggggtccccagagaggtgattgagcaccgtctcgccgtgcggccgggcgcaaggccggtccggcagaaagtgcggcggcaggccccggaacgtcaagccttcatccgcgaggaggtggcgcgacttctggaggccggattcatccgtgaggtcctccatccggagtggctggcgaacccggtcgtcgttcctaaggcgaacggcaagcttcggatgtgcatcgactacaccgaccttaacaaggcatgtcctaaggacccttaccccctgccacgcatagatcagattgtcgactccatcgcggggtgcgaccatttgtgttttctagatgcatactctggttatcatcagattcgcatggctagggaggataaggaaaaaactgcattcattacccccataggaacttattgttatacgacaatgcctttcgggttaaagaatgcaggtcctacttttcagcgtactactcgaatttctttgggtagccaaataggacgtaatgttgaggcctatgttgatgacttggttgtgaaaacgcgcaaccaagagaccttactctcggatctagcggaaactttcgaaagtctccgctccgcccgcataaagctgaacctcgataagtgcgtgttcggcgtgcctgcgggcaagcttctcgggttcttggtctctgcccgaggcatcgaggccaaccccgagaagatacgagctatagagcggatgcgccccc

SEQ ID NO: 48040 - DNA, 801 bp, Oryza sativa
aaacaacaactactccgtagtagtgtactactccacaagcgattgaaagccaaaaaaaagatactactaattgattgattggttgattgattgattaaggggatatatgtgaatgaagaatcaggcccagactctcttcttggggataaggtcgaccgtcttgaccttgtctatgcgagccgcgacgatgaagtcattgacggtgaggccgccggcggagggcgtctgcagctcggccctgacctggttgggggcctcgaagacgacggtggccggggcgccgtcaaccgcggcgttgatcctggcgacgagctcgtggccgcaggcttcgtccctgaccttccagacgcactgcagacgcatgccgtcggcgtcgtcgaggaggcgccagccaaccaccttgtggaggaggcggcgggcgtcggcagcgtcgacgggcgcggggttaggctcgagggggaggcgcgcgatggagagcacggagagcgtggggatgaggatgttgtggagggtgtcgacgttgcccagcaccctctcgccgaagttgctctcgatctcctccgggaaggggtcgcgcgcgccaaagtcgcccagcaggtcggccatggccaccaccacgctcttttgcttcctccgcacggcgagctgatgaggcggcggcagaggaacccgccgtccgaagcagcagctgctgcggctgccggcgcgaggatgtggttggtgagcgccattggattggattggaatggcgatgaggaacagctgcagccaccagtccaccactccactccagcagcgagc

SEQ ID NO: 48041 - DNA, 1068 bp, Oryza sativa
cgagcagcgcacactacacgggctgcagtctgctgcaagccgggagaaagctgcatcaacggagctcaaccaaatggctgaagaggccagacggcgtgctgagattacaaggtcagttaagtcgttatatatatatatatatgtgtgtgtgtgtatgtatgtatgggagtctttcttcaattgcatatgctcgatctgctgctcacgaaatgaccgacatctctttcaaaacaaaaataaaattgagtgacatttgtttccacaggttgagggaattgcacactctgaaaggaaaggtggaatctgtggctaaactgaaaggaatcgacttggaggatgtcaacaatcaacactacactgtttaacctacaacacgacaatgcattatgcattatgccatctctgaacatcgatctgactccctagacagtagtattgtttagtattttcctttcccatcccatttggtttattgcatgtggatcgaacatttactctcctcgtaataaagttggatttattgtacctcactcagatctttgcatgtactactatactactagtagtagtccatgagaccatgaggcaggtaacgttgacacctaatatagagtataatggtattcttaagtttttggaccatcagttcctccttttgtttttggatgatccatcagtcagtggtctttgctgtagctagcctagccataccatagtggggtacaagtacaccacattaataaacaaacctagctcctgttgtttctctctgtatgagtctgcaggttgcttaggttagtataatgcgggtacgcatactcttgtagtagtgatgcgtagtgcctgtccacgccatttttcaatgtcaacctgtactttgaggtagacctaacacacactttgatcaatttaatcatatacagtaagtagttgttgccatgctagtaaactttatctattgaaccagctaatataagtactactccctctatttcagaatataagaaaccagatattttttattactacgaatctgaatatgtattagcagtttaatgtgtccgctca

SEQ ID NO: 48042 - DNA, 6288 bp, Oryza sativa
tttttttggcaacaaagtgaacagtcccaaacacattcttgccattgctaccataccaaatttagaaaatccggaatctaaactctattgatatccgtaagactttaaactaaacgtgtttaatagtactaaaaaattgttatatttttagactaaagtagtagttaattatgaaacgtttagaaaatatatttataagagtggattgtatgtacatggaggcatatagagacaggtatttggtactagtggtactagtggcataaagagaagttatgtttggatgaggtgatgaaggggttgggttgccggcgagcgacgaaagaaagaaagaagcagcagcagcgggtctcgtctggtctggtagtaactaggagtagtagacgggcaccggcggcagcagagtcaccttcctttcatttcctttctcttttctctttctttctctctctttcttggtgttggaaggcgaaggcaacccagggggggaagcaccggaggagccgcagatcccgccatgcgggtgctcccggcgtcgtggtcctccgccgcctcctcctccgcctccgcctccgcggaccgcctcaactcccccaccccggcgccgccgccgccggcccctcctcctcctgctccaaaaagcagcagcagcagcagcgcggagctgtacctcaacatctacgacatctccccaatcaaccactacctctactggttcggcctcggcatcttccactccggcatcgaaggtctatatcactctatctccttcccccttccttgtgcgtagatttaccttctctacgccacgccacgccccgccagggaccctacctctaacctggtagtatagtaggcgtactccagataggtcaggatcgaggtaccaccacacctacatgccttgccgtatgccgtatgctgcttgcttccttcgggacctgctttgctcttctactctggagtactaccttactagtaccattttcccccttttcttttctttctcttgtattattattaatcccaaccaacaattctcatgctctacaattcaccacatcctataagccccccccccccccctacacggcacacgccaccaattcttgtgtgtgcctaccgttacttctaattagaaacaacatgtgcaacttaccctaacaccctgtcaatgccccaagtccgactctctaccaggcaaggttcacattacttgttgaccaccggatttatcacgctttgggacaaaattctgcctgcattttgatcaagtttactgtttaccatttgaatttgtcaaaaccaccaaatattccaaccgaaaattgatttccatccgcatcgaaacattgaaaacccgcgaaaaccaatcggctttcattggctctgcgaaccctgctctctacgcgcagcctgtatgtgagctcagctgttcaatcgcctcatcgagacttcatttggtctccaaatggagtacaaacggcacaaacctaagcagtattgctttgctatatccaacttttaccccccccccctttttttcttttgctacacacgtatctagcacatttgctatatattacttgtgggctggaccaactgttatttgttctaaggtcttcagtctgctgatgccttagctgctcatagaattcccatgtttgctttgcaaccattactttttttttggtttgacatccagggatcagcacctaacaactccaataccatttgcagtgcatggcatggagtatgggtttggagcccatgaatacccaaccagcggagtcttccaagtagagcccaaaagctgtcctggctttatcttcagacgctccgtgtgcgtgggttccactgatatgtctcgttcggaagtccgcagtttcatagaggatcttgcagaggattatcacggggacacttatcatttgattgcaaagaattgtaatcattttacagcagacatctgcaagcgtctgactggaaagccaattcctggatgggtcaatcgacttgccagattaggtttgcttctgcaacacaaactcataacctattgttcctcgattttgatgattctaaactattgctgggatcgcaggttctttctgcaactgtgtactgcctgaaagcatcaaggtttccgctgtcaaagatgtaaccgatccccccgagtttcctggtaaactctctctctctccctcccccagttagtgcgtatggatggattcaattgtttattttcctgcacacatccatttttgggttggactgcttatataaattaattacctaagatgtttctaccagtccaagcacatgatttgatgttgacctttctaggttgtactgcctgggtaaattattggcatatgcttccttcctccttttgttcttctagttggctctatcaacattgcattagctggtcatactcaaatcatttatttataccacatttcctcccaacgtgatgttgaattagtggagatattttcccgaggtttgatgtaatctagctgcatcctaatattcgagcgttaggtttcttatatgcttgagtttaacatctcaaaagttatgcaattaacgttagtgaagtgccatgctatgactgactaacagtatagttactcttgtagtcttttgtttatattccatatataatccaataatcgatcttagttataatgattaaccgaattaatcaaaacattctgctaatacattcaaatcgttaaccgtttcacaagtagtgaactaaatttcttattattagagccaataatttctacaagtttggaaccatttaatatatcctaccggtattttctatgaatggttagacatcatggaagatcttggtaaacctagcatggccgtgagtttaattgccattttcatattctgttttccatatgaacatatgatgtgaattatacacactgtaacttgtcatttgtaattggtaagattctgttgctacagatgatgatatggagtctaatgcatccattgttgacggaagtgatgcggatgatttagaccatcttctaataaccccaagtagcgatgttgtatcttcaaaagataagatattaactcctggcagggatagcttgtaattgcatgtattctccattgatatagttcaagtattacttgtggggttgttttctgaggatcaatctgatgatttcttgctgagtggcgatgtggctggaggaggggtatgctgtgggcagtcaaccttgaatagttgaatgtataatccatgaatggtaattctgtgtgtcttacactagaggtagtgaatgtgattgtctaactgtggcgaagggccatgtttccattataagtatatgctgttttgagagaggggaggggaggggaggagtgcgttgacagtgtggtatgtatatgctgtaactagttggagaatgattgacttcatttgagttacctaggtgggcttcctgttttgttttgttgtgtgtaactgatttgtttgtacaaatgaatgatttgcagttgtggaagttgaatagatgttcggtccgtctctctgttgttgttctgcctgctactctctctctctctctctctctctctattgtttgagagggctgatgctttactggagtaatgtagccgtcttaattgttggcgaaccaaacagatcgcttgctatgctttgattcaacaagaagtgttgggcgcatacattatcctgcctattgtcttttgtctcttcttttatcttcttttttcctttatggcaagtgcgttcttatcccgtctttaactttaggaaaaagtacgaattatcctccgaattattgaggtcgatcgaattatactctcgaactcaaaatccagacattctacaccctcaactattgaaaccggacaaataatccctctaattcaattcggggtggttttggattcacgtggcagtccagtcagtatttttttaaaaaaaaatcagtggaccccacctgtcagttcttcacccctctctatctctctactctatcccaatgtctccctctctacgtcagtggaccccaccaatgtggcggccacgcgagggcgggagccgacggcggagggcgccgggaagcgtcgaggcgggagttgagcgtgcagatgatggcgccggccattgggatgccgaagtggagctcgcacatcactggaatattctacgcgaacaccgcgacctgcacacagagacaaccaaccaggcaacgatttcttctgaaaatacgaatcactcagctgctaattcggaaccaaattagaagattcaacaagtaaattctaagcgatttggttttttttagcatgaaaaattgaagaagggggagatttgggagaaaaatccaattactgtattgattggcggcggcgaacggaggtcaatcttaccacgtggtggcggtggacgtcgagggcggcgagggaggcggcgaggcggaggcagcggtctcgcgtctcccgccaggtgcgcgtgagtccggaggaggaggcgacgatggcggggtggtcggggtagacgagggcggcgcggtcgaggaaggtgatgggggtgagcgacgcgtggttggcggcgcagagcacggcgccctccatcgccgccgtggtggacgtgggcgtgtccggtgaactcgggacgacgagatcaaagtcagagagacgagctgaggtgaggtgaacaagggcaggcgaggccacgcaaaaggtgagggaagagaagcttgttttatgacgacaaggcagcagcacaccacgacgacgctcctcagccgcctcaacctgcacggcaacctacgcgggcgagctctgcctcccgctgctggccgcttgctccgcctccgtctcagccgcccggcgccctccaccgccggcagcgccgcctactcccgccctcgcgcggccgccgccatgctggtgagaagagagagagagagggagagattgggatagactagagagagatagagaggggtggagaactgacaagtggggcccactgatttttttaaaaaaaatacttattggactgccacgtggacccaaaaccaccccggattgagtagggggttatttgtccggtttcaatagttgatggtgtagaatgactagtttttaagttcaggggtgtaatttggtcgacctcgatagttcaggggtgggggtaattcgtactttttccttaactttaattgttattttacctccacattttcaagtaaaacttgtattttgcctctgttctgttaacaagacttaatcatgcttttaagtttaagaattcctgtaattgggttgacgaagccctaattttcttgctgaacgttctagtgaacgatgtaattatgtttgtagattaataaagcgcgccaaatggcttccttaaaaaaataagacttaatagtatttaagtttatgtcaaccttgtgctcgatccttttcttttttacattaaacatgtgaatgtcaaaacagatgtcaaattcatgtgaaaaatataaaatatttggtgtcaaaatcatcaattatttccaaagacgaataaacttaaaaaccaactcaaatatggatgacataccaaaatactggcaaaaacatcttcaatttttataatagtagagataggggttaggagtaaaataaaaaatctcagatttatactcctaaaactattagaaattttatctttttttgttacggctaaaatattttaaaattaaggtcaagattttatacataaatgtaatactattgaaagtttatatacatttttttctagagttttagatgatatttgttagtaggtgtacacgatgttacacataaagttttggtggttatgattggttaagacgattggttaagacgagggataagtgggagattatgaaacaaaaacctaaacattataaataattatatgttaggatggaggggttatatattttaaatattattaagtcttattaataatagagtaggggcagaataaacttggtttacaaaaaatattgaaaaaatgatgaagttggggtatcattttttgtttgaaaggttcctggtgggccaagggggagcgatcggatcaggggaccacctagagaataaggggcttcgtctccccacgcttcccattttctttcatttgggttggagaagttgggggttggggggttgggcgaggaggaggaagaggagtacaagaaagaaagaaagattagtagtagatggccgcttattccctcg

SEQ ID NO: 48043 - DNA, 741 bp, Oryza sativa
agaccagtgcgccaaccatggtgtcgccaagttcacccgccttctcgccgaatggtccgcctcccatggctactgcctgtactactacactacactacatctctctttctttctttttcagtttccttcccttctcaattagattaattaattaattaattaattacttgtgctactgcctgctaatgatggaaaacgcatagtgaaatcggaagtggaacatgggactcttggttaatgcctcttcagaaacaggtccactacttgacttcttcaatctagctagcctaggaatcttgtttacctactagtaccagtaataaaaacaactctttctatattctttccacatagtactaatttctccctcatgtctcaacaggctgatattgtttgcagtaaggtgattcaactttcccttttggataataccttcctacgctatgatgatgtatgtatcatcactggattgtacccttttcttttccaggtaaaagaaatgaaggaactctccaatggttacaatatagttggtctttcacaggtatactcttgcactgctgtctgtattgtttatggttcgcgccacttccttttaccaactgcaatgctatgcagctgttttttttccacctgctgtatattctctaagaacagagcactagttactcaaaacattacaggaagaaaaatgattccatatcaatcgttaatctaatttgctctctgtttttgtatgct

SEQ ID NO: 48044 - DNA, 2410 bp, Oryza sativa
  unsure (1)..(2410): unsure at all n locations
gggccgtttatctggacagaggaggctgagcgggccttcacttagttgaaggcgtacctcagttctcccccagtcctggtcaccccggagccagatgagccgctgctactttacctggcggcaaccccgcaggtggtcagcgcggcgttggttgtggagcgcgacgaggacaaccctcaccccgcgcatccccaccctgtgtcgactcgacccgggagagagcaggcaggagaggcccccgagtcgaacggcggcccgaggcccccgacggccggagttggccctccgcccgcttgtccgacggtgccaggcacccccgacccccaggatggccccggggccactgcgggaaggccgcgcctgtcaccctccgaccccgaggtcgtcggcacagaagccgagtgcgccccgcgcggcctctcggacgaagagcgccctagagatgcggcccctagcgaagaggatcggccccgccgaaaggtgcagcggcccgtctacttcgttagcgaggccctccgggacgctaagaccgataccctcaggcccagaagatgctttacgctattctgatggcttcgaggaagttgcaccattattttcaggcgcatcgagtcacggtggttacgtcttaccccctcggccaaatcttgcataatcgagagggtactggacgggtggtgaaatgggcaatcgaattctctgagttcgatttgcactttgaaccacgccacgcgatcaagagccaggccctcgccgactttgtggcagagtggaccccggcccctgagcccatctccgtccccgaggccagctcgggcccctcgcagctgcctcacaccgcctactgggtgatgcagttcgacggctccctatctcttcagggcgccggtgcgggggtcatgttgacctcgccaaacggagacgtcctcagatacctggtccgcctcgattttcgggcgaccaacaatatggcggagtacgagggactccttgcgggactcagagtggcagctggactggggatccgccgcctcctggtgttaggcgactcccagttggtcgtcaaccaggtctccaaggagtaccagtgctctgacccgcagatggacgcttacgtgcgccaggttcggcgtatggagcgccattttgacgggatagagcttcggcacgtgcccaggcgggataacgcggtcgccgacgaactctcaaggctcgcttcctcgcgagcccagaccccaccgggcgcctttgaagaaaggcttgcccagccgtcggcgcgacccgaccccctaggggagacggacacgcctgaacggcccccgaggcccgtcggagtccaggcctcgggacccgaggggagcgttcccggctcccctagattgattgcttggatcgctgaggtccaggcatacctcacagataagactctacccgaggaccgcgaagggagtgaacgcgtccagcgcatctccaagcgctacgtgctggtggaagggaccctctatcggcgcgcggctaacggagtcctcctgaagtgcattcctcgggaacaaggcgtcgagcttcttgccgatatccatgaaggcgagtgcggagcccactccgcctcacgcaccttggttggcaaggcctttcgccagggtttctattggccgacggctctcaacgatgcggttgacctggtccggcggtgcagggcgtgccagttccacgccaagcaaacccatcagccagcccaggccctgcagaccatacctctttcatggccgtttgctgtctgggggctcgatatcctgggtccgtttaggcgggccccgggcggtttcgagtatctgtatgtcgctgtcgacaagttcactaagtggcccgaggcttacccggtcatcaagatcgataagcactccgcgcttaaattcatcaggggcattactgctcggtttggggtgcctaatcgtatcattacggataacggcacccagttcactagtgaactcttcggtgactactgcgaagatatgggcatcaagctctgcttcgcctctcccgcccaccccagaagcaatggccaagtggagcgcgccaacgcagaaatcctcaagggcctcaaaaccaaaaccttcaatatcctcaatatggaggagttgccagcggtgctctgggcgaaccgaaccacgccaagccgagcaaccggggaaacgcctttcttcctcgtctacggcgcggaggcggttctcccatccgagctcaccctgaagtcccctcgggccaccatgtactgcgaggctgatcaagatcagcttcgcagagatgacctcgactacttagaagagcgaaggcgggcgcgcggnncctncgagccgcgcgctacagcagagcctgcggggctaccatcagcgccacgtncgggccc

SEQ ID NO: 48045 - DNA, 21054 bp, Oryza sativa
tcccggacctgcgcgcgcgcgccatcctcggttccagaagagaactcgtccagcgctgcccacggggagaagtcagggtccctggcctggtagcttgccagtacgagctccaccgccccccgggcgaggtccctcgaggatgacttgatcgtctcctcgagctcctcggggagccgctggagggtcccggccatctctgagaggcgctgggcgaggcccccctggttggcggcgtatttcgcggtacgcccgccccagaggcccgcctgccgcccggcacggtctagacgggagacggcgtcccgaagcatgctgggccctacctcgcccgtcaagcggagggcttcgacctccccggcggatgagtccagcgcgccctgcagctcggcgatggtgtgttcggcggctgcgaggcgggcggctaggttgccgtcgcccgcggccgccccgccgctgcgcgctctcgcgtccagctccttcgcccgcgcctcgaattcagcggcccgctgatctagtgcggccctctcggcgcgggcgccttccagattgaggcgcgcctgctcctcccgccgctgcgccgcggcctcggcctcctcgagagctcgctcccgctcagtgagctcgtcctcgcggaggcggagtgcggactcctcttcggcgcaggcggcctcgtgcgccgccagcgttgcctcccggatggcgacggcggcctcgcgacccgccagttccctctccttcgtgtccagggcgcgggcgcgctcctccagcaccgtggcgcgagcctcaagggcctcttcgcgttgccgggacgcgtcgagcttcttctctagctccgccgcccggctcccgtattggaggcagaggtcgtcccgcgccgcgttgaacatggcggtggcaatgagggcagtctcccgctcctcctccacctccctggcgatctccgccaggtccctacgacgggcctcgagctctgaggcgtgccggcggtgtgccttgcggcccgcctccaccatggcttccaccgagcgccgcccctcttcgacgcgtgcccacgccgcatcgacctccgcccgctatgcctgcaggacctccatctgggcgcttaacccgtccaacaccgtggtgttcgcagcggccaaggcctgcaggaggggctctgcgctcaatggggcagcggaaggcagaggggagagccgcctcggtgtgggcgctgcgcggctcggcccgccgatcgacgtgccgaactcgggggcgtcccccgaagcgggctcgtcccgaacgtcgccagaggggtcgggcccgagcggcgcgcccgcggcctcgtcgtgggtggcctcggaagtcgttgtcgcctcgggcggagtcgggtcgggggcttggcaggccgcccggcgtgcgcgcgccgcctccgtctcccggacggactcctcggcccggcggagtctggcctcctcccaaacggcttcctcagcctggcgagcccggacggcctcctgggcagcttctttggcttcccggaggcggtctgcggcttctcgccggtcagcttcccgcctccgggcctccgcggtcgccgtctcctcggcctcagaccggccggacttggaatggcgggaagggcgcgacgggatctcgctgaggcagaagaaaaaccagaagacgaaaaacgggtgagtgaaaacttgccttgggagatgggagaatgaatacggccgcagtgggcgcggggacgaacctgcgaggaggtcggctaaacgaccaccttgggggggagatgaggtttccccggcatggttcggtcccccccatcttgcggagccgcttcttttttcgctccccctcgggctgcgacgtcggcacagcaccctccgggcgcctgctgctggcacgcaccgccccgccccctcagggaggagatggggagggggtatcctcctgtttcctcttcccccgggcgtcggcagggcggctgccccccgggcccccgtcacggggcccagaatctcttcccctcccggggtagattgttcccccctacggctcccgcccgcgccatcgtggcctcgaggagcccgctcccctgacgccccgaccgcctgcatgatggtcaggatgttggcgcgctctggatcgctgcagagggggaggacaccttgggggatgaggaatgcctccacggagctgagattcagcacccgttggatcaccatcttgaagtcttcagggacccagtcccatttgaccccctggtgggtcctcatgtagtcctcggacccggtgtactcccaggcgccctgggcgcgccgctggagcggcgcgatccggcgacgaaggtaatcgccgtacaccatggccccgtgagcccctggaatcgcagaccagccaggcggtcaagaacggcgtcgtagccgtctcccagatctaccggcgcccgccagctggaggcctgcgccgggggctggctcggaagtcggaggcgcgcttcgtcggcgagaggggtgtagaaccagtcgctcttccagtcgtcccacttcttgcgaaggacgcagggaatgtagcggttcagcaccggcccccgcggctggaagtagcagccaccgactaccgacggtggcgacaccggctgtacggtgaagaaccaccggaacagccggagagatgggcacaccccgatgaacatctcgcacaggtgcgcgaagatggccaacgtcattaccgcgttgggggtgaggtgcgccatctggagatcataaagctccagaacatccatgaagaaagaagagaatggcgggaccagccctgccattgcgaaggaaaggaagaatacggaccgccccgggtagtgtggcgccgggcgtccctcacccagcgcgaccacctcccggccggtggcagattccggcatgaatcggcgcggcagcccggcctgcctctcgctcacgatgcgagaaggcggcagcacgctaccgtcgagcggtgcggagccccgtgccatgacgccggcggaggaagggcttgagagcgagtgagtgcggcgaggatagggcacaggaaacgagaagttagagcgcaagcggtgaaggcaaggggaataatggcgagaggaaggaaacgaatctcttcctcggcgtctttataccctcgccaacgctatgcccggctcctcgcttcccgcgccaactatctcgcccctcgtttctcgcgcccactcctccactaatcccgctcgcccgtttgcggcgcacgaggcggatgtgcggccgtggcagtcgagatgggacatatcgtgcgcgcgttaactacgctcgccgaccgatgcaccatcatcacatctccaggcgagacgaaccggctcgtcccgattcgcgcgctactcaagtaatgtagcggtcttgaagaaagccgctcattattgtcggtcgtttttcccttgccgatgcgcgcgatttgcgaccactggattcctgcctgcctgtagacaccggccccacctgtcaccaggcctaaggagtggcgtcacgcccgagcgctttcctcgaggagggcgatcgccctggcataacgccgggggctactgtcggtgacatgggaccgagggtatcttgactagaggtttgcggcagccgcggtcacccacgtggcctgaccccctcgggggggggggtcgggcccgagggtgatgtggccgcccctccctctgtctccccgaggggtcgggccgctcccgtttcggccccgagggctggggcgccccgaccccctgtgggtttggcgccacgtgtgtgggttaggtgagcacagcagcgctcacctaacctcgtttattgcgggttggacgagcgccccacgccgcatttaatgcagcgcagcacactcgttcggtccgtgacaggtcacagtgtgtggccggtcacagaccggtcatatcgcgggttaggtggcaacaggcggcctttcgcatgcctcgccccgtcccgtcggaatgatgagaagcctctaggcactcgtccctagccggagccggcgtgctaactcctggagttagcacgtcagtcccggctagattcataccaggcttcatcgcaaccattacaaggaagtcattttatgaagaagggctgacgtgtggcatgctaaactgacgcgtggtagacaagaatgaccggtttgtgactggtctgacgccggtcacgtcatcggcagacaaccgtgctcccacgttgcgcctgcttccggcggagtggaggtaggtatggcccatcccatcggagggtcattcggatagcagccatggcaaatctccgcccattaatgagggagtaacagggagatccccggtgtcaggcgagtgatgacgctgggcctcactcaaagacaagctgtgatttagcttcgaggcgaaggcgcaagccagttttttttttggaagatagggtgagtccccacccaaaagaagagtaggtagaagtggtgcatgtggtatccccttgagatataaaaggaggaccttgcccacttaagagaaaaaagaaaggggagaacacctgagctggtagaggagagaaagaggaagagggtctctagagtttgaactctcttgctctccagctctttgtaactccttcatacacagatccaccagaacacaggagtagggtattacgcttctcagcggcccgaacctgtctacatcgcccgtgtcttgtgcatttgctctctcgcgaaacattccacagatcgagggcttagaacctcacctagctcccccggccgaaccggcaaaggggggcccgcgcggtctcccggtgaggagccccacgctccgtcaccttgtcattcccctttaaatgaatggagactttttgcggtccatctcacgtggggggggctccagacgatgcattgatgggacggggcatacctgcccctactccgccgagcacagggcggaacgtgggggcaccaccgcccgtccgatcggacgtgaccggcgacaggccggtcacaatccggtcacgcccgattgatgtgggtcaatcgggcaacgccgcacgtccaacctcaccgcattaaatgcggtgagggacggttggggcgctgcgcattgatggtggttcagcctgggtctccgccccactgtaggatcaaggaggccgactagagggggggtgaataggcggttttaaaacttaatggcacttaaacaaaactaacctaagttactaggcaaggtgaggtgcaaggttaactaagcaactaagttaagttttgcaaacctaagtgatatgggctcaaatatgtctctatgaatgtaaatagcacaaatgtaaatgcaacaaataaatgagacaagagacaaggaatttttcaccgaggttcggaaactcgctggtttcctaatccccgttgaggcgagcccaactccaccgctcaaccacgaagccaccgcacgcccccttcgtcaaggggtgggcaaggcgggagccggcccatggagaggactacccaagcctcgatcactcggggtagttcttccttcactccgaaggtggtgaactccaaaccactcacaaacggtgccgggcctcctccacaatctcctcggagaggtcaccgggcaacacctccacaagccgtctaggaggcggcaacctccaagagtaacaagtctaggatgcttgccgagtatgatcaagtgccacactagctataacaatgaagcaacgcactttgacggagcgtggggctcctcaccgggagaccgcgcgggcccccctttgccggttcggccggggacgctaggtgagattctaagccctcgatctgtggaatgtttcgcgagagagcaaatgcacaagacacgggcgatgtagacaggttcgggccgctgagaagcgtaataccctactcctatgttctggtggatctgtgtatgaaggagttacaaagagctggagagcaagagagttcaaactctagagaccctctccctctctctctcctctatgagctccgctcttcctttcacgagctccccttttcttctcccttttctcttcctcccgttccccccgtcctggtaggcatggtcctccttttatatctcaaggggataccacatacaccatttctacctacccttcttttgggtggggacccatcctattttgaccaaaacttggctcgtaccttcgcctgacaccgggatatccctgtccttccttcattaatgggcggagatttgcaatggctgctgtccgaatgaccctccgatgggataggtcataccaacctccactccaccggaagcaggtgcaacgtgggagcacggttgtttgctgatgacgtgaccggcgtcagaccagtcacaaaccggtcattcttgtctaccacgcgtcagtttagcatgccacacgtcagtttagcatgtcacacgtcagcccttcttcataaaatgacttccttgtaatggttgcgatgaagcctggtatgaatctagccgggactgacgtgttaactccaggagttagcacgccggctccggttagggacgagtgcctagaggctctcatcattccgacgggatggggcgaggcgtgtgacaggccgcctgttgccacctaacccacgatctgaccggtctgtgaccggtcacacactgtgaccggttacggaccggataagcgagcgctgcgccgcattgaatgcggcgtggtgcgcttgtccaacccgctataaatgcggttaggtgagccccgctgtgctcacctaaccaatacacgtggcaccaaaaccacagggggtcggggcgtcccagccctcggggccgaaacgggagcggcccgacccctcggggagacagagggaggggcggccacatcaccctcgggcccgacccccccgagggggtcaggccacgtgggagaccgcggctgccccaaacctctagtcaagatacccccggcgttatgccagggcgatcgccctccttgaggaaaacgctcgggcgtgacgccactccttaggcctggtgacaagtggggccggtctctacaggcgggcaggaatccaatggtcgcaaatcgcgcgcatcggcaagggaaaaacgaccgacaataatgagcggctttcttcaagacggctacattacttgagtagcgcgcgaatcgggacgagtcggttcgtctcgcctggagatgtgatgatggtgcatcggtcggcgagcgtagttaacgcgcgcacgatatgtcccatctcgactgccacggccgcacatccgcctcgtgcgccgcaaacgggcgagcgggattagtggaggagtgggcgcgagaaacgagggggcgagatagtggaagcgggaagcgaggagccgggcatagcgttggcgagggtataaagacgccgaggaagagattcgtttccttcctctcgccattattccccttgccttcgccgcttgtgctctaacttctcgtttcctgtgccctaccctcgccgcactcactcgctctcaaatccctcctccgccggcgtcatggcacggggctccgcaccgctcgatggtagcgtgctgccgccttctcgcatcgtgagcgagaggcaggccgggctgccgcgccgattcatgccggaatctgccaccggccgggaggtggtcgcgctgggcgagggacgcccggcgccacactacccggggcggtccgtcttcttcctctctttcgcaatggcagggctggtcccgccattctcttctttcttcatggatgttctggagctttatgatctccagatggcggacctcacccccaacgtggtaatgacattggccatcttcgcgcacctgtgcgagatgttcatcggggtgcgcccatctctccggcagttccggtggttcttcaccgtacagccggtgtcgccaccgtcggtagtcggtggctgctacttccagccgcgggggccggtgctgaaccgctacattccctgcgtccttcgcaagaagtgggacgactggaagagcgactggttctacacccctctcgccgacgaagcgcgcctccgacttccgagccagcccccggcgcaggcctccagctggcgggcgccggtagatctgggagacggctacgacgccgttcttgaccgcctggctggtctgcgattccaggggctcacggggccatggtgtacggcgattaccttcgtcgccggatcgcgccgctccagcggcgcgcccagggcgcctgggagtacaccgggtccgaggactacatgaggacccaccagggggtcaaatgggactgggtccctgaagacttcaagatggtgatccaacgggtgctgaatctcagctccgtggaggcattcctcatcccccaaggtgtcctccccctctgcagcgatccagagcgcgccaacatcctgaccatcatgcaggcggtcggggcgtcaggggagcgggctcctcgaggccacgatggcgcgggcgggagccgcaggggggaacaatctaccccgggagggggtcgtgcttctgggccccgtgacgggggcccggggggcagccgccctgtcgacgcccgggggaagaggaaacaggaggataccccctccccatctcctccccgagggggcggggcggtgcgtgccagcagcaggcgcccggagggtgctgtgccgacgtcgcagcccgagggggagcgaaaaaagaagcggctccgcaagataggggggatcgaaccatgccggggaaagctcatctccccccaaggtggtcgtttagccgacctcctcgcaggttcgtccccgcgcccactgcggccgtattcattctcccatctcccaaggcaagttttcactcacccatttttcgtcttctggtttttcttctgcctcagcgagatcccatcgcgcccttcctgccattccaagtccggccggtctgaggccgaggagacggcgaccgcggaggcccggaggcgggaagctgaccggcgagaagccacaaaccacctccaggaagccgaagaagctgcccaggaggccgtccgggctcgccaggctgacgaagccgtttgggaggagaccagactccgccgggccgaggagtccgtccgggagacggaggcggcgcgcgcacgccaggcggcctgccaagcccccgacccgactccgcccgaggcgacgatgacttccgaggccacccacgatgaggccgctggcgcaccgctcgggcccgacccctcgggcgacgctcaggacgagccagcttcgggggacgtccccgagtccggcacgtcgatcggcgggccgagccgtgcggcatccttaccgaggcggctctcccccatgccttccgctgccccattgagcgcggagctccttctgcaggccttggccgccgcgaacaccacggtgttggacgggttaagtgcccagatggaggtcctacaggcagagcgggcggagctcgacgcggcgtgggcgcgtgtcgaagaggggagacgctgtcgcgaccgagaaaattgccttttcccgaacgctagtgtattgatccccgtcccaggaaaagccggggtacaccacacaaacatgatacaaaaggcacatctttattatatcgataatatttacattattacaaaggcacttaaggcctgacaatcaaaaataaacagcagcggactagcgggcctacggctccatcttcacaggcgctcaactagggtataagccaggactccacctaagacatcttctccaaagcttctcttactgaaggggggggaaaagattgagcaagaatgagtacaatcacagtactcagcaagccacaccggagatgcataattaatgcaagggggtacaaggggataataatataggggttaagttttgcagtaaacagcatttaaaagtcacttagttgcccaaagctattttgtaaacacgatcctagagctatacaatattattaatcaaggccgtggacccacacgaacctgccttaacccaaggcctacgatgattcagaccgaactggcaacccgaccctgggtcccagctcgtcccaagccaacccaggccaaccattccacattttagttgttaagcaggttttaagaattaaaacactaacttgggtacattgctcggcttgcccataaccgagggcgcggctattcgaatagattatactctgatcagaggtgtacatctttacccacaagacacatcttcctcatgtgtaaccacgtgccacataccaccacggtataaggacggaagacgtgacatagttcccaacccatcctagccataaacaagagtaccgacccaaccctacctacggccggaacccccgggacaagtaggcaggactgagcccccagcagcaggacaccggccctgtgccatgacatctcgactaccgggccgcagctcgtgtagccttcatttgtcctagagatgtccatcgacccccgacttcgtccatctccatccgtgtacttttgtttataaccagactgagccacaaactaagccttacccactagacatgtggaagtacggtagtgctttgcaacagaggcccgagcttaatccttatagtacccgaggtacgactaacaaaacccaaccacgcacctcgagcccagcctaaaaccattttgggggttttgaatagagggggaggtgtgtgtccaattccaacataagccaaccattccatagtgtccaaatgatatgagaattcccaaagtctaaagttataaaaccacctaatgttgcctaattaatcagcgaagcatctacctaaattcatactagtggaaccatgaatagagtacccactagttggggttttgtttatcctagggtgaacaaggtaataataacaataataataataaggtcataacaaaggtaaataggcatggctagataaaacagtgataacgcgggaatttaaataaagcgataatgcaataattttaaagcaacataattttataaactgggattcaatatgttcaaggatgatgtgacttgccttgctcgctttcccaaacgccggcttcaacttccacgaagagcggatcttccgaagctgcagcgtctacacgaccaacggaaaagaaaaggcttttactctaataaactccatataacaagcagaaacaaagcacaaaaatgggttcttgacttcttaaggaaaaattagagacttgaacggtccaattccgagttcaaatggccaagttatggccatttgaagtttatatgctctttaaatgaatatttgcgaatttcttcatttaaattttaatttaaaatagatttattgcgtcagccgaggggaggggcgcgcggaccgggtccacggggggtggggcccacgcggcagccccacggtccacggtggaccgggcgcacccgggctcgcaccggccggcgccgtgggtcccacgcgtcagccgcacctaagggcgcgggcggctgacagccgggccccacacggcagccgcggggcgcgcccgaaggcggccacgccggcacagccgacgggaggcggcgcgcccgcgtccctatggtcgccggcggcggccataggtacggcggagcggcggccgagagaggggagggaagggggaaacgaatcagcggtccacggctcaccccgggtcgacggcgacgacgggaacggcgaccggagcggaggaaggcggcggcgcggctcgggtggacggggtcgacggtgctccggcggtcggcgtgcgaaacggaggggtggacgaggtcgccggggatgcggtgaagccgaaggtggcgacgccgaggcgggaggtggtccggggcgacgacggcggcggaccggagctcggcggtgacggcggagagagagagcgacggcgcgagctcgattccgacggggagagagggcggcgagtggcggaaacggtggagggaggcacggggaaggtttatatagggttgggagggggagagagcggccggacgagggggaaacgggcgcggaagatccggtcgccattgatggcgccggcgaggttaggagagaggtttccaaatgaatccgagggagagagggagggaaaaatggggggaaagagggagggaatcacggggaatatttccccccctcttgattgcacgcggggcggacgggggcggcgggattcacggcggcggcggcggcgctagggcgcgggcggggcggcgggagcggcgggaggaaggggatgacgggtgggccctacccgtcagcgagggaggcgggcgggcccgcccgtcagcggcacgcgcgcggggaggaggccgaatgggccgcggggagaggagagggagggggagggagctgggccggaccggcccaagagggagagggggagggaaagggaacttttttagggtttttctttttataaaacctttttaactttgtttatttcttcttaattattatttgtgctctgaaaattcaagtaaaatttgagggctccttttagaccaaggagaatttaacaaaaattctccgggccacattcgaatttttctggtacgtattttagtgtttgccaatttcttttcgaattttaatttaattctattattccttttagggaatgatttttatttcgggatgaatttatcaggacgtgacagacgctcggtggaggccatggtagaggcgggccgcaaggcacaccgccggcacacttcagagctcgaggcccatcggagggagctggcggagatcgccagggaggtggaggaggagcgggagactgccctcatcgccaccgccgtgctgaacgaggcgcgggacgacctccgcctccaatacgggaaccgggcggcggagctagagaagaagctcgacgccgcccggggggtccttgacgccgccgctgcccgggaacggcgggcggcggagaacgaggcggcgtcccggcggcgcgaagaggcccttgaggctcgcgccgcggcgctggaagagcgcgcccgcgcgaaggagagagacctggcggaccgcgaggccgccgtcgctatccgggaggcaacactggcggcgcacgaggccgcctgtgccgaagaggagtccgcactccgcctccgcgaggatgcgctcaccgagcgggagcgagctctcgaggaggccgaggccgcggcgcaaaggctggtggacagcctgtccctccgcgaggcagcgcgggaggagcaggcgcgccacaatctggaaggtgcccgcgccgagagggccgcactggatcagcgggccgctaagctcgaggcgcgggcaagggagctggacgcgagggcgcgcagcggcggggcggccgcaggcgacggcgacctagccgcccgtctcgcagccgctgaacacaccatcgccgagctgcagggcgcgcttgactcgtccgccggggaggtcgaagccctccgcttggcgggcgaggtagggcccggcatgcttcgggacgccgtctcccgtctagaccgtgccgggcgacaggcgggcctctggggagggcggaccgcgaaatacgccgccaaccaggggggcctcgcccagcgcctctcagagatggccgggaccctccagcggctccccgaggagctcgaggagacgatcaagtcatcctcgagggacctcgcccgggggacggtggagctcgtactggcaagctaccaggccaaggaccctgacttctccccgtgggcagcgctggacgagttccctcctggaaccgaggatggtgcgcgcgcgcaggtccgggacgccgccgaccacatcgtccacagcttcgagggtacggctcctcggctcgtgttcgccctcgactccgacgaggagggcggtgacggtggtgcggacgacagcgacgatgaggccggcgacccgggcgcgtcggcgtgagcccccaggcccccgccaatcttaaatagctttttctttcttcttctgaggccttcgggcccccttcttgtataaactaattcaatctgcaatcaaataaagaagaaatttttgtgtcaactctgtttgttgagtgtatgagacgaggatggtctgtgccgcggtccttctttgtcttggattgaacgagggctcgtgcccaggtcccaacctcaagcggcgcgggtcggggctagtgcctagggagatccgcgtgtcgagactggccaggccgagaacgtggtgaccgagggttatggatgacccgattgtgggcctttgccgattcccccccggagttcaccacgccccggggcacggctcggttctgggccccgtttggcgattttagccggcccgggccaccgagggcagggtcgggcacgagcatgctacttcaagccaagattcttcaaaaggaaacgatggcacagacacagtcctcaggaaatcgaaaatgcttttattgaaatacggaagagaaaaaaagataaggatatgcatgtggtagcccccggccaaccctgcacgcccgggggggtgcggggttggcccgagcccgagacctgacacccgactcccactaggggtagaagcgacgaaggtgctcgatgttccacgggttaggcagctctgtgccgtcgcccgtggccagccgaacggagcccggccgggggacgccgatcactcgatacggaccctcccacattggtgagagtttgctcagtccagcacgcgtttggacgcggcgtaggacgaggtcgtcgacgcagagtgatcgggcccggacgtggcgctgatggtagcgccgcaggctctgctggtagcgcgcggctcggagggccgcgcgccgccttcgctcttgcaagtagtcgaggtcatctctgcgaagctgatcttgatcagcctcgcagtacatggtggcccgaggggacctcagggtgagctcggatgggagaaccgcctccgcgccgtagacgaggaagaaaggcgtttccccggttgctcgacttggcgtggttcggttcgcccagagcaccgctggcaactcctcgatccacgagtcgccgtgcttcttgaggatgttgaaggtcttggttttgaggcccttgaggatttccgcgttggcgcgctccagttggccattgcttctggggtgggcgggggaggcgaagcagagcttgatgcccatatcttcgcagtagtcgccgaagagctcactagtgaactgggtgccgttatccgtaatgatacggttaggcaccctaaaccgagcagtgatgcccctgatgaatttaagcgtagagtgcttatcgatcttgatgaccggataagcctcgggccacttagtgaacttgtcgacagcgacatacagatactcgaacctgcccggggcccgcctgaacggacccaggatatcgagcccccagacagcaaacggccacgaaagaggtatggtctgcagggcctgggccagctgatgggtttgcctggcgtggaactggcacgccctgcaccgccggaccaggtcgactgcatcgttgagagccgtcggccaatagaaaccctggcgaaaggccttgccaaccaaggtgcgtgaggtggagtgtgctccgcactcgccttcatggacatcggcgagaagctcgacgccttgttcccgaggaatgcacttcaggaggactccgttagccgcgcgccaatagacggtccctttcaccagcacgtagcgcttggagatgcgtcggacgcgttcactcccttcgcggtcctcgggtagagtcttatctgcgaggtacgcctggatctcagtgatccaagcaatcaatctaggggagccgggaacgctcccctcgggtcccgaggcctggactccgacgggcctcgggggccgttcaggcgcgtccgtctcccctagggggtcgggtcgcgccgacggctgggcaagcctttcttcaaaggcgcccggtggggtctgggctcgcgaggaagcgagccttgagagttcgtcggcgaccgcgttatcccgcctgggcacgtgccgaagctctatcccgtcaaaatggcgctccatacgccgaacctggcgcacgtaagcgtccatctgcgggtcagagcactggtactccttggagacctggttgacgaccaactgggagtcgcctaacaccaggaggcggcggatccccagtccagctgccactctgagtcccgcaaggagtccctcgtactccgccatattgttggtcgcccgaaaatcgaggcggaccatgtatctgaggacgtctctgctcggcgaggtcaacgtgacccccgcaccggcgccttgaagagacaaggagccgtcgaactgcatcacccagtaggcggtgtgaggcagctgcgaggggcccgagctggtctcggggacggagatgggctcaggggccggggtccactctgccacaaagtcggcgagggcctggctcttgatcgcgtggcgtggttcaaagtgcaaatcgaactcagagagttcgattgcccatttcaccacccgtccagtaccatctcggttatgcaagatttggccaagggggtaagacgtaaccaccgtgacccgatgcgcctgaaaataatggcgcaacttccttgaagccatcagaatagcataaagcatcttctgggcctgagggtatcgggtcttagcgtcccggagggcctcgctaacgaagtagacgggccgctgcacctttcggcggggccgatccccttcgctaggggccgcatctccagggcgctcttcgtccgagaggccgcgcggggcgcactcggcttctgtgccgacgacctcggggtcggaggtcgtcgggcgacaggcgcggccttcccgcagtggccccggggccatcctgggggtcgggggagcctggcaccgtcggacaagcaggcggagggccagctccggccgtcgggggcctcgggccgccgttcggctcgggggcctctcctgcctgctctctcccgggtcgagtcgacacaaggtggggatgcgcggggtgagggttgtcctcgtcgcgctccacaaccaacgccgcgctgaccacctgcggggttgccgccaggtaaagtagcagcggctcatctggctccggggcgaccaggactgggggagaactgaggtacgccttcaactgagtgaaggcccgctcagcctcctccgtccagataaacggcccggagcgtttgaggagcttaaataggggtagcgccttctctcccagcctcgatatgaaccgacttagggcggccatgcagccggtgacgcattgcacatccctaagcttgctggggggggcgcatccgctctatagctcgtatcttctcggggttagcctcgatgcctcgggcagagaccaagaacccgagaagcttgcccgcaggcacaccgaacacgcacttgtcggggttcagttttatgcgggcggagcggagactttcgaaagtttccgctagatccgagagtaaggtctcttggttgcgcgtcttcacaaccaagtcatcaacataggcctcaacattgcgtcctatctggctacccaaagaaattcgagtagtgcgttgaaaagtaggacctgcattctttaacccgaaaggcattgtcgtataacaataagttcctatgggggtaatgaatgcagttttttcctcatcctccctagccatgcgaatctgatgataaccagagtatgcatctagaaaacacaaaaggtcgcaccccgcggtggagtcgacaatctgatctatgcgtggcagggggtaagggtccttaggacatgccttgttaaggtcggtgtagtcgatgcacatccgaagcttgccgttcgccttgggaacgacgaccgggttcgccagccactccggatggaggacctcacggatgaatccggcctccagaagtcgcgccacctcctcgcggatgaaggcttgacgttccggggcctgccgccgcactttctgccggaccagccttgcgcccggccgcacggcgagacggtgctcaatcacctctctggggaccccgggcatgtcagccggtctccaggcgaagacgtcggcgtttgcccgcaggaaggagacgagcgcgtcttcctatttgccgtccagaagaccaccgattcgtgtggtcttggacggtccgtcgcccagggcaacctccttgaccgggacctcgtcacacgtgatcatccgctgccttggggtggctgggacggaggtgctgagcctctcgttgccaccctcgggcttggacgcggcggcgaggtggtccgcgcgctgctctatacaagcaagcgcgactttgaggtcgccatggacagagatggggccaccggggcccggcatcttcatctggagataggcatagtggaccgccgccatgaacttcaccaacgcgggcctccccaggaccgcgttgtagggcagactgaggtccgccacatcgaagttcacccgctccgtgcggaagttggcggatccaccgaaggtgaccgggaggtcgatatgacctagcggccaagtgtgccccggcgtcacaccgataatcagctgggacggccgaagcaccatccccggggccttgatggcgtcaaaggctgcgggggaaaggatgttgagggctgcacccccgtctatgaggacacgccccaacttcacgttgcaaacggtgggggaaaccaccatcgcgatctgtcctccccgggcaacgcacggcgggtggtcggtctggtcgaaggtgagggcaacctccgaccaccgcgcccgccgcgtcgcctcatgggtaggggccgcggccagaagctctcgcttcatggccttgaggctccgacgagaagcgtgagcgcacgctcccccatcgacggtggcgatggtggccccaggctcctggaaccctaggtcatcgtcgccatcgtcgatgtcctcggcgggggccttctgcttggcctcacttcgccggttgccggagggagccgccggggccttgccctcacggcgctcctgcctcctctcctcctcccacttcctcgtccgctcagccaaacttttgaccgcgcggcagtccgcgaggtcgtggagggaggtgttgtgcacggtgcaccacttgccggtcgggcgctccctgctgggagcgccggcctccttctttttgtcgctcgcaggcctccccttttgggtggcccgcgaagctccctcgacggcgaggacgtgtccctcgtcgttggaatgggccgacctcttcttcctcctcctgtcccgccgccctgaccgagcggcggatccgggggcggccgaagctgccacaccggaaccggtggaattccaggtccaggcctcctccttgcgagccacacggtccgcgagctgaaaaagctccgcggtggtctggggctccttggaggcgatattttcgagcatgcggttgtgccgcacgccccccctgaacgcgtagattaccgcgtgtgcggggatgcatggttgtgtgttgcggacttgacaaaaccgctgaatgtacgagcgaagagactcatcgtcccttcgctgtaccgcatgcaagtcggcttcttcaactgggcgcggatatgtgccttggaagttcatggtgaactgctggcacaaatcctcccaagagtggaccgacgcgggtggcaagttcattagccaaccccgcgcctgtcccttcagggccatggggaagaaattcgccatgaccctgtcgtcacccccggcggcctcgatcccggtcgtgtagacctgaagaaactcggcggggttgacgcttccgtcatatttttcggtgatggtgggccggaaccttgggggccaatggacgttccgaaggctcgacagccgacaccaccaaccgggggcacggggggctggtccccgcacccgaaccgaaatggcgctccggacgaggaagcgccttccgttgcgtgggcagcacgacgaccattgcgccggcgctcgatactgaggcgggcatccggccccctacgcacatcttcttgggtcggaggcgttgacgagggaatggctgacgaacggcgggtaacggccgccgctcgccgcgccctccgcctcgacgacacggagccgacggtagcagcgccagaggccttggtggcggaggaccgcccaccggcgcctaggcgctgctgtgccgtcatgaccaagtcggccacgtcatccagccaacgtcgggctggagtctctggatcggggacgacaggcgggtgacgcaagagcgcgcccgcagcttggagcgcgccctggggcgtgctaccatcgccgtagacgaggaggcgacgctccccgtctcgccgtccttcttcatcgctcgtgggcggcgaagtcgtggatcttttgaccccctcgagcgcctcctcccacctaagacttcggcgagaggggggcggtggagtacgagctcgacggcgcgggttctgctccccgtcgtcaccgctagcgcttggagagaggttgtgcgccacttcccgttcggccattgggctgagcgggagaagcttggcgcacacgaaagaggacgagagcttagaaaaacacacgcgccccctacctggcgcgccagatgacggagcgtggggctcctcaccgggagaccgcgcgggcccccctttgccggttcggccggggacgctaggtgagattctaagccctcgatctgtggaatgtttcgtgagagagcaaatgcacaagacacgggcgatgtagacaggttcgggccgctgagaagcgtaataccctactcctgtgttctggtggatctgtgtatgaaggagttacaaagagctggagagcaagagagttcaaactctagagaccctctccctctctctctcctctatgagctccgctcttcctttcacgagctccccttttcttctcccttttctcttcctcccgttccccccgtcctggtaggcatggtcctccttttatatctcaaggggataccacatacaccatttctacctaccttctttttgggtggggacccatctattttgaccaaaacttgg

SEQ ID NO: 48046 - DNA, 1855 bp, Oryza sativa
tctttttgtcgctcgcaggcctcccctttcgggtggcccgcgaagcgccctcgacggcgaggacgtgtccctcgtcgtcggaatgggccgacctcttcttcctcctcctgtcccgccgccctgaccgagcggcggatccgggggcggccgaagctgccacaccggaaccggtggagttccaggtccaggcctcttccttgcgagccacacggtccgcgagctgaaaaagctccgcggtggtctggggctccttggaggcgatcttttcgagcatgcggttgtgccgcacgccccccctgaacgcgtagattaccgcgtgtgcggggatgcatggtatggtgttgtgaacttgacagaaccgctgaatgtacgagcgaagagactcatcgtcccttcgctgtaccgcatgcaagtccgcttcctcacctgggcgcggatatgtgccttggaagttcatggtgaactgctggcacaaatcctcccaagagtggaccgacgcgggcggcaagttcattagccaaccccgcgcctgtcccttcagggccatggggaagaaattcgccatgaccctgtcgtcacccccggcggcctcgatccctgtcgtgtagacctggagaaactcggcggggttgacgcttccgtcatatttttcggtaatggtgggccggaaccttgggggccaacggacgttctgaaggctcgccacaaaggctcgacagccgacaccaccaaccgggggcacggggggctggcccccgcgcccgaaccgaagtggcgctccggacgaggaagcgccttccgttgcgtgggcagcacgacgaccattgcgccggcgctcgatactgaggcgggcatccggccccctacgcacatcttcttgggtcggaggcgttgacgagggaatggcagacgaacggcgggtaacggctgccgctcgccgcgccctccgcctcgacgacacggagccggcggtagcagcgccagaggccttggtggcggaggaccgcccaccggcgcctaggcgctgctgcgccgtcatgaccaagtcggccacgtcatccagccaacgtcgggctggagtctctggatcggggacaacgggcgggtgacgcaagagcgcgcccgcagcttggagcgcgccctggggcgtgctgccatcgccgtagacgaggaggcaacgctccccgtctcgccgtccttctccatcgctcgtgggcggcgaagtcgcggatctttcgaccccctcgagcgcctcctcccgcctaagacttcggcgagaggggggcggtggagtacgagctcgacggcgcgggttctgctccccgtcgtcaccgctagcgctcggagagtggttgtgcgccactgcccgttcggccattgggttgagcgggagaagcttggcgcacacgaaagaggacgagggcttagaaaaacacacgcgccccctacctggcgcgccagatgacggagcgtggggctcctcaccgggagaccgcgcgggcccccctttgccggttcggccgggggcgctaggtgaggttctaagccctcgatctgtggaatgtttcgcgagagagcaaatgcacaagacacgggcgatgtagacaggttcgggccgctgagaagcgtaataccctactcctgtgttctggtggatctgtgtatgaaggagttacaaagagctggagagcaagagagttcaaactctagagaccctcttcctctttctctcctctaccagctcaggtgttctcccctttcttttttctcttaagtgggcaaggtcctccttttatatctcaaggggataccacatgcatcacttctacctactcttcttttgggtggggactca

SEQ ID NO: 48047 - DNA, 7477 bp, Oryza sativa
ggcccgacccctcggggagacagagggaggggcgcccacatcaccctcgggcccgaccccccccccccgagggggtcaggccacgtgggtgaccacggctaccccaaacctctagtcaagatacccccggtcccatgtcaccgacacaagggtgtccccagtgtcaggcggggggcggcgctgggcccctactcgaggacggacgactgcttagcttccgggtgaaggcacgaatggtggtccgatccaagcggagtgggttcctctcccgtgaaggagtaggtagaggtggtgcatgtggtatccccttgaactataaaaggaggaccttgcccacctaaaaaagggacgattctcagtaagcctaagccccggggaagaagagtgagagtgctccctggagtttaggaaccttggtaacactcaaccttaaatcccacgcgcaggagtagggtattacgctccatagcggcccgaacctgtataatcccagctctcacgggcggtctcaggagactctaggcggatatacgttcttgatcagcgcgccctttcccccggccgaactcacaaaaagggggggtctctcgatcacccgctagagaggatcactcctcgacagtcgtcgttgtcgcctaggacttctcgcaacgagaagaggtggccgaatctcggctaaagaggagaggtgattgggtctggtatgccgtcgtcgcttctccatcacgcatcggcatccctcttctcatctctgccttgctagccgtgcagagggattaaggaagggaagagagatgctgtcagcggcgacgaccaagggccccgtggcgacatcgtcgtcatgtgtggagctccgaacagtaggaggacggcggtggcgcgagacacagacctcccgggcgaaggagcgccaaaaagggaggatgcggtgactatagtggccatgtccatcgttggtcatgcttgctgctgttggcgccgagccaaatcaccgatttctcacattgtagaagagaaaagaggggagaaagcagaaagtggaagaaggaataagggggaaaagggcaatgtgaatccaagggaaaaatagtggcatatttcaaatatatgtaaaattataatggcaatgttactaaatcgttaatactagtagcatatttcaaaaccgacatatttctaatggcatgaattcaattaaccctaaaagttagagaccaacgagaatccctacccttactagtgtatagtggcggaaacaggggtagggtagctagggctgctgccctactcctaagcctaaatatccattaaaatttacatgtcaaaacctcaaaacatggaagataaagataaattatgtacattatactggttaagccctaggcttgagaaaattctggctatgccactgctagtatatacaacaactaagcatattatcgcctctcatgcctcatgggtcgacgcccgaaactttggatcaccacgctacctggtccccttcctcctccatttctttgcattaatgtcagcaacgaggggaagggctgaaggggatcggggatccgtatgatccctagggccccaaaaacgatatttggcgaacttattcagttggaccacacctatattgtaatacccttgcgcttttgtcctcacttaatgcaaaaaggttcgaatcgatattactaatgatcaagcaactcaccttatcaattaatgtgcatcaagcttgatagcggagatatgcactaaattggacataatacttcattattgacttctattttcttaacaaatccattccttctatgttcttagctcatgccactcctatctagtagccaattgtccaaaaaatctagattttaactcaataaacataaggatatgacatttgtaattgtcgagtaaatgctcgttcaaaaaaaaatgttgagtgaatacccatcctttaaagctacggccgccactattgggcatggtcaccggtatctggcagttatggctattgtgtctgggtctgacaaagaaatattgcatatcagatcgatgttatttttgctctatatgtgtccaaaccgacccattgtaatcctacccacccatagatctaaggtgcgaaatagtccaacaaactaatatatttacatttgttttgacgccatatgaaatttgcagtcaaaacttaaacttgtaaattatttatagatgagaaaaatcaagatgtaaaatgtgaaatagtaccttcttcataaaaactctttcataaggagtagtatttcatatggcgaatatacattccttattatatgttgggtagacaaggggtaggggcaagtcaactcgtgacggcacgcctcgccacgacacgacacgacacgacacgagagagatctcggcgccggcgggcggcgccggcgaggcgtacggcaatgcctccttccgccgtgcccttctcccgtcgcccatccgacggtccacgcggcgcccgccccatcctggttgtgatcctcatcgccgccgccgccaccctactcgccctcgcctactcgtccttcccctccgcttcgcgggctaccaccgcatcatcttccatggctgtggcgccgacggatgacggctgctgcaggggcctcgaggggctcgagctgtggggtccggcggtcaagtggggctccgaccaccgcctgctctccgccgccgcgtgctgcgaatcctgcaaggccatgtgcaaggccaacgactgccgctgcgattcctgggtcttctgcggggacaagaaaagatgcggccaaaggttcggggaggtccgttcgcccacccacccactgactattcattctccatttctactggagtagctataataggaggagtatttctgtatgaccaaaccccaaattcagttttagtcactcactactcctgcatatactaatatgatattatataatcccctttcgcctgcttgcaatgcagtgctggctgaagaaacaaaaggatgtgatggcaccctctgttgttgcaaagggagatgatgttatgtggacttctggtctagtcttcgcaaaaggagaggttagtgtctgtctcgcctgattcccttcaaatcccagctgtttcatgtgctccctgcctctgcttaatttgaaatattttggttccaatccaactagagaatgtgtgtgtatcaccttgcctacaagtttggaacgcttgtttccttatgctttcaaacaaacaaaaatgtaccaccaattcataccatgattaattcagagatttataatttaataatgcagggcattgtgggcctggaaacaaacttgggaccattcgtattcaagtaagtgctctttgcctctacaacaaggcaacaatattttgaatcttctttagtgttcaatcaccgaatcaagaatgttacatgtaaaatgctgtgcaccggggcccggggccatatacagctatagttgcatccactgatctaagatttctcttagcaattattttatttgcatatttttctacatgtatctcattttcagtattgtgcacttacctttgggcaatgtaaaacccctttttaatagaatggccacaaggtagatatcttttgtcaacaagaacattagatgcaggtagagatagggaagctggcggagtggtgtagtgtcatttacttttctttccatgaatctgacacattttttgtttactcattaagcattcattcaagccaacaaagatatggtgtgctaatcgtgttgcttctcctctgcccatcaggggtttttatagaatattgtttgttccaatctgttctactgagaacatggtatatgcttgttgagaattggcaacaacaaataatgcactggggttacatttgctacatggattgtttggctatatagagagccatggcaaacacatgagattatggatttaatatgtgtctaagagtaaaaccatacatgcatttaatgtaagaccgctaagctgccaagtgaatatcgatcattagagattatgctgttagcccaggttgctctgtcaagaagtttggatggtaatttcttgacattttgtgcaggtagttctaattctgtcttctggataatccacttgagttgaatggaattatactgtatctgcgatttttcaccatgtcttccctttctaatatactttctttgcatctagttgctgcctggctgtgcaccccattctgtggactatttcattgaggttctgggcttgcggaactgcgctggatgcagattttatcgagctgaaggccgtgggaatttgtgggatgcaaaaggcgaccacataaaaaatgtatgtcttctatgatcgattgcatgaaagggttccaatgtcacatttgggtttggacttgttggtgacaacaattataccctaatgccccttgtttttgtgtgactaggctgcatatggtccaccgtatgccttgcttcaagggacactggaagtcgatggtttaccctttaaggagagagcgaaagaagcctgcccagcactgagaagaggatcggttgcatgggttggatcagggccggagttcttgatcagcttagcaaaccatggggagtggaaaggagcctacactgtgtttgggtctgttgtgcccgaggacatggcgattgctgaggaaatggcactgctgtcgaccagcacagacgtgtggagcaatgtaaccgtgaaggtgctgcgagaccctgtgtatttcaaggtgaagagaagcaccagcagtggtgttccttaggtatcactcattcgctcactcactttcagtcggttggtcggttcttgtgctcattgccgattcctttctggactatctttgtttcttatagaggacataaaagaaagggaaactagattagaatcaggcatgttatagcccctgacatgtagtagtattaccctaaagaaaaggggattactgtgtaaagaaagaaactaaagttgccatgttcaactgtttacctgctcatctttatgtggtctgataagtgatgatgatgtttcagaggtttattcacttatactgttatagtacatactagaagagtttcttcttcttcttctgtcaatagtatatatacttctatttctatataggtagatagaggagttcaatcttggctatatatactgttatactattccaaatcttaaatggcctccctagtccctaatatacatatgctctgctaatgcttgtaatgggctactgaggaaaaaaaagcagtaatgggtctgggccggccgaggagaaggcccacgagcgtcatctcatgacggtttcgcctctctctcctctcgttctccctcctcctcactcggaaaggaaaagagcgccgccgccgccggcgtgatgcttcccttcgaggagcaggtggtggcggacctcctggaggaccccaacggcggcctggtggtggtttcgtgtggcctcccggtggcctccctggcgtccgccgtcctcctccagctcttccaccaatcccccgacgatggctgcttcctgatcctctccgcccccgagccggtcaaagctcaaatccggcggcgcctcctcctcaactcccagagccagcctcctctcttgcagctgcaggtccacgacgtggccccagacctccccgcccaccaccggtcgccctctacgcctcccgcgccgcgctcttcctctccccccgcgccctcgtcgccgacttcctcacctcccgcctcctcccctcccgcgtccgcgccctcctcctcctctccgcccaccgctcctccgacacctcctccgacgccttcgtggctcgcctcctccgccaccaccacctcctccctgtttatgccttctccgatcgcccccatgccatggtctccggcttcgccaaggcggagcgcgctatgaagagcctctacattcgacgcctccacctttggccccgcttccaccttcttgctgccgctgacctcgagcgctccccgcccgaggtcatcgacgtccgcgtccccatgactcagcctatgaggggcatccaggccgctatcctcgatgccatggacgcctgcctcaaggagctcaggcggaccaacaaggtcgacgtcgaagacctcaccgtcgacaagggcctcttcaagtcttttgatgagatcgtcaggaggcagctcgaccccatctggcacacgctcggcaagaagaccaagcagctcgtcgccgacctcaggacgctacgcaagctgcttgattatcttgtcaggtctgctcatccactccataccttcacctatcattctgctccattaagctgttgatgattattccttcctggatggcatgaatcgcacacaaaaattctcttattcaaataataaaacttcttaggcattctctaggtacgatgctgtgacataccttaagtacctggacacactcagagtatctgaaggcgtccgatctgtttggatatttgctgactcaagccacaagatattcgacctttcaaaaaggcgtgtctaccaggttgtgagagcagacggtacaaaggttgcagcagacaacaagggcacaccaacaaagaagaggaaggtggcacgcgctagcagcaggaaaggaaaagaaactggtagcggctaccggccatttcctttcaatcgcaactaatgccttttcttaaagaatttagatataggcctcttaatttcatgaaaaaaataaatattttccactcaataggagtggctttaacgactttccactgcatagatactaattaattatttgccactccatagacagtcttaatataagatcttcccagtcattttctttgcgatcaccccaaaacaaaacgcagtggccacctatcttgttgctttacgcctcctctaaccagacttggtctggtcaaataagctcaagcagagctgatcaggggacatgccacttatcttcttccctgacttctctatccaagcgacaatacaggcgacatggcacgccggcgccggcaccgccaaggaaggtgcactagcaggggagccattagcaagttggatcctggagccatccccaatccccctttttggagtaaatttgcacaaaatcaaagaagtagcttcttctttcatctactcagcatcatccttgggtcgcatgaccactgttttgcagtttgcacaatcatctgcactctccactagttcacatgtcccctgcatcttctagccaggagcaatgtgttggagtcagcgacgctggccactgctggtcactggaccatgaggcggcggcactgctgcagttgaagcatcccggcactgtctaatcagaggcaaggaagggaggggtaattttggaagaagaatatgtgtgcctggcatttagaggggaagttgcagagaaagtggcatttcataaagctcatgtgtctatcgggtggca

SEQ ID NO: 48048 - DNA, 5425 bp, Oryza sativa
  unsure (1)..(5425): unsure at all n locations
ttgttagagaaattgaagtatacaaggcagaaaatccatcgatgaagttaaaagtttactttcttttttatgaagattctgccgaggtacaaaaatttgagtccagcattcgccgggaaaatgaagcatttgaatctttgatcagacagaagtcgctgatgatgatacctgttgatcaggtggtgtaccactctgctaaaattcgttaaatcatcaaggattaatttcagcttgatccttgcgtaatgttcactagtatatgaatgcagacatactatgcttgattaaattactattacactttttatctaatctacatgtgaacctcatattgtacttatcttagctgtcagtcaaccttatgtgagcaaaagtgccggtgtgcacatggagaaaattccatatatttccctgatacatgaaagcacatctgtcttcttttcagaatggccgttgcattggaccaactcttgcaaatgaaccagaagctcttttatctcaaaattcactaacaagaaaggcaggtggtagaaagccactagagaaggagatgcaggtgatgcttccgtccattattttgactaaggaacaatattatttgcttttactggctgaattgctgagatgtttattgttgcatatccttctaggttattgtggacatgagagaattcatgagcagtcttcctaatgtattgcaccagaaaggtattcgaataatacctgttaccttggaagtcggtgactatgttctttctcctttgatctgtgtcgaacgaaaaagtattgcggacttgttccaaagctttgcttctggtcgtctctacaatcagattgaaaccatggttcggtattacaagatcccagtgcttctgatagaattctcacaagacaagagcttttcctttcaggtaccccctcgccctcctctgccatgcattttcttttcatgctactatttgccaatttggtaggatattcgttcttagatggatggtatcttgctccctacaaacagccatcccatgttgtctttcgatcttgagcaaattttaatccatttccgactatgtgctattttatattggttttcgtgttcaaaggtgctgaatggtctgtttatttttcagtctgcaagtgaaattggggatgatgtatctccgacaaatataatctcaaaactttcattactagtcctgcattttcctcggcttcgcatagtctggtctcgcagcttgcatgccacggcagatatattcctatcactcaaaacaaaccaggatgaacctgatgagagcaaggcaatgagagttggtgtgccctctgaggacggagttgtggagaatgacgtgaggtaagttgtttttttttgtatttggtaacggcataacgcacgcggaagcatacttatatctgatctactctcctcggtaaaatatgttttcgtcagggctgaaaattacaatacgtccgcgattgaattcttgaggaggcttcctggtgtgacagattcaaactatagaagaataatggaggaatgcaatagcttagcagagctggccctgcttccggtagagcggctgtctgagttgatgggtactcagaaaggggcacgcatgctcaaggaatttctcgatgccaagtgtccaactatgctctagggctgtgtaatcttgtttgtaattgttgaaaatgatcaataatgaacttattattctacttagtaaaaccgattttaagatgtggatggtgaagagtgatgaatgtacaacccttactagaaagcttgggtcactcggtcgctaaaccatcttgcatatggtgctgttctcacaatttatttacgaggcggttgtcacaatttaactcttgcattcttttatgaaagatctgtagattttttttctttttacagagatggagttatccgaggagatgcggaggaaatgaacaatttaaattcgttgggagacagaatgggtaaatgggccgaaggaaagcccatctagagagcaggaaagcccaagtattaggccttgcctcctcctttgagggaggtggacggcgccgccagcagcggaaaggaaaccatggcgctcgccgcccttgagaggtgcttccaggctgtcccgacggacgccgtcgcgggcatcgtcgactgcgtcctcgcttcttcgtcctggtcctcgccctcgcagctcttccacgccctcctccactccgaccatgccgccgcgtcatctctccctcacgccgccgcgctctgccacctgctcgccctgctcggtaagacgaagaagaaaacccctatctactccgtcctactacagaggctacagaccgaagaagaacttatacatgatgattgattgatgaaatccagatcaggagcggccggcggaggattctgtgcgcgcgctgctatggagggtcttcctgccgctgcttaggcaagaagaccagctccagcacaccattgccttgatgtgcgatgccgtctccaccaaccaatccttctctgaccttctaggagctaccatcttgcccttgtgtattcgatcctccgccatcgccatggatatggatttggattccactctactgtttgtgtaccaaactggggaggacccgccgcctccagctccaggggggcttcttcttctaccaatctccaaggccaccgctgtcctggcgtcgttgctccaacacacattggagaggaacaggaagagcacaagcctcaatgcgctgctgcacaatttgacctgggacctctcctcgctggcgctcaacatgtttggccacagccaagagtatcgatcctgtgccacccgggtcctcctacaccccctgctcctttcgctcgcggatgtttcctgtgtcaccgtgcacctggagttggctgcagctcctcagcttaagctctcaaggtttccgtttcctcttctcttctcttctctcctcttctatatgcgcctgcctcaccctacctactattgattgtttgtctcgtgcaggtctggcttcttggagtctatatgggcctcctgcctttctctctttgcactggggcctgctgagcgcctggatgcttataatatactctctctctacttgtcaacactgaaacatgttatcttgggacctgatgagtatgatcttaggaattccaatgatttttgggatgaaattcgcaggggactggtgcgcgtttctgctctgactgtttctgctagtcttttagctctttatactcatcctgctgcttaacctcttcacaccaggttgacaaggattctttagtgaggaagcaggctttgtacatcttgagaatatcactagacatcttttcctcatctgaggataatggtgctcagcaatgctccaggaggaggtccgccgctctgcctgctcaagacaaatcaaatactgcaatgacaaaaagagaaaggtgggctcagaaagaggccaaatcccttggcattggagaaatgagccaatcagatgaaaactgctcaagtggtaaagaccggtggaaagttttcctgttactctacgagatgctccaggagtatggaacacatttagttgaggcggcctggacacaccaggtcagttggttcctacatgctctttctttaagacctgtatatctaagtgtcaacacaatatataccaggaacaacagtcatagcacagcaataaagtaaccacatgcacgttctattagatgggttgataaatttaaatattatttcccaggtaatgctgctgtttgagtccacaccacggagtgattactcaaatcacatgtcctatacagttttccatgctcagatggaatctttcgaaggatttttccactggatggtagttctttgggagcgtgggtttactcatgataatccccaaggtcagtactgacattgatatatacagagtgcatatgcttaaaacttacaatgttgtcttacaatctgctgttatcaatgatttttacagtgcgctacctggttatgcattcctttttggatattacatgggaacactacttggtttgccctcagatagttcccagaggctttgttcttggaccactgttacgtggtttgaacgatgtagttcatcacaaggattttggtcagttacactcatattacactaaattcaatataaaatcaacgtattcttctctgagtaatacaaagttctttttttttgttttatccccaaacatgtgccttttttttgtatgttttcttgtgcccatttcctttttatgagatattcttgaacctctagctatggggaatatcatattcttctacctcaaaaatccttgcctggaacactcgccacctaagcttccatttctttgtgaagtatagatctgaatatttcaaatggcagactacttgtgaaccaaaccaataaatgactgaagaagcctattcgttgatgtagccattctcagctcatatgttgtgtcatcctactttattagtacattatttggtttgatctttagctaccccaacttgcttgggactaaaggctgaatgcaaatttttgtccnngtgattattaccttccctatcantgctgtccttggacaggtgtttcactatttatgtttagaatttgaagttgaaattctaaagaatactgcactgctacatcaaaactacttagcaatttttcgtgctgattctgtgcccaaaccaaaagttgattgtgagtgcactacaaagggcgattatacttggtttgttccttgtttaaaacacctgagttgctcttacttttttgaaagagaaaaaaaatgagatactaagaagaaactgtttgcatcatgagattcttcttcttgtttgcaccgttctcttctaactcttttataatactagtatttgattattctttctggttctgttacanactgttcaacagtttattaccttttaagtactgagttgtctatctaactattttaggtgtgaagggtgtttatgattcaaaaatcataaaaggtgcagagaggttctttggtctttacgcacagagattgacaacacggtactgatttttaaacaactactaccttttttcctgtgttgcacctcgatgaaaacatggcatgcgaattctggtactttggattttggaaaggattttagttatcttcactactttcaatgattgaaactatggtggttatggtttggcctacaccacaccctgttctcatttccctacacacagaaattgcgcgccaacggccaacctgtgttctgtttatcttccccatcaatcccctccttagttggccatcaagaactcatgttcaaatccaaacacttctagtattaaaaacaacatgctttttggagaacgctttctccacatgtaaatgcgggtacatgga

SEQ ID NO: 48049 - DNA, 6233 bp, Oryza sativa
taattaccaaaaatctcaacttacatgctgcgtactccatttgtttctccaaattcccaaatttgtggcaaagttggagtaagtgttaaattataaattgtgtttctgattacaggcttagagcttcagttgaacgcttccttgatgttttcaatcctgatacttccgggactccttctggaatatttagttctcgccctgaggttcataacattccctttctcttctagtacaagtttaggataattgattcctgcttcttgaaaacaatttgtttgcttttttagacaaattctaggggtgttatggtttctttatgagaactgaatgtttgattcttttaagagaagtctgaataagatgatgttttcttaggtctcttttgactttgaatgtgttcctgtgtcagtgatggagcgagtaattaacttcctcaatgtaagaacttcaacctgatcttgcttttccttcattggactctaagctaatcatacttagctatgttaggatgtgagggaggatctgagacaatctatagcgaaggactcaataacaatcaagaatgaggatctcacagcagaaatgcatcacaaagaggacagaactgatgagaacatagttgagttgttagagcctagtcaagatgtgcttaattttcaaaagaaaatcacaccctataggaactttgatcaaccattaaacgttgggtgggatttcagttgttggcgatgacttttttcaagattactcttaggtatgtaaagcatccttgcaattttactattactcctttcttcacattccctcccaaaatagcttgcaagatggatttgcacaggcttgttactttcattgcgcttggtgtgctaagtttttatgtaatactaagtcattttgaagagctaagctgcggatgctcttattatctacaaactgagcttttgtttttgctccctacgctatttcacttgtccatgtgctgtcttgtttgctgggtgcagatctagagggagatgaccagcagttggatttagcgctagaatcaagaaatcacgctgtggaaactatcaagcaaagccagcagcaattaatagtagtagcatcattggtagatcgcatccctaatcttgctggactgacaagaacatgcgaggtatatatcggtataattcctgttattatccctgaaacgtgcatgatataatggtattaggtttttggtgacagatattcaaagcagttggattggccgttgctgacaaaagtattatcgaggacaagcagtttcggttgatcaggtatgtatatggctggcagatgtatataggtgatgatgatttatttgtgtttctctgacttggcatgcaaatatgcaatgcatgcagtgtgacggcggagaagtggttgcccatgatggaggttccagtgaatagcgtcaaagtgttcttggagaagaagaggctggaaggctattccgtgatagggttggagcagacggccaacagcaagccactggaccacttctcttttccgagcaaaacggtatataattagaagatccaaatccccccctctctctctctctctctctctctctgtgtgtatgtgttatgtttgcattactgcacataggaggagggaaaaaatcatacaaaaaaagaactaacaaggaaaatatatttattgacaaggtgcttgtgctgggacgggagaaggaaggcatcccggtggatatcatccatgtgttggacgcatgcgtggagatcccgcagctgggcatcgtcaggtcactcaatgttcatgtcagcggtgccattgccgtgtgggaatacacccgccagcaacgcatcgcaacttaatttctgtttgagcagaaatcaacttaattttctcaaagctgttccttgttactagtactcctactccatagtggagtctgtattatatgtattcatcaatcggttagaactagaaacaaatgagagatgatagtactccacttgtcttgcccgtacatacagcacaactctactgtcctgacctgcaccccagctattgttattaccaaaaaacccatatttgttcttgctagtaatgccacgcactacggcactagatagaggtgagtttataatacgaataaaacgtttgtgttggagtatcacttaaactttcctcgtcatttggaacagagctcgaaacgggggaaaaaaattcgaggattggttccgtgtatttgcatttgaaccttttattatttattactagtcgaggcatagaatattttgtaagctataggtaacactccacccgttacattcaagcacaataacaggatctctaattctatttgtgaggtagcaaagcatacacaatactatgttaattctacactaacaccagtgtattagtcctaataattttaatttaagagtaaaatacgttggtggtatcttaacttgtaacttaggtgtaatttatttactcatcttgtaaaatgctcaaataagtcaattatcttgttttcttttttcaaatcacataaaaaatgtgttatgtaggagctcggtattaagttggatgccatgttgaattcttttgcaaatatccacaaataagccaactgccatatgagatagtagaatataaattaagatgaattttgttattgcttgctatgttaaaacacgcaatagcagctagcataggtgaaaatataaatatgggtgctaatttgctattttattgattggcaaaaaatatgtaagcttgtcttgtccacatgtctcacaaaatgtatgcttggcccttatggcttccaagttagaaacaaacggtattttctaagatttgcaccatcgaaacaagattagcgactcatttgtgcaaattgtaagatgaatgactaaattgcatctaacttgcaaattgatactgctagtgtattttactttttaatttatttgcatgtccaatatattcttcctctttctatccatttctcttacagcatgtttggatgatgagttgtgaggggtgtgattgggaatgaaaatgaatgaaggtctaagatgaaaatgaaatgagatatgaagaatgaatggttatgatttaaagatatcctttggtggataggaaatcattttcctaacccattagccaaacatgtccttggagccgtgtatagcttaacctcttgtaggagggtagctcctctttctcacctcttttctaatccaacttatcatcggagcctacgatgtaacttgggctagtgttttgtatcttattgtacctactcaagttaattttaattttgtggatgtgtgctcttagagaggtacaattaatgcataagtgagagaaatagagataattttaaaggcaaaatttatgcgcactatttattcttatcggatgcaggtgactggttcgcttgaacgatagccacgcgtgagaggagtgctactaattaaatacaagcacagcaaattcaaagatttttttgtgtcatgcatgtctttttttctctcctttttatagttttttttttctcaaattacttatctgattacaccattgtatttattacaataaaatatttataacaagatatcacattattatgatgggagctgctatataccggtatcccaccggtatcccgttgggatactgtcccaacgggatcgctcctcttcacctccctgagacaggggagcacgggccactgtgggagcagcgagcgtagacgagctgacgccggcggcaccgacaacgagctccagcggcgccgacgacaagcttcggcgtggaggatgcggccgccggcgacgagctccggcatggaggacacggccaccggcgagctccagcgtggggcatggtcacatggacggcagaggatcctgcgtggtgatagagacggcgccggcgccgagcaccagtgtggggcatggacggcagaggatcctgcgtggtgatggcggcagcgccggcgtggagaacgcggccgcgggttgaggcgtggacgacggacgcggccgccggtgacgtgctcccaacggaggatgcggtcgccagcgacgagctccgatgtggaccgtggacggggaaggatgcggctgccagcgacgaggatcgggttcggtgtggaccgtggacgagggaggacgtggccgccgacgacgacacctcgacgcccagctcctgatatctagtaagtatcatctgatacctcgcaagtatcatcccgatacatcgtagaaatcgcgcgatacctgataggtatcacataatacctcgcgagtatcgcctaatacgtgataggaatcgtctgatacctgatgcgtggtagaatcgcatgatacctggtaggtatcacccgataccggctaggtatcaggcaagtatcaccatctatgtggtaagaatcgcatgatacctcgcaagtatcacatgatacgtggtaagaatcgcatgataccttgcaagtatcacctaatacgtggtaggaatcgcctgatacttgatggttatacctgatacatgttaggtatcaggtcctgataccttaccagtatcaggcgatacttgcgaggtatcaggtgatacttgatacctataaggtattaggcgattcctatcacgtatcatgtgatgcttgtgaagtatcaggtgatacttgtaaggtatcatatgattcttaccacgtagaaggtgatacttgcaaagtatcaagtgtacctatgaggtatcagacgatacttactagatatcaggtgatttctactgcgtatcagaaaccgaacacctacccggcaccaacgccgacaaccactaccgcccccaatctcccctggctctagccaccgccgccgccttgcccctccctcccctggctccggccaccgccgccgctccatcccccggatccggctaccgccaccgccgcccctcccttccctagctccggccaggcggccaccaccgtcacttcgttccctggctctggccaccgatgcccctcctctcttcgttgatgtatcccccgccggcggcttggccacgatgtgctgctgcctcgacgcgacgcaaacgaggtcctcgatgtagcaggagcttactgcgcagggctcgtcgccggcggccgcgtcctcctctcgccgagcgggtcttcttccccaaccgcgccgaaggtcctcacggacaggcggcagcgatctcctccacacgcttaggcgctcagctctcgcttctctttggataggcaagcaggacgaaggatcccatcccgacgggatcccggtatatagcatttccgtattatgattatattttgatgaaataaacatatatgttgcaaaatactttcactacttttattgtatatgtaaaaacattataatatatagatttattgcaatattatttaaaatgtactttaggactttaatattgaatccattcgtttatacaatattagttataaaaaaatcaatcattaccgtaccttgtaagcgggctcaaaagatgggagagacgagggggaaaagggctagagtagacgaggactgcgcagtggaggaggcagaggcagaggcgagagagatggagatggaggcggaagaagagacattgtaggcggcgagagagagagagagagagagagagagacggactagactaggcgcgattgccttgttgttgggtcgtcaagcccgatgaccatcgcaggaggaggagaggggatccctctcgatcgccgccgcctccattctctttatatccgccgcgctccccgctgcctccacctctctcctcctccgccgcccctccccgccccgtttatagatgaatgctaatggaggttgccaatgccatggatgccatcaccaaggagaccgtcgacctggttgctcatctacctcctccttcttctttcccctttataatataataaaataggatattattctcctatttaatttaattatctagtgatcgattccatctctgtggagtggagttgagttgagtggattaacatgcgggcattagttttgggttataatgaactccctccgtttcgaaatgtttgacaccgttgactttttagcacatgtttgaccgttcgtcttatttaaaagcttttgtgaaatatgtaaaattatatgcctacatcaaaatatatttaacaatgaaacaaatgataaaaaaagaattaataatta

SEQ ID NO: 48050 - DNA, 3280 bp, Oryza sativa
  unsure (1)..(3280): unsure at all n locations
ccaaaaaaaaagatatactaatatgatggacgcagttaattgaactcgcatcgatcgcaggagcacatccctgtggaggaggtgttggatcacctaaaatgcacgcgcgagggtctcacctccgaggttgcccagcagaggatccactccttcggctacaacaagctcgaggagaagcaggaaagcaaactgctcaagttcctcggctttatgtggaacccgctttcctgggtcatggaggcggcagccatcatggctatcgccctcgcacacggaggaagagatgccaggggaaaggtatattcttcatcatcatccactcttcttattgattttggacaactatagagtatacactacctacctagattagctgcttctaattgcaagtgcaaccatcaataaaccaaccacgcagagaatgcgcatagactaccacgacttcgttggaattgtactgctactctttatcaactctaccattagcttcatggaggaaaataacgctggcaatgctgccgctgcactgatggctcgcctggcaccaaaagctaaggtgcgtatacctctacttacctggacagctggacttccaattcataaatcattctactagttaattgaatttaacttatttctaggttttacgtgatggaacctgggatgaattagatgcatccttgttggttccgggcgatataatcagcgtaaaactcggggacatcattcctgcagatgcacgccttctcgagggagatccgctcaagattgatcaggtttttctggcagctcagccttctcctttgcatctaggactgtcgctcaattctgctaagaggaataactccgctacaaaaatatgcagcaataacaacaccacaatgtatcacttaatttgcagtctgcacttacgggtgaatcgctacctgtaactaagcatcctggagatggaatttactctggttcaacctgtaagcaaggtgaaatagaagcagttgttattgccactggaattcatactttctttggaaaagcagcccatctcgttgaatcaactactcacgttggtcactttcaaaaggtgagtcttcagcaaacaatgtctcttcaattggtctggcataagtttatattttgtttcctgtctcaccatgttttttcctgtatcatgtttcaccacatctgactgtgtattcattaggatacaaactgtaacttctgttgccaatgtcatgatcttggctgccatcgtggatgttttccaggttctgacttcgattgggaacttctgtatttgttcaattgctgctggaatggttattgagttacttgtaatgtacgctgttcatgaaaggaaataccgccagattgttgataatcttcttgtgcttcttattggtgggattccaatcgccatgcctacagttctttctgttactatggccattggatcacacaaactggcacagcaggtatgcctatacacagatggccagaattctctggttaccatgccccatgaaaagaactctggctaccaacgaattgaacagcattttagaagtgactacttcctttttattgtttacagggtgctattaccaagagaatgacagcaatagaggaaatggctggaatggatgtcctttgtagtgacaagactggaacattgacactcaacaaactgagtgttgacaaaaatttaattgaggttgtatgggttcttttagcatgttatattttcgtagctgtagttcattcattaaccacctactgagctaacattttcaaacgaagcacctacccccaccttcccttctgcgtgtgtggcccaattgaaatgagatatggaaagcaagcattttaatgcagtttcagctctgaaatgatttctcttacaatgattgtgacctttatcaataaatgaccatgagcatggttttaattttttaatccatgctgacccttcgcactgactattgatggcattgcaccaacatttatttgtaggtttttgaaaaaggcattgagaaggacgatgttgtattgatggctgcaagggcttcaagattggaaaatcaagatgctattgantttgctattgtttccatgttaccagatccaaaagaagtacaaaactcttgtctgctgatttccttcaaagaattacccattccagtgactcacttctacctatctcactcgaactaacaaatgtgcactgaggaacaatgtctatatcatcctgttctttggaattatccccattgtagtttgatctagacatttagtggctttcaactatcatatgattttacagctggggttggcatcaatcatctgttaactcaagtttacaactcaagtgttccttttgctctatctataattaattttctggttcgttgttacaaggccgatataatgttatcctatgacaatgagtcatattgttaggcatttctagtttatggtcaacttaactttcctatacacttctgttttattctcttctgtctgctgctaggcgcgagctggcattcaagaagttcatttccttccatttaacccaacagataaaaggacagctctcacatacttagatgctgagggtaaaatgcacagggttagcaaaggtgctcctgaacaggtatagattgactctgataataatcaaattcttatctctactattaaaaatttgaagatgtttccgctggaagtttggtacgtcatccgtgtttgagttggttgtatgtcgcttgtatccaattcaacgtgagtctggaataactattaaacaccccctcccagcccaacccaacaggcccacaccatcccaccgcccccccgcctccacttggggccgcgcgtgcccctcccccaatcgctgtcttttttttcttttttcttttactcctttttttccccaatcatcctgatcctctccctctccttccgatctccctttatcttttttttttctctttgatttctcttccaaatttttctcgtcataaatattttccttttgaaattatcattggttaaggtgtgtatgtggcaagtttgtcactttgcaaatactttccatctcaagtaaaaaaaatcactaattggataatattaatttcaatctttagtcgatgaggtataacaaaatacacgagtcaacttatggaatagtcacccgatcgatttatgaggctatgaaaaggtttacataaagggattcttcgtgtgatgacgcatgaaacaagcacaacggtttcagtgatat

SEQ ID NO: 48051 - DNA, 1177 bp, Oryza sativa
acttcttatataccctgatgttacaaaaaaaaaccctaaagtgttgatctacacagtacacctagtagttgtgctgtgcatcacaaatctgttctcaggattgcttagctattttgagcttcagaataattaggaagaacacttccgaatattcacacaaggagagtaaatccttgtataacagcacattgtttgagtgtttcccattttggtgaaatggaacaactatctataacagtctccatggcagttggaaggtacatggacagtggatatcaagcatagttcttatgggtcttgtgatgcacctgtagtacaacaaagctaaacatctaaagaatgaaaggttccttagcacatagttcatcctaaaactcgcaattaaacatcaatatgtaagaaaattaagcaataccaggactgaccatataatttggtattagatgattaatcaactttcatactatatagtttttgttcttttacttttggtatttcttgcccattatctaaaatttttaaaaatataatgcaatttcacctcctctactgttttctttcaaaaaataatattttttgtgtgtactgtaacatcaagaggaagttaaggattaaaacagtactttgaagactatgacttaagcctaaaaggccacattaatttacattcattgactgctttgaatttacaccctaaactggatacagtatgtgcgttattttttaatttgaaattcatgtgttccaaactgggccgttctgctgatctacacccttagggatagtagtagcactgtaaatctgtaataactgtgcttagccaacacctcaaatctgtaattcattatctacattgcagaattgctgatacatcctggactctgtcattatcaatgtggtttgttggaaatattttcaggtgatcagttggctattggtaaggagacaggccggaggttaggaatgggcacaaacatgtacccttcttcatctttgctgggtgacagaaaagatggtgatatcgctgtcctaccagtggacgagctgattgagcaagcagacggatttgctggagtattcccaggtacagattaattttctatctcattgttaatgtctgtcgctctaacttgttttccttccagagcacaaatatgaaattgtgcagaggctgcaa

SEQ ID NO: 48052 - DNA, 2575 bp, Oryza sativa
  unsure (1)..(2575): unsure at all n locations
tccatttttccaatctgatgcaggcttgcagagcttgaaaactggtactagatcagatatatcgtttttagcatttaggtaactcaacttgattcttgagggacttggcatgattaggagatatgattggtcacacaatgggtgagctgctaggatctttaagattatgccaaaccttgtaatattgttactgttgtaaagaatgtgaactctgcctggttacagttatttcacaagaatacatgtgtggtaccttgatgttaattttactgcagctacctataatagctcatctttgtttatttgcagtctggtattttttgcattcttgctgattccctgattaaaatggagatctactcagactatgtccaggttcgtgtagtcatttgcacttgaaaatacttaggtggattttttgtggaataatttattgaatggtgaattgcaggcacatcttgcacctagtggttacatgaaaatcccaactgtgagttttttatgacttgaattcttttttgtcatcaccctgaagacataatgctttttatgttgcttggttgaaattttaatttgatttttcaattattgccttgtagttacaaactatcagaaaaaaaattataagttagtaaaatgatgaaaacaccgatctttcttcaaggcatgataattactggaaatagaatttgatgtgtatttatgttaatgtttcgattaactgaagtttgcataaccttcctatgcttttcaggatatttcagattatttaaagggttgtagatttcttccaaagcttaacaatgagttaccaggtgaaagaaatgccacctacaaggaaaggtttagcagcttagagaatttggtattaatcatggtaagtttaatatagtccaaggttgtattttgattatgttcatgttcaacctccaagactgttggtagcatcggtttataagcgtcaacaattgtgttccttaactccttggtatctacttaggtttatccgatttctacttgtatagcgccctgactgttctagaattctggagcatatcaccagggtatagttgtatggacccatcagcagtaccctggtggcaataagataagttgggtagattgttggccgatgctgatcccctgctaacctgtttgctacctctgttccatggctaaacttgcttcatatgtggagctggagcttatgcagcaagccagcaacttggagttgttcatcattgtggtgtcaccgcatgtgttgaccattagttctatattagattaagttaataaaatctaatgagtttatgatattataacagtgctttcgaagagaaatctacacataatatttcattttaaactaagcatttgggaaattattgatggtccaatttttaagagtttgactaaatcttgtcctaaatgtaaaatatttatgaccagaggggggtaatttattactcattagtctgcctttagtgtgtttatccattgtttaatgtttagtttcaggatgacgctgtcttgatacctcgggaaacagcatggtttggttactatccagatggaggtttcgatcctgtcctgccccctcagaaggttgagccttgcattgcatgtagtgcaaatggaatgaagtaaatcctctggccttaacattggtagcaacatgtcctggtgttgtggttgcagacaaagctgtacatggaggactggattggtctcaagacgctggatgatgaggggagagtgaaattcgtgtccgtgccaggggggcacctgggtatttccaagactgacatgatgaagtacatcgtgccctacttgaagggaaaggacaatggaaaggcttggattgctgcgacttggcgtgccatcaccaacaccatcggtggggaagcgtttgtgctcaactagctactagtactagtatcatgttgcagcctctttcttggctctgatgatgattgtaaaaagatacaggtgtacagtgcaggatacgcgtttcattccctgtgcaagtatatgtattcctcatcatgtatacattcaccaaactaggagttcaagtaacaagtactcctatatatgaagacaaaattgagctgatcttacatgatggtatcacaaatgattcggagaagtagtaacaaatttatttgtgggtttgcggccaccctgggacttccaggcagtgatggcggtgagcagagagcggttgggcacaagtgtcttgtttggcatccgaacattggtgaccggagacacatccttgtcgcacacccacatctcaatggcgtggcgctcgtacgagtagccgtccgacgcgatgcacggctcttgcataaccctctgcattgcatctcatggatgaggtgttagttaggagtttgcattnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 48053 - DNA, 779 bp, Oryza sativa
aaaccctgttcatgaagacggaattaacgagagtggcatagttttggtagcatgcaaagatgagcgctcatgcgtgcagctgcaagaatgcatatcaaaaggctcgcatcaggtaacagttgaagtataatgtagttagcaacatagcatcaatcaacatcttaaatgcaagttttactttgatatatttaaaactaaaccatattaatccttcacacgcttccttgtttttaacaaggtcatgcgggccgagtgggagaagtacttgcttggcaaagctgaactgcatggattgcataggaagaacaagaaaacatctcagcaactaaaagggtttggtgttctggatggggaagttcctatgaggtctggtgagagtgcaggtcctgttagcattagcaaggttgaggctaatgccttacttgcggctgcctctgaaataagcactgtaactaaggaagcaaatcttgctgatgattcaaatgtcagctgcaagaagagatcattcggaaaagggaaagggaaagggaaatttaagaaaaccatggcaaagagagaagccagtaagttgagaaacagaaatactacagaacatactgatttggaagttgaaggtcaatcaggaaaaacaaatgaacaggctgagactgatgcttgtaagttgtctgcagaaaatgattctgcatcagctccagctgttgacaaagctgctaacaatttatctgcttttggagactctgtggataccgaaccactacctcctgtgcaattttacgccc

SEQ ID NO: 48054 - DNA, 3420 bp, Oryza sativa
ttgcgatgaagcctggtatgaatctagccgggactgacgtgttaacttcaggagttagcacgccggctccggctagggacgagtgcctagaggctctcatcattccgacgggacggggcgaggcgtgtgacaggccgcctgttgccacctaacccgcgatctgaccggtctgtgaccggtcacacactgtgaccggttacggaccggataagcgagcgctgcgccgcattgaatgcggcgtggtgcgcttgtccaacccgctataaatgcggttaggtgagccccgctgtgctcacctaaccaatacacgtggcatcaaaaccacagggggtcggggcgtcccagcccttggggccgaaacgggagcggcccgacccctcggggagacagagggaggggcggccacatcaccctcgggcccgacccccccgagggggtcaggccacgtgggtgaccgcggctgccccaaacctctagtcaagatacccccggtcccatgtcaccgacacacttggattggcttaactcactctctaacacctcactagataaactaagtgcacaagggtgtgagagctcttggaagggttcaagataatgcaatggagtgccaaaaccttacccttgctgctggggagtgggtatatatacccccaaccaccaaaactagtcgttggaaccgaaatccccaactttgtgctctgtcggtcagaccgccgttgtgaggccggtcagaccggactactttgtaacggctagaaaactagccattacagggcaatcattgagcctactcaacctggccggtctgaccgcagtgtagtggccggtcagaccgtccacggctcggtcagaccgccgtcgactcggtctgaccggttacggctctggcagctctgtatcgccaccaaaaaccagaccagtgcaacagaccagtggggccggtcagaccggccttaccacgccggtcagaccggctaacagacccgatcagaccggcctaaggcccacggtcagaccgcaggtcacttttcagctcaaccgaccgttagtaaaacggcgatatctcttgactcgggtctcgaaatttggcgttcttggactctatggaaagcttattcaaagggccatccaacccatgaaaaatccatccaataaacacaacttaagtcaaggataaagggctcacactccaaaggatatccaccggacatacccacaagatatcactcactcctattagacatgcccacttatctcttggtttaggacttgagaaaactcatcacacttggttagacaagcccacaaaatgcacctacatgcatatgaactaatatggcacaagatcatccacaagctcgcttcatagacccctcttgatagtacggcgcctatctagcaaatccggtctacaccaaacaccaagaccgggaaaagactaagaaaacattcttagctacattatacctttgccttgcgccatccatcttggggtcaagcttgagccgagatcaacacttgtgaccatccagttgaaccatgtttatgctgaggtcttgtccatcctttgtcaagactttattctcatcacaagcttgacttcattcttgccaacatgacgatgtccttggcttggtgaccactaacccatggtgtcattcattagcctcatcgtagtaggacctattccttttcacacctcaaaggagaacattagtctcaacaaatcagttgtcatccttcacttgatgaccaaccagttgcatatgaaagatatggatatgtttgttgagtattcattaacatcacaagtgtcatatactcgtatgcaagctcaagtgcaaagatcagatataaataataggtgaacaacatggatctagaacatgcacaataaatgtataggatttgctccccctaaatatatgcatacaaataaatatacaagagatgcaagtgtatgcataattagagaatggccaatggggtttatcctatacatatagagaaggcatatgtagtaatgatgtagaccaacataaaacatataccttcatgatctccatgttctcaatgtaaatgagactaaataagataacattcgagtaaacattagtctcacacttatatatcaataacatggaaatcatatatatgaacctatcaaaaagtaggagataagaagtggtacatatcgttttatctctatgcatttcatccttgtcatgattaaggtccatcacaaaagaatgcatgtcttccacatctcattatcgggaaataacctagtagacaacttatgcaaaagagaggttaatcccataaacatcggtttatcatctatcaccaaaataacaattacacaaattgtttaatccaagatctttcaatcttttctctctttggtgatggataataacccgatataaacaatatagagagatgagatgaaaaatgatttcaaatcaagatagaaatcttataataaacaaaatatagaataagctccctctcaagatgtgcatacatatggatatgaaggaacgcatatgcacataatcaataaagatcaaatatgaagctcacactatattttggatccacaagagagacctagttagagtatgtgaagtttaatacatacctctcatcatttttacttccatatccaaatgagactagtcaaagaaaggctcataaaaacgttagtctcatataattagatttgtcattaatcaccgaaaccaaattaaggcacttgaacttacacccactcatccccaccccccccccccccccgccacgtggcggtcgggcgagggcctcggggcgaggtagcacgagggcccgaggggtctgacgtggcaccccgaggccccctggctgcctctgcgtcgtccgagatgtgaggggagagccaggctgtagggtcgcgtggctggacgggaaggagacttccccatacttcgcatacccccgggcccatatcaccgacaacgacgatgtcgaagcaacgaggaccgaggaaagagcggctgcttctcctctctggcgagctcgtgcaccttccttccaacctccctcattgcactaacgttgcctgatgtaccctcatagcctcctccgtctagcagctgcccaacgcgctccaactcgccgtcaacgaccaccttggtgcttgacgcgacaaggccgacctttgtgaagagccccgggtggacctacccggtgctctccggcaccttgagctcccagggcaacatagcgggcgtacattaatgacatgtttcgaaacttgcataattttaatggcatggatctaattaaccatattttttaagagtgcgctaggaatcgtattccagacgtatgagggttgtcatgtatgacttgtatattatctttcgtgaaaaaggg

SEQ ID NO: 48055 - DNA, 10887 bp, Oryza sativa
ttattgttgacgttgacgaggcaggtgatagccttagctatgatggcgatctggatggtgtcggcggtgagctgggccagcggctgctgcagcgggacgccgatcttggcgaaggcggcgttgcacttctgcgtcagggacagggcctcgtccagcttcttctccccgacgtcgtaggcgcgattgttgatcacgtcgtgcgcgctggcaaaggcgaagcccacgccccggtactgcttcgcgcactccgccagcgctggcttgatgcccgccgtgcttgccccggcctctagctcctttatgtcatcggcggcgaggtccgccttgtccacgcccaccagggttgccgccttcgcaagcccccacgcgtccgcgtcgcggtggtgccccagctgcgacaggcacatcgccaagtggacgcgcttgtcgctggcggccgcgtcactgcaggtgctctccaccgtcgcgtccacgcccatagcggccgcgctcaggctcacggagatggccaccacggcggcgagggccttgctcattctcattcttgctctcctcctttttctttctatctgtgagcatctatttttttgtttttttttgggttttaaacaagacatgtgtggacgaacacccatgtatagatggagagatccacgcgggcgccaacaagtgtgtggtcgcatgcggcagcccgcccaagggcactcccgccaatttaggcactactaattttgttttcttctcaaacgaattcaacaagcacaaaaaccatacatcatttaaattattactttgcgacataaaaagtatcaactctctaaatgccacttttaaatttgtaaaaaggtccaaataccctccgaataaaaactttcgataaaaatccgtttaccaccttaaaatttaaaattggacgccaatccttgctataccattcgtattacccgtaggatgattttgcatattaatatattttacgtatctcatccatttatatcatagcgatgtcacacttttattatattggtactcttctataagtcagtgagcaaggaagtgaaaagaaatatttaaataaagattttaccatatatgcacaatgtgtatgtcacgtcatcaaacttatccaacgtacatataaatttgataaaaaaaacactttgcaaacccgtcttaggagtttatatgaatggtagtgcaaagtttggaagttaaatatccggtttaaagtttaggtgctaaatggacttcgaattaatgtttttttgtgaggggggagggggttgggtatttggacttattcctttacgtttttatcgttggacaaataagagttcttaatatattttttgccactcttgtctatgtggcatgacacatctacgtgtcagcatggattggtgatacgaaatgactgttttacccttggtaggttctttctccctcatttcccttcttttcttgtcgcgcgtacgttagttggtaatttccttcaggggcgattgcaatacaactgaatgggctcatcttcttcttcctccttaaccttgttactcttcctcttctaccctctccattctctccttgtaagactatagttgaattaatagaattatctttttttttaccttcctgtgtttataattcatatactactttagtagttatatgctttataaatataatatactttatttacatgtttcacttgattagactagtcatctatggtacgataacgatccaatgaccttgatgggctgttctagctttaacttgtccatccatatagtgggagttctaggggaattaatgtcattatttactagcataagtatggtgcttagataaatgccattggatgcagatatgtcccatgaaaagtgaggccaatccgtcctttgtactcctccaattcgggtatgacgtaagagtgcgtaaattctataaacacgctggcagatcagcagggagtattctctcggtagtacatgggtgcctataactaagtcctagccttgtaagcttgtatgtgttaagtgtatacttagacattaggaatatagaagtacaattatatcatagttctcttatgtcctttttcactatactaattatttagaaatgaatcttttgtgtgccacatatttctatttttaaccggaatgaaaaagttcaaaaaacaccaaaacatgatttttggatatattagaatgtattgggtgcattcgtggcaaaaactcacttcgtgactcgcgaggtgaacttttgtcaattaatgtcgatattggcacacgcgggtgcgatgttatataccggaatcaaaaagttcaaaaagtataaaaacatgatttttggacatattggagtgtattgggtgcgttcgtggcaaaaactcacttcgtgactcgcgcgacgaacttttatcaattaatgccgatattggcacacgtgggtgtgttgtttttatctggaatgaaaaagttcaaaaagcaccaaaacatgatttttggacatattggagtgtactgggtgcgttcgtggcaaaaactcatttcgtgacttggcaatagaagcatccggataatagaggtggattttgatattttagaagttgtctctatagtctagggaagttaagtaaaattttgatcatatatgtgaatggatcaatatgtctcgggactaaaatatatctaaacgaaatcttagttaaattataagattccgacatttacactatggtgggttaattatagattgatttatgatgtataaactatatctttacaacgccaccttctctgcagaaacatacatatgataggaagagatcgacaggagaccccacaggattgcgcagtggtgaaaacgggagcacagtagggatcgatggcgattggactccacaaggagatcttgatgacgtgcgcggagagtgcgacgatgctgccatcactgatctggctctggccaacacgtcacgacacgagcgaaaactggagggggcaggcgcggtacggagtaaatacgtattatccgcatccgttagatttgtccaatgatgaatgagtaaatagactttgtgaattatagagcagatgatgctgtctctctccatatcttcattttttttctttcttctttcttgttagtggacgtcacagcctctcgtggccttggagcccagcgcagacatgagaagagcctggccttcaacgatttggtaaagtctgatacaactccctcaaatccctcattcgctaaaatgggtatatgaaccactcgaaccgtataaaaatgactcactcggtggtggtggtattgatggtttttactaacgtggcgtccacatgacagccgttattaaagaaaaggatgccacgttagagaaaataactatcgaaatagtaagggaggagtgttatgtcggttttggggttgaggatacaaatatttagggagtccaattggaccttttcctcaacaaaactttgtaatcaaatccaagaccaacccagtccaggctccagcccagcatcccgtcgactcgatgatataccagcaaaaggggcaagtgtgagcaggcggcggcggagccatgccgatgccgtcgcgggcgcggcgcaggtccaaatcccggtggcctctcggcgagccccctcccggcctcttccccgctagggacgacctcctccgcctgctcgccgtcgtctccatcgccgccgcagcagccgctgcctgcagccttctcaaccgccgccccaaacccttgtgcgacagcggcggcgccgcctatacccaccatggtgactcactcactcactgctttctcgatctctcgcgcgtattccgtttcttttcctttggctagctgtagctgattatactaataatacgcagattcatgccaaccatgccctccccatggacgatgcgtagacggaaacctggagtgcgtccagggattcaacaaatatggcaacctgtgcatagaggatgggctggtcagccaaactgctaccaagattgtactgcccctttgcttgctctcttgttcctttccctctcattttgctatgcataccttccttttactgcttctccacatatctctatatagtcacagttgctagagcggaggatctgcgatcaatatgcccgtgctttatgtggccaacctgccaaaatcttggtctgttttcgttttactgctccccatcctcatcttcttcattacgactatgtcccccccccctgctttccatgccctcatcctcgtgtacttctgttgcctcgctttcagttccaagagctcgatatcttaaacatggctgatgagctgttatccaagggttttgttggcctaagtcaggatggagctaaggttgcaaaaattaaggttctggacagtgcgcgggccttctttgagaaaacattcagctccgacgggtatgcttcaccactacttctccccctatctctgactatatgtacgctctctttacgtatgtgctgtttcccctttcttgtttagagtcgaagagtttaaatgtccagacctggttgccgagctttataggcccctgacctgtcaaattcggcaatggatctcaagaaatatcatgtctgtgacagcctttggtgtcctggtacgtctatagcattaccatcttagtcatgcagtttgcttaaaggcagttcaattgattattgtacccaagttttcagcactgctctggattctttggactatttacaagagacaagcattatcaaagagggccgaacaaatatatgctcaggtatgaaattcctctctctctctctctctctcactcacacacacacacacacacaattcttccagttctttatcccatgacgaagggttatttgctgctaatttgcataaaacgacgaagtctgattaaccgtatagtaaacgttgttcttgctgtaagctatagctgttattgttttttgttggcaaaatttgattggagttactgcagtactagcattcacttttctggcgcaattcactagtacgtcagcagttccaccatctctttcaccttttccaagcatgagggaggtggtggctgtggggaaaggtggatactttcctttgtccaaaaaacagtagtaaatcatttgtttgtgcattttaatttttccataacttctttggaccttcttgtatttgtcttttgcctgttctcatacaataggtgtgtgaggtccttgaagataatgccatagatgcaaagattggcaactctgaatgtgagccttgggtggtcacgtcttggctgcgagatcatctgctagtcccacaagagagaaggaatgctttcctttggaagaaggtaattactttgcagtatattccactcaatacatagattttgacctgtattgattagcattacccaaattcgaattcttaaaggaaagttccatggagctacaatttttctgtacatgttttatattagtagatgaaagtacgtcatattttcgagcatctgaagcaataattcaaacatttaaaatgtttagaagcaacgtttaaacaatggggcacaataaaattcaataaatttggtttctttggataaccgattaggttactgtgtagtatttgagaagacacttgtacgcgttacattttattttttgatggcgacaagttaaatttcacatttttagtcctaggtgttcatcattacctacacagctttttcttcggttgctcccatggtattttgttctttgaccaccgtcgctgttggttcagtacacgtaattttcagttaaaaatgctgttgagggaatggctcaagcagcgcaacgttgcagctttatttctgagtagaaagttgacatgagtctcatctttaacttatcaaaacttgactactaaaaggaagcgttgagtgggcattaatcttctcatgatcatgtttgcattgaaagattagtgtctagtactagtttcttgatgatgtggagtttatgaaaactatccctagtgtcttgggttggaactggccttatatggcactagaagtatcttgggaaaaggagaaacacactgcccctaatttattgacaagtgcattgtcctaggctcaatatatgtactagtatatgggcataatagagaagtaaaaaaattgcctcagcaagtcgtagcctcattggtctaaccttgtaatttatatagctctgctgctgaaaatttgtcatttcactctccattgttggtaaactaatttccctttctctgttgtattgtggcataggtggaagaactaatactggaagattctcgcatagatcaatacccgaaagtggtcaagggagagtcgaaagttgtttatgagtggcaaggtacaaacatggctcctgctttattagttccaccaactaataaagcagagaagtattgacctgtttgacagataatgtggtgctatttttatttcgtcgagtatgctatcttattagatgttgttttgtggttatatacttatattggtgtgtttgcttgcagcgagcggctcgctcagtggaaagaaaaaggttaagaagatgcaaggtgtagcagcaggcaagtcaagagccgatggtgcagctggcggcgccataaaacttgctgaagaactggatgcaggctagctagagctgccatgcgttatgtatgtacaaatgtttctcaagctactaggagagtatatatcatgatgtatgcttggaatgtactaaattaattgagttaatggagtacgtggtgtatatgtatatgaatggtcactggaagatgctactgacagagcagtcgtcgtgaacgcgccagatggtctcgccgaggagattggcgacggagaggacggtgagctgggggaaggtccggtggtgaagcacggggacggtgttggtgacgatcacctcctggaagaggccgctggagagcctgtcgacggcgggcgggctgagcacggcgtgggtgctgcaggcgtagacggccctggcgccctccctgtgcagcagctccgctccctgggacaccgtccccgcagtgtcgatcatgtcgtccaccatcaccgccaccttccccctgacgtcgccgatgaggtgcaccacctccgactggttgtgcccctgccgccgcttgtccacgatggccagcggcgcgtccgacagcttcttggcgaaggtgcgggcccgggcgacgccacccacgtccggggacaccaccaccacctcgtcggggcagatggtcttgctggccaggtagtccaggatcaccggctgcccgtacacatggtccacggggatgtcgaagtagccgatggactgccccgagtggaggtcgcaggccagcacgcggtgggcgccggcctccgtgatgaggttggccaccagcttggcggcgatcgactcccggccgccgcgcatcttgcggtcggcgcgggcgtacccgaagtagggcacgacggcggtgatggtcttggcggaggcgcggcggcatgcgtcgatcatgatgaggagctccatcaggttctcgtttgccggcgggcaggtgggctgcaccaggaacacgtcgcacccacgcacgctctcctgcagctgcacgtacagctccccgtccgcgaaccgcttgatcttcaccctccccagctccatccccaggtagcacgccacctcctgcgccagcctcgggttcgccgtgccggagaagatgcgcagccgaccaccgctagagctcgcctgcgcctgcgatagcgctggcaccgggaccacgtccgagtactgcctgccgccgtaggccccagccccagccccagccccaactggaagcaacaatcccctctttgacctgctgctgccactgctactgctggtggtgccatggccggcaagcgagcacggcgccgaaatcttgacgaagaaggccatggccaaccaccgacgtatcctctccacacagcagcatctcggtcggataagaatctattatattattaaagaaatagaaaaatgagcttccacgttcgttcgcatggcctagaaattctcacattaatcggagaaaaagaaaaagcagaatccatatagaaatacaattaggaaataactgaaattcggaattaaaaaataaaaaatattagaagaggagactagagtcaatatagaaatacaattaggaaatagttgaaattcggaattaaaaaataaagaatattagaagaggagactagagtccatatagaaatacaattaggaaataactgaaattctgaattaaaaaaaaggaatattaaaagatgagactagagttcatatagaaatacaattaggaaatacctgaaattcagaattaaaaataagaaatattagaagtagagtatagagtccatatagaaatgcaattaggaaataatataaatttgtaattaaaaataagaaatattagaagtagagtatagagttcatatagaaatacaattaggaaataatataaatttgtaattaaaaataagaaatattagaagtagagtatagagttcatataggaatttaaaactaactaaaatttggaataaacataataaaattaaaagtagagtttagagtccgtataaaaatataatttacaagtaactaaaatttgaaattaagaaaaacatgggaagaagagtttaaagtcaatataggaatacaaatataggaatacaatttagaagtaactaaaattcaaaattaaaaattaaagaatattgaaagatgagtttagattccacatagaaatacaattagaaataataaaaattcagaaataaaataaataatattgaaagaagagtatagagtttatatagaaatacaatttacagaaaattcggaattaaaaaaaaagaaatattaaaagacgagtctagagtctatataggaatatatataatttacaactaactaaaatttgatattaaaaataattaataactaacacatatataaaatataatatgaatattacacattagtagtttttgtaaagttattgcaaaatttaaaattatgttgtcatttcaatatatttgaataatataatgagaaaacatatatactattatatgagagaaaatataatgatgctagccgcgcaatctgcgcgggccaccatgctagttaacataaagacgatgagaacatccactgcgcttgaggccggcccaccaagcttctgcctcgcatatattgatcttttgtcatttttcttttagaaaaaagagaaactcataactattttgttatcacgcatgaaacgagacacgcaccttttgtcactatcatttttttgcttatgcttatacttatcagccttgaatttcaactttaaatttagagttgattttgaaggttttttattgaagtttatttttcagcatttgcttttagatcactaaaaacacgcatataaaaattctattcacatattatttttcgtttgcaaatatgctgtttgatggcacccatatgtaaaatgactttcctccaaatctactacattctttcccaaaataattgcaattctagattgtttagcatatattaaggtttaagaagaaagactaaggtgtccctaattaaatgtgtataggtaataaaatggttgaaggtagaatttttttttaataatggattaaaccggcttctatatctgttgaaggtagaataggaagaaattcaaatcaaaagtgattaatgggatagttaattagtactctattgttgggaaaaatttgaatcctaaaaatataattattatgggacggaggtagtacgatatatgcattagcatttcctttcctagccacatatacagggattatcccatgaaaaccatcgaatagatgaagactagactaaaattttcctaaattcattaaaaaaagtacaagagacaagtatatataggaatgaactacatttctaacaaatcacaagtccaaactcatttgcatttgggaggaaaaaaattaagatggccaaacatcgtcgcttcttgttgtaatggttaggagatggggccggtggcgtgtcacgccactggagacgaagaagggcagggcaggatatccgcgccggatttgaggaagagtgatagtatggcgccaaggtgtgacggagtatcggatagggaggcatgcgacagtcgcatgggacgagattcgggagctgcacgaatcttggaacaatctcgaccgttcaaaagtgaatgatattttcttagaaaataaatcagcgggctgatgaatatagacagccgctatatatatacatgaaccgcataaggaaatgcacaaacaacacttgctttccagctgcgcttctaacaaaagaaaacaagaacatattactgatgcaacgaaaagaactcagccatctctcttccgcgtataccaggattcagtgaacccagaaaggactcagcactccaaaagggaaagtactagtcactattcgtgcaactgcgcggagaaatgctcacccattttagttgcataagtgtagaaatattgctactgtgtatacacacttatactgaggatatacaacaaatatactgtctatgtacatgttgacttaatctttctatcttctacgtacaagtacatacctacctaaggatcatcaaaaattgtcagctgtgtcttgtacatggttctgtgatctgatctgatcatcccattttgccattcaagaaaagcggtgctagctagctaccatctcatgatctgttacaacgtgtctgaatttgttgttccttcctgtctgatttcctgaattctttgccgtagccttctcctgtgg

SEQ ID NO: 48056 - DNA, 1164 bp, Oryza sativa
aaaagaaagagagattgaatgaaaagaacacacctgccatggtgacatgccatagaagaagctgcgaagctcctcatcctcgacatccctgatggcgcgagcatgaggtgaatatttgacaacttcatcctgcaggcagagattaatcaaatcgaagagaagagagcaagtaattagtaaatatttatatataaatacgtacgtcgaggataaagagcaaagccataatcggcggagctgcatatccgagtccctcaacaagcgcagagagagatggatggaagccccctgtgcagtctattccggccatctggcatatgaatctcccagtaagtgccatggcggcataaatccctgcacccatcagattattattctattattacttaattgttgcatagtagcatcgattattactaaaatggaattaatttaaatactaaaagtagatgaaataacaggagtcgttagtaccaatgccatagctgagcctgacaaccgctcccagcctctcccacatggccagctccgcgtcccgggctgcgaagcccccgcctcctccgcctccgccggtgacgacgggggcggcaggtggggcagcgacctccacgactctggggccatctgcagccaagcggccgctcctccgttggtcgccgcctcggccctcagctgccgctcggatccatctgcgaactcggggggcgaagccgatggaacagtgggtgtagctgagcctgagcctgagcttgcacgtgtttgtgactgtggaagaggaggaggaggaggaggccgccgcaaaaggggccagctccattaattcacaagatccctggctgccttttcaatctctctctctctctcgatctcgattctacagcagcaggaggagagagtgccaagcggatcaaagaggggcaagaggagagacaaattaaagcagagccaagaggagagacaactaaactaggaggacggaagatcgatttttgttttaatactcctactcctactcctattagaagtatactctgtctatcttgttgtcctacgctagtagaaatgtactcctagcataggaggaggaggagactcatgcgccatttgattttgattaatgggtttccgccattagttttctagtggccgccggtttgctctgca

SEQ ID NO: 48057 - DNA, 778 bp, Oryza sativa
gagcaggcgcgccacaatctggaaggtgcccgcgccgagagggccgcactggatcagcgggccgctaagctcgaggcgcgggcaagggagctggacgcgagggcgcgcagcggcggggcggccgcaggcgacggcgacctagccgcccgtctcgcagccgctgaacacaccatcgccgagctgcagggcgcgcttgactcgtccgccggggaggtcgaagccctccgcttggcgggcgaggtagggcccggcatgcttcgggacgccgtctcccgtctagaccgtgccgggcgacaggcgggcctctggggagggcggaccgcgaaatacgccgccaaccaggggggcctcgcccagcgcctctcagagatggccgggaccctccagcggctccccgaggagctcgaggagacgatcaagtcatcctcgagggacctcgcccgggggacggtggagctcgtactggcaagctaccaggccaaggaccctgacttctccccgtgggcagcgctggacgagttccctcctggaaccgaggatggtgcgcgcgcgcaggtccgggacgccgccgaccacatcgtccacagcttcgagggtacggctcctcggctcgtgttcgccctcgactccgacgaggagggcggtgaccggtggtgcggacgacagcgacgatgaggccggcgaccccggcgcgtcggcgtgagccccagccccccgccatcttaaatagcttttctttcttcttctgaggccttcgggccccctcttgataaactaa

SEQ ID NO: 48058 - DNA, 30029 bp, Oryza sativa
  unsure (1)..(30029): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnattctcttgctcttttgatccaaacgttagttttatagcttgggtcttgacactaggaattgttttggacaggttgattaggttgctctcgctgttgggtgggtgcattagtgaacatattgttgacaggttgagttttctggtcttttgtttccatgggagtataactaaggatgacgaacttacacatgttcacaccacacaaacacaaacacaagcgaactagtgtgcaccaagtacacagttcaaataataaaaggaacttcccaaacccaggcatgaatgtactcccaataaatatatccttagtattaaatggcttaaaaattcccttttcacagtacagtagctagcgagagtgtgaaccacgtcacgtaaaaaatggaacattccacacctcgacacttttttattagtaacgcccgtgtgggtatttctccaaataaatgtgggtagaacaaacatccctagctagtacccaccattgtgtcatcgacactttcaattcagcctagctaagtcagtaaaaaatagttgcattgaagataaaagcaacattgagatgttttgccatttattagttccctgaaacaaatctttagcatacataaataaagataaaatagtaaatgtgattcaagacagaaggtttatgctgacctcactgtagatacatagtccatatcaaacccaattcaacattttgccctttaatagcatatagaggacataacactaaggattcacatgtgatgtttctcaatgaaaaaaactatatattatctatatttaatcatgtgatcattttttgctctgtacttacaaactttttatgtatgtaaagattgtgtgatcgatattattgctcacaaatacccttttcacactacataagtgagcaagagtgcgaaccatgccacatataaaaatggaacattccaatctcaaaacttttttcattaaaaaaaaagctcgtgtgggtatttattccaaagaaatgtgggtgcaacaaacacatgagtacccaccattgtgtcatcgacactttcaatttagcctagctaactgagtaaaaaatagtggcattgaataaacatttggatggttttgttctcaacataattccagcaattaaccttttcattaaacacacgtatatgtacctttcattaaacatttggatggttgttcccaacatgtacctttatgatagttcttccgatctggagcacatggatactggtgccaaggtacctgctcaaaggacgggcgcatgttggcgatcttgttcacagacatgtaaggactcatgactatgatgggcctcagatgatggcacgctcaagggatggagctttcaggaagttgagctccttcatatggaccatagagagaaccaagcttttcatggtggggctcatgatgtccatggaaaagggcatgtcattggggttgatcaacgagagcagctcaatctcagggcagctgacgagcaaccggtcaaagtcattagcttgagtgtatccctcgcacaggatgagctcccgcaggcttggcaggaagacggctttgctggccctcagggtcaacttttacggtggttggccaaagagcgcgacagtgtggcacaccatggaggtgcaggtgaggatcttgggcgggagggtggcggcacagcgcatgccgctgaggtgcacgatgacaagatcctagacgttgtcattgcgttccaaggcacggatccaatacctgaggctgtcgtggcggttgaagctggtgatggtgagtcggacggagtggaaggggcccgggtgggagtcagtggtgcgcgacaccgtcttcaccaccgcagagtgtgtttttggaagcccctggcaacggggcccactatgggacaaaacagggcatcatcgaggacggaggggcacaaatccctagatccaggcctagggatgggacagcaccattggcggcaggcaggcgggacacaaggtcgcgaggagctcgggtgggagctggctgatgccggttctatcagatgggggagtggtgttggtggaggctggcggcagcggaaggtaggcaaggatttcatgcatgcactcgttgtgctccatatgatcggcggcggccgacagcgagaggagagcggcacactgtgagagggaatagggaaacaacgatgaaggaacaagagagcgaagatgagttgcatcagaaatgagaacaatgctagggttccgtgccgttgagccgacaacgtggtgggccacagtggaagtagggtcagccgtagccctcgcctcatgaggctgcccctgcccctgacttgcgccatgtcaggttgaacaaatcttatagcagtttttctagccttccaaaccatcacccccatggaagcttgaggtcgaggccattgatcgcctcccaaatccatggttgcgatgcgagactgtggatgctttctaaggccctgactcctaatggttctttgacaacaaataatgcggataaatgacgccagggcaaaaaaatgtatgtgaagtatacaatatcagcctagcacaaaggggatttttttaaaatttttctaggatcttggtgatagaatgttctatcttcctgttctctgttctacacatatttttttgttcagtatgtcgcctggtccaaccgtccaagccattttaacatttgtatttatgcacccgttcatgaataattatgtatggtgcattttttattaatacgagatatgattatgtctcagccattttgctatatatatatatatatatataattgggcttattaggataaatggctggttggataggatttttttagcaagggcatgagagcccccatttccattttgtatggttggataggttaggccatattgatgtgttgagttttgaaatcctttatttttgtgcgagtataactaaggatggcaaatggcgagtataactaaggatggcaaacttacacatgttcatagcacacaaacacaaatgtgagcccacaagtgtgcagtctactacttatgtgataaatattggaactatccgaaccttgaaacatttatttattttccattaaacacaaatcttctgctatttccccacaaaaaaaaaaagatctgctgctatttactctaaataaatttaaactgaggtgggtgggaacaaattaacacccttcatcccgcggcactgtggttgataaaataatatcatgggtgtaaatagtgttaataacattttctatccagcctaagtgtgacaaaacagtgaaccttaatgccatagctaaagtgttttgcaattccttgaacattaacacatcaaattcaatttgtcttgcttgaatttgcctgagtcagatcgaacaaaaattcagcgctcttgatatattataatctgaacactggttaatttggcagcctatcgaagatcctcagtctacccagcttgatgactttgagttctgggaggagatcaattcagttgaatgtgtcagatccagcatcaagaaggtagtgttccatgggttctcctggaagaattctgagatagcgttcatcaattccatcgccgaaggaggattggtgctcgggaagatctgtatcttccagagtcgacatggtactgccccagatgatgatgaactgaatgctaagctgagcatggtagcttctctgaacatcggccttggccgtacagagatcatattttcaggtgaagatccaacctggtgctctagggcggcagctgatctttctcgtgctgatcctagtaatggtaatgatctttcatattttcatagcgagatgtttttgccatttaatttcctgaaaaaaatctttaacacaatataaatgggatgcaagggagaaggtttatgctgacctcactacactagcccacataaatcccaattcagcattttgcccgttattgaaagacggagctctagggtctaaaccacaaaatcacatgcacatccatccatgccaatcagtggtggagtcagcactgccgtaaaacctgggcgactagtagcgtttttaaatgaccgactgatttttgtacgtgtcaacggctaacgacaatggagacggtagtggcggagcccaagtagccgaccgacctgccttccgccgctgatgccaacaattctcagagatttttgacatttaattccctgaatactaaagcaataatcagaagtttttgccttttaattagatgaaacaaatcttcaacagaaataaatgaattagatgtaattataaattattgtcaatatatgtagttactgattgtcgatatatgtagactgtgtaatcgtatttcctttttcttgttttgagcccaatggcataaaacgtagactcaagatttcaaggttacaccaaaatcagaaaatatacaaaaacttcatctgatgaacattattgaagatattagctaggtttcatcaataatttttatgctagctaatcaattttgatattgaatcacaaaaggtctggacctagatccatgatggctgattaattaataatttgtggactttaaataataataatttgtggattattattattattattattattattattattattattattattattattattattattattattactattattattattattattattattattatttcatttcaccttctctatgtatgaaagatcccttttctgaatactgagagattttcagatacaagaatgcatgatattaattctgacttaggtgtataatttgttctctctctctctctctctcttgccagagtgaagctttattttaacacaaactctgatagctctgtagttcagttgtaacttttgtaacagtagaataaatttcttgatttgttacactattgtttttacataaataaacatattttgatatatgtgtaacaaaaattaacaaatgcagtctacagataagtgtacaactaaggattataaacttacacatattagttacatcacacaaacactagcgagcgagtgtgcaccaagtatatacacattccaactttccaaacctcaacataattttctcattgagcacacccgtgcttgtgtgtaatccaaataaatgtataattaagatagaattgcttacaaatacccttctcacaccacgcaaacacaagcgccaagcaagtacaccacacacgccaaatataaaatggaattttccagacctctaatttttttttccaaaaaacacactcgtgcaggtatttactctaaataaatgtgtgtgtgtggggggggggaggggggacaaacactcttactacccaccattgtgtcgttgacactttaaattcagcctaagtgagaaataaaaaaaaataaggtggcattgaagcaacaattggatatggtttttgcgaacgtaattccattaattaaacacacgtctatataaacaataaatcaaatatgcaacacaaagggttaaactcagtttggtgggaaacacacatcatccttggcactactgtcattttacatccagcctaagtgacaaaatactgaacatttttaaacaatagttagagggtttttccattaaatcagttagagggttttgccattcaattccctgaagacattaaagaagcagtgaagggatttgctatttaattcacagaacattaaaagcaaccgtgagatattttgccatttattgattccttgaaacaaatctttagcagaaataaatgaagatacaatcataaatacgtgatgacagagagaagatttatgcttacctcattgcagctagtccaccatcaattccacttcatcctttcgccctttaatagcacatataggcacacaaccctaaggattaaccccaaaattcccccaccaccgcactgtgcccgctgccaaatcccatccgtgtcaatcaccatgttctccctcctttcccttgcccacaaactctgccctcgattcatctcccccaacaccgcgagcggcacacctctactaatgatggtcaagaccaaatcactgccctccccaacaatctcctctctgaaatcgtctcccgcctccccatcattgatgccatccgtaccaccacactttcccaaggctggtcaaggatttggcactcggtgccgctcagcctcgatcactcccagatccgacgtgccggggagaacatcctcgatgatctctccaacagcgccatggtcgctagggtctccagcatcctgtcctcccaccctggccccttcaacagtatccatctgacctgcagcagtatggggtctcacaatgacgccctcaagagctggttcaaggcatttgctgacaagcacctcaaggagcttgccttcctcaacctgaactacccaaatgacatcatggtacctactgatctcttctgttgcaagtccctgaagcggctctaccttggtggtgtccagctgcctgcaaacactggcatcatcccttgttcccacacattccatgaactctgggagatctgtttgtatcgatgcatcctgcacgagtgggacattgagaacctgctgacctgcagcccaaaggtggagaagctctcgctggtcaacagtgcttgtggttggccactgcggctgcacatccgcagccacagcctccgatgcatgctgcattgggcctcctcgttggaggagctcgctatggtatccactccatgcctcgagcgcctcatcctttggagggatgatgctttgcactggagtgactgtaagaagatcaagatctgctctatgcctaagctccaggtcatcggatatctcaaccctgcggaccatgttcttcagattcgtgatactgtgatcaaggaatggagctctagatctcctgtttgtgtttctttaattaatttggattattagtatctaaaattaaacttatgtatgagtgtgtgatttatttagtggtgatattactttgcggtttggtttaatttcatatattcataatgtagaatgacatgaaggctagcgctgctacggttgttcctagtgtcgaggtcttggcaatgactatccgttttggtgttcacgaggaagagcggatggtgccttgcttcctcaagtgtttccctagcgtaaaaatattgcatgttaaggtggggatattaattgtgttccccctttgattttgtttagttaatttttacattatttttaatgaggccatccacccactgacttaacttttgttacaatggtttttgtagtctattgcacgtactcagactaccaatgaggttaacttggagttctggaaagatgttggatccatccaatgtgttcggtcaatcatcaagagggtgatatttgatgactttagtggagaggagtgtgaacttgcattcctctctttcattgcacaaaatgcaaatcagctggaagagatttacatcatcccttccaagaaggatctttctgcagggagttctctggggaatgtcataaatcacttcatgtcttcaatattatgggcttctgcatattgcagggtacaagtttgtgccagtgcaaaaaatgcttggaactaccaaatggcatcagatctctctctttatgacccttttggttatatcgtgtcagcaataacgacagcttcttgtccttccctggtacatggttaagctacgagtggtgcctaaatgtgaacattcttctattgtaaaccagatcaggcagttctggtgaattcataataatgtaatagtaagacaatactgcatgttcaagctgtctgttgtctaaaccttataggttgtattcgatccatatgtttcagatgagatgttgttagttttctcaatgaaaaaactatgtattgtccaacatttaatcatgtaataattttttgctctgttttttactgattgtcaatatatatagattgcgtaatcgtaattcctttttacccttttttatgctttgtgcccaaaggcatacgacacatcccttctttctatataattacaaccacgagcagccaccatgcatatttagccatctaatcagaatagtttcaaccatcggatcgatctgcagtaggtgttagatgaaagtcccctccacttccttaccaattaaaatgatgctattaatctttttccaaccatctaaaaattatttaatctggcagtcaactggacactaatgacatcaattttggatcgacattaccattccattcatctttccgttcagttttatatgcatatactaataaaaaaatgtatgcatatacataggaaagcatacatattttgttttccctcacaatgcttgtacttggtgaacagtaatcaacatgccgatcatggaagcatgcaatttgcctatgtttcatattcatacagattcctgcagcaatgctaggggtatcaacaaataagactaaagatttcatgggacacctagatcagaaaaaaaaaatacaacaagttcattcgatgaacattcaaaatgttaattagactttagcagtactttctattagctactcagtttgaatattaaatcttcagaacatttgatctggatccatgaaaatgtagagaatcatggttgattgaaatttggtggattttacatgtaacatatactggttgttttgtttcaccatactaggaaccatctgaaatgcggggaacttttcctattccagcataaagttaagtttttcatgtaaaccacttatgaactcactgcattctaaatagaatgaaggaatttatgccattacaagaaaattattttgtcataacataattgatgtttacatagcttcagcaaaacatcttaatgtatactaattggagtctctcctagcaacccctacattaatctaaaaggtaaacaagctagaagttcccaaattaatagaaaagctagaaattctcacactaatgtaattaaaaaggataaaatcatatacgttcgtctatcaaatcaattaatgagatcttttccacctcataatatattcatctatgaaaataggaaatcataaatatatggttgtattcggtttagactcttaattatagttttttcatgattgaatcatttcaaaatttgaaattaataaatgtagagttgtactcgttctgaagtctcagttattttagacaaaaggcagtcacctgcccagtttttcattgcaagcataagagttcgtacaaagcaaaataaaaggaaagtaaaaacaagttgctggggtttccagctttcaggatcagtacagagagccttccaagacttcacagcagaagtgcctaattttgaaatataaggactatgctgctggcacagcagaacaagccagagagggaaaaatcaagattcagcgtttggagagctgccaagccctcctgtctcgctaatgctggcaagcagagatccccttaatgtatccaggtctcccctcagtttcgcaggtgctaagcgcctccactgtattaagaaggagacaactttgtgaggcaggttaatcacatcagctagcagcttattattaaacacccaatcatttctagcaatccatatggcctagaagtaggcatcaaaaattgtgagccaaacagagttcttcccactcttcttttgcataatctctaggagatcagctctacacacatgcactttgtcccaattaaaagcatctctcaggcaacaccacataaactgtgcaggggcacacatgaacagcaagtggtcaatctcttcttctctaccacacaatttgcagttagcaaccccccccccccccctacttcattttctttagttgagcagctgtttgggtccttcctttcaaagctaaccaaaagaagatttttattttcagagggattgaagccttccaaatatcctgtgggatctagtatctttgacacctccgaagatcatctccctatacagagttttggtagtaaattctcctgtttttgtcaatttccatatcattgtgtctttgttagaagttagctgtatgtctcttagtttctcatgcaaatcattccactcccctacttctctgtttccaattgttcttcttataccaatctcccattccccccagtgttcatttgtttcacagtactgttagggttataacaaatactaaacaacatgggatactgggtttttaaaggaatttcacctaaccacacatcactctagaatctaattgacttcccatttcccagcttataacaactaccaaggaacatccatttcttcacttcatgcaaacccttccaaaattgtgaaccccccctcagcagaagattgaaagaaacctcccccatttctcatatacttcatcctcaacatcctataacaggggtcattagctcctgattccagcttaaaaatacacttacaaagcagagccctattcattatctttgtgttaatgaaaccaagtcctccaaattccttaggtctgcttagagcttcccatttcaacatgtggtatttcctcttcttttccaggccctcccaaaagaacctggctctgaagtctcagttatagttttgaatgatctaataatattctgaaattctgaatcaatcaaaagaaagttatacttgacctgtagtttcaattacaatttttttatgattggtttaattcttctaaaatttgtattaataaaagaccaaatcatactcagttctttatttaataaatccaaatttaagaattaacaaatcataatagttaattaatgaatattaggtcttggttggcctacaacctcaataagttttttccctatattttaatgattctaaattaataaatattgagttgtccttagtgtgaaacttcaattataatataattgtaatttaataatttggaaatctaaattagtaaattccaagaagatattgattgtttaaaatatgtagtgcctgggaatgtacaaattaatggcttgcaaacataattaaaagcatattcctagaattcctttaatttattcaataactaaaatacccaatggatggtccatctatagcaattaatattcttaattcatgtgaagaattaaagaaattagctgatcgattgatcgaactattggtaaccgctattgtcagtacgacaaaaagatgataatggcaagctagggcaaggcgagattaggggagcgaaatttgaacgcctacgtgggagaaaatatctcataattgagagtgatcggaagcggattggcttaaagtaaatgttgatggctcttattgcgcattctctgttgaggcggacattgccattgccatgagagactcagcatggcaagttcttatatcttcttcgtgagtaatctgggatggtgtggcaggagagaaagttgaagctatggcatgccgagaaaggctagctctcgccgcagagtgggttcgcaaacccattaccttgagtcatattgtgtggcaatgacatgtttccttacatcaaatatagttgattggtcatcaatgaagccaaacgtataatataatgtggttgtttccgaaggtgaaggttaggcatatatatattagaagagagtgtaaaagcatagcgcatgagttagcacagtttgccatggattaagcatagtgcacgatgttccctacttatatccatttttatataatggaagttttattgaattcagtacattacattgaggtgataaagttgtcttaaaaaatacttatatccatgatcttataatcctcaaggatgattaattaatataacacccttttttcttgtaaaaaaaagtaatgcatgagatcctactacagagtagagacatgtaaacaatcaggaaaaagtaggggactgaaaacagacctcccacacacacacgaaagagtacacgagggatgtgactgctggctcacatccagtcattggcttagctagctgccaaatgggccccaacaacgtacacacaaccctctcccctctccctagctcatgcgctccaaccttgcaccacaaccacactgcatgcgctccgtccagccgcagctaacaaactgatgagccgtgtagcaatcagcaactggcaaacgggccccacgcagccacgcctcctatatccacgctgcccagcggcgcccacctcgattcccccttctcctccacaccaccgcgcctcactagcctcgtgccctcgtagctgccctcgcgcgccaccaccatgccgtccgccatgaacatgatcaccgccgccttccgccgatacctcggctgcttctccgccggatcaacccaccgccgccgccgcggcgccgctgaacccgtcctcgccggctcacttacacttcccgccgccgccggcggtgacaacgcggccaggcgccttgatgtcgtcgtccccgcccccagccgccctgatggtgtcactgtgagcggcgaagatttcatcggtagccttcctggccatgtccgctccgccatcgtgtcgcgcctcccggtcgcggacgccgccgctcgcaccggcgtgctgtcgtcgtcgcagtggaacgggctctggtcgtcgacgccgctcgtgttccaggactccgacctcatcctcgccgcgaacttcaccagcgtggcccccgtcgccgccaccgtgtcccgcgtcatcgagaaccacccgggccccttccacaccgtcaccctgaccagctacttcccggagtccgagcgggacaccttcgccggctggatccgcgccgtcgccgccaagggcgtccgcgacctcaccctgcacaacatcccctggtcgggcctccacgtgctccccgccgacctcctccagtgctgcgccgccctggagcgcctccgcgtctgcgtctggcggttcccggccacggccggcgtcctccaccccggcggcggcgacggcgacggcgccgcgccgccgtcgttcccgcgcctgagggagctcgtcctcaacaggagcgccatcgaggaggccgacctggagaacgtggtggcgtgcagcccggcgctgcggacgctggtgctcgccttcagccgtggcgcgccggggcgcgtccgcctcgccagcggcagcctccggtgcgtcgtgctgtgccagtcgctggtggacgagctcgccgtcgtcgccgcgccgctgctggagcggatcgtgctgcggtggtgcgcgtcgggcacccaccacggtcacctcatgaggatcaggatcagccgggcctcgtcgatcaaggcgattggttacctcaaaccaacctgtcatggcctgcatattgatgccactgttataaaggtaatctagctagctacttccatttattgattattagttatattttgagtttttatctgtacagatttgtggattagtatacttgggggctttttagatggagtgtttgtacttctgaggcactataggagtagcaaagttcacattattttttgaaacgagtagcatcaaagatagtcatgtttcatattgataaagcatggacaaaatttgcattaatttgtatcggaacctcaatagagcatggttgtacctagcctgtcagataattttgggggaaactttttccccattttaagtgataacttcatattctctcatactacctaatagataattgcatcagaaacataagatactagtcgatcaggaatgagaagcaataggaagttgttgctttgttggttatatttatttaaattttcaccaaaatttctttgttgcattcaaaattatattacagaggggattccaaattaacatatgtcattgccttgttttttttttttctctttgctctctccgatgtttacatctatttactgtagcctgggataacggctagccccgatgaagtggctgttccaagcgtcaagatattgggtttacaagttcgatttggagttgctgcggaagcaacgatggtgtcctgcatgctcagatgttttcctaacgttgaaacgctgcatatcatggtaaggcataaaattcaatttgtcttgcttgaatttgcctcaatcagatcgaacaaaaattcagcgctcttgatatattataatctgaacactggttaatttggcagcctatcgaagatcctcagtctacccagcttgatgactttgagttctgggaggagatcaattcagttgaatgtgtcagatccagcatcaagaaggtagtgttccatgggttctcctggaagaattctgagatagcgttcatcaattccatcgccgaaggaggactggtgctcgagaagatctgtatcttccagagtcgacatggtgctgccccagatgatgatgaactgaatgctaagctgagcatggtagcttctctgaacatcggccttggccgtacagagatcatattttcaggtgaagatccaacctggtgctatagggcggcggctgatctttctcgtgctgatccttttgattgctgccgttgaagatcgatgtctctgtgctttgatcatcttcgtactatatatacattttgtgcttcagaatgtcacacagtctgcaaaggttgctcaaggtagttatatagcgaataaatatgtgacatctggaaattttatcatgtgtgtgtaccagttaaattctatcctgtggtattaataaatggtactggcgaggcagtgtgcaacgctttgtactgctggattgtgttttaatttccttgagcttcttgtttctgttgtactgaatgacaatgattcaatctcatggatttccaaactagcattatatagtactgtttataactttatatagattctttctcttcagttgaaccattaatccttcaaagataaggatttagttagataataaacagatgaatatcttaaatcaaaactgtcatcccctcgatcgtcgatttttaaatggcagaactccagcctttatgttcaaaagtgtgtgtctgtgtgtgtgtgcgattatgttttatcttcttggtagactgcattacatacatatactacatacatggaatgcttacctattatcatgtgataatgttcttgacagattcttcagtccgacggtaatgtacgatgtttctaaaatcacctagtcaaaattaaaataaagcatatatactaatagtctaaaatcacttccttgaactcgtttcagggataattaatccatcaagatacaacttgttgaaatataaaaaccaagatattttttttcagatcctcaaatcaaactaagcttcataaagttcttcaaatcatgccaatatataccaatctgattcagaattggtatagagctgattcagataaaatcatgccaataccagtcaggccttgttgtaagaatctgaatttcaggcctgtgccccttcatctgcaatatcgtttgcatacggtatgcgtacattggttatctcaccttgcagcaatgcattcttctcatatgcagcgatgttatgtcagactaaaaaaaatgactgaattgaaaacaacccgcttttatttggaacatcgtatacgaaattttccagattttgtgtgcaccatactatatagggttaattggatccatgccattataaaattaccggttttgaaaaataccactactatttgtataattggaactatgccactacaacattgcgaaaattgaatccatgccatgctatacacctgatacacgttttgaattttttttctatactgtattttcacgcggaccaaaatacccctcaaattaatccaaccacaatagccaaatcgatccccttatcccgtcgatgcggagctcctagaagcagcagcggcgcggccggcgagcgtgaggttgggtacggcagcaacgtcctgcgcccaaaggcggtactggcggcgggcgtgaggtcgggtctggcggccgcgacctgcagcccagcgccggcgactagctcaacgcgagcttgctcttgacacgaaaagatacagtggcggcggtgacgcgcggtccacggcggcgatgagctgcaagcggccagtgctagcgatggaggagatggacgacagctcgccggctcgggcggttgtggacggtgacccctctatgccggcgagtgatgccgagggcagcgactggcctgccggtgttcgtggacggcgacctggctgctccaccgctcttttcttcttttttcccaattattttcctcttcttttttttcctgtgcaacttttgtacacgagatgcattcaaccattttgtactgtgaatatgaagcggcagcaatttgttgcaacggcgatttcaaatatttgatttaaaactttgttagatctgaagcattaaatcgtggagttgacatgaggaaggatagtgttgttgttcagagcttgagactacacacggttattttagaccatacgaaaatacggtagtcacaaaacaatttaaaatgtgtttcagacgtataacgtggcatagatctgattttggatgtttcatagtggcatggttccaattatacgaatattagtggtattttttaaaactagtaaatttataagggcacagctattgtgcataagataagaataaaccgcaagacaataatgcaaccaattggagtagtagttaatgaccatagcaaatagtttgtcacatataagactaactaaattaagccccaagtttatttgtgaactagattctgtatgaccaatataaacccctagttgttcataaaaaatatttaattttcatgtgactatattgttgcacaaacacttatgttggaaccaaaacagtacctactccctccgtcccataaaaacaaatttagtataggatgtgacatatcctagtactatatatgaatttggatagagcaatcctatccagttttagtatatgtcacaactgtactaggtttgtttcttatgagacggagggagtaactagctatcatagaatttccaactaaatgatcttttctaatataagcttagaggtctgatcagagtaagttgtaccacacatgagatccatgatgcaagcaggatgaccggttgactaatatattgtctatttcacaagaaaaaacttataacctacatctttctgtatatcatccatccccccaccccaccccaccccacccacacataacataccccctgcatacgcacaccaacccctcgtctcgctctctcagtctcgggtaatggttattatgcaggatatgtgtggttgttaaacatctagattaaatgtggttgctaaaaattattacaaccacaaaaatatggtcattatatgccattgaaggttccatcgttaaaagtattaacgacttcgaataaattcatgtcacgaattctttaacgaatcccactttaatggcccctatctattctcagcgatgggcccaactcaattcatgggtattaatctgaatatccaagatttttttaattaaaaaaagggtatatacatatgtaatgtgtatgtctatattttactataaaagataatagtggtggtggtggttctgccaccagcccaccaccactacttagaatgttatagtaattagtccatggtattttataatattatgtaatagcctaatatttatttaaatcaagtgagtaacataatattaaaataagcataggcatttgactagtgtatgaaaaaaacaagaaagagattgtattcaaccgaagaggttgtattcaacacttaatgcatatgctatatattataccgttagtacatgacagatattagacttttggctataaactcttttttgacccattcacattttaaatacacaacttcaaaatccagagcccgccatgtcaattctcattgatctctaacgatctccggtggtgtcttctaatagcttataatgaatcatgactaaatttggatcactaagacaaattattttgtggttttaaactatacatgtctacttacacccacatctacattagtgaaaagaggatcccaagaccccaccaggatgagccacatcatcaaacaaatatgaaccgttggatgcatgatttggatgaagataatcgttggatcaaaagaaagaaaaatcagttaaaaaagcaaaccgtatcatgaggagttctaaacccttcaaacacctcccaaaatatgtgtctaacaaagatatgagattgaaaaaaaaaagagaatgccttaaaaattgattgtataaaaagaatatcaccaatgagtattcaatagtagttgtattgtatcaataataacaagtatcattgtatatatcgtattgtatcaataataacaagtatcattgtatacataaatagctacttaacctaatactatcaattactccactatatcttaaaattaaaaaaaaacatgtggcatggaggacatagtaaattttgtaaagttgatttaaatcatatgattctaagatttgcgataaaaaagcgtatagatacttctaaactatttacatgtggcattgcaacgcgtaacagatgtagctatttacattatcagtacaaatgatgcatttagatactgaatgaagtaatggtcgcggtaatatatgataaattatttgttgttacgatatttttttatcacaaatcaagatatatataaatcctttaatgttgtaactacacttcttaaaaaatatgttcaaaaacgtatctattgttaattgttactaaacatttacgtccattaacacaagcaacatataaacacattgatagatagagatgacagtcgtgtgaacgggcaacttaataggctaggttttaacctgaaaagcattgaagcgtcttcaaattaattaatggccacattcttaataagaaaataataatatagatgaacaataatgtacataacttatatatgaccatttttttattcatccaagtaaaatagtttaattgattcttgcatcccgttgaaaaggtaaattctaatagacatcatgcatggaatattcagtcagcaccagcatttgggtggctagatagcctaattgaatagacatatatatatttaatttacaactaggaatatactgatttaattaaatagtactctgacctgaaggtgcacgtaccattgcatgtatacttatatactactcagtgaaaacaaccgaatataatgggatatatatcatgcatatatagatgtatcatattcagctaattttgagccctagaaaaacattttgccgtttatggccccaagaatttgtgttatatatgaactgaatggctacagttttttttgctggtatgtcaaaaacacaaatatttcacttttctgggatgcatttctgaatatcactagtaattaccgagctgttaaccaattttatgacaaaggtatactgtagcagagaagagttatctgaaagtagatggctcatttcatttgcttttcttgtggtgtcttcaagttgtcacctaatgatactgatttcaatatatagtagataccacctcatacattatattattagagtaattaataggaagcaatgaggacaaaaaaaaatttctagattgtatttaaagacaagacaaataatataagagctatcttgcaaaaaaaaaaaagaccacataaacttattaaggcaatgaagagggggggggggggcagaaggaatgttatagtgatgtttatggtttctactgcacttagcagtaagcacacgctatttttccaacaatctaactatataggttgatgggcacacaagagcgcgtccattgtactccccccgtcctaaaatataagcagttttggttggataggacacatcctagtactatgaatctgacagactgcctgtctaaattcctagtactaggatgcgtcccatctaaccaaaactttttatattttgttacggagagagtatattatatatgccaaacttgggtagcaaatgataatgaaaggtctaaaggtaataatagtgagaaaatacattatattaagtcggcatatgaaattggatttttttttctaataaaaagtttcaaattaacatgcatacaatgggctaatcagatcgagttttgtatggaattgtttcttcaatcatgtagcagcaacgagcaaataaaaattgaatcaagaaagcgagtaactgatttttttttcaagccaactgtaagaatcttcttgtgtgaagaaaacagaaattacttattttaaaatagaaatatggattacacaattaatgcaccccacaaacataagtcctagtctaatgtatattgttcgccagccaaacaaagttaccctcatatttatcaagtgactactactgcagggaaaaaaaatgataacattaattctcaaaacgataatttatttgtaaatctccaaatattattttacattctactcctataatgatgtgccacatcgttcagtatgcatactgcatgataaccttcaaatattactaagttattgcactatttaatttgattatacatatgcatgtcttgactgctcaatcagcagtgcctaggtggaatcaggattaccaataaaaagcggctactttatatatgagacagccaaattaaatttggttccaaactagccaaattaaatcacccgcacatatatatgagacggccggaagcacaacttacatagacattaagtcaggtagtttcgccttgaaatcagtacggtttgccatattttggaatgatttaaaaaaatgaacaaaatttgactgaattaaaaaaaatgaaaaaatcgggtaaaatagtgtcatgccagggggcattaattcccgaaatttcagatcggaattgcaaacactgcttgaaatggaacatgataaaatgctcttaaaatattacaatgctgattaattatttttttaagatgagtatagcacagtataaatgtcttttgatctggttcttgggattacaattaatcggatctttggattatatttctgatgaagaacacttatgtacagaatgccatacctaagcacagcttgtacaaggatcaaaacttgcaatcgttgtaaattttatgataggatgacaatcgcactgcaaacacactttacctgtacttgtatcagctgaatatatctgaaattgaagtgaacatccacttacagaaaactgattggcactttgtagtgcctgagactcagagcagcttgctctgaaagattctgaaaacaaaaaggacatgaattcatattattcatcatatggaaaaccatatgtttgttaagaaatttcacagagcatctgatggtcaatctactaatacttgaattccagacagaaaatttgcatcgataatgttgaaataaatttgcagagcaaaataaagggctcataacatgcctcagagcaaaaaataggaatattgttctaaagtacctgagtacaaatcgtattcatatcaggccatatgtatatatgaagctaattaaataacaaaggagcataacaagcatatgaatagaactgtaatcaccttgcagattagaaaagagaaagaagtgatggtgcagtaaaagtagatcaacattagcacagaagaatcagaaaattaacctgaaaaaatacacaggggaaattaaacatataagagattactggctataatctgaggatgcattattaattcacaaatcaaatacctgcaggtattttatgtccacgttgatctccatcgtcagattaagatcgatatcggataaagggacatatatataactagaagaagaaaattgaagagggaataattggtactagtacactactcagggaaaattgaagtgtagtagctagtgtgtcagtgtgtggaagctaaggccggtggttaccacggcctgtccctggtgtggcctggtcacgtacgatgcctcaaatgcgtgggatggcttccagatcgctgccggattcaggggtaagattgagagcttacagagattccgccagatgggtagccgccgggtgagctagccgaaccgaaccgccgccgccggccggctctcacgctgctgtgtgcgggcgaggcggcgagccaagacgtgcggggaaggtgtggtcgggatcggccgccgttgcctcgcgatcgatcgagacatggcgttggggaagggacaggggcgcggacggggtatggggccggctgggctggtttatctgatttggggcctgatttgtgtgggcgagtttagttcccgacaacttataccccgtttttcacacaaataatacaaacgcaatattttttttttatattcagcttcccaactttatttcacggttggctcagtgatgtcacgagctaccaggcgagttacaaaatgtacttgattataccaaaatgtacttgattatttcttctgccagttttcgtattggcagggggtttcagttcttttcaagatagtggaagctttatcgatcttagacgtaagggcttgttcggtttggaggttattgaatgaggattgagacggaataactctacaccgcaatagtgtgaaataaatcccctccaatccctccctcatggggattaaccgaacaaaactttaatgaacaactattatgagaaacacctccggcctctacaccagaagagtgcacacatccaacaggaatccacgatagcagaaaaaaacttcaagagccctctaaccatagcctaaaacgccacctatatgccgggtagaaaactccatggtcactagcttcaattattgacaagccccagtgatagtactccataaattgatcttttagaagatagcccatgaacggagccaatctaacttaggccctgtttgattcagcttaggattattataatctagcttattaggagtaagctgaaacaaacaagtagattattatagcagattattataatctataagccagattattataatctaataagctgctctagaggagcttttttcagattattgagtggctaaaggcccactacccctacatacttgagaaaaattacccacctatgccatcaaccaaacagatagctgagggcattatagactttatcctttcaaacccaataatccatgcctccaataatccaaacaaacaaacaactcacagcttattctatgtcagcttattataatccagcttatagtaatctggcttaataatctagattataataatcataagctgaaacaaacagggccttatactcattcgtttcacattataagatgttttggtctctgaatttctcattagattcattaatatccgagtaaactgcatattgggatatatttagttagcatttttttactttggtctaggccatacactgtgtcgtaggctctccggaccttccattatattatatttgagagataaagtgaataattcaagtcatcaaacaagcataatgaaacatccgacgcctcgagagaggaatattggagacattgctgggccattagcctgccagtcaacttcagcctgagatgtgcccgtcaaaccactcgaaggcggtgaccagatgtgttacacattcaggagacttgacaaaaatggctaaagatctacaacctctcaaatattcctaactcatactcatgtgaatctagttcccaggatgtgccctagatccacactttcatcttaagcatgattatacatagcaaacacaactaagatgaaagaaacttaagacttacaacatcttaataattacataggccgaccggccaaatagacttattagagaacagcagaagcttgactacccaatcacaagcacaccgactaggggtttaccccattaagttctcatcctagaagaagcaatcggaacccgcatcactcaaagactaagtctaaacctgcaaacaaaaggttatatcaacagcaagagtcagtacattaaacaagttaatgtattggcaagcacaagtcaatcctaccatactacatgtaaggcatatattcaaagaaaggcaatatgtagttcaatttcagcataaagcaagttttgtttcgcaattcttttgtaaaggagttgatgcttcaattaacaaaacaaaattttaagtttcaatattaagttcatcataattccatcgtaatcaatctcttgttgtcatcctttgacaacaaatcataatatatcacctcacacacacaactcaacacatttatcaatttcaaaccaatgtcacatgatcacattttaaaacataaagtctatactcatgacacatcaccaaagcgctcatgaccgtgagcacggctaatcgattagtttaaagaactctgcagagtttgtatagctttacccacatgatatgaactctctagtttgttttgagtttgtaagactccaccacactcttcatgttgaatgtgatctagaggtcataacgaagcctttacacaacttagaacctagccttgcaccagcacgatacgtgttcctccatcctaggcatacttggaatatgcctagaaccgttaagtggcgggcccacgccttaaacttaacgccgtggtggcggacacaacgggaacccacccacgtggcacaataccgttgtattggacagacttagtcacctaaactatcatgtcggggcaaataggaagttcatctgaatcatcgactaattcctcagaattatcgactaactcatacacaccggcctaccagaatgcaaggctagtcctaaatagattaatcagcttaggccatcccatactagcacatgtggatatatgaataactttaaatgggtgacacaagttcggtccttatggacttaggcaaacactccccctatcggtatgcaactagcaccatatgcacaccacttgccgcccaagtataaaatcacattttacacattttagttcgcaaatacccatcatattaattttattccagcaagggttcatgtatcaaaattcacattttaattacagatggaatgagcatttgcatatttctaagcatggctaagcaagtagttgcacatagagcatatataaacccatttgagcacaaagagtgtactctaaccatttctaagggttcaatcagcaagaggatcaattattcaaggtggggtatggagcaaataagtcataactaccttaacccaattttaaataccgatatagtctaagttcacatgcaactttgcaaacaaatattttcattcctcaaatcatgggattcaatgtgttcaaaggatgggaggagaaaacttgccttgatcagagaaatgttagcacctaatccactccttcaccgattatgcaattatctagataaaggacacgatatgcaattaaacaccaaaagagctgaaaatccaaaatgctctaaaatgcatgatttatgcatagtgattaggtactggtctaaaataaatttaggtgaaagaattcctattttatcttattccatttggatttgggagttatgaattttagaagttttatcgatttatagtaatatagtcttaggtagtgttatgaaatacttttgtaaagtgatttttattatattagacttcacagaggtgtagaggtgtgttttctaagactaatacatttggtttcacaatttttggagttataatgattttcttatagattttacaagttacaacgtgttttaggcatatagtgttttatatgtgcatgactctcaagttgtaggttcagaacatgctacttcatgtttaagttgaataaaaggaataatttagttaactaaaacatttttagttcacatgtttatgatctttactactatggttcatattttataaactagagatgctctaatctaaactagcaatatattatattaacctagaaattgttatatgagctaagttcttctaagttttagtggatgaggatggaactatggcttcactggtcaatcaagtttttatttaggtttaattagacctaaagtgtatatatacttatacatgtttatgtattacttaaacaacactatgtgtttaaattcttatttcactaagttaaggttttgatctatgttctctacaaaaggtgccaaatttaattttactatgttgaagataactatttgctggttctatagaaactttgttcatttcatttggactaaaaatgaattttctacaagttttacaaattaatggctgctctatgttagtaaatccttatatgaatatttagagacttttactacacagtaagtatataatcttatttcataacatggaaatacatgttttggtgatcctacagaacttaaatttactcaaattaaagctaaattgggttctacatgaatttctaaagtttagcttatctaaactaatcattctagagataatagttttagaggcatttgatgcaaagtaagtaattacttttatttcacctaatcagagagtgcatgatgatgaatctgtagaatttgattttgtttcaaaatgagttgagatgaattttctatgtattttataagcttgtacatgttttatgtatgacctatcttagataaattttagagacattatttgtgcagtgagtgtcaagttttatatttctaaaatagagttcataactttaagaatctacagcaactggaatcatctcaaaatgagttttatttgattttatatggattttacaagtttgggtgttttcatgttaaacatttaatgttttagttatttttcctttgcattttcagatttttatacacatgggtccactgatcggtggctgaaccaatataccaaaaaaggtccctggctttatatgaactgcatttaggtccgtgggtccacatgtaaacgactgaagttttatagtttgaaccctatgtttctgatcatttacaggacaaagtcctcatcttcaacctccagcagcccgatggactgggagcttggccatggctttggcgagctcgttggcgacgattggtggctcgattgggaatgaggtcaaaagataaaatgaagagaatgctctcacgattccattcctctagttttcttggctaggagacatcggagtagcgccgatggtgagggtgagcggaaggtatacatgagctgttactgcatgttacctagggctttgattttgctagatgcatccatgcatgtgtttcctaagaggttcaggaggctcaccaagctgtaggaagaaatcgctgaagcttggatagcagcggcttcggttggaacggttcgacggcggcgctcctcctcgggtgaacggcgacggctcgaacaggacgacgagctgctaaaggaaggcatgcaagagggttatgaggtcaaggagatggtgtatgcgcgaggaatcgaacaatggctcaccgagtcagcggtaatcgacggcagaggcgattctagatcggcgctggtgaagaaaagatgtgttctccgagtccttcacatctccggctagggttcttgaggcgtattgaagaggaggttgagacgatgacgatggcgcagcggcttgctccgaggtggacgagaatggccggacgacgacgatggttgaagcggcggcgctccggtgcgtgctccagggcgtcgttggcgtggtcacgttccggtggctgtgatgcacaaaacgggaggtggtcaacagagaagtggtttggcattgtgtggagagatggaaacgcgaaagagatagtggtgaccttgactcaaacggagatagcgatggtcgtcacctccatggccggtggtgaggtcgctggtgacggagaggcagaggacctgctcccctcggcttcttcggctctgagtgatgagtgaggaatggcgactcagactggaggagaagagagcaagaaaaggaaagcccgaggtcgtcgacacgttgtggccacgcgtcggctcgctcgatctctccctctctgtgttcttggtcggctgagggtgaggcacagagaaagggcgagctggagaggctgccaagtgggccaggacgaagtgctctaggtggaagtgagaggtgtggggaagattctgggtgaacacggttttagacgaatttttagattattttctcaaccctaactttgtagcttcataacttaatgtgtggaccaaattaattagtgttgattttactggaggtaaatgattacacctagattccattttctttggttgtactcaaaaataatgggtagactgctcacagaaattaaacaaagatgggctattagaaaggtagattgaatttttaggaagcctaaacagaggaggaaaattctagaaaaattatatttaggcatgataaataatctagtatttgaataaattattttccatgttcacttatgtacagttaaatgtacttttggatgaagtatggctttagccaattaaaattttatttgatttcttttagttttctactttgactgattaatttgtggtattaaacttagttattaacttgtaccaatattatagtgaattgcttatgctaaacatagtttacataattttttccataaatttttccatgatttcatcttgcatagattattttaaagaattagaataacatttctttgtatatgtgtccctacttcataattgcacctaatattattatagggattacattaaacttcttttgggctgagaaaaagatattagaatttaatattaagtccacatgttatcacccaagattaactatagttttgcttagtaatttttaacccttttagtttatgctcatgagacctattatgaaaagagagaccaaaatccaaatgcacaatgtatgctccaatgcttgatgacatttctagtctaatgttgggatgaaaaagttttattttgttctcaaattttaatcatgcaatggtttaagttggtcatcacctaagttaaaacggaaatttttggctctcaaaattggagaagttaatctctaactattttgacaagaaactttaagtcctgaaatttcaggtatgtcacagactggtagagaaaccatctttggtcggtcgacccaaatccacaatagtcccggttgcattaaaaaccgggactaaaaatcatttttagtcccggttgataggaggaagatgttaccaaccgggactaaaaattatctttagtcccggttggtaacttcaaccgggactaaagttcatttttagtctcggttgattccatgtcaggccgtgtcagggccctaggatctttagtcccggttagtaacaccaatcgggactaaaaacctatttttagtcccgtttgatgttactatctgggaataaaaatcaaaacacattatataatccctagtaccgatcctcttttcccgtccacacaacaaacttctccctctatctcttttttcctctctaacttcttatctctttccttatctctaactcaagcctctccttccttttttccttcactccacaacgaagaagcgtacgtgcacgagggcgggccggccaagcggcggcgcggggaccgctcagaggcggcaggcgcggcggcgcggggggcggcgcggaagcggctgcgcggcggcgggcggccggtgcggcggcgcggggggccgcgcggaggcggcctgcacggtggcgtggcggcgcggggggccgcgcggaggtggcctgcgcggtggcccggcggcgtggggggccgctcggcggcggtcggcgcagcggcgcggtaggccgcgcggcagcgggtggcggcaccggcgtggcgccagccagcgcggaggggaggcggcagtggccg

SEQ ID NO: 48059 - DNA, 7123 bp, Oryza sativa
tgaggatttaaagattcggagatgttctgtgatatgtgatgatttggatttgggaggggatggtgtgaaatcaatattcaatgttaaaaacaatgaaaaagagaaaaaaaaagaaataatatctttagtcccggttgactaaagatgctcccatctttagtcccggttggtaacaccaaccgggaacctggactaaagatcgatctttagtcccggattcgtacttctggttggaaaaccgggaccataggggggttacgaaccgggattaaaaagcacttctccgccagtgatagctcatgttttcactttgggctagagtttctttccttctcagatcaccacccgactgggcactgcctgcacatcctaccatcgccggcaccgtgaaccctctgctgctgctgccgccggctgctgcaaggtgtgaagagcaacagcaccgctgaaggaagatgaagcaaggagcaaagctgcaggaggcagcaatcggtatagtataggcataggcatatggagcttgaaaggttttttaacatatcgaggcctcacctgctcaccatgggcttcttccttcctcattgtgttgccattgcatccagactacgggatgagaacacacggcctagatatagccgcgttggtgaggtgctaggagcggacaagatagagatcgaaagattggggaggtctaaactgaaacaaaagttattttccctagcccaaagtgaaaatgttggttgcatcatagtccaaagtaaaactttagtaataatacctagcccaagatgcgattcactcttaatatccatataaatttagacacattgtaactggacccactaggaaagaaagggtttttctaggcgacccaaaatctattttcgcgtgcggaaggccggctcgtctgcttaaatggtctatggaaatccgatttttatgtacgagtagcgcacccgcatgcgaaaatccgatttttgtgtgcggattcttatgtcgttcacacatacaaataaaaaaccgaaaaaataaaaaaaaactcaaaaaatcaaaaccctaaggatcccggcgatggatcgggacgtcacggagccggcggctccgctccaggccgattcctcctcctcatcgtcaacgtcggtgccaggtggggacggggattgtcacgcctagaaattctcgaaacagaatttctaagctgaatgtgcattaaatccctgtccaggaccagccagggtacacaaacgacaattgttgacatacagacccacgtcttacaaaaatataaaagattacaaatgcagcggaaaaggttaaagcgagctaaaccgggaagcttgacttcagcaacgggcgactccactccacaggcaaaccttgacggcagcggcgaaaccaacctctctgagacggctccaactgagaagaacttcaactctggtgtgggggaaaagagagcaagactgagtactacccactgtactcagcaagtcataccggaagaggaggtatgatacaggatataaccaaaggaagctaggggttcttttgcataaagcaggcatttcaaagcagtagttgaaagcagtaaaacagctgtagtaattaatcaatattaaccaatcactgtccaacgctacaccacgttgcaacagacccaaccatctacctgaactacaccagttcattaagctaaactaggggtgagactaatcacggtgaatctggttgatcgcccataaccgcgggcacggctattcgaatagttttactctggccagaggtgtacaactgtacccacaagacacgattccacacatgtcgccatgccccgaagtatcaccatgatactgcaaatggggaaatcgtgacaagaccctccacataaccctcccctaaccattcacaccacgctaaggtttcacccccacccctcaaaaggtagtgggcggtcccctcttgcgccgcggtgaatccggcagctggacaaccgaacacctcggccgacccaactccatcacgcccaccctcgccaccggtgcctaggaaagggtcgagctatacttcagatcaagcagttacccactcccgcttgtggaaagcacggtaagtctcccagggtttcccgtgaaccggtccttaactgccatgggtgcgaccagcaaaaccatgcacccacagcccaccattcagtgtattttaattaactaacaccattgcggtggcaccaatctaaagctatgccaatagacaaagtctatgtaataatgtagtccccatttgtgtactagttgaactaagcatggctaagcatttcctaaaccaacatctaatcattttgatacccaagttatcaatggcatagggtaaccaatatgtggctgaggaataggacccatcccacattacattgtaaaagaatgcaacatttaatagaaatgcgggatattggtaaattgggtacaatatgatcaaacgtattgcatgacttgccttgctctcgaactgatgagacctcagcaacgtcttcgagaaactgcggatcgacgaaacggccgaaacctacgcgacaaacaaagcacacaagcaaaacatgctataagactactgaaacaggaaacaaaaccatttttaatggattctttgcatttttcttgatttactgagacttgaatggacttaaacggagctcggatgaattacttatgaattttagaagataaactgtgtttttactaataaagaaaaagtccttaattaattattgcgcaataatacccagggctgacgtcatccaaggggggggcggcgccgacaggtggggcccatgagtcagcggctccaaagggagggaggtggcgcctggcaggtgggccccaccaggcggtggctcaaaggggaggcgagggaggcgccggccgggctcggctcgacctcaaggccgaccggccgaccaaggcgaggcagcggcgaagcacggccaccgacggcggtgaccggcggtgcgggaagcggcggcgacggccgaaaggcggcggcgcatggccggagcagcgacgtggccagcgctcgcgggaagttaaggaaaggagggggggagggaggactcaccggcgacacggcggccggagcggaagacgaaggcggcgacgacgacccgacgagaggaggggcggacgagtggtggcgacacctagaggaggggaggagaggagttagggatggagaaagcgaccgcgacgaccaaaatggctggccggagacggaggggaatggatagctcaccggctcgcgagggagatagggttccggtggggttccggcgacgcgaggcggtggccgagatggcccacacggcggcggagctagcggcggcggcggcttggcgcggcggcggccctagtggcgacggcacgcggccggagatgggcggcggcggcggcgctagcggcgagcggcccgcgaccggtaggaggcacgggagagcgcggcgaaaaggggaaaagggagagggagatgcggggaagctttataggggctcgaaaggggcggacatggccgggaaaccccccaatttggccggcgacgtgggggaaaagagagagaaagtggggggggattcaaatcgaatcccgcccatttgcgggcgcgcgtgcgggccgggagatgcgggggagagagcggcgacgtgggcgcgaggtgcgggcgcggagtggaggcgcgcacgtggagaaggcggcggcgcgggcggtttcggcggcggttgccgtcgtggggcgggcggctggaggaaggggacgacctgacaggtgggccccacctgtcagcgtcccggagagaggggaaggggaacgggccggcccaaaggaaggaggccgagcgcgggagggagtgggccgacggcccaatagagaaaaaaaaaggaaaagaaaaagaaaaggaagaaaggatttttcctgggattaaaaattgcactttggtgatttttaattggttaaaattatttccaaggctctgaaaattccactaaaaatcttgttaatgcattggagcatggggaactcaagaaaaaattccaccacgctatttccgattattaagtgcatttattaactagggatttagctctaggttaattaagataatttcttcgggcaatttatttaaccaatttttaaagcaagaaaagggggaaacttcagggtgtgacagggatggcgccgctcccgagatgcacgccgccagctcctggccaccgctcgccgctcacaatcgaccactgccaaagtcacgtcgagccgatgcccacccgctgcctgccactatccggagtcatgccgcctcccgctgcccaccgaagttgcgccgagccgacgcccgcccactcctggccactgcctcgtcggcggtggagccgagccagccgcctgccgtgcactgcacgctgcccactaggaggggagaagaggaagaaagggaggagacagagagagaacagaggagtgaaaataaaagggaaaggaagagagagaggaggtgataaaaattgaagtgggtgagagggaaaaaggagaggtggggagaaaaagaatatgtgaaggagagtgaatatttttgcgtgcgggccacttaataggcctgcttgtgaaaatatgctcatttttgtgtacagccccttaagaggcccgcctacgaaaatagatttttgcatacgggctttttaagaagtcgtatgcgaaaatgaaggtcgatttttgaagacacaaccaattatggtatgtctgcaatctcaaggcattcccgtattgaaaaatcatttatatagtagtgacctattcgtgaatttattcaaaactcaacagcttataattgtggaacagaatggtattgccttataattttctcccctttgtgtttattttcagcccagtaatatctacctctagtagtctttgatgtgtcccctcaggaagaagatagaatcacattgcataagaaggtatagaggaaaggcaggcattgatatgaacagctctccctgcttgtgtcaaactcctaccattccatccactcagtctcttctccattctctcaagtagaaaatttaacttaggagtaagaatcttctcaggtccaattggcaaacccagatatttcataggaaaaactccaatggggcagttcaacatttttgcaactgtctcagtttcagcaaccttcaatcccacagtggaactctgaaactcttgttatgtggaaaggaaaaaaaagaaattctttgatcagaaacctgtcagccattttgatccttagttatataaaattattgattaatgttgtgttttattacatagaaaatacaggaggaatatctgaggaaaactgatggtaaggtgatcatcaatcatgcagttcagaaagctgcagaaatcaatgacttgaaattgggaggttcattagaaaagtgcagttcaaactgcttaaaaaaaataaaacgggtacaggaacagacatgcatggtttacaaaatccaaaatctagtttatccttggagaaatcttcacatataataccgatattttgtagttgatatctaagttgttgtcatagaaacaagctattgtatatacacaaagccatgttaacatctatcaagaattacataatgtaatgctatccccttaccatttccgccaacctatatatgatttcttagtgcattctatgagttagcattgccaaatagatgatgttgtgcaaatcatgatggagaaatgaattcccagaaaaaactactcctattagaattcaggtgtttagtaagagggcatcgccaaaataattgctctgaggtttgtttctagcattggaccatcctgcacaagtgattcactatcttacctctcctccgcttcattaagaacgattgactttctgtggagcatccagttaattggtcaacatagtaagctacattaagaatggtgaagaatcagattaagcaatggaacaaacggtgccatatggtatttgttactgacacttgacgcatgagatacattatattcatcaattagttaagaagatcaggtaaaagaaatcaacggatgaactgtccccaattttccttcgagattaaaaatcatcaaataatgcatttctagaaaatatattaaaagttaaagcaatttaatcaagtgaattaatgaggaaattaaaattttcttttaaaaataatggctggaaataattgttgtaatattctcgtgctctaaaatactctctgaaatttcctgtgaattttcggagcacaatatctaattgtaatgtcacaaagttcatttcatcaatttaattaaatggaaaacaaattaaaacccctctctcctccttgggcctttttcggcgcatgtcttcctcttctccctccctcagcccgccgcccctcttcctctctcgggctggcctcctcttcccctccttcctcctatcggccgccggcccgttcgctctttcctcaccgtaaagtccacttcacgtccctcctctctcctgagccgccgacaggtgaggcccacctgtcggggtcttcctcgacctccagccggcctccctcccgcgccgtcgcgtgcagcgccgcctcctccgctcgatccggccgttccgttgctccccaaaattgattgcaaaaacggatttctctctgtctccgctaacttaaccccaacaaaccctcatcagattcgtggtttatccatcgaattttttctcctttttatccggtgtacttgggataaaccccagtttttccctcaccgaattcctcaaatgcgatccgatctttcctcctgtgcctataaaaatccttcccccgtgctctcctcgaccttttctcccaatttcccgagctctccgtgccctaaaaccaccccgccaccatcgccatctctccgccgccgtcgccaactccagccgcgttgcgccgcccgacgccgacctgcgccgccatctcctccggctccgcaagtacttgggctacatcggccactggttcctttgcgccgaatcccgccggaagcccctcgtcaccgtgcacccgaggttctcggcctcagtcgcgcct

SEQ ID NO: 48060 - DNA, 1085 bp, Oryza sativa
cgcgtttctgacaaaactcagtgtacacagagttgatgcacaagatgtttttgcacctgttaaatcctttgtagttttttctctgaaaatctgacccaaggatgttactagaaagcaacaactatatgatgacacctacaatcagattgctgcaatccagcgttctgaattgactacctgaaatcatctcaaaagaaagttgttcagcacatctaaattgatttgtgccagatcacttttatcttattctacaaaacagatgccttgtatctgttattctcaaaacgatgaagcccatccccaaactagagtttacacatgcaaaacataacactggtggagaaaggatttgtagtcccgattggtaaccctctgtagtcccggtttttcaaccgggactacgaatctgggactaaagatgtccatctttagtcctggttgaaataaccggaactaaagatacatctttagtcccggttcgtaacaccaaccaggactaaagatttagtcccggttgatgtaaccaaccgggactaaagtttttttttttcttttttttcttttctcatgttcaatctctccaaatcattataaaaataacaaataacaaatcacaccacaaatcacaaataatatatagcacgaatcacagatacacgaatcatagatagttcacatatcacatatctcctaatatcattcacaaatcacagatcgcatcacaaatcacagatcgaacaaatcacacagatcccacatcacattaagaaggaaaaaaagaaaaaaaaagcaaaaaattccatgccgggcggccctccgcaactgccgcggggcggccctccacgactctgctgccagccgccgcggggcggccctccacgcctctgccgcctgccctctggacgggcagccgccgccgccaggccctccgcgcggggcaaccgccgccagcgcctccaccacctgcctcggcgccggccggcgcttgccgccgccggccctccgcgccggccgccgcccgctgccgctaggaagacaggggagagaggaaggggaggaggagaaggagaaagaggagaaggagt

SEQ ID NO: 48061 - DNA, 29915 bp, Oryza sativa
  unsure (1)..(29915): unsure at all n locations
aaaatgaaccaaccgggactaaagatcaaaaaatacccctaagcttttaaaccgggactaaagatgtttcttagtcctggtttttattggaaccgggactattgtgtaattgggccgatcgaccaaagatggtttctccaccagtgtaaatccagccaccatgaaaaccaaaagcattacattaacataaaaatggagattaacagcagagataaaaccctaaaaatatacagaaaatcatcaatatgcttttgttcaactaactcaaaacaacacagtttatcagccagtagcatcaaaaatcgcccaaaccacaccaaacgaactaattaactccgaatcacaaaatactaccataaaactctaccacaaatcctctcaactaaaccaaagcgggaaacaacaaagctaaccaaaaaaatagatcccccgatctggagccaggagatcccgagacactacggcgagagattagaccagcacaaaatcatgtcgtgaaattaaaaacgaaaacgccatggatctaaaactaaaacgccattgatctaaacccaaaacatcatggaactaaaacaaaaaaatcaccaatcaaatcaagctagctcgggggaacaaaaatcacttccaaaattaaaaaccctaactgcaatgaccgaagaataatagggatgcttgaggagataaggaggcgcacctcgtagcgttggacaaaatcgtcggagaatcactggagaaattgaaatcgccggaaagggataagaggatttgggattatcaatgtggggagagaaaagcgaaacgcaccgttcaaaaacgcaacaacgctatttctgatataactttatctttgatatttttccgcttccgcttctgataaggatgataaaaaaaaaaggaaaaatagaaaagcaatcaggaaacggggccatgcgaagaaagttgcggacggcccaagcccaatacgacagatacgcctagaccagaaaaggcaaggggaaaccacacgtttgggccaagataacgaaaggggaaatcgatcgctcggcttttatcccagagatcgattaggatttttgattcgctcctaccaaatttccttccgccgacggcgcctccaacccacacgcacgcgccacctcctaaccctacctttcttttcttccatatatggatctaatccctctctcgctagttttttaaccttcttccatatatatccatctaatccctctcttgctaagcgctcggaattacccacacgtgttggtgcatgcgcatgcgcgctcggccataacccccggccggcgagagctctcgaccacagctcgtcgtgccgtcgttgtcgtgtgcgtctccacggtatatctatcctgggcgtgcggcggcggtgtaggcagtgcgcgcgtcgcggctgccatcgattacaaattggtcggagaggcgagaaattagctattttcctatagtttcctctctttttttcatgttcttgttattagactggtttccctgtatgttctactatatccttctagacttgtttttttttaatttcctttctcctccaatttggatggggttattattttgtttgctctctcaatctagcagcatgctacccgcgcgttaaagggattaatatgccatcatatttttcatgaacaaatagtcaacatatatttaaattgtaagtttctttctaaattacagatgtaattttagtctatttatttacaatgtaagtctctaaattacataagtaattttaaaatttttacaatgtaatatatttaactttgcaaccggttatggacataataaagaaccgtggacacaaaataggagaaaaaaatgaatttattattaattgtacaagtccgcgaaaaatgagcacagaagagttggagcttgatcaagtgtcctagttagttacgctttcggatagctttgatctgacgcaaaaaaatctgactctaatcagcccacaaatatatatgccagcacatgtttagtaaaactgtattatgtttgttcacatatatgaacgaataggtaatgagtactgtaatagtgggttaattaattagcttgccagcttcaggggtgccaatattagttctctcatggtttccacaaattcccgatgttgttcttgtgcctttttctttggctaaaattaaaagttctagaaaacatcgtgtcatgctagttttgagcagaagtttaaaaaaaaaaagaggttatctttgaccagaatactagatggatatcccaataacttccaatggctctacggtttgagatagttcaatatgcaacttctttccaagggccgctctattatttggaaataattcaacatgaacttcccaagggcactacggttttagataattcatcgaattaataactgcattctgtagtttgatttgcatacatgtaatcctcaagatatctccacgtataactaatcttgcatatcctgcctattcagaattgagatatatctcatctaaactctcaattaataattgacaggtgcacacacaaacacgggattatggcggcggataagagccctatcgacgaggctctcctacatggcaaacacgaagaggctctcctacatggcaaacacgagcacgtggagcagcagctcctccccaccagcggcggctcattctgcatcaccggcgcttccttcgggaggagttgcctcaacctgagcaacgtgatatctggcatcgggatgctctccgtgccgtacgcgttgtcgcagggcgggtggctcagcttggcgctcttcgccatggtcggcgccatctgcttctatactggcaaactcatctatcgctgcatgcgcgccgaccgttgtgtacggagctacccggacatcggctacctcgcctttggccgttacggccggacagctatcggcctcatcatgtatgtcgagctctacctcgtcgccatcagcttcctcatcctcgagggcgacaacctcgacaaactcctccccggcacggtggtgaagatcctggggtaccaagtgcatgggaagcagctgttcatgctcgtggcggctgccgtcatcctcccgacgacgtggctcaagaacctgagcatgcttgcctacgtctcggcggttgggctcgtctcgtcggtggcgctgacggtgtcgctggtctgggccggcgtggccgacaagggcttccatatggcgggcagtagtatcttgaatctcagcgggttgcccaccgccctcagcctctacttcgtctgcttcgctggccatggcgtctttccgaccgtgtactcctcaatgagggccaggaaggattttcctaaggtatagtttttaaaatgtatttatgtgttgtacttggtagtaagtttgctaaaatttgtgataataattaacaatgcaaatttagaattatggttaatgaaattgaaaagtcaattgtggaaataaattagcaacaggtttagtaagaatacaacatattgtttttttattctatgtatgcacggaagacgcacacactcattattattttttagaaatcgtacatcagtatattactaatcatgcacactattagctcatggaagttttcttaaacaattttgatcctttcaccattcttttactgatacttatccatgatctaacgacatatattgtatcaaccgttgcattcaatggtccatattttcatatgatgtagctcaatgatgttgcattttaagttttacctttcacttagagagatttggcaaccaatgataattgatcattggattatcagttccaattatcataatttggtttatgaaaccatgatgatgatgatgatgatgatgatgatgataacgctctattcctctccaattaatgtgcaggttttgctgatctcttcggtgttgtgcagtctcaactacgcagtgacagcagtgttgggatataagatctacggtgaggatgtgcaggcgcaggtgacactaaacttacccacgggaaagctgtacaccaggattgccatcctaacgaccctgatcaccccactggcgaagtacgcgctcgtgatccagcccgtcacgaccgcgatagaggagaagctgtcgacagcggcggcggcggtagcggctgatgccgaaaacaataggctaaccagggtgctcaccagcacaaccgtcgtcttcagcacggtggtgctggcatgcacggtgcccttcttcggctacctcatgtcgttcatcgggtcctcattgaacgtcactgtcgccgtcctgttcccgtgtctgagctacctcaagatctacatgcctcgaggaggagttggccgcttcgaggtggcggcgatcgttgggatactggtcatcggagtgtgtgtcgccgtcattggcacctacacctcccttcaccagattataggcacattttgattgtacatttgtgggtatggtggtaggtttaggtagtaattaaataggtttcaaattcttttttttatttattttcttaaaaaaacaacatatatgttatactgagtgttaagaatcaactgagcggctatatattgcatgtgtactctcctggaatgcatatgtgtattatcactaaggaagtttcagaactttcattgtcttcatgttgactaattattgcagctaaaatttaaattttgaaattacttaagttttaagttattctgaagtttatccatcatagtttatcttcttctacccttagatttaaatcactggtaacatgtataaaagttgggatttgtaacatatatgtctgcaattttttttttggttttatctataaattattatttttggtttgtttcattcaaggcttattagcctaactaaattttgtcgattctgaaagtatggtgaaatatgacgcaaatggccatgcttcttatgagattaattttttaatgaaagatcggtagagtaaattccatttgttttctaatagatgacgccgttaacttttaaataaatgtttgaccattcgttttatccaaaaattttatataaatgtataagataattaaatcatgcttaaagtactttaagtgataaaacaacttaaaaaatatatattataattacataaaatttttgaataatacgaatagtcaaacgtgtgacaaataatcaatggtgtcatctatagaaaaaaacagaggcgatggcggcggctgcgatccagaccggtggatccctcgacgaaggcgaggagaggaggagaagttcaccggtgagctgcgtgccgtcaccggcacgcagctcgatctccatttacttcgccgtcttcccctactgcatgcaaacaatgttgtatcgagggctctgcaccacgatcgaagtggtcctcgagctctgggtactccgattgccttgcctagttggagcttcattaagccatgcatgctcgcgggaaggagctcaagctgatagcccactcgtggagtctgccaccgccaactccaccacacctcgttaattttgccgtcgtcgggcggagcagcttccagagctggcgcccggccctctactaccctcaccgcccgccgccttgctcctcatcggcgcggcccgctcgccttccttttccgtggctcgaaatggagtaacttgtagagccagcgctgctccaacagggagtaggaggctggctgccgctggacttcgagttcggcccacccgtgctgatcccctttcgctcttgccccgtgctccctctcgcagtggccctaccctcttccatattattttctggacgtaatgacatgtaaagcgccatgtagatgtcaagtgagaaaaaaaaacaagtcaaaatgttatgtaggataaaactgttgtttcaaatcaccctaggatttgatttgcactggttttgatagtagaaataggggtgggcagaaaaagaccgaaccgaaaagaccgagaccgagaaatccggtcatcaattcggtcctaggtagtaaaagaccgaattttgttcggtcaactcggttagtctcctcgggtaaccgaatagaccgaattattaaaaaaatgtctaaatacaacatataatccactatgtttaataggattaaattctaattttcacatccctactttttctagacatgcaacctaataagagtctttactcataactgcttatgattgttttttttgttatttttgtgttgaaaatttccattatttctttgcatatataaaaatgttattgtatttcggttaggaccgagaagactgagaccgaatttgtcggtcctgacattttttcgttgaaattcggtcttcacttttcaaagaccgaaattttcggttagaccgaatgcccacccttaagtagaagtatgacatatacttttgtggaggagggatgaaaatgaaactcggcctatagctgaggtatgcaaaatggactttttccttgttcctattaaggccttctttattaggccgaaataccagcccataggtggacatggatggtctcagactatggaccatgtccaaatgaggcctcgtagaaggtaacgaaagctagaggttacagagggccagcagcatcccggcatagccggttggctagcagtcccggtccaaaaccaaactcgggagtccaccaatgctgctaggtctcggtgccggtgggtctctcgtcggacctgggcttcagttgggcaccatgcgagcagcagacaccggcacaccgcgtgagcaactagcgaaacagcagacaccgcgcgagccgtgagcagcaaagctttcgctacgcatcttcgctagctgcagaatgccccccaaaccctttgctagctgcagaacgcccatccttcctcccgcccgcactcgatcgcccgcctacgcaggatgacagaatctttatctccaccacggtccacgctcgtacgccgcgacctgtcttggccggccgcgtgtatgcatgcttgaagagcttgatggacagtggacaattggaaaggttccagtgttagttctcacaaaaaaaaaaaagttccagtgttccaaatgaggtttacgggcgttttttttttttaattacaaagtacaacgtagacactcaaaacacaagcacactcaccgttatgaacgcacgcacgcaaaccataccggccatataagcatctttgaaggttcgtggatattcttaaccaaaacaaaaataattatctttatctttatctttatttttatatctatacctaattaaaagattcgtatttttcctttagtcacattttatttcgtccatatgtccgattccctccctctcagcgcgtgcatgggcggtttacaaaactagggtttctctttcaacatctatacgatatggttttgctttgattcttgggaaaacggaaagaggagaagataaggatcaaaaccctcaatttcggattatctcactggatgtggccagatttcacaaaggagggggattcaagccttctcaggcagatgcggcaatacagacggaggttggagacgcccctgtagtactggcccacgtgacaatgaaaggagtgggggaggctgattagacttggcgacagtgaaggaaagaatgggggaggatgattagacttgtagtgccttgctgggctggatgcgtacttgcgggccgaagcaaaggggaggagaagggagaaaagtgggtcggctaggctacgggctgaggaaggaaacgggctaaaattggcccaagagaaaggagaatttttatttagatttttgtttaaataaatgctgaaatgatgtttgtattattaaaattagccattgagatctgaaaatttcaagaaatttctagatagtgtaattaatcatggagaacttcataaaaattaaattcaggcatatcattttatttccacacttactttacttttcaattaatttaaacacctacctacttaaaaaaatcaagtattccaggaaatgtgtatttaagttaattacataatctaaatctttcttaaattctcctcgattttctcatcttttcttcccgttgtaacgcacgggtattttttatagtacctactaaaaaacgaaatatgtttccaaccaaaatttcgatcgtccgtcaaaataacaaaaaatttgttttttggttacaaggagggaacctgttttctttcgaaaacgctttacttcggacgtccgacccgagcaaaataatcggacgctaccacacgaaagtactcccagagtaggcactacatgcagcgatgggcccacaaaaacaggagaatgccagatgtgcgggcacccgatgtagtgcgcatgcattgggcgctgctaccgcttgggcgcaccacgccgcctgttgtgccacccacgtctctcctacacgcgtcctcgtgctgccacgtgtccccaccacgcggcaccagagaggttggcaccgtcccattgtatgacggtgccaacgactctggcgccccgataagttttttcagggttctatttatgaaataagtttttttaaaaggatcagggaggtcactttggtgttgagtacgtagtatatcactagaaacaacaattttaccgtcgccattcttccaaggttggtgtttacactctgatattcttcatatctcttatatttgctggtattaacataagagtaaagtgcatagacgggtccttaaactcgtagggttgtgtcatctaggccctaaagtctaaaaatgcagattcgggtctcagaacttgtcaaagtgtatcatttagattccaaatcgatatagccctttagtatcctacgtagcgccaatgtggcatgccacatggacgtgacgtgtcattttctttttttttctttcctttttccttttcctttttgttttctgatctcattcttctttttgtttcctttcttctgctcggctcacagagaaaggagaagaaagggaaaaaaaagagaagaaaagaaggaaaaagaaaaagaaaaaattttaaatgggttccatttgtcacatcatgttcgtgtggcatgcgacatcagcgtcatgtaggatctcaaaggggctgtggcgatttgggatttagatgacatactataataatttctgagacttgaatatacattttaagagtttatagacttagatgacacaatattacaaatttaagaaccactcgtgtactttactcttatcataagttagtagtcttcagtcaacggccggtaacctcatagaacagaataaagacagggaacaaactccagattcttcccgtcagctgacaaagcgggaagaattctagttttagtgaagcggtagaagtaactattttcaaccaaagtgtttgagccccaaatcctcgcttttgttgaaaacaaaaacagtggtagatgtaattataacatgtactccctccgttttaaaatgtttgacaccgttgactttttantacatgtttaaccgttcgtcttatttaaaaaaatttataaaatatgtaaaattatatgtgtacatgaaagtatatttaataatgaatnaaatgatatgaaaagaataaataattacttaaattttttgaataagacgaatggtcaaacatgtactaaaaagtcaacggtgtcgaacattttgaaacggagggagtattatcaatatgttttgatttgcctctcaaaataatacgtccgcatctcggcagtgcgcgtccccccttcgcccgtcacagtcggcgcgcgtgacggccttggagccagacgaaaagcaggtcgagaccgctccaccgcgcatatccacgcaacgcaactggtacgtgctgccttgacgcgcccagaaaagcggcacggcttccacatttttcggccaaatattatatccggccgtgtaccggagcacgtgccgagaacacgtcgccgtcgtcacgtctcccgccgtgatctagcgccaaccggggacgaccaatcacgtatagccggagaggtcaatagccgagtaggcgaccactcgtttggtctattggccagttagaatcgctgcaggttttaagcaagggggataaattaagagtcctggacgcgttggcgggacagggacgtgtgtttcgtcttcgagagctcgacttcactcgcaccgtgtccgtgtgttgcgtgtgtatatatagctgggcagccacgctctggtttccatcaaactagaactgaactgagcgagctagctgcttctacaactgtgcaggtagctaattaatctagcaatcctcccgtagattggaataatggcagatcagaaggtgattctcgccgagccgctgcttccggggaaggaagctgacttcgccgacgacgacgacgtggaggcgcagctcacttcgtaccacaccggcgcctccttctccaggacgtgcctcaacctcaccaatgccgtctccggcatcggggtgctgtccatgccgtacgcggtgtcgcagggcgggtggctcagcctgctgctcttcgtcctcgtcggcgccgtgtgctactacaccggcacgctcatcgagcgctgcatgcgcgccgacggctccatcgccagctacccggacatcggccagtacgccttcggcgccaccggcaggagagccgtcgcattcttcatgtacgtcgagctctacctcgtcgccataagcttcctcgtcctcgagggcgacaatctcgacaagctcttccccggcgcaaccatggagattcttggctaccagctccacggcaagcagctattcattgtactcgccgccgccgtcatactgcccactacctggctcaagaatcttggcatgctcgcttacgtgtcagcggccgggctcatcgcctcggtggccttgacggcgtcactgatctgggccggtgtcgccgagaccgggttccaccggaacagcaacacgctcaacctcgccggaatccccacctccctcggtctctacttcgtctgcttcaccggccacgccgtcttcccgacgatatactcctccatgaagaacagcaaacacttctccaaagttctcttgatctcgtcggtgctgtgcagcctcaactacgggctcacggcggtgctgggctacatgatctacggtgacgatgtgcagtcgcaggtgacgctgaacctgccctccggcaagctctacaccaagatcgccatcgtgatgacgctggtgaacccgttggccaagtacgcgctgctcgtggcgccgatcacggcggccgtcgaggagaggctgtctctgacgcggggcagcgcgccggcgagggtggccatcagcaccgccatcctcgccagcacggtggtggtggcgtcgacggtgcccttcttcggctacctcatgtcattcatcggctcgttcctcagcgtcatggcgaccgtgctgttcccttgcctctgctacctcaagatctacaaggccgatggcatccaccgcacggagatggtggccatcgccggaattctgctgctaggagtgttcgtcgccgtcaccggcacgtacacttctttgctgcagattatagccactttctgaggtggttggttgctgttggtctctgatagtagacagtagtacttacagacaatagtgtgaccacagtgtccttaaaataaagggcgcttgaaaaaattttcggagttagtttgtatctaagataaagctgaatcaataatattgacttaggtgaaaaaattgtatatattattggtgccaacaatgtcaatgttgtatttaataaatatcagatatgagacactaatttaggtttatttgtaaaaaaaaaaatgccaagtgactaatttgtttaaggaacaaatccataagagatgttgtcgacaatgtcaagggacaaatttgttaaagtaacaaagccataaggggaggatccactaaaaaaaaaggaatggacagcgatacctgtgttttgctatttgaatgacggccgatgcttccaaaatccaaacctacccacctaggtactacagacctgaagcaacgaagaacgaaggttttttcctctgctatcgagaggtctttcgttgcatgtcattcaaatatttatcaaaaatcttaaaagaacaacaataaattgaaattcaacctattcaagttgaggaaaaataataaattaaaatctaatgttttgttatttttgttttaataacctatatagattaaatttgaaattgcataattgttaaatatgcacgtttgtgaaacgatatataatatattaagctatattttttaacttttcaaaaaaaaagctatttaaatagcatggaaaaaaggaagagcattttactctctaatgggaatagttaactcacatatatagatgctaaatatgcttcacatgcatttggggatagttaactcacatatatagatgcttgattaatcgccagtatgtttactgagaaagagaagaaaaggaactgataagtcaaaggaactgataagtcatcgccccctacaagcccaaacaggcaaaggtgtacgatgtgggtcggagtgacatggtcgtggcttcgccgctttgggtggaggcgtggagcgatgcgggcagtggagcagcatgctttgggccacccgacgcaagaagagaaggctgacgaacatagggtggaataatttgtatgagtagcaaaggaggggcgtggctctgggtgcccggacgagacgctggagcggagctgctctggcactcggctcagcagcggaggagcgagctgtttctaatccggcaacctctctgctagatcacccagctcttcgcctctactctaggcctccgttgtcagattcagtagattccacctctctacctcattccccacctctattccttctacctctattcttccactacttctaatcctacacctggggagccgatcccgatcgtggcacgagttcgatccagaggcggtcaaattttaccgttcctccaacccaaacatccatttcatacttacggttggattttgctggcgcaggggatgcgaaccctatggaataaggtcaccatagggccctcaactgaacagcgagattttctaagatcctttaactagaaaaccagaaatgtgtacctctaaactctctcaaaccattcaccgaaggtcccttggcagtatttttgcctggttttactgacgtggcatcctagtcagaaaaaaaataaaaaattacgtgcggcccacatgtcagctgcacttttttcccttttcttttcttctccttctgtactctcttctctgattctctcttcagcaagcgcggcagccacaagcggagcggcgtgacggggttctcctccgtggagacgacgagcacggccgcggtggcgatggcaggttcccagacccagagccagcggttgccgacgccgacgcggcaagtagcgggcgagcgcggctggagcaggtggaggggcggcggtcagtgggagagcgcagttgcagcggctcaagcggcgggcgagcggcagcaggcggcggtgcgcggccggagcaggtggaagggcggcgttggcggctgtaggcggcggaaagcggcggtctggtcccggggactcgaggagaaggaaacgcgagcaccggggccgaggcgcgtggggagctggtcgcgcaacgcggcgacgtcgtcggggctgaagaggaacctgcggtggtgcacgagctcgtcgcctggacggagcttgtcgctagcctcgtctgatgccggctcgtactcggggtggtcatacgccggacgcggcgggtggcgcgcgtcgaggggctccctcgctcacaccggccagacgctctgcgccttccgcgagctcaccgacggcctgcaagaactgcgtgatccccgccgcgtcgacgaggttgtggcagatctgggtgctgaacacgaagccgccacacctcagtctcgtcacctatgatgcaacacgaaaccgccacacctcagcctcgtcacctacatgcatggcatcatgaacacgtaaatcacgcacaatacaaatggtgcaaaatttgcaaagtttattcaagttttatgacgacgtacgtacctgcacatagagtagtggccggtcggtgacgacggtgaagttgctatccggcagggtcaagagttcgccggcgcaagggatcggcgggcacagcgagtcaccgaactcctccagcgagacatcggcatcggcctcgacgaacgagacgaacgcggaggaggccgatgaggaagtccaccgcgtccttgtgcgccttcgcgtacagcacgcgatgcaagcgcttgtccaccagcagcttcagctatggcccggccccggcgggcttcgcctgcgccgtcatgtcgttcgccgtctgcaagcacgtagtgctcctagcaatcaataatgatgtccacatttttattgacgggagcgatcaaggagcagcggacggtgagctcggcggcgacgtaggcgcagcagcagcatctgggcggcggcgaggagcgcgcggcggagaatgcggcatcggtgtagcagccgctgctccggctgaacgtgctggctccaggtctgggaacctgccgtcacagccacggccgtgctcgtcgcctccacgaaggagaaccccatcacgccgctccgcctgtggctgccgcgctcgctgaagagagaagagagaagagagaagaggagaagaacaaaagagagaaaaaaaaagatgtgcagctgacatgtgggccccacgcaattttttaatttttttttgctgactaggatgccacgtcagcaaaaccgggcaaaaatactgccgagggatctccggtgaacggtttgagagagtttaggggtacatatttctgattttgtagttaagggatctcaaaaaaatctcgctgttaagttgagggacctccggtgaccttattccgaaccctattggacggataacccaatttttgttttgcgcctattgggccgtttgtcttgccgcctggtcgaactactcggcccgctggagagtggagacagtgggcccatgcaccgcgtgttgcgaagacgcggacggcctccgccgccgccggcgaagcgctgccctgccagtgccaggtgccagacgtgactgcgtgagaggccagcgaagagatggatggccaaaccatatgggcggccctacgattcctcgccggccggccggatcgattccgtgtaccgcatgctgcggccccatctccgacttcctcggcgtgccggttggatcgggcgctgcaccggatgctggcaagattgctgtggaggagatcagctcgctgctgtcgcgatcgacagtcgccggaatccattgaccagtagccgactccgcctgggacgacctatactttggcacttttattagcgacgacctacttgcttgtgcaggtaggcacaaatatttgtccagcgatcagttagctttctcataaatcggtgtcgaaacatgaattcggcaataataaaagggggtagcgcacgagacctaaaagtggatggatgcggagacaaaggatttagacaggttcaggccctctcaatgagaggtaataccctactcctgtttggggatttgaatccgccgagtgtgtattgatctgacaatcagattgtgtcatgccccctagagggcctcctgcccaccttatatagggtggggggcaggattacaagatagaaaccttaaccaatacggtatcggtttcctaaatctactttacaatattatcaaaccaggactttaggctgttccgtaatatataaggaaacgtaatacccgagtcatgatctattacatattccatagatataagttatcccctatgactagtcggataaccatgccgtatgggtatggggtacccataatatccacagtagcccctgagaccttcgcagtcgaaaagataatcttctctcgaaccagattactccaaagccgagtgcttcaatcatctttgtcatggtctcccgagtacttttaccaaatctgaagactgtggagggctggaaaataaagtcaggtgcaccgactagatgcacctaataggtgtagcccccgacaatgtggttaattgaataaaccaagcatatagtcaaggaataaataatccaatcaaccgagtggttttgataatcgtaatcaaccaagtgacttgatatcaatatatagcatatgcggtgtgaatcctccaaataacatgatccgagtgatataccaactgctttgtaaaatatgatgagtgatatagcaaaatagctataaagaagcttgtatattgtgaataaagaaatttccaaagtattgggcatacgccatgcgcacactgctttaacagatgtgcttaagtccctagaagacacatggtttcaccacacctggaaatatatggcatatgtggtgtaaaatccgagtaaataaactcataaaggatttaccaaccgcctagaaaatgaccacaatatataatcagcctaagccataatattggtcaataaaaatgcacacttacgtggcgaaaagcaacgatattgtatccaatcaattgcttaaaaacccaaacagcaccatgactatattaaaaagtcagcggggcagctatataaagctttactgtttgacaccttttaagatgcattgtaccaactcctaaaaagttgagtaactgcggtataaaaggattttaaggtattgggcacttgatcacgcgcactttggcctaagcaaaaagtgcctaagtccctaaaagaacgtgacaggccacacctgaaaatatgggctgcagacatattaggcctaggccaaaacatatgccctcgacaccctttaaaggatgacgcatgtaacatgctcccgagtaataaatcttccgggtaatatagaccaagcgtagctcatatgaatagcttctgatctgagtgattatcccttatgggatactccaaaatagatgtaacaattgaatcccgactggcgcaagtattcagttgataacccttacggggaataataaatagtccagtctttgagcatataaaatagacccatgatcatgaattcatgttgcatgtatccggagcaagtccaaattgaagatataatacttgtatttgagctagtaagcccctgagcacgtagtcacaattgttcattgatggtagctgacgcagttggcatagagacaagacaaccaatatagagagaatattgcccaccagaggtggcaaaaatattggtggtagtgaagatagtgataccgatcaaaagtactgaagtcgcatagccatggaggcgaagaaaccagtcggcggcagtcaggtcaaccagcaatgaatatgaaggcgctcagcgataaagttgtgtagttgacgacaacaaacgcaatcgacatgatgaagatgacgatgtcggtgatccagccaatagcagtgtagcaaccaatgataatgacaaagacgctcatcagcatttgcatagtaggtcaaccgtgaaggtgaaataataagtcggcgaaaacataatcatccattagcaacagcagagatgtcagggtcgatgaagcagaggtgctggtgatgatgtcagtgacaataatccatcaaattaatgttatagctgttgtagatgcttcacttggaggagagttgatgttgttgcccaactcgtctaaaccgaaatatttgaagttgttgaagtagaatgtctgctccgaagcaaagatgaagataatgactcctggagttgactcgtgggttgatgaattgatttcttcagcttgacataaaatttgtcaaattttgagccttgtatttgtgtagcccccgactctttgattagttgggaaacaactgaacatagagtcgagaactgtagcctcttgtcgtcgaatagttattgcttgattgaagatatgtgttgaagatgtccaagtagaaatcctgaatattggagagcctcttgttgtagtaaaataacatggcatcgcatgccgagatgtcgaggctcacaaagacgtcgtggttggtgaagtagcaaaacttgcgaagtagcagcaatagagtttgccagtgccgaagataataaagatgaagtcgctctatcatgatgacaaagttgcattgccgtgatgaagtgaacacgagtcgtcggcaacagaagcaaactggtagtgaagacgcgcagttgtgaaaataaaagcactagtcggcgacaacataaccagtcggcgacggaagacgatgatgttcacgctaaaattaaaagtttgatctttatacgatgaactttgggtgcgtttagttcacgctaaaattaaaagtttgattgaaattagaacgatgtaatggaaaagttgaaaatttgtgtatataatgttatgaaaaagctagaagtttgaaaaaaaataatgaactaaaccaggccttttccaaatgggaattgtagataaagactgttcaatcatgatgaagctttacgtaagcggtgacgaagcaagtgcacatgtgccggcgatcacatgtctctttcttataaaggatcagacagcagttccatattggagtatattctccagtaccttcagacaaacgaaaaatcagcaaagtggctggttacccatcctaggctcccagcggtttcttgcaaaacaagatgtaacttcagcgcaaatactctctctctctttaatagatagcatcgttgattttctttaccacaagtttgaccatttattttattcaaacaatttacgtaaattatattattttgttatgagttattttatagcttaaattactttaaccataatttataccttacacatttatataattaaaattggtgaaacgtgtgttcaaaagtcaacgacgtaatctattaaaagacggaagaaatataaatgtagaaatcttgcaggcgaagcaggtaagacattggagggatgaccggatgatcaccaagtcagaaatggcgacttggtaccattcttcctggataattcgagctgaaggcattttgactcggacactacaaattaggtggatctcctcttctgaagatcacacagtttttcaggcttctgaacttgctcagctagccactctgctccaacgcacgcagcttagctcggagtgacaacggaatggctaccatggatgagcagcagccactgcacatcctcttcctcccgttcctcgtgcccggccacctcatcccgatcgccgacatggccgcgctcttcgcggcacgcggcgtcaggtgcaccatcctcaccacccccgtcaatgccgccgtcgtccgccctgccgtggaccgcgccaacgacgacgctctccgtggcgatgccggcggcgcaccggcgatcgacatcgccgtcgtgccattcccggacgtcgggctcccgccgggcgtcgagagcggcacggcgcttgcttccgaggaggaccgtggcaagttcgtccatgccatccagcggctgcgcgagccgttcgaccggttcatggcggagcaccaccccgacgccgtcgtggccgacggcttcttcacttggtccgtggacgccgccgccgagcacggcgtcccgcggctggtgttcctcggcaccggcgtgttcgcgcggtcatgccaggagagcatggtgcgccacaacccggtggaggcctgccccgacgacgaccccgacgccgccgtgtccctgccggggctgccgcaccgcgtcgagatgaggcggagccaaatgatcgacccaaagaaacggccggaccactgggcctacttcaagatgatgaacgacgccgaccagaggagctatggcgaggtgttcaacagcttccacgagctggagacggactacgtcgagcactaccgcacggctctcggccgccgcgcgtggctcgtcgggccggcggcgttcgcgagcaaggacttcgcggcgagaggcgccgccgagctctcgcccgacgcggacggctgcctgcggtggctcgacgcgaagccacacggctccgtggcgtacgtctccttcggcacgctgtccagcttctcgccggcggagatgcgcgagctcgcccgaggcctcgacctctccggcatgaacttcgtgtgggtcatcaacggcgccgcggacgacaccgacgcgtcgggtcagtggatgcccgaaggcttccccgagctgatctcgccgcacggcgatcgcggcctcaccatccgtgggtgggcgccgcagatgctcatcctgaaccaccccgccgtcggcgggttcgtgacgcactgcgggtggaactcgacgctggaggccgtgagcgccggcgtcccaatggtgacctggccgcggtacgccgaccagttcttcaacgagaagctcatcgtggaggttctcaaggtcggggtcagcgtggggtccaaggacttcgcatcgaatctggagaaccaccaggtgatcggcggcgaggtgatcgccggagctgtcaggagggtgatgggtgacggtgaagagggcgccgaggcgatacggaagaaggcagcggagctaggcgttaaggcgaggggcgccctggagaagggcggttcgtcgcacgacgacgttggacggctgatggacgcgttgatggcacgccggacctctgttgacgtatgaggtggcggttgacgtgaggaacgccgtcggatggtgaccggacagcacacgcgttgtaaaattctggttatacatatacatgagtataacgttgagcggcccccgcaattgcgcagctagcattaatttaaaattatctattttttatatatgattttatttaaaattatcatttccgtgattctaataattttatagtttttaaaagctatgccaatcgttaccctttactcctttgtatcctttttatttgcttacttgatctaccactatttatattcatcatctttagaactttaaaaattaggccttatagttttcagagttcattttcttgatggatttcttattcataatttttggaagtatcatcaaacatcgccaattaactactctatggcccgtccgttgctacttctctttattgtcattggattttaaaaatcgtatataattattgcttatgttctttttttactttctataagtctcgccaaatcattagtggctttgccactatacccagcccgcccactgtctcctttccttattgtcattgagattttaaaaatcaaacatgattatcattggggtttatttttactctctataagtcccgtaaaccgtagtgaccatgctgcttaatgacatgcctatcgtcacttctcttaatcattattgggattctgtttggggtttgtttatagtttttagatatcccagcaaccgccagcactctacttctttacagacctgttgcttctccctttttattgtcatttgtcatcgttgtgttctagatggatttttttaataaaaaatgcatatttttcattccaatgatttttattcataaattatattcctacttaaactcttataattatttttctatttttgaaatttattttatttgttattttgaactttaataatctcgtcatgtgttctagatcgtcctccacacttagaccggccgtctctaccttcttgtcgatgccttggacctcaccccctcgacctcgacgcctcttttcctcacacacgacaacaccaacctcattgccacagttggctccctccttattgatcccgttgattctgacaatcctcgatgccctcgccaacctccactctctctaatgctccaagatttggtctaggaaaggagaaagatgataggaaattgccttagtattggggatgatggttgagaactcgatggagggaggaggagaatggcgattagtcctcgggccaatggggcggagtagctgacgaagagaggatgaggacaaatcgactggagagcaaaaggattcagtggggaggagtaatggatctagagataaacaaatctaaaaataacggagaaccgagcgttgctcggttggctagagtcgccaggtgagcgagcagcccgcgcaggttcgatccctgggatcgcaactcatgtttcccatgcactgaggcctattgcctccaatctcatggtgtgtgtaagtgtgcgttctgagttgtacccttctcaaacaaaaattaaaaataacggctagcccttaatttatctcgtggcacagaatcctgtctcgtagtttttctgttttagtttttttcttttcatcttctgaagccatgtcttctccaaacccatttagaacatttgaatcgggttcccaaaagcatactattcttgatatatcgcatttactctgatatatcgcatttactctgcagtgcatgcattattttagctatactagaaaaaatgcccgtgcgttgcaacgggtaattgatattttaattttattattgttatacggtttagctagggaaaaattcactgtgggaattcgcttgaaattttttttcagaaaatcatgagctgcaattaagagtatgtatttcatctcaagttagcatgcgacttttttcaaaagatttcttatacgactctttttatactttcaaaaggaaacaagcttaaaatccaactcaaacatggatattgtcgacgtctgatatcgcggttccggtatttgcatggtatgtggatcgtcggtgttagggtatacgcgagactaaggtaaaagagatggagacagggatttttatacaggttcgcccccctgaattgtcaggtaataaccctgtatcctgttggccggagccagtcgttgttcttattcaccataatcacacaagtataatatttggggtagcctatctaactgttgtcgacatggcggtctgaaggtctgaatcgtagtcgacaacagggtagccttcctcctcgaatccgtgcccggcgagatcagagatagcgctttcgtctctcctgacagtatccggagacaccgtagggtactagccgtgcatatccctgaagtcgatattcggcggcgtgtcttggcgtatgtaggcttctatgtcgattgtgttgggtgttgattctctcgtgtcccctctcctccaaggggggcttgtatttatacccataggtgtccccttgtccaagtagaactagggaaaccaatatggatacaatccgagtagtcattgtcgtttccatgtagaactctggttgtctttccttatccggaactccctcgaggtcagtttccgtataagacatggtatgtggtggttcctgccgagatttagtcaactactattaggtatgtggtatccataaccctgacagtagcccccgacttcaatgcaaatgaacgagttcatattctcaaccgcagactttggaggaactgttatcgagctcacgtgaccgttctcggtgagtttagagataacgttagacttcctttatcagtctcgtgcgggcaccgaaagggtttgtctgagtcaatctctgatgtcaaccgagaaagtacagagcgtacgactatgtttctcgtcttgctgtaatcgagaatttggattgaagtcaagaaattttatctcggcgggtacaccatttctttattccatattccttgtcgagatccaccaaaccgttctcgagtgatcgagaaggcgtagagtctgcgacggagccttgtcaacatttgtcgtactcgccttagtcgatcttggtgtggaaccatagagacatagagtcttcgataatgtcgaatagaattttcctgaactcaatactcataaaagaatattagttagaaatagcccccgagcgaatgctcaaagggtgacatgttataatatgacagactagtaaattgaatgtacagaccagtgttttgtatacgagcgtcttctctcttaccgactccgatcagtcagtttgtagagtcatacactctccctagcccccagccttgtcgtcggagaatcgttctcggatgacaaggctcttggacctttgacctgcctcggttgaacaagcactgatcgtagcccccagccatgaagttggaaaactcaatttccgattacacggcttggttaatacgcacggcgagaactcttacacgaccagatcttacatggtctttcgtctctgaaggatccgacaaggccttatcggctctgggcgtccccagccgaagttccctcaggttcctcggaggccttgtcaagacggcgtaaagggacagtaggataggtttcaaagctaggtgtcatcgtggtaagggatctctgggtaaaacacttggcgatcttgtgtacctgatatcaattttgttcgagaaccaggtagtagttgtaactcaaccactagaagtaaatgtacgagagattgctacgattgactggttgagaaccagtgagtaggtgtctctcgatcattcgaagtcgtggtgtgaggaccgctgcgttatagcagtagtcgtacctcgatcatctgaggttgcggtgcgagagattgctacgtattggttcgaggaccagcgaacgtgtagaattatctctcgaacaccaatggaggttgcggtgcgagagattgctacgtgctggttcgagaaccagcgagcgagtagagttatctctcgaacaccaatggaggttgcggtgcgagagattgctacgtgctggttggagaaccagcgaacgtgtagaattatctctcgaacaccaatggagacgctagagttggtttatgtgcatctcatgtggccagcatgactcacacacccaacttgtagtatatccggatgtccgttcgcaatcatgtcgggtgatcaagccgacggtgttcgcgaggaattatccgttaacaaccttttctcgagtagtccagccatggccggtgctatgagataggtcgtcggtcttcgttgataggttgggcgcgacgactctgcatttgccgagatcgttctcgataatgtggtgtacttgaccacaacctactcgagtgctcaattgttcttgaaaaatattttctagaagacaagacatatagcagataatatcgagtatgtactcaaaaactgcatggatcttctagtattatcaggatataacgagcagatgtaaatatcagggcattatgtaaaccataaacaagcatgattcatacagaagagagcagagcgagcccccagcgtcggtttaacgtcggaaacactcgcgcgatagatattgtatagaaacatgctctaggtaaacataataaattatagatctgacaatgctgtatgatctgaataggtacgataaattccagataaaatattgcgtatctttgtagatacaagccggatgtatctacgaaattagtagatcaatttaaaaaaccaatctaccaattaccttgttgcgtactcgttcgatgtcatgcgatctgacatcttttggtacgccgcgaagcttgaggcttggatgatctcgatagaccaagttgtcgatgacgataattgttccgatcttagtcggaagatttacttggacaggttggatctctccacggccgaagtcatcgagtagcttgttgttggagaatccatctcttaaacccatcttgtctaaatcctgaagcaccaaaatccccctacctggcacgccactgtcgatatctgatgtcgcggttccggtatttgcatggtatgaggatcgtcagtgctagggtatacgcgagactgaggtaaaagagatggagacatgaatttttatacaggtttgggcccctgaattgttaggtaataaccctacatcctgttggccggagccggtcgttgctcttattcaccataatcacacaagtacaatatttggggtagcctatctagctgttgtcgacatggcggtcggaaggtctgactcgtagtcgacaacagggtagccttcctcctcgaattcgtgcccggcgagatcatagatagcgctttcgtctctccagacagtatccggagacaccgtagggtactagccgtgcttatccctgaagtcgatatccggcggggtgtcttggcgtatgtaggcttctatgtcgattgtgttgggtgttgatcctccatggtgggtgttgattctctcgtgtcctctctcctcctaggggggcttgtatttatacccataggtgtccccttgtccaaatagaactagggaaaccaatatggatacaatccgagtagtcattgttgtttccatgtagaactctggttgtctttacttatccggaactccctcgaggtcagtttccgtataagaaatggtatgtggtggatcctaccgagatttagtcaactactattaggtatgtggtatctataaccctgacagttatgtatttccaaaaacgaaagaaattaaaaatcgactcaaatacgaatgacatatcaaaatattagtaaaaatatctttaatttttatattagtagagatttggtacgttgatttgtatctcacttaagctttgtacagcgcctacaaatttgacggcatggcccagcccctactaaacccgaagacattttggagtttggactcgtgtataaacatttctggaaacgccgtcctctcccgaagagcacaaacttttcaggcttctgaacttgctgagctaagtcactctgctatctactctgttccaaaacacacagaagaaaagctcggagtggcatgagcatggcagccattgatgagcagcagccactgcacatcctcttcctcccgttcctcgtgcccggccacctcatcccgatcgccgacatggccgcgctcttcgcggcacgcggcgtcaggtgcaccatcctcaccacccccgtcaacgctgccgttgtccgccctgccgtggaacgtgccaacgaggactctctccgtggcgatgccggcggcgcactggtgccgatcgacatcgccgtcgtgccatttccggacgtcgggctcccgccgggcgtcgagaacggcgcggcgcttacttccgaggacgacgttcgcaggttcttccacgccatccggcggctgcgcgagccgttcgaccggttcatggcggagcaccgccccgacgccgtcgtgtccgacggcttcttcacttggtccgcggacgccgccgccgcgcacggcgtcccgcggctggtgttcctcggcaccagcgtgttcgcgcggttgtgcaacgagatcatggtgcgccacaacccggtgggggcctgccccgacgacgatcccgacgccgtcgtgtccctgccggggcacccgcaccgcgtcgagctgaggcggagccaaatggcagacccgaagaagctgacgatccactgggcattcttacggcgaggtgttcaacagcttccacgagctggagcctgagtgcgtcgagcaccaccgcgcggcgctcggccgccgcgcgtggctcgttgggccggtcgcgctcgcgagcaaggacgtcgccgcgagaggcgccgccgagctctccccggacgtggacggctgcctccggtggctcgacacgaagccggacggctcggtggtgtacgtctccttcggcacggtgtccagcttctccccggcggagacgcgcgagctcgcccgaggcctcgacctctccggcatgaacttcgcgtgggtcatcagcggcgccgacgaaccggaaccggagtggacgcccgaaggcttcgccgagctgatcccgccgcgcggcgaccgcggccgcaccatccgcgggtgggcgccgcaggtgctcgtcctgaaccaccccgccgtcggcgtgttcgtaacgcactgcgggtggaactcgacgctggaggccgtgagcgccggcgtgccgatggtgacatggccgcggtactcggaccagttctacaacgagaggcacgtcgtggaggtgctcggggtgggcgtcggcgtcggggccagggacttcgggtcgaacctggagagccatcaccgggtgatcggcggcgaggtgatcgccggagccataaggagggtgacgggcgacggcgaggagggcgaggcgatactgaggaaggcggcggagctagccgcgaaggcgagggcggcgccggagaagggcgggtcgtcgtacgacgacgtcgggcggctgatggatgaattaatggctcgccggaccttccgttgacgtacgagataatacggagataatgggttggtttggtttatagcctaattaggccatatcaaatttcgtcaataccaaattttggtaagttttggtataactaattttggtaaggcaaaattatgtttagattgaagccaaaatagtctaagttcactattaaaatagcctattttttttagatatgtcaaaatttggcttcaaaccaaatagacactgaacactattaaaattaccaaatattggtaagcctaatttaaacctcaagccaaaccaaaccagcccaatctcttcaacgcgtacgtctgatccgttgggattttttttttctgtttcgcaattataagtcggcgaagtagcctactgttcattaaaggagtggtgaacagtgagagtgataagattctgtagcaaatacagtatcgttcaatatttattcaccgtataagatcactagtacgtacgtttcaagctaactgtacttgctgtgatcggttaacattttctatgcaacaataatggcaatctgactacgatagaagggtttgcacaaaaaaaaagactacggccgtgtttagttgatttggaaaaaaaaaaattgacgagtacggataaacatttaaaatattaaacgtagattaataacaaaacaaattatatattccgtcagtaaaccgcgagacgaatctattaagcctaattaattcgtcgttagcaaatgtttactgtagcaccatattgtcaaatcatagtgtaattaggctcaaaagattcatcttgcaatttacatgcaaagtgtgcaattggtttttttcgtccacatttaatgctccatgtatgtgtccaaatatttgctgtgacgaaaaagtcagaagtttaaagggaactaagactgtgttaagactgtgtttagatctaggggtgaaaatttttagtgtgtcacatcgattatacggacacacatttgaagtattaaacgtagtataataataataacaaaacaaattatagaatccatctataaactacttgacgaatttattaaacctaattaatccgtcactatataaaaccgtgcagtatagatgtgtgattttgctgacgtggtgtcctagtgttgacgtaaaaatcgaacacggcgccctgggagatctgcttagctcctgtgcaagtccaaatatgatgagatgcgggcgtgccagtcagtttgatcctgccactgacaagatatgcaaacagtagatcaaacagccgatcggctgacaagccgatggagtagttccagccgatagccgataatagccgatgccgataccagccgatagcgataggatttaagcgatcggctatatgtccaatgtagataatgatataaaggcagtcggctgatgataatataatatagcaatataatccagtagaaaaccaatcggctaataatatgatatagtagaacaagtattgatccaaaggttaaagcatatatcggctggggatccgatgtcaggaaatccacaagattagattaaacagtgaaacctttgttgtcatcggctaaatccaacttatatgtatatgcgatctttatgagccgatgcaacgtccagatcactccctggctgaaaccccgatgaaacccttattggcaatcaagaagcaggctagagattatggttct

SEQ ID NO: 48062 - DNA, 7819 bp, Oryza sativa
ggtacagtagttcatgagtggtagatatctaagctaatctaatctagcaacacgatttagcagataccggcagaaaccctaaagcgagaagcagccgatagagctaaattgatatgataagactagattaacagagacatatgataaataggtaggtaaatatatcatccaaaccgtagcaatccaagaggtcgaatatactgatgcagccttgaacgacgccgacgtagatgacaaattcaccggggcccgacggaacgtaggacttaccccttcgccagagatcgaactgaactgatgcagccccgcgtcaggtgcccaaattccgccggaagataagtaaaaacctcagggaagagggtggcgatgtgccgagagtagttgtattgatcgtgattgatagattacatagaccccgggtgtatatatttatacccatagggagatacaagtccttgtcggacaagaaagaaactaaaaaggaaaagataacgtccttatcggacactaaacacactttccaaaagataaaaagaaactaataaactatgtctaattaatagataaactgtcatgtcgcatccgtcttgaactcggactcttctagataagcttcctttgattgatccgactccaccatgaacacgacatcgtggcgacttgactcccatcggctgattctagaactttgaagccgatactgactctaagccgatggtaactttgggcttaccaaatttcactgttaacacatgccccccagttttggagtacgagaactcatgctttaaaatttcttgtcttgataactccaaaaccgatcttcctttgcttcgtgcaatcggctttcatgagccgatattgtttgcattagttgagctagactgtcaaactcgtggcaaaagaatctatctccgataggtgctgacaatccttggaatgcaagatctactagctattcattgcttaggttcaaactataacatcggctgcggacattacgaaatctctgaatatattccatagccgattctccttcttgctgctcaactgatattaagtctgaaagcttcaactcgctgactccagcaaagaagtagtcatgaaattacttctcaagatcggcccatcctctgatagaatttgatggtaatgatgaaaaccaagtgaaagccgatccagtcaaagacaatggaaaaaacctaactttcagagcctctttagtcgatgcttcaccacattgcagtaagaatcggctgatgtgttcaagtgtagatgtatcatcttgccctgaaaacatggagaaatctggaatcttgtatcggtgtggaagtggaactctatcgaaccattcaggatatggctgccgatacatatggatccgttccttaggtctaattccaaactgctcctctactaattttgcaattctatcggcccaatcttacttctggccgatactgttgatatagctcatcattgtgacattgatgtgtctgccccctgagccgatgctgttgttgttcttcaatctgctccccgagctggcttttctgaataactaacccatcaactgttactttgatcaaattttgtaatgtatccgccaaaactccagattgattaaacaatgtgcaatgaactgcttcatcaactgtatcttgaagtatttcaactatcggcttgggaaattgagtcttctgagttggcccttctggtgtcatgatgaaacattgaagacaacgcatttgaaaatcagctacaaactgcttcatctgttgcctttgttcctctgttaaattctacactgtgaccatgatcttggcattgacttctacttcagacatgtggatataaaattcgtggtcccactgggcgtgccaaaagcgtattgacgtaaaaatcgaacacgacggcctgggagatctgcttagctcctgtgcaggaccaaatatgatgagatgtgggcatgccagtcagtttgatcctgccactgacaagatatgcaaacagtagatcaaacagccgatcggctgacaagccgatggagtagttccagccgatagccgataatagccgatgccgataccagccgatagcgataggatttaagcgatcggctatatgtccaatgtagataatgatataaaggcagtcggctgatgataatataatatagcaatataatccagtagaaaaccaatcggctaataatatgatatagtagaacaagtattgatccaaaggttaaagcatacatcggctggggatccgatgtcaggaaatccacaagattagattaaacagtgaaacctttgttgtcatcggctaaatccaacttatatgtatatgcgatctttatgagccgatgcaacgtccagataactcactggctgaaaccccgatgaaacccttattggcaatcaagaagcaggctagagattatggttctaagcacgacttagtagatcaaacttaactgatgcagcactaagtatgaaaagaaacataatatctagacaatcaagccgttgactgattttcagggtggtagatatctaagctaatctaatctagtaacacgatttagccgataccggcagaaaccctaaagcgagaagcagccgatagagctaaattgatatggtaagactagattaacagagacatatgataaataggtaggtaaatatatcatccaaaccgtagcaatccaagaggtcgaatatactgatgcagccttgaacgacgccgacgtagatgacaaattcaccagggcccgacggaacgtaggacttaccccttcgccggagatcgaactgaaccgatgcagccccgcgtcaggtgcccaaattccgccggaagataagtaaaaacctcagggaagagggtggcgatgtgccgagagtagttgtattgatcgtgattgatagattacatagaccccgggtgtatatatttatacccatagggagatacaagtccttgtcggactagaaagaaattaaaaaggaaccagtccttgtcggacaagaaagaaactaaaaaggaaaagataaagtccttatcggacactaaacacactttcctaaagataaaaggaaactaacaaactatgtctaattaatagataaactgtcatgtcgcatccgtcttgaactcggactcttctagataagcttcctttgattgatccgactccaccatgaacacgacatcgtggcgacttgactcccatcggctgattctagaactttgaagctgatactgactttgggcttaccaaatttcactgttaacagctagtcagtaaaataaaaaataaaaataatatgtgggtgttaacgaccaaatttggttttctatcaacagtggggcccacatgtaagtgaagtgagaatgaaaaagtggggcatgcctatggggcccatcatcttagaggttttggctgcgtagacctagcgcatcgaggaggagccgtcgtcctcgccgtcagggaagcgggcctgggaggctgccggcggtagagggtggagtggtggcgggcgagcttggcaacaacagcagctcgccgctagcagcagcagtcggccgcctctcccactcccaccctctccacgtgccgcgccagcgggagggggagagaccggggacggtggaggaggaggaggagcgccgaggcgccaacagcagtagccagtcaccactcctctcccccctctccctcctaggcgccagcatgaggacggcaccaccaccgtcatcatcctcaccggatccctcctccgccgcacctagtccctcctctccgctggcgcccaccccaccacggccgctgacaccctccacctgcaagaatgaaccatcatcgattgacgacgacggagaggagggagtggagggaggcacataggagacgaggggagcgccgcaacggcggggatggaggggtcgcccaccacgtggtccaggcgcagccgtgcagggatgcgtcctccggcgtcagaggctgcatcgccgccttcccttccagcattgcgttgccgctgagttggtattggtttcacgcgcacgtggcggtgtgggagatttggggtgatttcacggggggagaggcgagggcgtggtggaggaggagacgaccggggagtgaagcaacgcgccgtgcatgagaaggatcgcatggcagccccgtgcactcgccacggagcccgtcgaatgcacctgcaagactgcaacctagctcactcgccagtagagcctcgtcgtgagcctgtgatgcccacctgtcaccgagaagaagaccaaagcggcggcgacgcatccccaaccctaggacatttaattatctggcacactttaagatgtgccaattaatgatttgccacttactatgggtgcagtgacaaatcttttataaccactcgtaaaagtggcaaatagttaattattcccccaaccccagtgtgggaatgtcgttgcacttcagtacaccccttaatcgttaacgaagtcaacaaacaagaagaataacatgtttgatgacgtgctgctatcgattttgtcatcctgttctgtttctgggtcccacaatttttaaaatttccttttggtaacaactccctccgtctcattatataagggatttagactttttgcatgcactgtttgaccattcgtcttattcaaaaaatttggaattattatttattttatttgtaacttcattatttaaagtattttaagcataattttttgttttttatatttgcacaatgtttttaataagtgtggagattatggataccccatacacacacggcatgtatatccgactgggtatggggtaccatgtataaatagaatatctttaaagggtttcgggttaaattcctaaacttgtatatcaaggaagcacccgagattttagtcggttacgattgtattttatctataactgcttattccgttaggaatataggctgtactttgtaatacggactccttcccctatataaggagtggtccgggtgcctcttggggcacgatttttctcccagatcatacgatcaataatacactcggcggatcaatccccagacaggagtagggtagtacttcttattaagaaggcttgaacctgtataaaattcattgtctctaaacccatctactttttcagcttgatagctacccccatttagtattgccgaaatcttgtttcgacaattggcgtgccaggtaggggtagcgtcaagttcttcgccgactagtgtgatgggtttcgtctctggcatcgacgccttcatcttccctcctgggcaggcgtttcggttcggcagcctcaacttcatcaccaacgacttcagcaagatttgtctccttgactcggatgcgaaccagtcaggaagaggccaagtatctgccccgttcggtatcccgaactcggccgagatctactccaagattttctcaaccgagtcggcttcaaaccactcggacgagatgcaatctactccgacacgacgtgatcaaggcgacggagcatatccctcaatcccgatgaagctccccgatgatttggccgttgttttcaccacaagggcgtcttctccccgtaggcctagacgagatccggcctcggccccgatccgatctagctctagggaagttggtgtcatactccagcctctcgaaacggtttcaacggaagaattggactgctatcttagctcccccggtgtcgattctcgaccgacggagatcctcgagtacgacgacttcggctaccattacgactacagcaacctcgacgacttcgacgaaggctacgaagacaactacacgcctctcttcttcggcattttcatggctgataatgagacggcagaacagcgtcaagctcgagaagcagaagaacagcatacacgacaagaagccgagggccgccgactggaggaggagcgactagcacaggagcaagactggctgcagtgtgagcaacaggagcgcgaatgggccgcaaaggaagctgaggactggcgacagcgcgccttggaagctgggcgacgagcacgagatcttatcggacaacaagacattgaagggacggcggtttttcgcaccccgcagcataacgtggtagccgcaatcacccttctagacactctacttcagcaagatgcgcccaaccacgtcgtcaacatcttaaaccagaccaagaccatgatcaccgcctcggtcccagtaaattcttcaagcgtccgtacgctgactggcagcagagttccacctctttgatctcaagactatcaccaaccaagccttagtattgccagtgcaggatctagtcgcaggagcagatcatgatgaacgatctgtttgttcacctgccgatcgacatagggagcgtcgggccgagcagccccgctctccgcgtcgcaggcgtctcgtcgatcttcacgatactatcaaccagcgtcgtgcgacaagaggccacatcccccaccattcaccagatcgttaagactaagggtatccgccatgaactcttagtcggcaagtttggacgcaagcctcccaagacagtcaaacagatgttcgaaaaagccaatgagtacgccaaagcagaagacgccgttactgcttccaagcagttgggcagcacctggaagccaaagaaagatgcgccgactatagggggaagtggaagtgccaatcacaaggatcgcaagcgtaagccagaggaacttgtggcaactactacgccatcctcccgacagcggtcacgcgtcaacaccttcgacaagatcatgaatgcacaatgcccacatcatccgaactcaaatcacgtagccaaagattgcttcgtctataaacagttcgcagaacaatatgccaagaacacacgcaagccgactgacggagatcaaagcacgtcgaagaagaaggatgatgaagatgataccccgactggttttcaagactctcgtaaggaacttaatcacattttttgtgggcccctggcttacgagtccaagcgaaagcaaaagctgactgaacgagagatcaacgccgcccagcccgacacgcctcaatatcttctgtggtcagagacggctatcaagtttgaccgctcggatcatcccgaccgagtggtccacccggggcggtacctcctggtactagacccagtggttcataacgtcacgctccgacgatccctcattgatggcggcagtgcactcaatatcctcttcgccaagactttggacgatatgcagatccctcggactgagttgaagccaagtagtgcgccctttcacggagtcatccccgggctatcttctactccactcggccagatcactttgccggttaccttcggcactcgagagaactttcgcacagagaacatttgcttcgaagttgcagatttcgagatagcgtaccacgctatactcttacgcccgacgttagccaagtttatggctgtcccacactataccttgtcacgcccagaaatttagcccaaatttccagactattttgcgtattaaatccctgtccaggaccagccagggtacacaaaacgacaagtaatatacagttccaaacgtaaataaagcgtaaaatacttacagaagaggcacttagtcctcacaccgaaacaaaagcagcagcagcggaaaaaggcgatcctagcggggcttcagctccactccacaggcaaaacttaactggggtctgagccttggtcctctaactccatcttcagctcagaagcgctacacttctgaaaagggggaataatagcaag

SEQ ID NO: 48063 - DNA, 5880 bp, Oryza sativa
ggtgaccgaggtgctgcacggcgctgcgaggcgagaggtgaagacggagcgacgcggcggcggctaaggcgacggtggcacacggctggagacggcgtatggtggaggtggctcgggatgcacggtggaagggtggttgcggtggtggaatggggaaacggagcggaggccggggtagagcttggcacggcgttgccggcggcgcaagcggcgaggtgcggcgacgactagcgcggcggcagcggccggctgaaggcggtgtgtggcggtagtggctcggcctcgcgatgggaaggtggttccggcggtggaggagggagatggagtggatgccggggtgcggcgaggcgctgtgatgctataggtggcggcggcgcagcgcggcagcgacgggagcggcggtggcgggcggctggagatcgccggcgagcggcggtgaaggggatcggcgtggagagctcggtagagggtgtgggggactcgggaaaacggggaaaaaggaagaggagtccacggggattgattttatagctcaagggggcgaggagagggccggggagcggcggacttcgagggggagtggggcggcgtcatgggggtgtggcggctcggcgtggcgtcgattcccgcggggagagagggggagtggggcgggatgtggtcgcgaggtggaaggggtctcgggtccacgccggttgggacgaggggaggtgcgggatcggcagagggagtgggcggcgtggccgacggttggagctggccggaggttggggatgacaggtggggtccacgggtcccacctgtcggagagagagagagagggagaggccggctggggaggcggaacagacttgagggagggagagagccgagcgggccgagggaggaggccggcccgagagggagagaaagggggcgcgcgggccgcgggagagaaggaagacttgggccgaaaatggcccaaagagaggaagggggattttctttgttttctttttattttaattgattcaatgatccttgtgctattaaaattatttctcgagctccgaaaattcgcgggaaatttcagagagtattttagggcacaaagaatattacaaaatattctcggccaatgatttttaaaggaaatttttaattccctcaataattcacttggataaattgcttaactttttatttaatttctaggaaatgcattattaaatgatttttaatcccgaacgaaaattggggcgttacaaatctaccccccttacaggaatctcgccccgagattctgggatggctagaaagaaagctggtgtaggctgtcggtctgactgatctgacgggtctgcacactgcactgcccctttctatcttgaactgactgattgactgattgatcaaacctgcaccattgaaatggctggattcgacctttctattcctttgctttgccaaaactagaccggctagttctgcttgaactgacccggaccagaactgtggctgctcacgaaacttacttatcttgatctgaactgttgacactggcagtttgataacctgacaattcaccaagctggctagagaagggtgaagttgttcctaagacttgcatctggcatttgtaactcattgatcctacgtccgcttgaacgggtcctggctcgaatgacacgtaattccaggaaacctgcttgacctgtcttttgtctgaactgcaaccgtccctgatgctgcttctcaaagctgagctattgacctagcctcaccggtgtacctcagaattcaatcagataacttgagatcggtgtaactctgctgacaccttgcaactggcttcttcaagtactacccggattgttgcactgggttgaaccttcaactaaaacagcgatgaggtgagccaaaactcatctccgagacctaccccccttacaggaagtagtcttactttcgcctgactgggaacaattggactattgtccttggaaaaaaaaataaccaacacttctctgacttacaaagaccctcactttgaaaactgaaacttcgtcgattcatcaaaatagagcaatgacgacacactttcatcccagcaaaatttggaatttaaccctcagttgctgataggaaattccacataaagaaattctcatttagctcctgatcttactaactcttaactgactttcccatcagtactaactgctggcatgactgtccttcttctgacctgacttcggtgtcgtccacctaaatgggttgtgtagttgatatctcaaaactaaactgaccgactcgcattggaattgacacaacttgaggaactggggtgctgcgagtagagctgttgtcttgatgacgctaacgccttgtcgttgaacaaccttgcaagaactgaccttgtaaaccataaccactataggtagcacttgttgcctctgggattggtggtgacttagctgtgctggtctgctgaagacttggtggcgtactgtctgaggttgcaggtgcttgctcttggaaaacaaactgactttcgctctgatcctgattccggcttgcatctgagcttgtacttgttgttggagacattgtcgttgcatctgctgctttggactctgcggttgcggtatcaacatctgacacatccatcattagatcttggctagccaggatctgaccagagcgaggtgctccgactcagctggtagcttgttgtcttgaactgatccactgactctgactgcaacacactactgctagagttgcttccgctacattcgaccttgcatcgagctttgcatctcctgcatcaatacacccatcttctgatcctggataccaaatgttgatcacgagcaggggttcttctggcatcgggagtacctggtagctttcgactgatccattgatctgtgactttcatacaccgttgttgttgctcttctctctgatactgaccatctgctgccagaacagaagagaggtggaagagaggggttgctaaagataaggtactaaaccacttgcctattgatctgttgtgagtagatttttatggtttaagttgcttaagcaaacaacctagtatggtcgcatccccaccaatgatgcaaaccatacccctgcacacaagcaaacaacacacgatcttgctaacgaaactacccttcagggaaggattgggtttaggtgaacttcgggaaaactcttcttgatcttcgcggaacgacgactctgaactgaccttctcgctctttgctgcacgaagcttgatgcttgacttgacttccgaacagacacgaagctgacagtttgtcctccacggtttaacaactataagaattggagggacaaggaggagaattttgaaaaaccgtttcgcaaagaaaagccgaagggcgaggggagacattttgcaaatagggttttcagaaagcttgtccttagggtttgaccatttggctcaacctacagtcgagttggctctgataccactttgtcacgcccagaaatttagcccaaatttccagactattttgcgtattaaatccctgtccaggaccagccagggtacacaaaacgacaagtaatatacagttccaaacgtaaataaagcgtaaaatacttacagaagaggcacttagtcctcacaccgaaacaaaagcagcagcagcggaaaaaggtgatcctagcggggcttcagctccactccacaggcaaaactcaactggggtctgagccttggtcctctaactccatcttcagctcagaagcgctacacttctgaaaagggggaataatagcaaggctgagtacaaccaccgtactcagcaagccacaccaacgatgcagacgtgcaaggggatacaaggacggtttgtggctatttgcataaaggcggttgtaaaacattttatttaacaaacagtaaaattgttgaataattaaagtaacattaaaatctccactgatcaacgctacaccacgttgaacaggcccaaccaacccacctggactacagtgtattgggtcgatttattaagatgggactaatcacggtgaatctggtcgatcgcccataaccgcgggcacggctatttgaatagttttactctggccagaggtgcacaactgtacccacaagacacaacccaccgacatgtcaccgcgtcatcatgtgcccatgatgcacacgtcaccatgtcgagtgattgtgacgagacccttcgcataaccctcccctaaccatccacaccacgctaaggtttcacccccacccctcaaaaggcagtgggcggtcccctcttgcgccgcggtgaatccggcagctggacaaccggacaccccggccgacccaactccatcacgcccaccctcgccaccggtgcctaggaaagggtcgagctatacttcagatcaagcagttacccactcccgcttgtggcaagcgctgtaagtcttccagggtttcccgtgaaccggtccttaattgccatgggtgcgactcacaaaaccatgcacccacagcccaccattcagtcgcattttagttggataattacgaccataaaacatggccagatgtctcgagcacgcggctcaacaagatactagaatgtctaatactgcaattatcccatcgactgagctagtggtaattaagcatggctaagcatatagttctagctaggtcacataagtaacatgagctagatgatttatcacccaaggttgacaaaggatagatatcaagtaaacatggcacaagcgagcagataggtaaaccctgaccccgtgtaattagcaaaacatgcatatttatttgtaaacggtaaaacatttataaattgggatcaacatgctcaaggggaatgtgtgacttgccttgcttcttcacttggattttctgaactcttttcctcgcgaccgcgatcttccgaaacaacggattctacacgctggcacgcaaaacgaggaaaaactctaataaagaccaagcaaacagtacataaaaagtaaacaaacatgtagagctcaattttagatgaattttgcaagttgaatggctcaatttggagttcgaatgaattagatatgaattttagaaggttttgagccattttaatgaatttctagaattattaccgatttattgcgcaatttaaatcaattatgacgtcatccgacgggggagaggtggcgccggcaagcgggccccacctgtcggtgactcacgggtggcgggcgcaccgtggaccgagtccacgcacgcactggtccgcgggcgcaccacgtggcagacacgtggcggccacgacggacggctagcggaggtggcgccgacgtggcgccacagaggcaccgacgcgggcggcacgggaaggccacgtggacgacccagaccgccccgaaggaggatcgggcggccacgggcgagcgggagccggctcaccggtcgaccggccgggagcgacggcgcacggcccgatggtcgctggcgacgaccacaggcgcgacggcacgcgcgggaggcggcgcaaagagggaaaaaggagaggaaacggagggggtcctcaccgaggagcgccggcgacgggacgaccatggggaggcgaccggcggcggaaaggatggcggcggccggcacgggaggcgacgggaacggcgttccgacgacgcccgaccatggcggagccacggccgagggccggcaagacctggggaaattattggagcggttagggagggaaataggcgaccggagcggcgagaataccacgccggagaggagaggaatggtggggctcaccggcgaccgagagataccacgttccggtgggtttccggcgatgaacaacggtgaccgaggtgctgcacggc

SEQ ID NO: 48064 - DNA, 19437 bp, Oryza sativa
agggcacaaagaatattacaaaatattctcggccaatgatttttaaaggaaatttttaattccctcaataattcacttggataaattgcttaactttttatttaatttctaggaaatgcattattaaatgatttttaatcccgaacgataatcggggcgttacatacctacatgatgatgaagatgccaggacctcgaggaatcatatctctgcggagcaacatcaagcaagccgttacctgcgacaaggaaagctgcgagatgcccagacacgtgagatcacgctcgctcgagaggagatccgactggctgcatcaacagcaaccgaaggagaagtgcctgcgcccaagatatcaaagagcggagaaagcgatgccaagactaagaaaattcctcttgatccctttgatcccactaagactgctgtaataggcgccgagttagattgtaaataggaaagcacgctcatcacctttcttcaaactaataaagatatttttgcgtggaaaccatctgatatgcctggtattcctagggaggtgattgagcactctttacatgttaaggaagacgctaaacccattaagcaacaactacgccattttgcacaggataggaaagatgcgatcaaggaggaattgaccaagctgttagcagctggcttcatcaaggaagtcctacatcccgactggctggcaaacccagtcctggttcggaagaagataggacaatggcgtatgtgtgttgattacaccgacctcaacaaatcttgtcctaaagatccctttgggttacctcacattgaccaggtagttgactcaacggccagctgcgagctactcagttttttggattgctactcaagttatcatcatatctgcttaaaagagtccgactgcttgaagacctcattcatcacgccttttggggcttactgctacatcactatgccttttggattgaagaacgccggagcaacttatcaacgcatgattcaaaggtgtttttcaactcagattggtcgcaacgttgaagcttatgttgatgacatagttgtcaagaccaagcagaaggatgatttgattacagatctagaagagacctttgcaagcattcgcgccttcaggatgaagttgaatcctgaaaaatgcatcttcggagtaccatcagggaagctgcttggctttatggtgtcccgtaggggtatacaagccaacccggagaagatcaacgccatcctcaacatgaaaccgccaagttctcagaaaagatgtccaaaaactaactggatgcatggcggcgcttagccgctttgtttcacgactcggcgagcgggggatgccctttttcaagttgctaaagaaaaccgacaatttccaatggggacctaaagcccagaaagcctttgaagactttaagaaacttcgcacaactccaccggtcctggcttcaccacatccgcaagagccgctgttgttatacgtgtcagcaacgtctcaagttgtgagcatggtcctggttgttgagcgtgaagaagatggccatattcaaaaagtccagcgaccaatttacttcgttagagaggttttggccgactccaagacgagatacccctaggtacaaaagctgttatatggcgttttaatcaccgtcaggaaattatcccattacttccaaggttactcggtcacggtggtcacatcgttaacactcagagacatacttcataatcgcgaagcaaacgaacggattgcgaagtgggccctagagttgatgtctttggatctatccttcaagccacgaacatcaatcaagtctctggccttggcagattttgtcgccaaatggactgaatgccaagaagacacgcctacggagaagatggagtactggactatgcattttgacgggtcaaagaggctttcaagtactggagcaggagtcgtcctgatttccccgactggagagaggttaagctacgtattatggatacatttctttgcatcccacaatgtggcagaatatgaggcacttcttcatggattaaggattgcggtatctttagggattcggcgtctgatagtttgtggagattctcagttggtcattaatcaagtcatgaaggaatggtcctgcctcgatgacaatatggctacttatcgacaagaggtacgcaagttggaagacaagtttgacgacttggagttaacccatgttctccggcatgataatgaagcagccgacagactagccaatttcggttcaaaacaagaaacagctccttccaacgtgttcgttgagcatctttatgaaccatctgtaccaagaaaagaaacgaccgaggcggtagatactcaagaagtaaatatgattgacgccgactggagagagcccttcatcaagtttttgaccaagcaagaactccctcaagataaagacgaagccgagcggatttccaggcgtagcaaactttatgtcatgcatgagaccgagctgtataagaagagcccatcaggaattctgcaacgctgtgtttctttggaggagggaaggcaattgctaaaagatatccacttaggcatttgtgggaatcacgctggcgcacgaaccattgttggcaaggcttatcggcagggttttttctggcccatcgcaatatccgacgccgacaaaattgtgcgaacatgcgaaggttgtcaattttttgccagacaaattcatttaccagctcaggagttgcaaactatcccattgtcctggccgttcgcggtctgggggctcgatatactcggccctttcaaaaaggctaccggtcgtcacaatcacagcagacaaggctagagacagctcatctttttgtggctgtggacaagttttccaagtggattgaagccaagccagtcgtcacaatcacagcagacaaggctagagacttcttcatcaacatcgtacactggttcggagtacccaaccgaattatcacagataacggtactcaattcactggtggtgtgtttaaagatttttgtgaagactttggcatcaaaatttgctatgcctccgtagcgcatcccatgagcaatgggcaagtcgaacgcgctaatggtatggtacttcaaggaatcaaagcatgagttttcgaccgactgcgtccctacgccggcaagtgggtagatcagctgccatctgtactttggtctctgcgcactacgcccagtcgggccacggggcaatcaccgtttttcttggtttatggtgcggaagccatgctgccgagtgaggtagaattcgaatccttgcgatttcgcaacttcaaggaggagcgctacgaagaagaccgagttgatgatctcgaccgactggaggaagctcgtgaagcagccttgattcagttggcacggtatttataagggttgcgacactatcacagccgaaacgttcgatcgcgggcattcttagtcggagacatgggcttgagaaagattcaatctacacgagatcggcacaagttatctcctttatgggagggaccgttcgtaatttctgaggtcactcggcccggttcttatcgactcaagcgcgaagacggtactcacgttgacaactcttggaatattgaacatcttcgtcgtttttatgttaggcattactcatgtacattcttttcctctttgactaccaacatcaagttatctcttgaagttaccagtcgggggctactataataacaatggagtgtgatttttatcaattcaatttgcttacttgatttatcattgccctgtctgattttttgacttagttaatgaggaatgaaagttttttgaggactttcgcgggttctaggctcagcaaggtttgatgagaacttttaagaaatcaaacactaagtttaaattatcaagcacagcataaatacatcagtattgtacaaattgtgcctccagcatcacaagtcacattatacaatgtcaattagactcagttctttcatcatcagatacatcagcctttgtcggaccaagattggtatcttggaatatttctatgacatctacagcaatcttatccgcggctttctgagcatcattaataagatcaaggacatcttcttcgcttgtcccgtccgcaaagccgtcgacagtgtcaacatcgatcttcgggtacaaagacttggtcatcgccaataccatgctcgctcccatacatccagcttctttgatatttttgaaacacacattcggagcagttatcagcttgtcaaagatttcaacagcgttgaatgaactcggaccgttgttgttaaaaaacatggcttggatgagtggtgtagcagcattggcgacctcatccctagctccctcaagtttcttgatcttgttgactagaacgtcgaattgagcttgagatttgatcttgcgatctgcatataagggctatatcaacacttgcatgcgaagacaggattgattttggggtttggattataattaccttcaacatccttcagagccgagtccctcttcttggttagttcacccttatctttttccagagctttgattcgcttttctagctcagtgatcttggcagcttgtattgtagtatatctcagcagttgattgaatacggatagtagcctggagtaagttaattaagagtacgggttacctttggatgatccactaagctcagcgattcgatccctgagatcgtgttcagtcttcctggctagctctctggtttcatggagctgggctcgggttgcctccagggttccaagatgaccgaccagtttctcaagggttgcagtttttgcttcattcctgagatgaattctctgcattacaaattcacccagttcagaaagttgaccgacaggatgagttaagctataagctggagacgtacatttacgagacgagtggcttgattaagtgtctttgtgagtagagacacttcttcgtcttctttctgcttatttattacaattctttgtggctacatttcgtcatcccaccatttgactaagatgggtgggcgagagtcttcagttgattgtatccgaagaatctcttcttcatcgccaattattgggtctatgcatttgtgtaaagagtgataaggcgattgaagagaacttttttaatataaatggattcagatgatcaattaattgttatgaccttcggaggagggcgagctggcccttgtactttgtcaaaagtactggtctctgaaccaacattggtgttattaaaaggagggctgcttgtttgtctctctgtctccgggatgtctttatttggttcaacacccggctggtctccaatcggacgctcttggtgagcatcggtctcaacttctgctgactgatttccagtcgggggcactttcccagtttctacattgtcggtcgccgactggctgccagtcgggtggttttcttcagtcggctcggtttccttggcagttgtagaaccagtctccttgtcagtcgactaagggtcttttccagatggatcgatgtcagatggtttcttgaggattcgagacgtgttatattgatgctacatgttaagacaacacaggagaaatgacaagttgattcatacctggtcgattttctgatttttggtattggacgactggatgttttcttcttcgggttagcctgtcttggctgttttccagtcacctctttgctgccagctttcccaacgttgtcaccttcgtcatcgctcagaactaacttccttttccgagagcctggctggttagttggctttgggctgcttggctgagcaacagtctggatttttggtccgccactggcctggccagcttgttggcggggagagcggcgttgagcgattggaggatcagatttcattagagaaaattcctatgcatgatatttcaagttttcagccaaacattacaaaagataaaagacatcataatgaaagccagaatatgtgatgcgtaccggtggaggagggttgaaggcattatatggcaccactggcaaaaggtacgaatagctaaccacaataccggttgagaaaattttgtacatcctctccttcatgatcttgaactcaagagactctggatcttcacggttggggtcattcttgccatcgaattcgaaggcagtgcgggatctctccttaataggtgccagctggctcttaatgaaatgccgagttatttgttccccttgaagaccttgctctttaagcttcagcatgcattccaacagggtaggcacctgagaagcttcatctctcattggaagcgagttcaaggtttcttggtatgttggagggaggcaagagtactcgggaagagctggctaagggttctgcacataaaaccagtttgcatgccagcctttgtttgatgttttgaagggcatagagaaatatttctggctcagggtcccccttaactgaaaaccggctcccccaacgacgcacgacttgctcttgtttggctgaggcttcaggaagaagatgcggcggaataaggcaaaatgcgacctaatccctagaaaagcctcgtaggcatggatgaaattagcgatgtgaactatggaattggggtttaggtgatgtaagctaatcccataaaactctagaattcccctgaagaactttgaagttgggagagaaaaaccaccataaaagaaatgggagaatacaacgacctcgtgtgtatccggggtcgggaatgcttcgtcacatgccggacgccagccgatgatttccttcgctggaagaacaccatgcgccaccatctcttttaggttctcctccgttacgtcggaaggagcccactgactctcgaagctttctctttcctctgccatggatgcaatatggatgatgcgatttgatgaggaaatggctaggaatggatgggagattgatgcggaggttgcgcggaagattttcgcaggagctgtaaagcctcggcaaagtggattggtgcggatttgagaaccctagtttttgccgtcgcagttttttcactgtagcgaggagtggggaaaatggaggagaccacggcagggaagacgaagtggcgctctgttttagcgattatttcgctagggtatcggaaggtactaatgggcctgggcctgcatagtactttcagcccaactttattattgacgtggttggttgtactccttagggacttaagcatatatttttgccttggtaaaaatttctcacaacagaatagcccaatgccgcaaaaatcctttttgatgcagctagatgattctttggaatctctacaatgcggaatgaaaatgtgctcgacagaaaagtgtaatgctaattttgttggtctttttaggcaacaaagttgtttggattttattgagatggctacttttttatggccattctctcagcatgttatatgcttattttgataacgacataagtcatggcttaggctattttgacttgtcatttgtcgttttctatacaacagtcgatgaatcctttaagagttttttactcgaattattatcgcatatgttggtttatggacctttagagtgttttttcactcgggtttctttttgggcgcattatagctaaagcagtcagcagaatgcgttttagatgtcgcctgagcttaattatacagtcaccttggtgattcggttgtaaaaccactcggatggatatttcatgtgccttgactatatgtttagtttttattcaactaatcacatagtcgggggctacacctaattaggtgtatctagtcgatgcacctgattttttattttcagcccttcatggtttttaatttcagtactcgggagaccaaggcaggagaaattaaagcacttggattattgttttagagattacaagaaaagactatttcatcgactataaaggtctcaggagatactgtgaagattatggataccccatacccacacagcatgtatatccgactgggtatgggggtaccatgtataaatagaatatctttaaagggtttcgggttaaattcataaacttgtatatcaaggaagcacccgggattttagtcggttacgattgtgttttatctataactgcttattccgttaggaatatgggctgtactttataatacggactccttcctctatataagaaggggtctgggtgcctcttggggcacgatttttctcccagattatacgatcaataatacactcggcggatcaatccctagacagaagtagggtattacttcttattaagaaggcctaaacctgtataaaatttcttgtctctaaacccatccacttttccagcttgatagccaccccttttagtattgccgaaatcttgtttcgacaataagacgagtggtcaaacagtacaagcaaaaaagtctgatgccacgtcagcgaaaccagataattatactgtcgacctacattgcacggttttgtataatttagaggtgaagatttctggtttagggatgttaaataaacttgatgtaaagttaagggacgagacaggtgaacttatccgcaagattacacacatgggcccaggacaagatgaatggacatcacttctctcgggctgccaatgcggatcctcgcgaggattctcgagaagcggccatacattcttggctatgatcttagggtggacgagtacgagtattgtcaaaactgaagatgtttgtggttgttgttctgggcctctggctgctagctgttgagacgaaaaagggaaggagagaaagaaaaagagcagtagtagccatgtttccacagagttagaaaggatccactgattgcaattagtggatcctttcttttttttatcttcactaattgcatcgaaagtaaactattaaaatcacaaaagcgaaattattgggttcacgcatcaataattgcatacacacattcttctagcaaattgcactttggatcatgttttattttattgttaaagttctactttggatcatcatatacctaatttttgtttagtttggatcatcatatacctataacctaatatttacacttaattagctaactttttgttacataatggaacaccctaactctcttcactagccatatctagcatcttctttgataaaaatatgaaatgtgtataggtagggtagttcaccagatgctcgggtagttgaagtgctgatgatgtgatttggggtgatctattgtaggggatcctaatgggtgtgcgcgtgctggctgcttaactagtgcaaccacgcgacccctctccctggccccgtgcgcgattagcgcaacacatccacgctaattatggttattaacattaattaccacaattagcattattttttaaaaaatacataaataatttaaaatttgagttaaaatttttgaattttgatattaaagttctcaactagatatgaaaattttaaattttgagttgaagttttgaattttgatatgaaagttttcaattttgagatgaaaatttttaattgtgagttcaaagtttttgaaatttaaattgaaagtttttaaattgagttgaaagttttcaattttgagttaaaagttttaaagttgggatataaaaattttaaattttgaatagagtttatgaaatctattatattattaaaacagccttgaaaggaggcaccatgttcgctgtgggggctagaaattcccacattaatcggagaaaaagaaaaaaaaagaaaaagagagtccaagtagaaatacaatctaaaaatatctgaaattcggaattaaaataagcaataatgaaataagtttccatataagaacccagtacgagattaatcaaaattcaaaataaaaataaaataaaatccaaaattagaaaaaaaaaggagaatccaaatagaaatacaatctaaaaatagctgaaattcggaattaaaaataaccaatattgaaaaaagtttccatataagaacccaatacgagattaatcaaaatttgaaataaaaataaaataaaatccaaaattaaaaaagaaaaggatagtccaagtaggaatacaattttaaaatagctaaaatttggaattaaaaataaggaatattaaaagaagagtccatataagaacccaacacgagattaattaaaattaggaataaaaataaaaataaatccaaaattagaaaaaaaaataaaagaagagttcaagtaggaatacaatttaaaattagctaaaattcggaattaaaaataagcaatattgaaagaagaatccatataagaacccaatacaagattaattaaaattcagaataaaaaaataaaataatatccaaaattagaaaaattaaaagagagttcaagtaggaatacaattttgaaacaactgaaattaaaaataaaaaaattaaaagaacacaatacgatattaattaaaatttgaaaaaaaataaattctgaaattaaaaaaataaaaataagatttcaattaggaatacaatttataaataacaaaaatttgggataaaaataaagactattgaaagaaaagaccgtctaaaacacatgacgagataaattaagcaacatgcctataaaacagtagagtggtggcagttgatacgtcatataaaattcataataaaacaccaaatagatcctaatgacgattaaaaggagggacggccagcagaccatgaagcaaacgagtaaagcggttgccaggacttctagaaagtaaaaaaaaacccattgattatcatattcgatttttaaaatctcaatgcctataaaaaggagaagcagcgagcggggtgtataggagtatagttgcagagccaccaacggttgacgagacttctagaaaataaaaaataaattccaacgataattatgtttgatttttagaatcacaatgacaataaagagtaggcggcggacatgccgtagagtagcatagtggcatcattttacggaatttctaaaaagtaaaaaaaaacaatgtgttcgattttaaaatctcaatgacaataaagaaggaaggcaacgggcgagccatagagaagtacaatatcaaagccgctgacggtttggcgggacttctagaaagtaaaaatgaacccaaacgataattatgttcagtttttaaaatgtcaatgataataaagagaagagacagtggacgggccgtagatagtggacgggccgtagaggagtataatggcaacgtttaacgggacatctagaaattataaaaacgaaacccaacgtgacaataaactctaaaaactataagatctaatttttaaaggttccaaggagaatgaatagaaatagtgatagatcgtgcaagcaaataaaggaggagatgtcataaggggtagcaactggtgtgacttttaaaaactatataattagaaacacggggatgataaggtttggtctttcaaagttttaagacaatgagatagctatttaataattttaaagtaaaatcatacttaaaaaaatatatgattttgtttgggtgctagccgcacaattgcgcgggccaagaaaaaaaaagaaaaggagagtccaagtagaaatacaatttaaaaatagctgaaattcggaattaaaatcttacccattagattatagtgggtccgaattataatggtatagattgattgatattattgtatacaagatacaattatatctacataaattgaagttaagagttgtatgtctattaaaactaaaagttgtataaatccaaatacacttctacgtataaggttcctataaaaataaaatttttcagaggcatgcagccttgcggaattgaaatcaaacatgatataggatatatacgtatgtaacggactcaatatgaattattgtctgatttctgttagccaaaagaagttccgtatgaattagattatacatatgtacttctataaatcaattacgtatcacaacaatattcaagctttgatatggacggaaacagatcaacaaatattagggggacgaaagctgcagcagcaggttaagcaacgttaaaaaaagatttccataaaaaaaggaaaaaaaagatttctgtatggaaaaaaaaacaagcgctaaaaattttaggaattgctaactagcagcctccgataaaaaaaagtgcgaaaaacgggtttccgccttccgtaaaaaaaaggaaaaaaaatagtgcgaacaaaatgtccgattctaaacaaaaaaatcccatcctccgtgccccccaaaaaaacaagcgcgaaatttttttttctatccgattaaaaaaagtgtgttcccgttttccttaaaaaggaaaaaaagtagtgagaaaaaaagatttatgtccgattcttaaaaaaaatagtacgtataaaccggtcctcccgaaaaacctccgtgcccgaaaaacaaacaagcgcgaacaaaggttcccgttttccttaaaaaaagaaaaaaaatagtgagaaaaattgttaattgaagaaaaagttttcgtgaaacgttcaaaaaaaaatctgattccataaaaaccgatgcttttccaaaaattcctccaaaaaaaagaggttgataggaaaaaacaaagagtccaataaaaaatccaatacgagattagtaaaagttaggaataaaaaaataaaaaaaatcaaaattaggaaaaaaagaaaagacaagaagagttaagtagaatacaatttaaaattaaatataatcagtattgaaataagagtacatatcagaacccaatagtagatgaattaaatttggaataaaaaataaaataaaatctaaaatcaggcaaatgaaaaagagagttaaagtaggaatacaattttgaaacagcttatgaaaataaaaaataaaaataacaaaagaacacaataagaaaaataaaataaattctgaaattggtgataaaaaagtaaagaccattgaaagaaaataccatctaaaacacataacgagattaattaagtaacaggcctatataggaaccactctaataggaacagagtggtggcggttgatgggacatctaaaaactattaataaatcaccaaataaaatcctaatgatgattaaaaggaaggacgacgggcatgtcgtgaagtaatcggtcaaggcggttggcgagacttctagaaagttaaaaaataaaccccaatgaaaatcatattttattttttaaaatctcaattacaaaaaaaaaatgagaggcagcggacgggtcatataggagtacaatggcagagccgctgatggctggtgggtcttctagaaagtaaaaaaatgaattccaatgatagctatgctcgattttacaatcccaatgagaataaagagtatgcggcggacgggtcgtagaggagtatagtggcaccgtttgacgggatttctataaattataagaaaaaatgaaacccaacgagacaataaactctaaaaagtataaggtctaatttttaaaggtttgggcttctaaaaagtaaaaaaataaaccccaatgataatcatgtttgattttaaaatctcaatgacaataaagaagggcggcagcgggcgagccacagaggagtatagtgacaaagttgctgacgttttggtggaattctagaagtaaaaaaataaacctaaacgataattatgttcgatttttaaaataatactccctccatcccattttaaatgcagccatagttttccgcacctaattttgaccgtctatcttatttgacattttttaaaaaaaaaataaaaacattagtcacgagtaaagtactattcatgttttatcatctcataacaacaaaaatactaattataaaaaattcaaataagacggacgatcaaagttgggcgcgaaaacttatggttgcaattaaaatgggacggagggagtaatgataataaagagaagatgcagtggacggtcatagaggagtataatggaagcgtttgacgggacttctaaaaattacaaaattataaaattataaacacgagaatgataaggtttgttcttttaaaatcttaagacaacgagataactatttaagaaattttaagtaaaatcatgttaaaaaaatataattttatatgggtgctagccacgcaattgcgcgggccacacagctagttttaattgaaaaccttaaattatatttgaaaagtaaaaaaagcaactcaacgtgatatggctaattacccgaagaaaggaaaaaaaatcagactaatgatgttactaatctgcatctaattacgtgataatcactttttccctcgttttcctgtttctgacaacaccgctgttcgttccgctagcgacacatgcacttgtgtgccacgtgtatgcgctgaggtaaagttgcctagttcaaaataaaaagattgagtaaagaggaatctaaaataaaactttgacaataaaatagaagtgaaattgagtctgtctcttttcttttttaagcctcttttatctgcgcgagcaggcgattaaaaatgaagccaagatggtcacgtctacgagcacgcgggtcagaaaacggaagtgaggcggaaagtaaaagccgtctctttcccttcccctgacgccatctcccctattcgctacagcgatgtcgtgtcattttctgcaagtcaatcgacaagaggattatcgaagtacagatacagaagcaggcgctgctgctagaagcgaaggatataacaagcggcggccggagacgacgacggagaaatccggaagaagaggaactgccggcgctgagctgcaatcgcgcccaagaatccatctcctccggcggcaggtatggtgatttcgtcttcctcgaactcctccgtttctttttcctttttttttaaaaaaaaatcatccatttctcccctgatggagtggagtggagagctccgtttctcgtcttctcggtggatttggtcattcgggtagtgctaccgtttcttgatttatcctgcggaaatcgtgctcttccgcattgatcttataggctggtgggaggcgccgagccgcccatttgagttgaggggttgaccaatctgaggaatattctgacggcgttatataattcggacaatcgatgcacaactggggcccaaaaacaaaaaaatgttcctttcttaaacagttggttcagaatgggatttttttttctttttggtaatttttattttttgttccttcccgattaccgtgaacagtttttacaagcaatctacatgtctggtcatgaacttaacatctctaaaatatttactctattatatatatcatacactgttcaactgaattgagattgcttttttttttcttttttgtagttttatttgtttgttcccttccaagtaccatgaacaatcttgcaaattacaatccatttacatgtttggccacggcttgaaatgttaatccagtatatggagaatcatatacggctgaactgacttaaaacactgtagtgtttgacaatataaatcacactgttgaactttgttttagacttaagatactatatagtatttaacagtaacagtatgttgtactatgtatcatatatgcactgctgaactatcttaagagactgtaggtttaacagtaaaagattgccacctgtaatttcctgaaggatataagcagttaggaacatctttttttcgccgggccggcaaagaacaccggccacagttaggaacatctttgttgctgtatattcgtaatgcacccctatattcccttcttgttctgttcttattgctgttttatttgcatgtacagcttacagggtcgctgctccatctccttgaattgtactagctgtcttgtgcttaagatttgcgctcggcttcatttttggattcaagctgctgggtgtggatttttatgatgggctgtctaccaacaaagcaagtgggtcgttcaacacattccttgaatccacgggaagctgtggctcttgcggctgaaacatcttgtgagaacgtcgatctaccagatttcgttaatattgccactggaacaccctgtgagaattgaaatccatctttccataagaaagaaaaaggatttagtttgtttttggatatttttatgattctgtcttaaaatgtgtggattagcttttcttatgttagtcgttcaaaatcaaacaaaatgacaatgcactgcatatatgatgtgtattatcctgagtagaatggaactttgaaccaataacttcttttctaccacagtaccagtaacccaatggatgccagggtaggccaatttcatctaaaaaagcatgttatacattatcatggattgcgtatagttctgtaatgttacctgaaatacatatatttttccgggttttacaacaagtttcttaacatttttctattattgcagttactgtgaatgaagttgaggcattatacgatctcttcaggaaattaagtaattcaataattaaagatggtctgattcacaaggtaataagtgcttccgcataattttgattggtacaagtttttaagatatttggcatgcagcttattttgtttttcttatccaggaagaattccatcttgctctctttaggaacaagaagacaaatctcttcgttgatagggtaagacttaagagtgttaatatgttccaaattgtcattgtataggttttcttgatgattcctctgttcttcagtgctaacagtttatattaaaaataataatatttattctccatattctttttgaattaatatgtccaaatgatgtttgcagtccacattctttctacttcacaatagtatgcaagagaactgcatatcattatataaatcgtagaaaagattcccactttacattcttgtgctcattgtttttagtcatccaccatcaacactcatatgttatccttcctaaaggtgaatccatataagtggcctgaagcagtgtaatttctctcttgcgcattagagcaacatttaaaaactaacaaatagaatagattttacatgacaggcttccggtttaaaaaagggtaattttgaatgtattggcattcagtattatcagtaaatatttatgtgtttgaaaataatcgcaggtctttgatttgtttgatcaaaaaggaaatggtgtcatcgaatttgatgaatttgttcgatctcttagtgtgtttcatccagatgcacctgaggaacagaaagctggatgtaaggactcttcagtcaattgtttattcttaccaaaaacatgtcgggcataagaatatagatgtttagatttgaacatttgctttcactaattaatgttataacttcttattgcagttgcatttaagttatatgacctaagacagacagggtttattgaaaggcatgaggtaagtgttacttttctcttcttttagttccagaaaattgatttgagcaccgtttgatatactttttaatgctcagtagcacttttttttactgaatcacagtcagatatctatattgtcaggtatagatattacctagaaaattatcatcttagtgaaacaaattaacagattgggcagctacataacatgtttgtaattgcatgagagaagttatgcttgtttgtatttctaagagttgttgtgtaaactttggttctattttggtatttaatcatttctcccctcgtctatagcaatgaaatcatgctaactctgctgattttattttctctttgctattctttatttttttttgtagttaaaggagatggtgttggctcttctggatgaatcagatttgaatattacaagtgatgctgtcgagatgattgttgatagggtatgggtcctaactccctagaacaccaagtaaatatgtccttctgtattgttctaagtctttttaaaaacaaaaaaaaaacaaaaacagacatttgaccaggctgacacaaaaggcgatgagagaatagaccaggaggagtggaatgagtttgtcaaaaataatccatatgtgctgaggaatatgaccctcccatacctcaagtaagtgctatgcacaaatttactaccaccatgaatagagttgctctgctatgtagaatgtttttacttggagtcacactagcaattatactcaacaatatttcttagaacttgcactcgtcagtgccaaaacgtagaatcagacgcttgtcaatgatagcgattgggggaaaaaaaggatgataatgggcttcacaatcacaattgactatagtcatgtttttgtcatatgtattgcgcattaactaattattattggttggtgatattctttagggacctcaccatggtattcccaagttttgtgattcactcagaagtcagcgaagcagacatggttgcctaacctgaaacctggtgttgctacttgctagattgcaagtttgcaacacttctagcatgtaatgtttgttccttgcgtgcattgttgactagggaaacagccatataggagatgagttgatgcctcaaaatgtagcatcactgaccagcagatgctcactgttgagattatgggcatataatgatttaatttattccataaataaatcatgacattacagatgaaaactagcatgaacgcatcattagatctacacatgtaaactacgcagaataacatgaacagatcaaatatgcgcaacatattgaacacgtaccgaggtgacgaaaagaccggctgcttggtcgaaacttttcgcatgtgtctacgaaggcacgaaacacgcgagcgaagaggaaggcgagccgtcgcgaacgaacagggagcagtcgcgcgaagcgcttcccaaaaaccttattgccgccttctcccggtgcaggacgtcaaaggcagaggttccggagacctgctctcccgatcgctggtgcacgccggcgagcgggattgagtactctacgagcgacggcgcagtacagagtaggaggcaaaccctagattgattttgcgtatatactgcgtgaagacggcgggtcggtttatatagagaagggtcgcttgatcagggcgcccgcacgatctctactgcgcgtaaccgaaccggataagtcgcgcgtaacttatccggactccacgccgtttgcacgcaccggatttttcggaacgtttccaaaacaaaacgaatccgaatttgcagcaaaacaaaactgcaaaaggaggctgcatctgcgcaagggtgaggagccaatttttcggaccattcgacgcgtacgtcgtgcacgcgcgctgcctgccctgcagggcaggccaggccaggccaggcgaggcgagcgagcgcgcgtgtgtttcccctcttctctccaccacacatgcttcaagcgactaggagggcatcatcccttttaaggaggtccccctctcatagaataagca
